United States Patent 8,067,671 (METHODS FOR GENETIC CONTROL OF PLANT PEST INFESTATION AND COMPOSITIONS THEREOF) - sequence listing, part 44

SEQ ID NO: 92419 - DNA, 649 bp, Heterodera glycines
  SCN-specific regions: Sequence locations=1-347,369-649
gtcaagttggacccgaccagaccatttctgctgtccagcccatcgaatggaatcgaaacggaaagggagggcggagtgtctaaaaacccgggcgacccggcgtacggcgacgtgcacttttactcggagtcggtcaatctttggaagccgtccaatttccccgtgccgcgctgctcctccgaattcggtgttcagtcaatgcctttgcgtgggacaatggcacgttggattggtccgtccgattggaattacaaaagcggcactttggtcagtcggcaacatcaccccggcggcgttttgaatttgccggcaatcgtttcgcaacatttcaatctcctctcctccaacttttcttctctctctttgtccgccccttttttcatcgacaaattcgcttttctctcccaaattcatcaggcaattgcacttcaagcgcaaattgagcattaccgaaggttccgttcccatttggacgaggccgggcttggccacacaatgtgcgcgatgtattggcaattgaacgatgtttgggcagcgcccacttggtcaaccgttgactttgacttgcgttggaaagttggccaccatttcgtgcgccgttcgttctctccgctaatcgtttcaatgtttttggactcaaatggcattt

SEQ ID NO: 92420 - DNA, 644 bp, Heterodera glycines
  SCN-specific regions: Sequence locations=1-8,62-133,155-214,237 -264,289-527,550-644
attctctcatataaaataaaaatgaaaaaaatattatgttcaaatttattaatattaaaaagcttaaaaactaatttggatatgaaaaaaaaaacaaaataattatttacagggttgagggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggggtaatctacctaccctgaaagtttcattcggaagtcccatggtcacttgggtacctctcctttgtaagggcaaaaaacttcgcgtcgtttatgacgcgagtgctcacacaaggggtacaaacagtttgaatgactgtttgtacagaggtccggtacttttacctgatctcatcggaatgcttttgcgattccgatgccccacatttcctcttctcgcggatatccaagctgctttcttgcagatttctttggaaccagaagatagagaagtcacaaagtttttgtggctcaaagacacggaaaagccactttcatcggagaatctgataatatacagattctgc

SEQ ID NO: 92421 - DNA, 625 bp, Heterodera glycines
  SCN-specific regions: Sequence locations=1-330,353-487,581-625
ttcaagaataattttccgtaaatttaccaattatttaccttcaaaaacaaaaataattttcaataaattttcaaattttttaccattttcttctttaaaatttccaaaattttcttccttggttttttgaaatgctaaattctagtcaattcgagacgaaatttccaaaaaacaaatttgactccccaaaattttacgatttcctctgttttccattttacgaattctcctcccccctgtacatttaacttaccatcgccatggttgcccttcatgtgcatgttgttcatcgtcgccgtgtccgtctcctgctgcaacaccaccacctcaacattgtgctgctctccatactgcggttgccattgttctccagctactgcttccttttctcggcatttccaactgccaatgctttcgttgttattattgttgtgttgctatgataatgattatgatggcgattgttgtaagaatggccatcaccaaactgttgctgcttttcctgctggtactgcttcggcagctgttcatgatgattttggtgctccaccgctgtttctgttcctgcttcaacttctgcgaatgttcgccattgtttattgtggcccttttcaatgcccaaccg

SEQ ID NO: 92422 - DNA, 630 bp, Heterodera glycines
  SCN-specific regions: Sequence locations=1-630
cacagctgtccgatctgttccatgcccgagtcatcgccctgtccgtcgccaatttcaagctaaaaagcgtgcgattaaaatcattagcgcatttggaacttccccccttttttcccctcttttgtccccacttttgtgccgtccccgccggccatcccctgctgttgctgatggaccgaaatggaggcacgtcgtgcactgacgccgccctgctttttgaactctttgcggtagtaataggcggttactgcgggcggaatgttgaatttacgggccgcggcggtggcgccatggcattggacgtaactggcgacagtctgaggagggagagaatatagggagggaacaaagccaacacactgcacaaccccctaccattaaacccatctgttcaaaaatgccaaaaaaatctccaaaatttgaaatcgcccgagaatggcacagacgggcaaaagcccccgggcgatatgcctcatacgttcggccacacctttttctcctccggcgtgcagtatttagagcgtcggccccgcggtgccgattccgcgccgcttccgctcatgtcggcaccgccggcggagaacagactctgctgttgctgagtgccgggcgtcgcgaaagacgacgcgg

SEQ ID NO: 92423 - DNA, 475 bp, Heterodera glycines
  SCN-specific regions: Sequence locations=1-475
caacgacggaaagcattgaatggacggaacagagggagcagcttctgggcaatttgctcgccgaattgttgaccttttctgactgcgaatttcggctcagagaatgcgcttttggcgaatttggaaggccaaaagaaaaatcggaacgcaatttaattttgaccactttggccacttcgctgctttgtgagcaaagagcgtctgaggaatttgttcgttttactcttttcctttcaaactgtgcttttcttttctccctttttcggtttgtgggcccatcgcttttttggatcgcgaagttcattctgtgctgaatgggacggacggtggcaaagggacggagacgcaattcggcgccatgggcggtggaatgcacgcccaatttaatgatccctccgaacgaaggcttttcctcgagactctttttgtccaaacggtcatggactgttctgcttatgcgggtgcagcatccccg

SEQ ID NO: 92424 - DNA, 534 bp, Heterodera glycines
  SCN-specific regions: Sequence locations=1-534
gtttgagtaaatgtttttcgtttacctccgtttagtctccgcttatgttttctcatcagtgtgtcctaaaggcatctctcttttctcgacgacaatttatacgattctcaaactctgaggcgttcgacgcgtttatttcgtcatttccatgccttacctccctctggtgttccagttaatggcctcggtggcgcgacgcccagtggcttggaaatggccaaacgactcgcgcgccacgtttggcctaagggacagtggcgcgtgaagggccgtgtacttttcgccttttccttgctcatcgctgctaagcttctgaatgcgaccgttccgttcgtccttcgcgacatcgttgacttttttaatgggaaactcccggcggagctgtcgctcggattcgcattgcctggcgaagccattctgtcggcgggaattgctctgataattgcctatggcgccgcgaggggcggcacttcgctcttcaacgaacttcgaaacgctgtttttgcgcgtgtcgcccagcggtccatcccgcga

SEQ ID NO: 92425 - DNA, 619 bp, Heterodera glycines
  SCN-specific regions: Sequence locations=1-111,133-403,449-462,485 -486,558-619
tctctttcaacattttaccaacttctgaccacgaccctttgccaagtctctttttttgatataaaagttcaattggctttttgtcttcaaaattgatcagtgccatcggtttcattttctctatttctgatcgtccgcattggcaccattttttgctcaatctttcaccactttttggcaattcatttttttgagatgacaattttcggcttaattcgccaacttctttatgaattaatgaactttagagtaaaaaaaagaagctaaatttaacttggcacagaaccgtttaattggcgcggtgtggcgattctttttaatggtgaggcaaaagcattaccattctctaaaaataaacaaaatttatgaatggaacaatttatttatacctctaaattcagcgaaaattatttttaaataaaagtataaaaaaagaattaataaaattcgctgtcctttgccataatttatttgttgaatcattcgaaaaattatattataaaaaatttaaaactatattaatgaaactaaaatttattcataaaaaatgtaaaaatgaaaatcatttggtattatagcatataaaacaatttataaacgttaaattaaacaggaaaaa

SEQ ID NO: 92426 - DNA, 336 bp, Heterodera glycines
  SCN-specific regions: Sequence locations=1-23,46-336
cacagaaatttacggaaacgcttggaaaataaaaattggtagtttgagttggtccgtgtacgggcgaccgcctcacacactgagtgatattgcccctcattagatttcgacaacttaagcctcacacccgagcttaatcggtctttggttggtgttgtttcatgccgccaccaaactttctcaatcttctcaatccccctccagtgccggcaaccactcggcctatctgtccgcgtgtgggaatcaacgtaagcctcccaatccctcctcagcccctgcccggtgttggcagataaagaaagccatgcacccggcctatcaatccacagtggtggg

SEQ ID NO: 92427 - DNA, 650 bp, Heterodera glycines
  SCN-specific regions: Sequence locations=1-1,453-650
agtcccctctctctctttctttctctccttctcccctctctctccttctcccctctctctctctctctttctctccttctcccctctctcccctctctctccttctcccctctctctctctttcctctctctcgttccctcctatctctccttcttccctctctctctctctttctctccttctcccttctctctccttctcccttctctctctctctctttcctctctctcgttccctcctatctctccttcttccctctctctctctctttctctccttctcccttctctctccttctcccttctctctctctctcttcactctctctcgctctttctctccttctcccttctctctccttctcccctctctctctctctctttcctctctctcggtccctatctctccttcttccctctctctctttcctctcctgtctcactttctctatcacatgctcgctcactctctgattatctcacactgactgattcagtttctctccctttcattaaaatatttgcgatacgaaaagggcaaattcaagaccactaaatgtctcagaatttttgacaaagtaataaagactgccgattttttaaacacacccgaaagtgtggaccggtgccaaaacatataattcgaga

SEQ ID NO: 92428 - DNA, 646 bp, Heterodera glycines
  SCN-specific regions: Sequence locations=1-646
gtttgagaatggtaacggtgacacggcgaaaatcatttgcgtgctcatccattgacattgacaacgtaattggacgactgacaaatccaacggtccaagcgaatgtgcagtggcggcacggcgtcgacgtcagcgaatcggaagtgcgtgcgctgtgcatgctcagccgcgacttgctgttgtcgcagccgacgatgttggaattgagtgcgccactcaaaattgtcggcgatatccacggccaattctcagatttgcttcggctgttccacgcctgcggcttcccgcccaagtccaattatttgtttctcggcgattacgtggacaggggcccccgcagtttggagacgatcattctgttgttgtgctacaaaatcaaataccccgtcaatttctttcttctccgcggaaatcacgaagtcgcctcgctgaatcggatttacgggttttacaacgaatgcaaaaccaggatgaacattcgggtgtggaaggcttttcaagacgttttcaattgtctgccggttgccgcactaatcaacggcaaaatcttttgctgccatggcggcctttcgccacatttaaggacattggagcagctgaaacggatacagcgaccggcggaagtccaagagtctgggttgctctg

SEQ ID NO: 92429 - DNA, 577 bp, Heterodera glycines
  SCN-specific regions: Sequence locations=1-577
cactctgagagtttcgcgattgatatgcggcaaacggatgagcaaatcgtcgattatacgcagccttttaatgcccgtttcccctgtttagttaaagacacggccctaatattgcatttttattagaaatgctcactcatggcggacataaaatctttgtgcattgaaacgggaaaagttggttcggacagctcacgaagaaataatttaagagccccggtgagcacgtgaatgtcctcttcgtggtacaaagagtcataggaatctattaaaagtcaaaatcacgactaattgtaatcaccaccttggtcaatttggcatcggattctttggacggccgacaaatttccgttgacgcggtaaagcccatcggactcaagccctttctgttcaataagccgagtcacttcgcagatgaatttgggaacaaatgctttctcccgtgtgcaaatatccgcgagagtgctgccaaagacgggctccgctaaacaaaaagaaaatggcagaaattaaaaaaacgcaataataaactgtacgtttgtaaattccacgctctcgcagggattccatggaagga

SEQ ID NO: 92430 - DNA, 635 bp, Heterodera glycines
  SCN-specific regions: Sequence locations=1-1,45-74,148-256,331 -407,437-635
gttattttaaaacatatttttatcaagaaatatttttaaaaattgagacgttggtatttctataaatgcatatgtataattgaatattttattaaaaataacttaaaaatgaaatgaataatttaagataaataaactaataaatttctgattatagcaaataaaatgaaagctttaacaattaaaagtctagtcgattatatcactcgacaaaattaagttaatagaattaagcactattcaattgcactttgagaaaattaattttttttaacttataatttttaacaatctttagtcttaaatttaattataattaattaaaaataagagatttattgaaaatacaaaatcaatttaatatgcgatttgccctattgagctattaatatgtgattcctattagctattaattcttataaataaaaaataattagagaattgatgttgaacaatacgatcgttaatgagaattcgttaaaataagttaaggtatgaacttaaatcttcattgggataatcgcccaatgaatcaaaatattcaatttctgtcggcaaaacagcaatccagtgttcaagtatcgtgcccgcccggtcggtattcgccacaaaacagtatggaaaatgcctgttcc

SEQ ID NO: 92431 - DNA, 574 bp, Heterodera glycines
  SCN-specific regions: Sequence locations=1-11,33-145,167-271,295-574
tggacatgtgacggacctgttgctgctggacgtaacgccactgccacttggaattgaaacgcttggtggcgtgctcaccaaactgattacgcgtaatacgaccattcctacgaagaagagccaaggcttctcaacggctgctgacggacagactcaagtggagatcaaaggtttccaaggcgaacgcgacatgggattggacaacaaaatgctggggcatgtttctctcgcaggtattccgcctgcccctcaaggaggtccacaaattgaggtcgcttttgacattgatgccaaaggaattgtgaatgtgtcggcacgagaccgtggaactggctgacaacagcatattattatccaatcgaccgggggactcattatagaccaaatcgaaaacatggtacgtgaggcggttagacccgcagcagccgacgcatgaaagaatgacacgatcgaggtcattaaccatgcggagtcggtgctgcacgacactgagtcaaagatcacggaatacacggaacatctcaatgcagacaaatttattgtggtcaaagagaaacttgaagagttgaagaaa

SEQ ID NO: 92432 - DNA, 321 bp, Heterodera glycines
  SCN-specific regions: Sequence locations=1-87,113-321
atttataagcatttgaagggttctcagcagtttccctgcaaaatttggtgagctttcgatcagtctagaacgttggggatcaaatgcaaaaaataatttaaaaaaaataatactggtgtggtaagtgtgaagaactgtgttcctccaggcaaaaaattctaagaaaatttataagcatttgaagggttctcagcagtttccctgcaaaatttggtgagcttctgatccgtctagaacgttgggtgataaatgaaaaaaataatctaaaaaaaataatactggtgtggtaagtgtgaagaactgtgttcttccaggcaaaaa

SEQ ID NO: 92433 - DNA, 310 bp, Heterodera glycines
  SCN-specific regions: Sequence locations=1-310
tctcggcactccaacaatcgtcgacaatgttaggttcgaccccagattgagcgtcaatttccttcacaaaagcatcgaagagaagcgaaaggatgagattatccatttgctgtgcaccatttccaaccaacagcgggaagaattggcacgcgaattcaaacaattgttcggggaacatgtgtccgccaaactgaagaaggcactctctggcgactttgaggaactgattttgggtttgttggaaccgccagctgttatcgatgagctgcaaaggcaccgcgcgatgtccggcctcggtactctcgaaggg

SEQ ID NO: 92434 - DNA, 633 bp, Heterodera glycines
  SCN-specific regions: Sequence locations=1-280,302-483,505-633
cttagtacagattcaaccttccataccaatgcttcattttcgtctgctctaaggaacccattgaccggcttctacaggccatcgcgttttgatgcgaatgttagcaatttttccaacaaaaatcatccgtttgacgagggccttaatttctttggtaaattgacaagcagtcagtttgacaacaacaacagttatgagccttccttgaacagcaaccgattccgatttcgcgagtttttcgctcgtgagcatgaacaacaggagcaagatcgttttttgaaaaacttggacaattccagaaggaatgactcaattcgttatgatccctattcttcggcgtcgaaaaatcacaggcttaggaaaattctctacaaatccgtggcaaacattgacgatctcagtccccttccaaacaaatatgtcggctttaccatgcacgataaattggctcatctgaaaaaaacaattcgcggattcgacacgaccaatttttcaaataaggagaacagcaactttacgacccccgctgtttcttcgcttggcttccgtaacttggatagcactggttacggcacggctcttgcaaagcgctttagccctcccaacacttcgactcctctggcaactaatcaa

SEQ ID NO: 92435 - DNA, 118 bp, Heterodera glycines
  SCN-specific regions: Sequence locations=1-118
gatgaacgaggtttccggtggccaggcagtggagaaggtcgtagcaaaagtttaccggtggtggccgtgcgcagaagaaagaagcgagcgccagggctggagctgaaggcggtcgtta

SEQ ID NO: 92436 - DNA, 625 bp, Heterodera glycines
  SCN-specific regions: Sequence locations=1-43,133-273,295-591,615-625
gccaatttgaattttttctgaaatttcctagtgaaaaatatggaaaattataaaaaatcaaaatttttaatttatttaaataaaaaaaaaaaatagttttttaaacatatttttttaataatattattatttgctataaaaaagcattaaattcaaaaattttcctcgatttttaatgtcaatttaaatatatccaattttaagaatttttggtctgatttcacttattcaaatttagcataaaaaaatcagctcatacaaagcctatcaaccgaaaatgaaaatgagtgcaatttcacaaattcaccaagcacaaaatgtcataattgcacgttattttctggccaaatttctctccaccgaagcggagcattggcacaatattagcaaagtccattaattgcttttgcatggtgccgctaggcgccgtcgaatttttctttttgaaaatgtagtcgaaatttatgttgctaagtggtttcgtaaaaatcactaattagggtgtttaccaaataattaccataacttttgctcaaaattaacaaaatttaatacttttgataccgtttgacagctgataatgcctgctaaaaattttcaacaactatacaaatttttgtatttg

SEQ ID NO: 92437 - DNA, 641 bp, Heterodera glycines
  SCN-specific regions: Sequence locations=1-641
caatatttgaggagaaagtggcagggcgacccgaacattctgatcgaccgcttcgatgtccgtggttatctcgacaccatttccgagacagcgcccaatgctttggccaagaaaaacattccaaaggatgatgtcatcgaattgcaatgcgattacgaacgctaccgaattctggtatttaacgagtttcgaaaagtcagcgaaaagcaatttctgaacgaaattgccgccaaagagttttggcccgcccaacaacaagccaatcaatcggcgaacgccgcctataggagggaaattgagaagaagagaaaattggcttctaaacgcgcagcaattgcatttaattacgccgactcgacggaaacggcagcgaccggacagtcgaatgcgacgagagaaaataactgcacgtcatcgagcagttcggatgaggaggactttgatgaaatggaagaaattgacagtgtcctcgacaccaacgctttgagtgctgaacaggcggcgaccctcaacaaaattggagcccatttcaacatcacttctggggcttttctgcaacttttgtcgcttgaccgcaaagaacaaacctcgaccgcccaaattagagaaattgacaaagccaaactcgctctctcaggtcg

SEQ ID NO: 92438 - DNA, 649 bp, Heterodera glycines
  SCN-specific regions: Sequence locations=1-25,47-486,508-534,556-649
gtttgattcaacgatggtccacaaacccttttctctttgcctttcagtctttttcatttcggcgttcttttttgtgtattcagctgatgaatcgattaaaccaccgacaagaaatgttctaatcacagcggaagaagagaaacaaagagatgttgaaggtttcttggcaatcaaagccatccatgccgttctcgacgatgacaattcgggctcaattgatcggtttgaatctgccgatttcttgaaagaagatctcaaatttggcggttcggacaaaataaggcgagaaaatgcatttcacagtaacgacgaggcgataactgtggacgatttgtgggagaattggttccaatccgaggaacgcggatggaccaacaaacaagtggtcgaatggttgaccaaccaagtcaaactgccgcaatatgccaacggttttttgagtgctgaagtgactggcctggaccttccgaaaatggcagtgcaaaattcttcgtttctttccacaaaaattggcataaagaattacgtgcatcgtcagaaacttcagctaaaggctctcgacttggttttgtttggcttccaagacacttcttcgattgccaaagacattgccttggccggtctgctgggactgctcgttgccgttttg

SEQ ID NO: 92439 - DNA, 583 bp, Heterodera glycines
  SCN-specific regions: Sequence locations=1-47,69-275,298-583
acggaaggcagcgtgggggaggagtaggagatattctaaggttattatggagaacaattctaccaaaattaaaatccgctggcacggtattgggtagagaagcactagacaccggaacacgtgtattggacactatagagaaatctgaagcaccaaataaacaatcaaaatcgccgaagtgaagaagggagtggataatattctcgaaaagggaggagttgtcgtcaattcggaacgggaagacgaagaaagagtattaaaaggaacgcgataattggaaaaactgtacctaagacagtgataaacaagagaaaaagatcggacgtatttggaaaactattttaaaatggtctttaagaaaatagacaaagagtcggtaaactctataacttcagctttatcaatattcagccttccaccaactaatgtgtctgtgagtagttcttcagtgcgcgaatatttaccccttaacggacattcctttccactttaaaattcaccctagctccagtttcatagacctaaacaaatgttacatcttaaccgaaatgtccattaaaaggttcgacacctacaccaataa

SEQ ID NO: 92440 - DNA, 654 bp, Heterodera glycines
  SCN-specific regions: Sequence locations=1-35,57-107,129-213,235 -241,263-341,368-430,535-555
ctctctctcaatgcttttctcgccgtctgtttttacctgtggctgctgtactctgcccgttttccattttgtcctcttgctcatacacactttctccattatttcaagcgtgtgaaattgatgatgaagcgaatgggctggggagggtaaagcccaaaagtgtaagccaatctgcgtgaaattgagcctgtggattaagtgtaccacctacctacaataacaaagaaaaacaaatatctttttcaaaaagccaaataccaaagccattttgaattgaaaactggcatttctgttccgacaattccgtttcaaccaattcaacctttgacctgttgaaaagctaattaaaattatattttttaaatatgaagaagaagaagccaacaaattagaaaattcactttcttctcgttctatcatgtttcttttactctctctctctctcttccccctctctctctccctctctctttctcttcctcgttgtctctccctcactctagcttcctctctctctctctctcttcctctttcattaacctatatatccttctgctttttcttcctctctctgttcctctctctgaatcattctcttccattgccctctttccctttgcttcctcttcttctctctctctgttccctcctctc

SEQ ID NO: 92441 - DNA, 557 bp, Heterodera glycines
  SCN-specific regions: Sequence locations=1-557
ccaaggtgtcaatttcatggacaacgaccgcaccaaaaatggcaccgcaaaaagcaaatggaacggacatggcgaaaccacggggatatgtacaacagcagcagcccaaacaagccgaacgtgacgaacagaagcccagcatttgttcgatgtgccaatcggccgacccgagcccggcgcaccgggcttctctgctcgtccaatgttccgcttgtcaacaccaaatgcattcctcgtgcattgacatgccgttgaacatggtcgaagtgatccgcaaatacgattggctgtgcattgaatgcaaacggtgctcagtgtgtgagcagcccgaccaggaggcggcgatgatgtgctgcgacgcgtgcgaccgcggctaccacaccttttgcatcggccttgaaatgccgccgaatgggacttggcactgtcccaagtgcaaaggttgctgatactgctcactcactgtccaccgcccgttcggccgaccttccgtcgctgcttaattaatgtttataaggcctcactgaattccttcctgtccctttttttgcgttcat

SEQ ID NO: 92442 - DNA, 628 bp, Heterodera glycines
  SCN-specific regions: Sequence locations=1-66,88-98,120-628
gtcgtattttttgaaaaaaaaaattttcaaacaaccaattattgatcctaatgaacaaaaagaccgtgttttcttaattttaatgctgattaggctatcagagtttgaaaaaattcaaatttgagtccgattttggacataggcgcaaatgtcggggctccctacagatgaccttttttgcttttgaaaccactttttggagtgccttcttttcaaaaaaaacttttggggaagagcatgggtccggtgaagcatttgatggaagctgagcagaaaatgtgccgaattcgcaaccacggactccgatcactgaatcattttacgaccaatgcaattcgttcgaatcaatttttgcacgtaaattcaatttggttgactgttcctacaaagattcggtcagcgaattcacaaaaaaaaaaaaaaaatttgaatttaagaccgatccgccaaatgctcctcgggcagcgaattttgaaataaatcacttgggacccctcattagcaagtcaccaccatacgtcgccatggatttgatatttgttttcgaaattgtcaaaacctttccatcctttgaacagctcatcatcaatgataaggtaccattttactcggagcacatgcaaaataa

SEQ ID NO: 92443 - DNA, 522 bp, Heterodera glycines
  SCN-specific regions: Sequence locations=1-433,455-522
gctcatacagatgcttaaaacatttcttctccttttttcacatgatcacacaatcaatgtttttacctggcaatagtgcatgagatgggtagcacatcgtatccccctgttatatcacgcatcaatatttttctgaactgcacaatcgccttcagaagaatctccgtatcattttggcaatatgattgaagctcgtccggcaaatagaagggtgttgttgttttattttcctcatacctatgggaaatggggaacccccaccactgaaataaccctttagttttgcttaccaactgacaaatttatcgtatttttctcgtttcattgagccagcacagtagtcttctattggcggtaaatgcggaagcctcacgtcatagttttcccttaaaagcattattttttttgacaaatgtcacagctttcggaaaaaccttcggttgaaagcatagggaaaaaaaggtttctctgcacagtccaaattgaaagtttttggcagttgatcgagacgaacaggcatca

SEQ ID NO: 92444 - DNA, 591 bp, Heterodera glycines
  misc_feature (568)..(568): n is a, c, g, or t
  SCN-specific regions: Sequence locations=1-417,439-499,521-591
ccggccccctggtccccaaatcaccaacatttttgcctacggtatcagttcggtgccgactgtttcggcgccgccaactttgaaatgccacaacatttttctttgccagttcacgtagcaaatctgggcaccatttgatagcacaatttgtgctatttgtaaaaaaaaagttatggcatgtagcgctgaaaaagctatgaaaaagtcaattttttcaccatattttttttgtaaattgatgaaattttttgaaatttagcttactaattgtgaaccttaataactatcgcatcatatcaaaaatttaatttggtttataatgaaaaaagtcattaccaactgcgccgaactgggcgtttcccttccatccaccggtctttctattcctcagtttttttattaagctctccaacctcttcattttttcctcattttcccctcattttcccctcaaaaattgacccccccccccataaattgttttctgatgcccattgatcacaatggcaaataaattaatgcgcattgcttttgctttcactccaaattcaatggatgaatagtgcgngaattatctattatattattctc

SEQ ID NO: 92445 - DNA, 652 bp, Heterodera glycines
  SCN-specific regions: Sequence locations=1-274,297-413,436-652
taagccccttaacttttgtcatcgtcaccagtccaattaaaatctcgtccttatgcctgcttcgcactcgaacaaagaaggggctcacaatcagtcatccgaaggcgcacggcgccatttgcaacttccgtcgcctccacccgatgattttcaggttagtcgtcgggctgtgcttttgtcatcggacgaagaggacgaagacagcgacgaatctccgtcaaagccgtccagttcagcagcagcaccaagggagaaccgtggcagggcaattttattgtccgaggaggaggaagagccgcagggggaggagacggaatggttggggaagaagagtgccgccagtgctggcccatcaaatacggaaaggaaacgcgaaaaaaagaagcccgaagcccatgggatgctgaagtcgttgaagctgaaggcgaagaagttgagggagaagcagaagaaacggcggagaaaggatcggatgcgaagtgacgaagaggagggcgaggcgatggactcggacgggtccaacgacggagacgtcgatatgcgcgcagacagttacgacagtgaggacagcgatgcgaacgaacaaatttccgcccgtcaattgaaattgatgcgcgaattggagcagaaatgtgtggaatttctgaatgag

SEQ ID NO: 92446 - DNA, 635 bp, Heterodera glycines
  misc_feature (513)..(513): n is a, c, g, or t
  SCN-specific regions: Sequence locations=1-315,337-635
gtttatctgaagactttggcggtgatgagtcagcagcaatttgcggagagaaaagtgatgccgaagagggaatatcagaaggaacttactatggttccctcatggatgatttccactagcacgacgacaacagctgcggcgtcctcttcgaccagcgccgccagtggccaatcgtcgcccggccccgactcgcatctgccgcccttccaccaacatggcgacgtcggcttttgcgagttgccattggaggtcgaaggcaccagtaaattgggcagcgcactgctcaaacacaccgccacccgctcgtacagctccaacccacgggaattcttcaaatttggccgtaagccaaccattgccaagtcgcgcggcggaatcgaacagcaacagacggacgcggtcacaggcggtgccgtcggtgcgagcgtaggcgactccgcggcgggtccgtctggcagcagcggcggtgtttcacagttgcgctaccgcaagtcaggcggaagcggcatgggnagcggggcggtctggcgccgtttcaaaggacgcggagagcaggcgcaaatcgctgggcgcggccgccgcagccaatgctgtcgctgcgggcacaattctgcacagggacagccccgtgggca

SEQ ID NO: 92447 - DNA, 626 bp, Heterodera glycines
  misc_feature (561)..(561): n is a, c, g, or t
  SCN-specific regions: Sequence locations=1-626
actgggactcaacccaccaacattccaatcaacgggactcaaaccaccagcatttcaatcgccaacacttcaacgggactcaatccaccagcatttcaatcgccaacacttcaacgggactcaatccaccagcatttcaatcactgggactcaacccaccaacattccaattactgggactcaattctcctgcattccaatcactgggactcaattctcctgcatttctatcactgggactcaacccaccaacattccaatcaacgggactcaatccaccagcatttcaatcgccaacacttcaacgggactcaatccaccagcatttcaatcactgggactcaatccaccagcattccaattactgggactcaattctcctgcatttcaatcactgggactcaacccaccagcattccaatcaacgggactcaatccaccagcatttcaatcactgggactcaacacaccagcatttcaatcaccgggaatcaattctccaggacttcaatcactgggactctactctattctcctgcgtttcaatcactgggactcagnttttatgcattcaaatcactgggactcattctcctgcatttcaatcactgggactcaaccctcca

SEQ ID NO: 92448 - DNA, 596 bp, Heterodera glycines; identical to SEQ ID NO: 82169
  SCN-specific regions: Sequence locations=1-52,74-228,271-351,373-596

SEQ ID NO: 92449 - DNA, 644 bp, Heterodera glycines
  SCN-specific regions: Sequence locations=1-225,247-347,521-563,585-644
gcgagattcaagccaccgaattcttccggccaattgactgggaccgtctgtacagaaaggaaaacgaacctccgttcaaaccccagctcaactccgattcggacaccagctattttgacgcggaatttacccgtgaagctgtacagctcacgccgccggcggcgaggactggtccgctggacacattggatgagatggacgaaatacagaacaattttgtgcaattctcattccatcaggagcaagagttgggtggtgtgccggattcattgcgcgaaaacagcgaactgatggaggagtaatggaggaaaaagtgatcggaataggagcggaggaaaaagtgatcggaataggagagaaggaaaagtgatcggaataggagaggaggaaaagtgaacggaatgagaggaggaaaagtgatcggaatgggagcggaagaaaaactgatcggaataggagaggaggaaaagtgatcggaataggagaggaggaaaagtgatcggaataggagaggagaaaatgacgcgagagtgaagggcatttgcgggttgaatgatcggcgattgtgaagtgaacagagaagttcaagcgggacgaaatagcataggcaaactcaaccaccacggaagaacgcaagcaaaaaa

SEQ ID NO: 92450 - DNA, 528 bp, Heterodera glycines
  SCN-specific regions: Sequence locations=1-45,67-70,94-528
gcaagtactcgaataaaatcaaaatttttatgtacaatttctccaattttacaaaaggccattttttggaatgaaaatgatcttttttccttcttcttcgtcgtctttaaatatgccgctccttaatcgcagcagggggtttgaagcagcatgcatatcaacaacgagatagccatagggtttattagtcgcaatacgataggcagaaaggaaataatccagttttcccggaaaaagttgcactccaatgttacgaatcgccagtgcggaatttggagctcgcattaacaccaaatattgggcactgcagaaatcggtgaaaagaaatcggaggcttttggctggtgctgtcttggttttggtttgggcttgaggtggtccccactaattcccatagtagctgcagaaatcggagaaaagaaatccgaagcgcttggcaagtgttgtcttagtttcggtttgggcttcaggtggtcgccactaattcccatagtagctgccgaaatcggagaaaagaaatcggaggca

SEQ ID NO: 92451 - DNA, 636 bp, Heterodera glycines
  SCN-specific regions: Sequence locations=1-231,253-542,564-636
cggaagtgttggagcccattcatcagttcgtcgtccaatttctgagctgcgaaatctgctccaaaaactttgataaaatggcgcgtgaagatggcattttgagtgttcatcgcccaggtgattttggcattttcttattgtaaaatcgtgggaatggggggaggcaaaacaacttttgaaaatgcgtagtttcaatattaacaatttaagtcattccgagaatgtcatgttaaaaattaacttgaccaaaaaccctcaaaataggtgtttaattttgaaaattcactttttgtgagagggggggggggctaaaaaacaaaacttatttcgctcattttttccacggccttccgtttaatgttttttcccaagaggacgtcattttgtggctgtggagaggtcacaataaagtgaacaaacggctgaagggcgaggccagcgaagacccgcacttcccaaaacagcaatttccaccgtccaaactttgttcggaatgtcggactcaaaacggagatttcgatgagcaaaaagtcctccgattccttttaaaatattattccgaagttcggacagaccattacaaagtgagttattcacaattgggattcttttcatttcgttaaatattaagccatc

SEQ ID NO: 92452 - DNA, 643 bp, Heterodera glycines
  SCN-specific regions: Sequence locations=1-62,90-643
tgttcaccttttgtcaaatccgtcatcaccgataaaagacgcaatttgattctgtcgagcagtcaatttttgcatctcatttatccatttttcctcatcgcccgctgcaattggacaacgcatgagcataaaaccactttcatcttcttcattccttgtgatgacattgtcaaattctccccagtcaattcgttgatcatttcaaatggcaaaacggagccaattgaagaggacggcggaaagtaaacgcaaatgacgaaaacaacaggagaagaagcgaaggaaaatgcctaaaaaaggacaaatattaaaaaacgaattaattggagaaatcaccgctttgatctgttccacggttgccgaccattggtccacagctaaattctcaatgctgagccttcgaaaaattttcggaatgagtcgaaaacagccatttggctaccgcttggccatccgacgcattggcactgtcgtcgggcggaaattcaagcaaaattccgtcatagaaattgacaacgcgaggatgaacaatcaatcattgagcattgacgaaaatagatggatttcaactctatcagaatagtggtgtccttgaacattggccaaatgttgagcacagtgaattccgaaatgcgaacgtttt

SEQ ID NO: 92453 - DNA, 653 bp, Heterodera glycines
  SCN-specific regions: Sequence locations=1-14,52-197,224-398,420-653
gaactagtctcgagttttttttttttttttttttttttttttttttcttttagcatttattactttaaataccgataaaaaattgcaagtaaatatatgaaatgtaaatgtgtaaaacacctattaattgctcattttccaatattgcccagttgcgtcttccactgtcagcacgacgtgactttttgccgatttgctccatttttctgtttctcctttcctccgtccaccgtgggacgacagttgtgaaaacgtcgatggatgcgcaaattggcggattgtgcgaattgtttatgacagaatggacactgaaaagggcgttcgccggtgtgcaccgtgcgaatgtgcgtcctaaaattgaagtccaacgaaaaacgctttccacagtcctcaaagtcacaaacgaaacgtttctcgcccgaatggaccaacaaatggcgcttcaatttggaacgctcaatgaatgagcgtgaacactgttggcaaatgtgctgacggggcccatggatttgcaagtgctttcgcattgcgctttgtttcacaaatgttttctgacatcctttgtaagaacaagggatcttctgtgtgaacagttgcgagctcaacattggctggtccatcttttgaacactttccgtccgattctttcgctt

SEQ ID NO: 92454 - DNA, 626 bp, Heterodera glycines
  SCN-specific regions: Sequence locations=1-48,70-89,111-540,567 -569,618-626
tttttctccccgagaatcggagcttaaccttcaaattaaaacaatcagaaaattaattttcacaaggggtggtggtggtcgactgtccatccacaaattttcccaaaaatgcccatttattaaggtcattagggggtgctcatcctctctctaatcccatttcgcgactacggatggcgcaaaactaacaaatccaatttttcaatttcccaattttgagagtgccccgcggggggtaaattttcaactttttgcctccccccccccgaaatttggcgttttgacgcaccggcaaacgattcgccacgccttttaaaaagtttttccgccaaatttgtccctcgtcggcgcgcactcttttcgcgcacatcaatggatgggatgggatgacctttgtttcttcattttccattgtgttgttgtttgggcaaccacaaattgcggcggggcgcttaatgtaacaaaaatgggttgggaaaaggacaaaaatggacaaaatggagaaaagggaattggggggggggggggaaagattgcgtaaatttaatttaatttaatttaaattatgcaaataaattaattaatttaaattataaaaaataaattttaatttaaaacttatgatg

SEQ ID NO: 92455 - DNA, 624 bp, Heterodera glycines
  SCN-specific regions: Sequence locations=1-26,48-370,393-624
cactgccaccaaattcttcacgccattgtcccccgccgccgccgccaaattctgctgctcatcatcgcattcaaaagcctcaccattaccaccaccattcgctgttagcaatggcaccgcacaaaacttcgtcatttgaagcgcccacccaatcggagttgaagcaaatgttggacgaggcagaatatggctttgtgatggccgacaaaattggcacttcactgttggaacaaaacagggaattgcaggaaaagaacgaatttctggaggcatcgttggccaccagccgtgacaatgtggcacagctgaagcgccagttggagcagcgctgtgacctgttcaaaaagttgcaactccaactcgagggcatggaggaggaggagccgaacgggacagaccaataccatcagacgggaatgtgcagctcaacggcggcgcaattggagagcaaaattaaacgattggagggggaaaataaggaattgcgaacaaagacaaaggactcggatgaattgagagtgattgcggagaagcgcgaggagcagcggatcaacgagtactgctcacgcttgaggggagcaaacctgaagattggccaattggaagtgcaactcgcagaaaaag

SEQ ID NO: 92456 - DNA, 629 bp, Heterodera glycines
  SCN-specific regions: Sequence locations=1-33,55-79,103-629
tagtcgtaataaaaactaattaattttttttttgaaaatcctagaagtttaaaacaaatgaaaactgcgggggagaatcggtttgttgatcccataaatattgtaaaatgggccttcggcgattggaattgaaaaatgcctcaacaataattaccgccctcacaacaaattatggttgtcgacctgttcgctgttaacagtgcccggggtgtcgaagcaccaattgcccagtttgaaggtgaagtcgttgaggttcatgttgggccgctttttcggtccattgccctcaatttgggcaatttcgtcggcattttccaattgcccatcgaagtatttgatggttttgtccacggacacgggctgtttattctcttcccattccttggaaaatgaaagcaaaattgttggcaagtgatgttaggcgaacccgaaaagagctgccgatgatcccttggagcacaacgtatttcggatgtttggtggtactgaaggccgacctcagcattagggactcctaaatacaaaaataagatgtagtaattgccctcttggtcggttgtaactgtcaggtccaaggcggacttttcctcttggcatttatcacggtctctaaatgtttgatggactgt

SEQ ID NO: 92457 - DNA, 616 bp, Heterodera glycines
  misc_feature (509)..(509): n is a, c, g, or t
  SCN-specific regions: Sequence locations=1-335,358-616
ggtgtgttggcaatggcagcgaaattcatctccaatcagcgcggtggtcacaagctaatctacgagggccacagctacataaagcatcgtcatcggtcgacccccgtgggcgaagtcacttattggagatgcgaccaattgcatcgcctcaaatgtcccgggttcgcgcagaccaactcgagaagtgacgaagttgtggtcactcggtcgcacagccacgcgccgtcctccacccgaattgaggtgctaatcgccaaaagtgacatccgtcgggcggcagtgaacgcaattagtgcaacgcctggggcaatcgttgccaatgcgctggagggcatcagcgacgcggcaaagcatcagttgccgaagattgccaatctgaaaaagacggccacccgacaaaggaagggcattggggacggagcagcggaaaatccgctgccaagcagagaaacactgcgcaaaagattggtgcaaaactatcgcaacggcagtcaccgacggacaaccgntacagtaccaatgccacaaacatcgcattacgttgcttctgctgacccagcgctttcgataaaacaaagccaaagggcagaagagggacaatgccaaatggcaacga

SEQ ID NO: 92458 - DNA, 620 bp, Heterodera glycines
  SCN-specific regions: Sequence locations=1-620
attatttttaatggcaccgcccgtcaaaaaaaagaaaaagttttcctccgacaatcaccgcctcatttcttctacagaaattggtgaacatgaacaacaatcgatgggttcacttacgacatcgtttggaaaacggcaaagtctttttcgacatgcaaagaaaatgaacaaccgaattttgaggaaaatctggatttgcactgatatttggatggacactttcccgttctttgaccatgcccaactcggcctcaaattggcactgatttcgccacgtttcgatgttttagtagacaaacatttcaattgccaatctgaattgacaatttggagagaaataacaattgtcaaggacacaggatcagaattaaatctaactgtactgattggtggcaaatctgtgcaatttcctttgcccgaccgttcgctgcccaacaaaattcgctttgataatcttaatattgattacattgaccattccgtcctcgtgtttctccgtgccaataagcaaatttgggacaaaggcaccaatttgagtttgtatgtgtgctggtcacacaaccagaacgacaacaacaacaatttcctgccaatttgggatgtttttgtttgtaaaattt

SEQ ID NO: 92459 - DNA, 633 bp, Heterodera glycines
  SCN-specific regions: Sequence locations=1-633
cgagaaacggcttttacgacaaaaatgaggacaaagtgactctggccattgatgtcattgtggggcaagcagaaatggacagaccaatttctgctgatcaaagcaaatcgaaagggacactttttatggacattgaaaaagtgtcacaatttgcgcgagaaatcatttggagtgagcgcaaaagcgaaactgtgacgtgcttagggggacttccatggaaaatatccgttcaaatatttacgattgtgggaagtgccgtcaaatgtttgagcctttttctttgttgtaccgctccaaaagaaggtgaaattcaaataatcatttgaaattatatttaaatttaagacgaaaattggagagccgaatgttcggcaaaattccgaattgtttcgcaaatgagcggagttggggaattcagaaaggaatttgagcacactgtttttaatagcgaaacgaactgttggggattccccgatttcatcacatttgcggtgagaggccaatttgacattgcttaattgacctaattatgacaattaaggaattaatggacccgggccgaggcttatacgacagagaggaggacaaagtgacgttgggcatcgatgtgactgtgatgaaagagcgaaaggg

SEQ ID NO: 92460 - DNA, 636 bp, Heterodera glycines
  SCN-specific regions: Sequence locations=1-314,350-374,398-440,463-636
actttctcttccgctttctgttcctcttccactttctgttcctcttccactttctcttccactttctcttccactttctgctcctcttccactttctgctcatcttcccacaattttgggtccaactgcgtctcttccggctcctcaacctcaccaaaattccaatccgcgcgatcatcaatgtcttcccgttgctgctggtcatcatcattgtcttcaccatcaattccctgctcgtcgtcttcccctgcgtccaatgcctccaaacagccggcaaagtcatcctccacatcaattggttggtccgtttcgtccattttctgctgctgctgttgttgttgctgatcagcatcagcattgttttgctcgtcattcatttgttgctgttgttgttgatcatttccgtcattcttaagcccctcaatttgttccatgttctccacttgggaagacacatcggtggcattcggtgccaaatcgccatcgccaaaaccgtcgccagcttccgctcgtttagcatccgcttcatcgccacccttttgtctgtccgcaattggaattggattgacaaagccgttggtcaacagatggcagccgaccgcgctccaatgggcatggaatgaggccaattgggca

SEQ ID NO: 92461 - DNA, 219 bp, Heterodera glycines
  SCN-specific regions: Sequence locations=1-21,44-80,110-219
cgtcgttcgccatgaacactacttcttccatcccaatgggccccgttcttccgtgcattggccaaaacaataaaaagtatgaagtgatgaaaaagaagaaggagaaaaatgtttttttttatgaccttggaaacgaacaaaatggcgggtgaaaagcgaaaaaggccgccgagtttgtccgagaaaagtttttccatacaacggccggactggaaagga

SEQ ID NO: 92462 - DNA, 600 bp, Heterodera glycines
  SCN-specific regions: Sequence locations=1-75,97-600
atccctgaaaaatggccactgccgcgacacaaagtgccacgatggaccccgccaagctgacgccgttcaagcagacgcccggcgtgtcggcctcgctgcgccagatcagcgcggacgctttctacgtggtcaacgaagtggtgatcaaacggcttgggcccatcccaattttgaagggtgacttccatctgttgcccttcaaagtgcaacgctttgtggcggagaaggcggaactgtgccggccacggggcattttcatttgtgacggttccgaacatgaagcggaggagatgactgacctgcttgttgagcgtggtgtgctgacaccgttggtggcctacgaaaacaattatttgtgccgaactgacccgcgcgactgtgcccgggtggagagcaaaacgtggatggtcacacgggagaaatatgagacggtcacccatacgcccgcgggcgtggagccgatcatgggccattggatgcctccggcacaattcgcggacgaattggacacgcgctttcccggctgtatggccggccgtattatgtacgtcatcccattttccatgggaccgttgggcagtccgttgtccaaaattggca

SEQ ID NO: 92463 - DNA, 631 bp, Heterodera glycines
  SCN-specific regions: Sequence locations=1-547,569-631
acagcagtccctgcagctggacaacgcgcctgctcgtgccgccaccattctattcggtctcgggttcaagccggacgaccagcgctagccgacacccgagttttccgggggttggagaatgcgtgtggcgttggcccgtgcactgttcataaaacccgatttgctgttgctggaccagccgaccaacatgatggacatgcgcgctgtctattggatagagaatcatttacatgaatggcacggcaccattctgacagatgcccacgaccgcaaatttttgaacaccgtctgcaccgacattgtacatttgcactcacgtcggctggacgcgcacaacgagaactatgacgattttgacaacgcaatgcgcgagaaactgaccctccaacagcgagaatatgaggcacaacaacagctccgacagcacatccaggagttcatcgacgaattccgctacaacgccaagcgagcctccatggtgcaggcgcgcatcaaaatgctggaaaaattaccggtgctgcaacccgtcgagttcgactcggacgtggtggtccacttcaaagactgcgacaagttgtgcaacccggtgctgcatctggaccaagtggcctttcgctactccaaggaaacg

SEQ ID NO: 92464 - DNA, 651 bp, Heterodera glycines
  SCN-specific regions: Sequence locations=1-452,475-651
ttcttcctgtcacaattgctgcttttgtttgctaccccttctgatggtttccgtccaaaatgctgcccaaccgccaaagggccgtctcggctttggcattgaccggggcggcactttcaccgatgttttcgtggcatatccggacggccggaccggcaccttcaaacttctctctgttgatcgtcagaattattcggacgcaccgacagaagcaatccgaagagttctgagtgatttcattggcatcgaattgacccgaggcgaacccatcccaaccgatcacattgcgtggattcgaatgggcacgacggtggccacaaacgcacttttggagcgaaagggcgaaccaatggcactgctggtcaccaaggggttcaaagatttgcttcacattgggaaccaatcgcggccgaacattttcgaattcgacattcgaatccccgaaacactttacgaagaagtggaggaggtggacgagagagtccttttggaggacgacacctgcgaaatggaaatccaaggccgaaaagtgcgcgcgcagaatggccaaatggtgatcgtcgagaaagagttggaccaagaacaaatccgtgccgttctcggccaaattttggcgcggggaattcactctttggccgtccttctccttca

SEQ ID NO: 92465 - DNA, 654 bp, Heterodera glycines
  SCN-specific regions: Sequence locations=1-159,182-347,371-654
ctcaacctctatgagtacccgtcgttcaagtcgtcgttcatctgctgctaaggggtcacgtgagggcagcgtggcggggaagtcgaaaccttcggaaacggctattagcgactcaaagaagccgtcgaattcttcacccgagaaggctcaagaaacaggaaaaatggaagaggaaaagaagctggaaccagtcaccgaaacagagccagaattatcaacagaggatgaggaaaaatcaatagtggacgaaaaaaagaccactccggaaaagaagcaagaagaagttggggcccgcggtggagcaaccgctggaaatttacgttgagcacacagtgaagactgaaaaacttcatggcattgttcaggagcagtcacaggcaaaggattcggccagttctgatgctcccattgagaatggtcaacaacaaaaaaatgaagcgactataaatgaagaagaaatagtcgatgaagatgccttcatcattacaaatgagtcggaccccgctgcaactcacaaaatccaagtctacactttgagtgacagcggaattcccaatgagcaaaaagcaacgcctagcggaagtaaagctttggtatccgcaaaaccaatgctgggtgaagaagggaaaggggatgaaataacggtggtcaagg

SEQ ID NO: 92466 - DNA, 606 bp, Heterodera glycines
  SCN-specific regions: Sequence locations=1-355,377-606
gcgaacgccggagcagagtcgcgacgtgttctgggacaacgatcacattgcgccgttgtattcgatggaagcggcgcaacgcaccgtccacccactgatcggatcagcgtcaaaaataaacatggcaaagggcaaaaaaaccattacgatggcgcctcataagagcaaactgagcaaaatggacgaacggacgcggctggcacacattcggctggtggacaccatggaacataacgtaaagcatgcggaggagctgaaggcggacaatgcgaacaacgaaaacaaagcgttgggcgaactgcgcaagagacaaaaaagcgggaaaatccgcgacggtcggcacatggaagggatgccgtcgacgcgaagggcacccgatttggaacgcgacgggttccatcgccttcgcgagagcagagacggcgaacattcgccgtcgcaccatcggccgaacggcacgagtctcacgtcgccacaccggacgaggagagggtccccttttggcgccggcgccttgcgtcagcccgacccattgagccaaggccattacattggcgaggagatgccgcagcgcgacttgaacccgtacatgggccacattcagcg

SEQ ID NO: 92467 - DNA, 330 bp, Heterodera glycines
  SCN-specific regions: Sequence locations=1-184,208-330
ggtatgcaaaaaacaaccaatgcaaaaaaggcagtgatcactgatcagtattttttttgaattagcgcctaaattcgcttttggcattatgaatcattttgtctaacactggatttgatttgtctaacattgatttgaccaataattataccacctatgctttttaagattacgaattagaaaattaaatttgaaaattcttaaatatgtactaacattttcaaattttccatattactttctaaaaaattctctatagtgtcgaaattaccagccacgaaatttggtcattttttgacaaaaatctgttaacaaatggctttaaaaatc

SEQ ID NO: 92468 - DNA, 625 bp, Heterodera glycines
  SCN-specific regions: Sequence locations=1-492,514-625
cacctctgctgttgtagttattgctgcgtatcccaccgtttcgctgcctgtctcttccgtactctccagaaggtctctttttgtctccccaattctctctggccggtctctgtttgtctcttccgtactctctggcaggtctcttctgtttgtctccccagttctctccagccgttctctgtttgtctcttccgtactctctggcaggtctctgtttatctccccagttctctctacccgctctctgcttctctcgctcctcattccgctgcttcactctctgctccagcattaccattcgtttcgcctccaatttctcgtctttgaatttgatctccgacgtacgcacgtccatccgcggcttaaacgcactcgaaatgtccgcgcgattgcgcaactcgcggatctgtggcattcgcaacagcccaaaggcattcgcaactccgacaatgttcaagtctaaacggaaaaagaaaaatgaaatggtatttatgagaagaaattgccatcatcagacaaaccgtcgaccctttcaatttaaatgggaaaagtcggcggaaagaaacagcgaaatttgttaatttctcggacaatgaataaacgtttctgttttggcgtacctttg

SEQ ID NO: 92469 - DNA, 408 bp, Heterodera glycines
  SCN-specific regions: Sequence locations=1-18,41-408
atgggctgctgcgaatggaagtcacagccccggacaggtccatcatgttcgtcaaactgaatgcgaatgaattagacatttattgatgcgagtacttattctccaaccacgagaagttaaatggcacttttataaatgagggggaagcgtggaatttcgaagaacccaaaggggttttgcttcttttagaaaagaacaaaacaaattaattaccctatttagcaccacttttggcttttccatcaccctccccctccattataaaagggtcgtaaatgcccagaatttgttagctttccattgaaaaaccttggtcatgagcacacacagtcggtagtcccaaagttggatgactccgctgtgcagagaaggcaacacccaccgacgcgtgggaaggaaagaaatggc

SEQ ID NO: 92470 - DNA, 602 bp, Heterodera glycines
  SCN-specific regions: Sequence locations=1-602
acatacggataaagtgaagtgaaatcaaagtacgagatcttctctccatctcgtgcttcatggtaaagcgttagcggtcccgtgcgcccgcccatgaatgcatctctgatcaacagtggtccatcatcaacgtattccgcaaacttttgccgcatctctttgcttctgctcagcatacactgaatttcgcattcccaatacacatccacgtgtgccacttgggagcgaatgaattccaggcgctttgcgtcccgctcgcgcacttctcctgccgactttccatttggtagcagcatgttatcacttggataacactttttgcacccgtgccacgcacaaccttatttttcaaatgaaacgcataatccaaaaaaaaaaaaaaaaatcaattaccattcacttcgatggccctccgctcggcctggatccatccatcaaggctgtactggccaatcctcttttctccttccggtgagtgagcggtttgaaccaccacaccgtgttcctctgcaaaccacttgaagaagcgaagtgccaaaaggctttggttctgggcattgtcgtagccccgctccggcacaatggccagatgatcggctgga

SEQ ID NO: 92471 - DNA, 638 bp, Heterodera glycines
  SCN-specific regions: Sequence locations=1-386,408-638
tccctttcccccccccctcaccgtaactttaaaatgattgcttttcattttcctaatctaaaatttaacaattgtggttgatcaactgaactccttgccaaggtccgtgtctcgttgcgtgccaaggacttgctggacgcgctgatggccagtgaggacgtgaaccggtcgctgggcgaggagaaccgcagtctgtggcgcccggaatttgccgcttacatggtggagggcacgcccggcacaccgtacggcggtctgatgtcctgcttcaacattgtggagtacaacatgcgcttgcgctacgacgacgtgtccgcactgttgcggcccaacgagtcgctgctgtccatcagtttcccggcacttggcgcgcccgacttcaccgacccgccggcggtgccgcgcccgactcatccggacagtgtgggccgttcagtgttctacccggacgaggccatctacagcgggcacccccgttttcgcaaccttgtcaggaacatccggggccgacgtggcgaaaaagtggccataaatgtgccgatttttcgcgaccagaacacgccatcgccatttaccgagacctttgaaaacgccgaagcttcacgggctgcacttcccgaccacatttacatggacca

SEQ ID NO: 92472 - DNA, 637 bp, Heterodera glycines
  SCN-specific regions: Sequence locations=1-478,504-637
gttgtattaacaaatgtctgtccgtcgggtcatttgtgcgatttcgggtggagttgacaggtcattttttgtggcatttgtcaatttggaatttgttctaatgatttccctttttgctttggtgctgtgagtgcgcttttgctcaaacgccgcggatttgatgtcgtcggcgtgcatatgacgaattgggaccctcaggacgaagcgagtgactcatcgtcctgcccacagagcgaggaccttacggattctgaaaagttgtgcgcttttttgggaatcaaattgcatattgtcaattttgttaagcagtattggaatgatgtttttatcaattttgtggacaattgctctttcggtcggaccattgtgcccgatgttggctgtaacaagaaaatcaaattcaaccttttgcgaaaggttgccttcgaagagcttggagcggatgctcttgctaccggccactttgccagaacttcccaaggggattttttggagaatcatttggctgtgcctaataaaatcaaattattgcgtgcgaaagatgcgttgaaagaccaaacgtatttcctttcctccctctgccattcccaattggaccgagttatgtttccggttggttcgctttacaaaagcgaag

SEQ ID NO: 92473 - DNA, 645 bp, Heterodera glycines
  SCN-specific regions: Sequence locations=1-645
gttccgtcgttctctgttctccaacgacactctctacgacttcctccgttgcgtcgacaccgccaccctcggcctctccgtggccctctgttgccgccgtttcgccaacttcgctgacttcattttgcgtcgtcgtgcccactcgaattgcgcactgatgctttttgatggccaaaaccaaatgttatgtgcgaaatcgaaggcacagagttcggacagtgtttttgccgttcgcttgtgggactccgccaaagcaaacatcagagggcgagggtttgaacgccgtatttacgctaacggaatgactctttacaaagtgattgaccaatggttttgcaacccaattgaacaaaaggccttggaactgtcggagtttgaagtgccggaatggatcaccggcattcgttttctgtatttgcttgatgttgtctctcttcccgtgctgtcatttctccgtcagatttcgccaatgttggaaaagtgctgtattaaattcgagttgacttctttttggtcgaaattgcattcttccggccaacttttgccgtttctttctctcttcaaccctttgacattttctcttcatttgacttttgatgacctttattttcactccgttaatcgtcccaacccatacttcttcaa

SEQ ID NO: 92474 - DNA, 636 bp, Heterodera glycines
  SCN-specific regions: Sequence locations=1-224,247-636
caacctacagcgtcttcttcccatgtgatcagctaattagctattaattaaccccaattaacaaaactgtcccctgcttcttctgaaaatggcccccaaatgccttccgcctgaacttttgtacgaattcgtgcttttcatccctgttgaagatgccattccgaatgtgctctcgtcctgttgcctgctttacaatattttgcggccacgtgtaataaaatgggaaaagaaaatgcaaaaacttattgacgaatttggcaaatttcgtcgcgattttgatggattccgaggcgaatttgatggattccgaggcgaagttcgtaccgaactatccacaatgaaaaatcgttttgaagttctggacaagccgtttggtcagttgcctgtcagccctcagactttggagcacaactgggcccaattcattgactatttggtgcaagcgaataacggagtgactgggcgaatggccactctgaccaatgctgtcgagcgactaaatgcgggggacagtgacgaggccgacaaattgtacggggacgtgacggcactggacagcgattgtaccgacctggcggagatggttcaccgaattgcgcagctgccaaatgtggcacaagcgacacaattggcgac

SEQ ID NO: 92475 - DNA, 643 bp, Heterodera glycines
  SCN-specific regions: Sequence locations=1-38,60-144,167-525,554-643
gtttttccgaaatgataaatgggaattgtattttgcattgctttgaaaaaattttcaaattcttattgcgataataagtcagagctgggtagagtggcgcggccgggcgcggtggtcgtgctggcgttgggaattggatttcggaaaggggagggaaagggaaaagtgccacatattcccgaaagatgggtccacggggtgtgggttgccttcccacactcgctggtcacacaataagtggctttattctcgggacgactgagctccgttcgcttgaaaaggcgaacattaaatacaagtgaaaagtgaaatgtcatcgatcaattatcgctgggaggacggtacaattagtaaaaagggaaattaaatgcaaaaagaaataaatgtgaaaataatgaaatcctagagcttcggcagttaaacgagtaaaaacccgacaatttcgactctctcttacacctccaaccttaccaaagaccgtccccggtctcttaccaggattttcaattcacaattacccgaagcaaaaatatttcaaaaaaataataattttgctaatcttcatgcccttttccaattttgaatcaaaattttattcttcgtgccactcactcccaaccttacattggatcgtccctgatcc

SEQ ID NO: 92476 - DNA, 580 bp, Heterodera glycines
  SCN-specific regions: Sequence locations=1-514,536-580
ctcatagctgttatgatcaatcttgactaccctatgacacatataatcactcatagatactcaccatgaatgttataagctaatataatcaatcataactatcccatggctgttacaatcactcatcaataaaccatggctgttaatcggtccttataatcccgatcagttttagaatttctctttaatataatcacatattcgattcgttaaataaaataattgccaaccttgccatgtttggcatactcaatacagtagcgatcagtgaatgccgaagcggtggcaaccgcccaacagctggcacatgttgtctggtcctgcaccttgttgacaatgtccgcacagcttggccacttggtgcgcacatcaaattccacatgatttgagcaccgggcacccagcctatggcgccgcgtgttgccgagaaaggcactgaccgggacggcacgcggtggcttggtcccgcgaagtccggtcatacgtctggcaaaattttttttttgggattttcaatattttttaatatattgaatggaataatcataatctcgcaaaattgattaatctactatataaa

SEQ ID NO: 92477 - DNA, 606 bp, Heterodera glycines
  SCN-specific regions: Sequence locations=1-166,188-528,550-606
cgctttcggcggttccaacatcgagccttccgtccgttcctgcttcgaacataccaagttcccaccgaccatcaacgtggagcagttcctggattggctgcggaaagagccccagtcgctggtgtggctgccggtcatgcacagattgggctcatcggaatttgccaaacatcaggccaaatgcaacgcttgcaaaatgtttccgatcgttggacttcgctaccgctgtcttcgctgcttcaattttgacatttgtcagaattgttttttcagtcaaaggactgccaaaagtcacaaattgtctcacccgatgcaggaatattgcacaccgacaagcgcgggcgatgacatgcgtgacttcacagtgatcatcaaaaacaaagtgcgccagggcaaaagtcgaattggctatttgccggtcgaacaaataaacgaaggaccgccgctcgaatgcaacgaccaaacgccacagaacgcggaaacagaggcaatgcaccagcgaatgcagctgatagccgcgagattggacaagcggcaaaccgaagcggccgaggcttttccgaatgccattgtgccgtctgaagaagggaaagtgaagaacggaaa

SEQ ID NO: 92478 - DNA, 373 bp, Heterodera glycines
  SCN-specific regions: Sequence locations=1-175,197-373
ggtgcacccaaaaagtcggcagagacgttgccacgaaacttagcagaaagccaaagatataattttaatttttggcatgccactgcgacgttttgtaaagctaattatatagactaaaaaaaccccaaatatgtggactaaaaaggtcaaaatatgtattaaaatgctcagaatggcaaaatatggactaaaaattacaaaattgacaatcattatcattggctaaaagagactattttcattgaacggtacgatttttatgtttcagacattcacttcggcgtggattatttcggcgtcgccaagtttgaaatggaataactttttcgttattcgttgaagttattaaatcttgcaaattttaagccaaggc

SEQ ID NO: 92479 - DNA, 601 bp, Heterodera glycines
  SCN-specific regions: Sequence locations=1-601
gttggaggtgaaagtggaggacaaagtgcgcaatgagcgcgcaatgtcattcatcaaagtgaatgtccgagcagtgcctgaaattgccttcgaaagacacgcgaccattcgtttgttggtcgactcggcgctgtctccggtcagcgaccttttggacgaggaggccaaagggttggcgtctgcgctggtccgcgaagaacacggcgaaccctctcgccttgagttgttccgtcgcgagatggagtcgctgacccaggcatttgtggaagtgatctcgctgaagcccgacgagcagctgctccaacgtctttccacaaaagtggtggaccttcgcttcaccgctcggaacggcgacgaattcctcgaccccacgcatttgcacggactcgcaatgcgaaacagggagaggctggccacggtgttgagggcgcgcattttggcggtgggcgtggacatgtgcaagtggacgacatgcgacaacggatgccgtacggagaatagggcggataatagtgggcgttgtggtccaagccaaccgaactgtgatcgtcgggctgaacgcctcggcggctgatgtgtgcgaatgtcccgcctattctcc

SEQ ID NO: 92480 - DNA, 253 bp, Heterodera glycines
  SCN-specific regions: Sequence locations=1-128,157-179,201-253
atcaatcggtcaaagtcccgcataaagtcttcgtcctccggctgcacttgctgctgttgagtgcgcacacggatgtgctgtgcctcgtcatcgtcgtcctccgctgtgatcattcccacttccgagacgtcctcatcctcctcctcgtcctcgtcactaaacatagaacgaattgcaggataaaataatatatattttttctcatcaaacaataatgcaaacgcaaaattttcgtaacaactttaaaacagaa

SEQ ID NO: 92481 - DNA, 650 bp, Heterodera glycines
  SCN-specific regions: Sequence locations=1-199,221-263,285-626,648-650
cccattgagagggtgggcgaagaaaagacggttcctcccctccccacactcgcgcgggagttgtttattgtttacgtcggcggatcccgaattcctacctcacccaccgcttcacggaatgtttatgccaccgcataacggtgaagcaattattaaaaaacggacttcttggacaaggaagaaaaaaagaggatcaaatctcacattcaatcaacaaaataattggatgctgcaacacaattacaattaatttaaaggaacagaagaaaaagtaaatattttttcagaaaaaggacaaaagagggaatataaagacattttgtgttgctcatttgtcagcccattccatttactaatgcttttatgggcggaaagaaaagaccaacaatgagtgcgatgttaacaactcccttttttcgaacattgattatgcataaattaatagtccatttttggcactcgcacagtctttggccaatgtgtggggccaacccaaagagaaaatccctcaaaacagaggaagaacaaaagacgaatgggctaaatgctaaatggctgctccgcgcctgcccatcgcataaagttggcaaatgttgtgccagctgctgctgtaacaccatctagcacattatccatttttatttttggcg

SEQ ID NO: 92482 - DNA, 631 bp, Heterodera glycines
  SCN-specific regions: Sequence locations=1-120,142-631
ggaacaccgggcaaatgctgaacaaccatcggttggtcatgagtgcttacggttgcaaattgggactctaaaacgagaaaagggatgggaagcttagccatttagacaatcccaacccaaaaattccacatttgcaaccccctttttgatcaatcctccctcaattactgttaaatttccatcttttggccaagtcccaccacaaaccccaatttccccgatttgcttctgatcacatcacccccccccccctaattacccccctccctaattaccgccttccgtttgacgactccccaccaattgggccaacattcgctcgatttggcccagcttctcaaacactccgtcgatgttcttgaacttcccctgcagatcctccatcattgtgttcgcctcgttttgcaccgagtgaaatgcttcgtcgtcgtcgcctcccctcgtcgattgtaaacggactgaaaaagcgatgaatgaaaacgcacatttaaatatgctcaccggcatgtctttcatgcattcgttgcaataattttctgattggatggtcatttggaatttccaatttttcgttttttcgccgttcgtccaattccaattcccttttcacgtcaagcacttttcggaattt

SEQ ID NO: 92483 - DNA, 641 bp, Heterodera glycines
  SCN-specific regions: Sequence locations=1-28,57-321,344-346,368 -415,437-641
atcgtgatcagatcaccattctttattcaaaatttaaataattcaaaaataatttacaacgacaaattttgaagaaattgaccaatgaaattaatggaatgtgattggaaatataggaaaagaggcacaaataaacagaaatcaattttgagacattttggtcacattgtttgaagccagacgaattttttgaaactttgcataaccacaagaacacaaatgtttttgtattgcctttatcattcaaaatcgatgtccatccgatttagaatctttttttctgtaaaatttagccccattttacgacaaaaaatcaccatttgttctttcccaatagtgatcttttggacaattaaattcatttcatttcgcccaataccaactcagtccatcccggtcgtctgttgccgatttgaattttaattggtcaacaaattgatgttttggcccgagaaatttggcatcttttcgcgtcaagcatttgccgcttggattttcataatgctgatcatttggacaaattgcccgactcatttcgccaacaattctctctgatctgaacctgaattcaagcagttcacttggtccggtttcccgatgtgcttgctgatgatgatgggcccaatacaactgctggctac

SEQ ID NO: 92484 - DNA, 614 bp, Heterodera glycines
  SCN-specific regions: Sequence locations=1-614
tgcaatggatctcacacacctcaccacggaggaggaagccctctttcaacttcatgagcgtcgttgcacttggctttacgttgtcaacgacacactcaccgcactgcagggaaaaacaccgtatctgtacagacatgaaatgttgcagctgttccagcaggaattgatcactcagaagttggccaaatcactggacaagttgccgcagaagttgaaaccgaaggcattgatgagcacacttcgaatgccggagacacgcgattgctatcagtgtaacgtggaaaggagcatcaatgacgaaaacctttacctttgttgtgccgttcctcacgctgtgctccttttccaatggtatgaaccgctgtctcgctttgtccatcttaagcgagtccaactggacaaactgagcagtccctacaccgacctgcaacacccacacaaacccttcaatttggtcttcagatccggcgctgccaattccgatttgcccatggtgtgcattggcatttctcgggcgctcacttcgcctgtcggcactgcacaagaattgttgcgcgagttgcggaccaatctccaaaaggacaaattcgagctgcaactcgtcgactttaatg

SEQ ID NO: 92485 - DNA, 591 bp, Heterodera glycines
  SCN-specific regions: Sequence locations=1-3,30-104,129-254,276-591
atgaaaaataaaaataattatttttaaatgaatgacaaaagtgagtacaacacaaaactgacagtagcagcgcaggtgaaactccgatgcagaatgtcttttacaaaaaaaaataataaaatatttttgcctcctttggcgtaccgtccgccgccaaccgcctaattgactttgcaaaattaaattacataattaggcataacaaaatgtcaaccaaagtcagtcactgactcgactgacaaatgagtgattttgcgctgttttctcccgccaccgttttaattgcattttatttttctgttgtgcccaattcgccgcgttttgtccttgacatttcgtctgcccaaaaaaagggggaggaattgggcaatttgtccaattttgcgcatttgcactttttttgcttcggttgggaatggggggcggaggacgcgcacctttcccgagtaattattgccgcgccactaattgggcagtttaaacaaatgatgcatgtgcccttgggcggacggacaaacaaagccataaaaagagaaattaatggaaaaaggcggggaaggggggatcacacagcagaatgatcagaatggg

SEQ ID NO: 92486 - DNA, 640 bp, Heterodera glycines
  SCN-specific regions: Sequence locations=1-451,473-640
gttagggtgggtattcatgggcccgtcccgtattcatcctaattggggagaggctgagttcacttgcgacggtgtcgcatgcaggactccccgctccctggttacggtgtaaaattttagcatataggaatttggagtgggtgctcggaacggatattttcggcctggaaatggccgtggactttaccggcacatcagcatccatttgcacaatggatgcgttggaaggaaagccggtcccaaaaaatcacctagattttttgcttggcaatcagcagtttcgccgatgtaaattagcaatttttggtcattaaataaaatcatatgtattttcagtggccgcccgattgaatgccaccacaactgaaaccgatcgtgacataatgtgggcttataaaattagcgcaggacaaaaaaatcggtgggtgtgtgtgtgtttttacatttatgctaattttttccaacttttaggcagaacggcaacttgacgcattaattactcattttatgcggtaaaaaaaaggaaaggaggaagaggaggaggagaggaacaaccaagcaacaacaacaacatttaactcattaaaaatacattttttgatcacaccattcattcatttacattttcatttcaaaaaat

SEQ ID NO: 92487 - DNA, 636 bp, Heterodera glycines
  SCN-specific regions: Sequence locations=1-74,100-636
gagggtaatttgccttaatttacttttacatatcatcacaattccacatggttttttccattttccggctttattccctttcttttctcctcttccttccattgtgtccaacctccgctttctacaaatacgactccagcttcgcttttttgaatgtccgtagcaaaagtttgcccaccggaggctccgatttctgtgtcaatttccaacaatggcacagccgtcaattgccatcgtcggccgacacaaaaaattttgtccaaattggctggtggaatagcaatttaaacacgaacatttgccttgaaaatgggcacaatttcgccaaaaatgaactcgttccagtcgattatcgaactctgtcctcggagcttttgccatgcaaatttaaagagggcgaggcggtggtcaatgccacgttgaatcgtcttaagccaaagggtgtgcgaaatgtgctgtttttgatggaaaagggtaaacgcaaccgatacggaattcgcgactttttgttttcgcaattttacaatgccgaaattaacgattccgacacttcgatgtccgtgtttttcgtttacaatgacacatttcgacaggaaatcgaacctttactactcaattcgtcttccactgagcttc

SEQ ID NO: 92488 - DNA, 617 bp, Heterodera glycines
  SCN-specific regions: Sequence locations=1-617
cgcagtctcttccgactttccattctcgtatgggttttgctcaggcggtggactctttggctccggagttgggctcttcaaatgctgctccttcttccattccctgttcactgagtaacccccattaaagttgagagcgcgcgaaagggacggcgtgagcggcagaatatggagtttagggtggactgggtagccgggggcgttaattgctcggagttactggcagtggaagtagaaattttttgtcaatgttcaagcttatcgaggtcatcaggctgaagaattttggcccgggacaaacggtaaatgttgagcaggtcattaatgccatcgatcaacattcaacggtccgggagggattagctcggtgaaagcagcaaattgggtgaacgagggtgctgtcgcacgccgataccaattctgaatcattttttaattcgctttcttcaccgtgcaaatatggaagctgggcggtacatcatccgccaaagcaatgttgacgagtggcgggccaatgtacgaattttgagtccggaaggcgacgggcgggcaccgacaatgttgtccgacaattggtccctccgagctgtgcaaaatggacaagggaatgtcgccgc

SEQ ID NO: 92489 - DNA, 638 bp, Heterodera glycines
  SCN-specific regions: Sequence locations=1-164,203-638
gaaaaaaaaccgctaaaaatttaatccgataattttgtaaaaatttaagagaaaatgcgatcaaattggagcaggagaaggagacaattctggacaaaattaacaacatcaaagcatcatcggcggctggcattaagccgacggcagcgcaattttcgcaaggcaataaatttttttttaaattttaaattctaaaaaatttcccaattttttttcagccgaacgtgacggactgatgttgaacatgcaacgaattttggccaggtgcaatactgtgaacatatcaattgaaacgccacgtgatcagcaccaattcaaggcattggagcaagtgaacaaggtgggtggtgcgattgttggtgccacactttttcaagcagtccaaccggcggggatatatgccagttttgaaagtccagggcgggtaggcatttgtgccaacgccatcaaaaacatttcggaaatcggcatttaggcggctcaaaattcggaaaccggattccgattctaaaatgatatttttccgagccatagggatcagatcaggacacaatgtgtttaaagttgcaccccaaaaatttggcattatgaaatttaaataaaaattacacaaatattttagaatttttagatccatg

SEQ ID NO: 92490 - DNA, 564 bp, Heterodera glycines
  SCN-specific regions: Sequence locations=1-162,184-456,478-564
aacaacaatgatcaacccgtggctattcaagctcatcaccaatgccaatctgtacaacagtcgagcatttccaatggagcaaattctggcatttccaatgggacggcaccaatgccattgttcgagtcgaccccgagaaacgtgcttgttttcaaaggtgttcttttaaatcctttcaaaaaactctttcgttgaagaaaacgtcggacgcatcggctccgtttctttgacggtcacaaatcgtctttttcgtgccatttacttcaagatcaagtcgacctcaaatagcttttattcaatttgtccggaaaacggaattatccaaccaaaagaaaacgtcgaagtgattattaagccaaatgatgacagcttggccaatttgcaagaaataacgaccaaaaagcacaagttcttgatcatgtcggcaattgtttcgaatttggcagtgcaagcggaaaatttttggaaaggcaaaaagcacttctcagaaggtgtttattccaaaaagctgaagacgaaggtgcaaaaaactcatcacaatcagcaaaattccgaacaacggaa

SEQ ID NO: 92491 - DNA, 166 bp, Heterodera glycines
  SCN-specific regions: Sequence locations=1-166
gcgatgtatttgacgtgcagcaccgagcggcccggctggatgatgtccctgccgctgaatagcacacggccccggccgcagtcgaacacggtcagtgcgccggagctgtgaccggcacagagccgctgctgttgcgggtcgggcgagaagtccaagcaggagatgg

SEQ ID NO: 92492 - DNA, 444 bp, Heterodera glycines
  misc_feature (148)..(150): n is a, c, g, or t
  misc_feature (154)..(154): n is a, c, g, or t
  misc_feature (426)..(426): n is a, c, g, or t
  SCN-specific regions: Sequence locations=1-273,394-444
aaaaccgccgaattggcacatcggaggagagctgaaaactgcgcaagacaatcctcgacaacagcgaatttctctgcgaagccgtgcaaaggacctgaaggaaccaaatgaatatccccgaaatcggtggataatgaattttttgatnnnggcncccggaccggaagcgcaggcaccaagagaaataacgcaaaaagcaacaacaagcaagacgaaaaaaaaaaagcaacaaaaaaaagccacgcgagggtccgccgcgcgtccgcgcgaccaggtgggcgggggaggcgtagaaggcaggcggggacgcaagaggggatgggggggggaggcggggacgggaggaggggcgcaaaagggaggggggatggggagagggagggaagggaggagcagctgaattgcaacaggtgaggcagagtcacngaggcaaacaagagcgag

SEQ ID NO: 92493 - DNA, 632 bp, Heterodera glycines
  SCN-specific regions: Sequence locations=1-77,99-133,155-632
gtttagtttcgcttcgcccttatgttcaccactcgcaaagtttgttcccacactcacaccgcttttgaagtcattccttcgccccttttgcccctctctcctccaaatccgctcaatcggcagcaaagagtgcggatacagctcggagctgatgagagtccccaaaaggccaaattggactcgcagccgcttctgctcgactcgccctcgtcgtcctctgctggcgcagttctgagtaactgcccaaggcgaaaccactcatatttgagtctgttcaatctcgctcatcctcagcactttgttggagagcatggctttctctcgtggagttccttgcgtaaaaaggcaaacacagaaacaacggaaaacggcgattttgccctttacgacaacgagccggcacacaattttattgctccgtatatcagcggctatacgacgccgggcccaatggaacgcgaggcgagcaaacacaaaaaggctaagctcggcgtcatgctcggcgtgtaccttccgaccatccagcacattcttggcgtcaccatgttcatccgtttggcgtggatcgtcggtgtcgctggcgtatcgcatacttttctgatgctcttcatttgctggctttgtacgtttct

SEQ ID NO: 92494 - DNA, 490 bp, Heterodera glycines
  SCN-specific regions: Sequence locations=1-3,26-490
catcgtcgtcgccaccgccgccgctttagtcggccgattggtggtgccggtggtctgcgcctgttgaaagttcacattaccaatgggtggagaggggaggacggattattttggaaataaaaaaatattttgggcaaaaagtgtggttaaaagtgcgatttgcaaaggcatggattcatttagagcaattgaaaatgagtggtgcttcatgaagcgggcggtcaaagaatggatggacggaaactctctctacattttaggggtcaaaattgcgagactcggaaattttgaaattccgaacttttttgcggcctcttagaaccgcaatttcacccattgacgggggacaatgtttttccacccgttaattttcgctcagttcgcccaccctttggtctccgtcgtttgccacccgtccaattttgatcagttgcggtcgttcccgcacaacggaatggcacatcagcagaatggccgcagcgaatgccga

SEQ ID NO: 92495 - DNA, 639 bp, Heterodera glycines
  SCN-specific regions: Sequence locations=1-519,541-566,588-614,636-639
agatggcaaaatcaccgaagaaatcgcccaccaaacgacacgtgagcgtcccttctcacaatcagtccttaactaaacggccaaaggttgaatttgccgcaattctcaataaaacgaatggaaccgcagacaaacagccgatgtcatttgagcacagattggcaaaactcgatggtgatgatggcggtcttcatagagcatccacgtcaagtggccacatttctgcccgacagcctggagcggaggcgaagtggccacggccagcgccggccaaatgggtcagagaggggcgaacagacgcgaacttggcctttcaactgattgacatcgacttttacatgggtccgacttttcattcgaatgactggtgggtgaatccgaggcaaaagaaggcggacggcacttacacacttgccgttccgttgatacaaacctcgaaaagcattgcctttttgtcctcattagcagagttggtcggcctccacttggctgaacaatcttgacaggacaacaataaccgtaatataaatgtggaaaattttgcctgccggggtttttggctgacaccctttatgagcaattttgaagcctgaacctatatttgaataaaaccaacaactcagaagttttaactttcaa

SEQ ID NO: 92496 - DNA, 597 bp, Heterodera glycines
  SCN-specific regions: Sequence locations=1-161,201-350,372-526,548-597
aaattttttaaatattatacaatcgtgctttttgctctctattatttccctataaaaaaattcacttcccttcgaaattgaaggcagaatgctcatttgaagctacgcaaatataaattaatatttgctataagaactgactatttagtcaacagaaaacaaataaatcataaaattagaacaaaaaatgattttattttagaatgcacactgaagatgcataataagctaatatattcgaatttattttgaaataactgttcaacagattattagttgtttctaagaaataatgataggaagcttatctgaaatgtgtgctcacccaggtcggaatttttcatttcctgcaataaatgttttcatataaaggtttaaaaaattcgatcgggtttagaaacgttcaataaatgcatagataaattttttgaatattatacaatcgtgctttttgctctctatcaatttattataaaaaaattcacttcccttcgaaagtgaaggcagaatgctcatttgaagctacgcaaatataaataaatatttgctataagaactgactatttagtcaacagaaaacaaataaatcctaaaatt

SEQ ID NO: 92497 - DNA, 244 bp, Heterodera glycines
  SCN-specific regions: Sequence locations=1-185,207-244
ggaggtgagcgccaatttccttcacaaagccatcgaagattttcgcccggatgagagtgtgcatttgctgtgcaccatttcaaaccaacagcggcaagaattggtacgcgaattcaaacaattgttcggggaagatttgtccgccaaactgaagaaggcactctctggtgactttgaggaactgattttggctttggtggaaccggcagctgtatacgatgagcagaaaatgcggcgagcgatg

SEQ ID NO: 92498 - DNA, 473 bp, Heterodera glycines
  SCN-specific regions: Sequence locations=1-473
ctcaggccttccaaggcgaattgttcgggcgcaaattcgagttgtccccgaacgccattcggctgcgcattgtcaccgccatccgcgagtgcagcggcgtcaatttgggcgtcacaattccgtcggaggacatcgtccgctgcattatgaaagtgtcccattccaacgattacaaagcgcgttcgatgactctgctttttttcgcttcgcttggccgtttgatattcgacgacaaaaaggttcatatttttgtcattgagtcgctggactgtgccgatcagaccgaattttccgcggccattcgagcgggcaacgaattggcaaagcattccgttcccttttccgtcttggatatgaacaaaattgccgaactggttggctccaatagccttacccattgggtcagggccgaactgatggccgtcgtgggcaacctaagggacctttcgctgacaagacaatgccttgaactc

SEQ ID NO: 92499 - DNA, 539 bp, Heterodera glycines
  SCN-specific regions: Sequence locations=1-162,186-340,369-388,411 -461,483-539
atttatcatttcaatatatttttgtacaatttcatatttttgttctttctttctcatcaattcgttgttcttcttctttttcttcccatttttctccaaatatttcatcaaatgacttttgttccaattttttctttgctgatttaatttgattaattagggcaatgaaaattaaaattaaacaaaataatagagggaataatttcatttttttcaaaatattctcaaaatgttgtataattttctttttttttttccaatatgatttaattttatgaatgaatgggcatttattattcgtgaaatgattttcatattaataaattggatttttttttaattaaaacaaactacaaaatattacaatcgccaaaaaataaatcaactcattttttatttaaattttattaccaaatgctcaaaatattaaatgtaagaaatttttatgatttttttaaatcaaaatctgatagctttacaaacgaaatatgaaatccaaatctaaaattggcgaatccgttcaattaaaatgctatttc

SEQ ID NO: 92500 - DNA, 373 bp, Heterodera glycines
  SCN-specific regions: Sequence locations=1-290,312-373
tatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagaaaaaaatggtgtaagtaaaaatcgtaattttgctcaaaaagcttctcaaacaattttagcgcatccaattccttctacaatcgcctttatgcatcccattatgaacgctaaaattatcagagtgccgaaaatcgcatgtgatctacgcctaaaa

SEQ ID NO: 92501 - DNA, 610 bp, Heterodera glycines
  SCN-specific regions: Sequence locations=1-610
cagcctctacaaacttgtcgatattggcgccaatttaggccatccatcgtttcagcccgattttgcggatgttttgaacagagcaaaaaaggcaggtatcgtaaaattgttgatcactggcgcaagcgaatcaatcacagatgaagcggcaaaattggccagcaaagagccggactttctctattacactgccggtgttcatccgcatgacgcaaaagatttcttttattgacgaacgttggatttccttcgctctcatttgaccacaaattcgcaatgtgtcgcggtcggcgaatgcgggttggacttcaacagaaatttctcgccacgggaccaacaacttcgggttttcgaggcccaggtccaattggcatgtgagcttggcaaaccgttgtttgtccatgaacgtgaagcgcaccaagaaatggtggccattttgagtcgccacagcaaatcgttgccgcccaccgtcatccattgcttcactgggacagaaatggaggccaagcagtacatggacatgggactgtacatcggactaacgggatttctgtggaaggaccgtgccgtggacggcgtaaaacacgcgttgcggcaacggaccattcga

SEQ ID NO: 92502 - DNA, 633 bp, Heterodera glycines
  SCN-specific regions: Sequence locations=1-63,85-291,313-452,474-633
ggacgacgatgacgcaaacggaggcaaataaccgacagaatggaaaaagtggagcggacaaaagacgccaaaactcagcggaaaaaggacgacccgagacgggatatgcatcagtgttaacgacgaatgggtcggcgattttccatcggcacagaaaaagtctccaggacgacgaggtgaagggcaatggcagcaacaacaacggcatccatcagcacatgaaacaccggaacgattttgggagtagcacttcggttgaaaagagagagggactagtcgggagaaaatttggactgattaatggtgccattggcgcgctgctcaaccgatcggtcagcgaatcgaaggcccttaaccaacagcatcaaaatgggggcggacactacggaaagctgaaggcccaccaacaatttcctttttcccaatcatttcccgtgaaagaaaactcgaaaaagcaacagcaagcaccgattgctcagtcggagccatcggacacggactttgacgattcactatcagccacatcagcagtggagacgggatcaacaccaatgggaagtggcgcgacgaggacaccgatcggacaaggctcggcggagggcgacacttcgcaacacgaaaaacgaccatttg

SEQ ID NO: 92503 - DNA, 532 bp, Heterodera glycines
  SCN-specific regions: Sequence locations=1-467,490-511
cgcggcttgagactcatcgcgtgttgacttcctttgtcggcaatctttgtgcgcccaaccattttttccgaccagaccacaacagcggccgtttctgtgtggtgtctatcaacacgcatgaagctaacagagagatggtccgcactttctttcacgacaacgaggctgggttcaccaaaaaatattatttctgcgaactgcaattttttcctatgaatgaattgccttgggacgttgccgtgttgaagttgtacgcagaaaccatgggacatatttgggaccccctttttacgtacctggacgaagtcatcacttcactggagaatggtgacatgccgccgtacatttccgaatcatcgccaaataattcggccaattcactcgagaatctcccgtcggttgaggcaccgcaatcggatgattagttggagtgaagacttttctggcatttctgttccttcaccaaaaatgcctttgttgttgttgttggcataataaacaatgaattctcaaaaaaaaaaaaaaaaaaaaa

SEQ ID NO: 92504 - DNA, 96 bp, Heterodera glycines
  SCN-specific regions: Sequence locations=1-73
ccctaatttttgttgaaggccatggacgatcaaattttgttaatcgtattgggtcataaatttgttattgttgaaaaaaaaaaaaaaaaaaaaaaa

SEQ ID NO: 92505 - DNA, 367 bp, Heterodera glycines
  misc_feature (347)..(347): n is a, c, g, or t
  SCN-specific regions: Sequence locations=1-99,121-185,210-243,278 -289,312-347
gtcgtttttcctctggatgaacgaaaacaggcacagattctatcagccggggatgactcaggcggacgtggcaaaggccgcaggcgaggaatggcgtcgcatgtccagttccgagaaggccaagtggggagagaagtcggtggaggacaaagaacgctacgtccacgaaatgaacgaacagcgcgagaaagaagaaggggaggaagagggcgaatgagaaagagcgaagggacagaagatgagagagaggatatacaaacagaaagaatctttttggattccaaacttaattaatattaattggccatttcttttgccttttgtttctcaaataaatcattttgttnaaaaaaaaaaaaaaaaaaaa

SEQ ID NO: 92506 - DNA, 579 bp, Heterodera glycines
  SCN-specific regions: Sequence locations=1-7,83-100,127-203,239-579
atgggaaagaaaatgtaattaaaatggaagagaaattgacaaatgcggagaaggaaattgtcaaactcaaggaaaatgcgccacacaaaaagttgggagttgtccaggatttggtggaccgtttggccatcctcgacgaaatggaacagtgtctgaacacgttgtggctgatgccgaccgacagcaaaacggagttttatccgctggcgaccacgcggacaattctgaggctgacggagctgtgcgccgcgttggaatcggagtcgtccaattatttggagtcgatcaacgagcgaattttgccacttctgttcgcggaaattgaaacgcggaagggcgaactgtgccagcaactgtccgacttttacgcatcgttcttccgattcactgaggacgaccgcgtttcaccaccactctattcgatgagcatcaattgtcccagcatcaaaacggcctctgattgtttctccgccatgcgtcaactcgatttgcttgaagaccgtttggaggaaatggtggacattatttgggagcatttctgtctgaaattgatttacgcggtcactgaggacggacaaa

SEQ ID NO: 92507 - DNA, 646 bp, Heterodera glycines
  SCN-specific regions: Sequence locations=1-5,27-197,220-365,388 -501,523-563,586-646
gtgcgattttgctgctttttcacattaattttcgcttttccgactttgcctaaattaatttttcctccgaattactttgtgcattatcgctttgttcttggtgttcaaatgaagaagttgtgcaggagtctctcccatgcgctccccgccgtgctcacttggtcgttaatcgtcggttgttccgccgctttcttctatgtgttggtgcccgcccttgttgtacagcttggcctcgtcggctacgtgctctgctgcttggatgttgtgctgtttgtgctctgtctgtccaatttgtgcctttccaccgccatggaccccgggattcacccgatcgccatttcatcggaggagaccagcgtcgacgattttcgttcaccattgtacagaaacgtcgaaattaatggcattacggtccgtatgaaatggtgcgtcacttgcaaattctatcggcctccccgttcttcgcattgttcggtgtgcaacaggtgcatcgactgcttcgaccaccactgcccgtgggtgcacaattgcattgggcgccgcaactaccgcttcttcttcctgtttctgctgttcctctctctgcacatggtctgcgtgttcggcctgtccctggcctacacaatgctcagccgccgggacattc

SEQ ID NO: 92508 - DNA, 471 bp, Heterodera glycines
  SCN-specific regions: Sequence locations=1-173,195-471
cctaattacaaccgcaaccaatattttataagcattatcgacagtttgtcacagaagggacttctcgaagcgaatcgtcaaccgcccatcagtcactcgacactcagttttttgatggaaaggaaaaaggacccaatgtcaatggtcaacatttactgctcggcttcgggtgagcccaattttgagttttttgtctttcaacttgcagtcaggccaagcaaatttgttttcatttctgaattgagaagtcggcccgtttatggcttttgcgcagcgtcaaaaaaggaggccaaaaaggcttgcgcattgcgacttctcgacattttgatgacagaagaacgactcgaatgtgtcaatttgtccggacggaaagtgaggaaaatgccgccaaagccaattccgacaaaagcagcgaatgtcgaacaaagtcaacagcaggaaaacatgcacttgtcattctctgatgacatc

SEQ ID NO: 92509 - DNA, 545 bp, Heterodera glycines
  SCN-specific regions: Sequence locations=1-545
cggttttcgaagtttctgtccatgtgggaacagaatgaactgcaacataacttctcagaagcactgaactccaacaatgtcaagacccattctcgacgaattaactagggcgctttttgcgcatctccgagggggaaatgcgtgctttgatgaagaaaacgaactcattgaactcttccgacggtgtccccgatgctcgcgcagtcttcgcccgatcattttggacaaattcaccgacgaaaaagatggtctttagtacgagcgaatgtggtggacatgtccgggcatagagcagaaggagtgtttcttccccctggacatccccaaggaggtgttctggactcgtcgctccatggatcagtcccttcgtggcattctccctttgcccaacctccatttgttgcccctctctttgcgcgccctttaccacaaactcttcaaaagcaaggtcaacattgagaaaattgtgcgcatttccgccttcgttccgtcggatggacagaagagtgccgtacaacaagcaaattttggtgccgaagaacagc

SEQ ID NO: 92510 - DNA, 578 bp, Heterodera glycines
  SCN-specific regions: Sequence locations=1-578
tgtttaagtgctcgatatctgtttgttatggccggaactaatgctgctgttgaattggagtcatgggatgaaatggagattgacgaatcggcggcaacttttgcccctcgcgccgttcctgtcaccgaagatcggaccatcatgaagaatgtgatcgcatgggcaattgatggaaagttgaaatccctccggggcggggcaaacgacgaaaaagaaggagatctgtttaacgagttagcccaaagtggcgacttcatggcatggaccgtcttggcatactttgacacattgaagaagattgcggtggccgacactgtgaactttacggtcaaaacgacattgacacaatacttggcggcactcgacggggaacttccaacagctcaggcaaatactgtgtcagaaaccccgacatctcgcctgttggcccttttcatctcttttatctgcctcgccaagggcaatgaagcccgcaacaacccaaccatccagtccccggtctctcttgaaaatgcctcgattttccgccgatacagtgccatggtggcggggaagaacctgccaactgcaaacgctgt

SEQ ID NO: 92511 - DNA, 629 bp, Heterodera glycines
  SCN-specific regions: Sequence locations=1-629
cccacttttgttcagtgcctctgccgggtcagcccgacattccgcacacgcgggtggagttaatgctctcggccagggatctgaaggacaaggatttgttgtccaagtcggacccaatgtgtgtgatttattcgctggtgccgggcaaaggcggcacggggcctgagtatgtggagatcgggcgaacggaagtgatttggaacaatttgaacccgcgatggaacaccaaagtgacgctgaattactttttcgagaccaagcagcagttgcgcttcgacgtgttcgacatcgacacggagaacacgcgcgacttgagcagccaggactttttgggccgctgtgagtgccatttggcggacattgtggccgccgcacacggcgtattgacgcttaagctgaaggatgagccaggccaagagggcaaattgatcatccgagcggacgaagtcgacgagggccaaaaagagatggtgcgcatggtgtgccatgggcagcaggtggcctccaagggcatttgctggtgcctttccgcgagggaccctttcctcgaatttcaccgcctctacgcggacggatcgaaacagctcgtctaccggacagaggtccaaactcggacggtggaccccgaa

SEQ ID NO: 92512 - DNA, 484 bp, Heterodera glycines
  misc_feature (465)..(465): n is a, c, g, or t
  SCN-specific regions: Sequence locations=1-459
aattaagtcgtttattatggaaaaggacttctcaattaattgttacatcgccttttccaatcccatcttttgtcatcagaaaatgctgatgcggaagggcgagttcagcttcaattcacaagagcgttctttcacagcaaaaattcacaacaaaacgaggctccgcctttttccatgtgaattatgtgcggttggcaagaaaagatgtcctaacggccgatgtttgatcattcgctacaaaacgggtttttaatgatgacattaaggaattggtattgaaagaactcgaagagggagacaaactgaagattcattccgttttgctgggcattgccggatgaaattgacgttgaaatatcactttttcagggcttctgagtgtttttttttccaaaaatacagcaaatttggcaatgataaagttttgttgtttcttcaaaaaataaatttgagatcacgaaaaanaaaaaaaaaaaaaaaaaaa

SEQ ID NO: 92513 - DNA, 464 bp, Heterodera glycines
  misc_feature (437)..(438): n is a, c, g, or t
  misc_feature (460)..(461): n is a, c, g, or t
  SCN-specific regions: Sequence locations=1-196,218-255,281-391,414-438
attgcccgccaactttgtgctccgcccgatggcccgtctgaaggtgtgggcccgtaaccagggcggcctgcacgccccgccggatcagctgatcttcgatggcgaagaatcgttcggcgtcggctcaaacgtgcaaaccattctctataatgcgcaaggagaagaacgtgccacgcacatccaacgttcaagccagacagctgcctgaagaggaagagagagataatgctgataagagtgatcactgggggacggaattttaaattttttaattatttttcgaaaaatcgaaaaatgcacccccccccccccctcctaagaattgattttcttttttaattttcaaaaaattccccttatataaaattgattttttcaatgaccaaccgacatttaaccattaaattttaacaaattggataaagtgacaaataatnnaaaaaaaaaaaaaaaaaaaaannaaa

SEQ ID NO: 92514 - DNA, 616 bp, Heterodera glycines
  SCN-specific regions: Sequence locations=1-83,105-616
attaaactcgcttactctttattctgtattatcttattgtgctacattacgaattcttccgctgctcttggaaagtcgaaatcaattgcaaaactgcaaaatgacactaaaaacaatgaggtgatggtcaccgaacgcggcaaaatggttgttgacgaacagtcgcttgtcattgagaacccggagcagaacaccgcgggcatggagacagtgaacgatgagctcaaggcggtgcccagcggagggatcatcggaagtggtcagcagaatgccgaagcagcacaacagaaaccggtgccgagcagtgcactgaccgaaacggagggaccacgggactcgtcggcggtgacgaacggagggaccagcggaagtggaagcggtcagcatgaaagagcagcacctactggagcacaacagaaacaggggccgagcagtgcaccgaccgcagcggaaggaccacggtcgttgggccaacaggagcagcagccgcacgtggacaaagtcgaggcaggcggtacgtcgacatggatcattgttggctcgatcttcggaggcattggagccggagcgatcattgtttggatcgtcattagctgtgttaagagatgccaaagaa

SEQ ID NO: 92515 - DNA, 454 bp, Heterodera glycines
  SCN-specific regions: Sequence locations=1-88,110-454
acagcagagaacggtggctgagccaaagaaacagccgcagaaagtggcagaggccgaggaattgccacaacagacgaaacagccacaacagcagcaggaagaaagcccaacgacgcaatgcgtacagcaaaaggtgcgcaaaccgaagagcctaaaggcactgacggagtacgaactatgcaagcaagaatgccgaaggaagcgcgaccaggaatcggcgaatgagtacatcgactatctgagggaagagctacggcttgccgaagagcgtgtcgaagctgaagcactgcagcagcagcaacaattgcaatacgcaaatggcctttgagagggaaggggcgaaggacaaacgaatgaatgccattgatggtagacagaaatgaagcaagaaaactgattttatgcagcaaaacatccggtgtcagccaattttaacgaaaagtacgatcaaaat

SEQ ID NO: 92516 - DNA, 205 bp, Heterodera glycines
  SCN-specific regions: Sequence locations=1-6,28-35,57-205
ccgtgccactccagggcgggcctcggctcttattcggctgatcagcgagacaaatgaacgtgcactgttcaccggtgacacactgttcatcgggggaagcgctcgcttttctgagggcaccgcccagcaaatgcatcacgctctcaacgaacggcttgacactttacacgaccaaacgttggtttactgccaacactagtacacg

SEQ ID NO: 92517 - DNA, 78 bp, Heterodera glycines
  SCN-specific regions: Sequence locations=1-54
cacttacctactttaatggttgcttagacgtaggtaagtgattctttctaaaccaagaaaaaaaaaaaaaaaaaaaaa

SEQ ID NO: 92518 - DNA, 632 bp, Heterodera glycines
  SCN-specific regions: Sequence locations=1-468,491-632
ggcgctttatgccggcaacgaagaaaaaggcgcagcttgatcctttggtgaggcgatcgattgctttgttgtgggcttataatggcagtgatttggtccttttgacatttctgcctggagaatgtcgcttcgatgagtattgtcaggccaaccgaaagaattttcgggtgctcagtttgggcacatggttttccatcaaatatcagcgttatgtcaagtgcgagacacgaatcaacgttttggatgtgtcggtgctggtggagaaaccgccgcttgagacgagggttattgatgccgtcgtgcagttgtgcgtgccctttgtctgctcaagtgcgaatccctacactgatcagtacacctacaaaagctcactcggcaatattgtgctcagaaagtcgcagggcggtgggccaactcagttgctgatttggtgcagtctgcaaacggtcgcgtggtggaaagacccgatgttggcagaagttgtcatcagaaacaccgacgaaaggaaagtggcggaagaaagggacggatttggtggaagggatgaaaccacagcaaaaggaattgccacgccaaccaacgacaaaagtgcttctgtttggcggggtttcaaaccaaacatcaaagcaaag

SEQ ID NO: 92519 - DNA, 608 bp, Heterodera glycines
  misc_feature (525)..(525): n is a, c, g, or t
  SCN-specific regions: Sequence locations=1-441,479-556,578-608
ccgcccaattctcgaataacataaaaataagttttggttagaattccttcgattcttatcattcattgccgatgcgagttcaaagtatcaaatcgtgcctcgtcgcctccgcctttttgtgcctcgtctccgcttttctcattggcttcgcctctcttaccccaggatggcgttcgataaaaggccaaattcgtcttctgcagaacccaccaattcgatcgttcagtgtcagcaccggcttattcggttttttgtgttccgaagctgaaaggacggcacaatctgccgatttgtgctccaattgggccaataatgtctctctcttcgaacggattgtctccattttatgtgtttttggtgtcttcgtcggactgttcgccttcctctggtcactggtcattctgtttgatttgttctccggttgggagaataaacctcggtgggctcttccggcattggcattttccactttttctttggcatcggtcgccgctgtcatttatttgttcagaggatgcagcgaanatgacaacttcgtctcccatttgacctcctccccgtcttcgccttcgtcgtctcccgtcgcaaagtgttccctccactacagt

SEQ ID NO: 92520 - DNA, 247 bp, Heterodera glycines
  misc_feature (171)..(171): n is a, c, g, or t
  misc_feature (183)..(183): n is a, c, g, or t
  misc_feature (199)..(199): n is a, c, g, or t
  SCN-specific regions: Sequence locations=1-247
tttgctactgtcctcggcgccgcctgacgcgggtaatccgtgcgcatgactttgcgccttttcaatatttggcgcaagaatctctgagcgggtcgatgaagcagggcatctcacagtgttttaaatctgttttcccatttttcggggcgtcatctctctttcgtcgactcncattttgacganctgtttttgctgcttnatttgatcctggagaatcgctttctaaaacgattttccgcttcatttt

SEQ ID NO: 92521 - DNA, 529 bp, Heterodera glycines
  misc_feature (333)..(333): n is a, c, g, or t
  SCN-specific regions: Sequence locations=1-373,395-529
cttttctttgccattttatggacagtgcagcgcaattcgaccaccatcagtcgtttggtggcggcacggcgccgacgagggtatcgacgggcggtggcattggcactgtttcacttggcaccgtcatgtacatttgcgtcgattgctacaggaaaacgaaatccggcccaaagacccgatccgttgccgggagtgtggttaccgtattctgcacaacaagcgcagtgccataacgatggcgtaccatgctcgataaagaaattcccagtattgggccttggtatgtggcttgtgggactgaatgttggttaagaaacaggaactgccatttanaaattgaaaatggaatgacaatccggttgagatatttgccaacattgctgcgtttcacttgcaattcgacgaacttcccaccgatccaaatgtgaaaaagtggagtgtgcatgtgttgaaattgtcctgtacgaaaaggcatttggaccgggcggagctgcacaaattttgggaaatgctcgacaggcacatttcc

SEQ ID NO: 92522 - DNA, 491 bp, Heterodera glycines
  SCN-specific regions: Sequence locations=22-491
gaaaaatgatgcccaaaaatttttgcggcaaaacatcaaatttttctcccaagaaactccctgctcttctgctgatcatagtattgtcaatactaaattctgtgagctcttctcgtcgccaccattctcctgcttctggtcataatcggcggctgtcatcaatttcatcacccgccgttgcaaatggtggtagcctctttgaacatcgaacaaagcatcaaagtgttgccgcggctgatgagtcggccgggggttgtgccgttgttccaccatcgctttggtgcggctgtgacaagctgcagacacagtgtggcaccggacgattgtgcggccgatacaccggcgccatgcgaaatgagccgcttcacatcacactgatctatgaaagactgtgccccaactgtcaaaaaatcatcaccgaaaatctgatcgatggggaccaaaaattcaagaaaaacttgcgaaatgaatttgacccaattggcaatgca

SEQ ID NO: 92523 - DNA, 270 bp, Heterodera glycines
  misc_feature (251)..(251): n is a, c, g, or t
  SCN-specific regions: Sequence locations=1-248
aaacccatgaggacgagcgcataccgccacactgcacttgccggtctggctgccgtcgcgctgatcaccgcgggctgcaccgatgacaaggacgtcgatgcgtcaatgtctccccaggtcggattgatctccacctcaacggttcaaaccccgccgcatcccgcggaagtaaagctcatcggggagagggacgtcgaggtgacgctgaccggcccgatcgctgctaagtacaaaataaaatatcgaataanaaaaaaaaaaaaaaaaaaa

SEQ ID NO: 92524 - DNA, 194 bp, Heterodera glycines
  SCN-specific regions: Sequence locations=1-172
atgacgatgacctctacagctaaagtgtgaacattgattattcggaagtgatatcatcagatgatgagtaaaatatgtcattgtttaattgtattggctgcatttttgcgccttgtcggttattatgtgtattgtttttcatttatggaaaagtggaataaaaactcgactcaaaaaaaaaaaaaaaaaaaaaa

SEQ ID NO: 92525 - DNA, 540 bp, Heterodera glycines
  SCN-specific regions: Sequence locations=1-540
accttttcctctttcagtctattgacatgtacatgtactctcgttgaatctaacacccaagagcccatcgccatcatgaccacgtccgcgacctgcatcttctgccgcatcatccgcaaggagatcccgtccttcaagctcgtcgaaaccgagcacgtctactcgttcctcgacattggtccgctttcgcacggccatgctctcgtcatccccaagcaccacggcgaaaaactgcacgagatccccgaaccgcaacttgccgccatcctgcccgccgccaagcaaatcatcgacgccctgcgcaaggaaacgggtctgtccgactacaacattttgcaaaacaacggtcgtgccgcccaccaggaagtaccccacgtccactttcacatcatccccaaacgcgaaaacggcgaggggttgggcgtcaagtgggtcccgtccgaaatcaacaaggacatggccaagttgaaggagttgcatgacaagttgaccgcgcagttgtaaaattggtcattgtgcgcgtgtgccaagggttgaaca

SEQ ID NO: 92526 - DNA, 614 bp, Heterodera glycines
  SCN-specific regions: Sequence locations=1-29,52-614
caactttgttagtgatatgtctaccaactacaacaacagcaaccaacaacagtcagtttcaatccgttcatatcagaaccaaaagcagtccgttcctgtgcctattcaacattccgaggaaagccaatttaatgggtcgcaaggaccgcagacaattgaacccaatggcaatataaaaaatggttttctccaagagaatgatgtgaccttacagagacagcaacagcaaatggccgtcagttctccctctgattgtaatgctggattgggcaatggacaaaatggcatgcgacaacagtcgaagaaggtgttagcaacggcgacatttgccataatgcgcagcgacatcagctgcaattttctacgatgaacggccaaaatggcggaatgtgttttccatcgaatttgccatcagcaatgtcgatgttagcaaatgctcctcaaagacgaacatttttattcaattcggacatggcaaacaccgctgctaaatctatgcagcagcatttaaccgaagacatggccggttggcatttgcagcactgtcctattgctccctcaacttcacgtgcggcatttgaacagaaaaggacaacaataaacagcagcaacaa

SEQ ID NO: 92527 - DNA, 603 bp, Heterodera glycines
  SCN-specific regions: Sequence locations=1-331,355-408,431-603
atattttgcaaaaactcagaatatgcctacggtggacatcccttccccttttccggaattttcgaaaatacgccacgcgatgctgaagaattgggggagaatttcaaattcagggaaagcattcctttgggcgaaactgatttttctgctgaagatgtgaacaaaatgattcagaatttgggccaagagtaccggggggacagctaccatttgatcactaaaaactgtaaccatttctctgccatccttagcaaggttctaacgggccaggagttgcccccgtggattaaccgtttggccaacatttccggttctttgccatttgtcgagcgatggatccctcaggaatggcttactccaatcgcccttcaacagtcgttggattcgcggtcgcgcagtattcccttacaaaatggcatcagcacggcggcactgagtgtcccggaggaaacgaaagcggacgtttcgactgattccaccgcaaggccttcgtcttacaccgtcggttggcggctgttccaacggcgcaaccccagctgcgatcaatcgtcgtcccctgcgaatgcgtcctcctcctcggcacccgccacctccagacagccc

SEQ ID NO: 92528 - DNA, 605 bp, Heterodera glycines
  SCN-specific regions: Sequence locations=1-605
cattggtccaattacatacccaacacacattttttgatggattccaagtgcgtctcattgaacttttttgcgctcgtgaaacatgaacaaccggacgaagaagaagctgatgactacgcggatgagcagcaagactcggctaatacggactacaaaaatctcaatggtgcctcattgtcggcaccagaaatgcctcaaaatcagcaattttggcacgcttttccacccaacggcagcaatggttattgttacgacggtgccatgacaaattgcgacggtgaaaccaaagcgattccgtacgatgaaacgccgccgcccaaatttgtgtacacattccaaggccctggccgcggtcggtggaccttctcgtgccaattcacttctgccgacgcgttggacctgttcaggaaggggcacggaatgtaccagacaaagaaggacggatgccgctatttcttctgctcagtgaagcgatgcccgtacaaaatgatcggcattgaaaatgaacgccaatggtggaacatctatgacagaaatgcgcataatcataccgtcattccgattggcgcaaaaattggcgaaaagcgcaacagaaacgggagaaa

SEQ ID NO: 92529 - DNA, 462 bp, Heterodera glycines
  SCN-specific regions: Sequence locations=1-401,423-462
cacacacgaacgcagtcccaacaaactccaacagcaccatgcccgtccaactctccaacaagctcaacatcacgtccgtcgacctcaagggcaagcgcgtcctcatgcgcgtcgacttcaacgtccccttcgccaagggcaccaccaccatctccaacccgcaacgcatcgtcgccgccctcccgaccatccagcacgccctcgccgccggcgcgcaagccgtgatcctcatgtcgcacctgggccgccccgacggcaagcgcgtccccaaggactcgctcaagcccgttgccgccaagctcgaggagctcctgggccaacccgtccagttcctcgacgactgcgtcggcaccgccgtcgaggccgcgtgtgccccgcgcaccgccaagggcgtgatcctgctcgagaacctgcgcttccacctcgaggaggagggctcgtccaaggacgagcagggcaaca

SEQ ID NO: 92530 - DNA, 597 bp, Heterodera glycines
  SCN-specific regions: Sequence locations=1-119,141-522,562-597
cagtcctcgcgccaaagaaactcacctaaatacgagtcgaatatttcttttttaattggcgtgtggcttcaaaacagaaaagtgccaaattattttcgaatttgagaaatgaattccaattcgttgctcttctctctgttcactttactgttgagcatcgccgccaatggccatttttgcttcggaaaagccatgggccagcagcgctcgcgacgagtggcggctgtggacaatggcaattttatcgtcgtggacggatccgtcagtgttgtcaatggagtgatctccgggaatggctggtatttacatgacggaaaagggcggattttggaaaacgcggaagctgacgggccaaaacgggccaaattgaaaaattcctccaccaaatggacgaaaataaccgaaaatttccgcaaggaaattccaagggatttacaaggaattttttccgataggaccccacccggggagccccctcccagaattttattttaacaaaaaaaaagggcggagttttggatcaaataaaaaaagaggtgaaaaaaaaaaaaaaaaaaaaaagggaaaagcgcagagataaaaaaagggggggggaga

SEQ ID NO: 92531 - DNA, 480 bp, Heterodera glycines
  SCN-specific regions: Sequence locations=1-445
cgacgtcgccggcggtgcgctcctcggcgtagcggtgggagcgtttttcctccgaaatgtcctccacaactttcggcccaatcgctactccgtcttggacacgcaaatgctcagttcggcggatggttggcaagacattgagggaatgccgaacggatcggaagcattgatcagcgaaaaactaacagtgccgaaaacaatcgtaacgaaagagcaacaaaaaagaccaatcggagggcaaagggcgaacgattacggaagcgtaagggaaatgagtggcggaaggagcgacggcaggacggagacggcacaaatcggctgacaacgatgactttcatccctcccttacaccacaagaaaaaacataatttttgtcccatttttctttttgctattgtccattttgaaagcgcaaattattatagttcatgtttagaaacggaataaaaaaaaaactataaaaaaaaaaaaaaaaaaaaa

SEQ ID NO: 92532 - DNA, 359 bp, Heterodera glycines
  SCN-specific regions: Sequence locations=1-65,88-339
gtttgagcttaagttcttttttaatcttttcacagttcaaatggcagcttatagacccatttacaccaaggaaaaagaatgggtcaacacgggcacagcggacggagagataatggtttttcgaccgacgatggaggagttttcgaatttcagcaaatacatcgaaactatcgagcgcagcagagcgcatttatcttctggcgtttgtaaggtcattcctccgcccggttggcacccgcgtccgtccaaaaatccgtccgattactccgatctgaacgacttcgtcattcattgcccagtgtgagcactgcacattctgcaaaaaataatagtcatctgaaaaaaaaaaaaaaaaaaaa

SEQ ID NO: 92533 - DNA, 362 bp, Heterodera glycines
  SCN-specific regions: Sequence locations=1-322,345-362
aaaagccgaagcgtgtccactttgtgtgcatggaccgcgcggagtcggaggcgcgccgtctgatgcgccaactgcggcgcggacaacgctcggtcaaagtcagcagcgcccagggcgagtccttctcggaaatgatggacgagccgcagcagtgctggcggcgccggaactgaacgcggacgaatgggacgcggagagtgcgcggagaagagtagaaattgatcattagtcagtcaacatacctaacactctccgataacttccccccccccccccgtctaatcagtgatcagtgtgatcaatgaccgtaataaaagtgccaattttattttgtttaaatgcaccgataaaataattgtagt

SEQ ID NO: 92534 - DNA, 199 bp, Heterodera glycines
  SCN-specific regions: Sequence locations=1-199
gttacttgatcccaataaccaactcaggttcaagggaccgctgactgagtacgtgaatggccatctcccgctggcaaatccctcgcgggaggacgtttatttcattgtgaagacgacggtgcctaagttttattgcgtccgccctaactctggtgtgatcctagcaatcgataaaacccctatcaaccttatcctgcaa

SEQ ID NO: 92535 - DNA, 245 bp, Heterodera glycines
  SCN-specific regions: Sequence locations=1-245
gttggcattgcttggctgcagcggatcaatggaaattgtggcggcgatctttccgtttttcggtgcgttcggtccgcccaacagttgcgatttggtgttccagaagtagaccgactttagcagttctattccgcggttcatcatgttctgtgcgtacgcctttagtgcgtacgtagcctccacatggaattggttcaggaaggcgctgcgctgcagcattttgcgttgctgttgagcgctgaacc

SEQ ID NO: 92536 - DNA, 402 bp, Heterodera glycines
  SCN-specific regions: Sequence locations=1-305,330-379
agatgactttcctagcccattttatcgtttcgcttttgctgattgttccgtcattcattccaaatgtttttggagaggactgctgcaccaaatgttacaattccatgacgggctgtcttcagaagtgcatcattgagcacaagggggacccggcctgtcgcaagacttgcaagcccaatgtgtacaaatgcgctgccaaatgcgggccccactgtccgctaaattggacgacgacgacgccgaagagcggctaatgtggcgagggacgatcaaagaaaaagccattcattcattagcgagttaattaatgagttgattaaccattatttgtgcaaagctgttgttgatccgaaaaagtcatgaaataaaatgcttgtttaaaaaaaaaaaaaaaaaaaaaaa

SEQ ID NO: 92537 - DNA, 508 bp, Heterodera glycines
  SCN-specific regions: Sequence locations=1-29,53-108,130-316,435 -435,477-508
gttttcaaaagattcgaattttgcaaaagttgcacaatttttccatttttactgttcccaccccgccgctacccagtttttcaataatcagcacaacaaaatgaacgcaacagagcaacaacaaccacaatcacagaagcgggcacgccctgccgaggaaaacggcaacgatgatggcgcggtgttgacaaaaacgcagaaagtggacaacggcgatatacccgcagcaacagcaaataatgaagccagtgcgaacaacaacgtattaaaagccaaactgaccaacaatgaaaagcctggcggagcagcatcagctgatgaggagacggaagagcaagggcacgaggaagaggaggagagcgagggcgagtcgggcgccggcggagaggaggacgaccaggatgatgaggaagacgatgaacagggtgcagagggtgacgatgatgatgaagaaggcgatgatgatgacgaagatgccgagggggatgagggcggtgaacaggaggaa

SEQ ID NO: 92538 - DNA, 492 bp, Heterodera glycines
  SCN-specific regions: Sequence locations=1-240,273-297,321-362,384 -384,440-492
cccctcggggtacgacgaatagcgaccgaatcattgtgaaaggacgaacgcaacgcaaggcataggatagaactaagatgagagagaaagaacaagcatactaagcataagagataaagcagacggaaaggagagaagaaacggccattccttctgctgctgctactgttactggcgaggaaaccaagttcaaagtgccggtgcgacggaggcggtttttgtttaatgctaatcagctaattgctcactaattaccccaaataacaaaactgtgcctgcttctcccaacaatggtccccaaatgccttccgctcgaacttttgttcgaaattgtgccttttatccctgccgaaaaagccgtcccgaatgcgctctcgtcctgttggctgctgcacaaacttttgctgccacgtgtcatcaaatggaaagagataatgagcgacaatattaactttaaaaatgaaatccgggaagagctcaaaagaataaacc

SEQ ID NO: 92539 - DNA, 612 bp, Heterodera glycines
  SCN-specific regions: Sequence locations=1-127,150-193,215-267,289 -319,342-612
aagacacgaccatgggacgctcaaatcgccatgcagcccgccgcagtccgactgccggcctccgtaccattcccgacccacgcctcgaccctgcgaccgcccgcgtccactcggcgaccatgaccgacaccggcaccgcgaccggcatcccaatgcgccgcctcgacaatggccacgacaccacccgcaacagccggcgtctgcaggggtcgcccagcagcccactgagccgcgctctggctcggtttcaggccatgccccgcagcaagaagcgccgggcggtgctggttggcgccggcatcaccctcttcatcatcgccatagtctcgctcctggccacgtcgggcggcagcagcggcccaccctcggggatccttgatccgaaatcaccgcctttcaaccccacggaatccacggtcgccaacctgctgtcgtcggccaacgtgcctgacccgtcgcgcgtctgggacacgtacttgccgccgctgcttgttgagcggctgccggggacgccgtcgcacgccaaggccaaagatcacatcgtcagctcgctcaaggagctcggatggaccattgagctggatgcatttgaagactcgacgcccatgggac

SEQ ID NO: 92540 - DNA, 630 bp, Heterodera glycines
  SCN-specific regions: Sequence locations=1-226,253-333,358-363,434 -475,522-630
gtcaaccatcaacgttcatctaccacaatgtcgcaccgcaagttcgaacacccccgccacggttccctcggcttcttgccccgcaagcgctgccgccgtcaccaaggcaaggtcaagtcgttccccaaggacgatgtcaagaagcccgtgcacttgactgccttcctcggctacaaggccggtatgacgcacgttgtgcgcgacttggaccgccccgcgtccaagatgcacaagaaggagattgtcgaggccgtgaccatcatcgagacccctcccatggtcattgttggtgttgtcggttacgtcgagactccccgcggtctccgcaccttgaccaccgtctgggccgagcacttgtccgaggaggtcaagcgtcgcttctacaagaactggtacaagtccaagaagaaggccttcaccaagtactctgccaagtacgccgatggcgccaaggacattacccgcgaccttgagcgcatcaagaagtactgccaagtcgtccgtgtcctcgcccacacccaagtgcgcaaggtcaagattggccaaaagaaggcgcacttgatggaaatccagctcaacggcggctcgattgcccaaaaggtcgactgggccaaggagcacttcgagaag

SEQ ID NO: 92541 - DNA, 160 bp, Heterodera glycines
  SCN-specific regions: Sequence locations=1-160
tgaacgctcgcccgtgaccgtcgaggtcaccatccacggtctcaagcctgggcagcacggtttccgcttccactaattccgtaacaacaccaacggatgtgtctctgctggcccgcactttcaccttgtcggtcacaagcgccgagcccccactgaccct

SEQ ID NO: 92542 - DNA, 474 bp, Heterodera glycines
  misc_feature (468)..(468): n is a, c, g, or t
  SCN-specific regions: Sequence locations=1-8,31-313,335-434
tgagattataaaacgatggcaaaacgaaaatcgaagcgaaaagcgccgaccaaagtgaagtcaattgtggcattggagacgcagttcaattgtccgttttgcaaccacgagaatgtgtgcgaggtgaaaatggaccgtgaaaggaatgtcgggttcattcaatgccgcgtttgcatggaagacttccagtccaacatcaccgctttgtccgagccaattgacgtttactccgattggattgacgcgtgcgaggcggccaatcagtgaaaaacaaaagtggacaaatcaccaacagagaacggacattgtgtgcacagaccagggatcaccttattattcactgatcatattggcattattttccaacgcatttttttttgatttcctttttccattaaaagtcgtctcgtaattcgattttccccatttatgtgtatataaattttgaatgattaaaaaaaaaaaaanaaaaaa

SEQ ID NO: 92543 - DNA, 160 bp, Heterodera glycines
  SCN-specific regions: Sequence locations=1-160
gcagcgaaacgggcgaatggcgcgcgtgctgcagacgcacggcataaatttgggggcattctatgcacatgccgactttttggacatcaacaccatttattccaacgacattgattttatgttgcggaatttcggaattgagggggccgctcgcacaatc

SEQ ID NO: 92544 - DNA, 346 bp, Heterodera glycines
  SCN-specific regions: Sequence locations=40-92,139-263,285-346
gaggagcaaaagcctgctggtaagaaggagaagcgcgccgcagagaaagaggaaaagaagtcagaaagcaaggaagcagagaaaaaggagaatgaggagcaaaagcctgctggtaagaaggagaagcgcgccgcagagcagaacagtaagaaaggtgattaaaagtgagggaatgagaaacgcacgaaaagaagagacgcttttgaagatggtcccaagtcaaggactccataattaggagcaaagagggggcggttaagtgtaagaaacctcactcgccacaacacctgcggatgtgagcagaaatgatgctagtttttgctcaaataagaaaaaaaaaaaaaaa

SEQ ID NO: 92545 - DNA, 424 bp, Heterodera glycines
  SCN-specific regions: Sequence locations=1-424
gcatgagacccaccttgttctctggattgcctcgaggagctctctgtgggctagcatcgccacacccgtcactctgccatcgctatacccggaacacagccaggtgaagcgtcaaatgcgcgacggagcctacgacttcggccgcctctccatctcggcctggactgactccatggacgatcgactacacacgacccagccttcgacgccccgatataacccctacaactccgtcttccgagcccaacatcgactgacccgaacactgccagtgcgctggcctccgacacccagtacagtcccacagggtcgcccggcccgttctgagggcctggcacagcctacaacgcctggaggcacacgacagccccgacagtctgaacagactggccatgccggcgcctcgttgcccgttccagaaata

SEQ ID NO: 92546 - DNA, 623 bp, Heterodera glycines
  SCN-specific regions: Sequence locations=1-93,115-623
attttgttaaattgctatttttggcagaaaattttcatcaaatgttgcccagaatttgttgtagtagcagaagtttgttgctccggaatttgagaatttcccccgctctctccattcattttgcgatgcatcaaagcaccgtcgcgccgtcctccgccgctgctgcgcagagtttgggctgtaaaattgagcccccaaagccaagggttgacgccacgcgggcgaccgactcggacaaactttcgacagcaaaaaacactgtcacatgggcgctgaagggcgagggcattgctgtggtcaaaattgacatccccgacgtgaaggaaaacacactcaacgaggctgtgtcggacgacttgcgcaagacgttcgatgcaattgagcagaactcgtcagtgcgtggcgtggtgctgatgtccggcaaaccgaacagtttcattgccggtgccgacattggcatgctttcgcggtgcgcaacagcggaggcggcggcacgcatttcgcgtgatgccaaaatccattttgaacggatggaggccagcaaaaagccgatcgttgccgccatctccggctcgtgcatgggcggcggcttggagatggcgctggcgtgccactaccggatc

SEQ ID NO: 92547 - DNA, 565 bp, Heterodera glycines
  SCN-specific regions: Sequence locations=1-173,195-438,474-565
atcgtgactcctggcgagcacctcttttcaacactcaacacgcactcgatccattcccacgcgctagccgccctttcctctcctcactactcccaccatgacccgccccacgacccgccgctcgtccctcaagttcgccctgggcgccgccctggtcctcgttgcgctcgccgcgccgcgcctcgcggccccccttccgaacccgcagcaggcctgccagggactcaacgacgacccggaagccggcgggtgctcgaccgtcggtggattcactgccccgattgtcgacgaggtggccagttccgaggccgcgtcgctcaagaagttcaagcgttcgcccgagcccgaggtctcgggtgtcagcgaggcgcctgccgtgttctttgagcctggtcaggacgacagtgatgacgatccggccacgctggccaagcgccaggccgaggcggaggaggaggaggacgacgacgaggccgatggagatgcagagttggccaagcgcgagccgcatgatgatgaggaggaacatgaccactttgtcaagcgtcaagcggccgaggccgag

SEQ ID NO: 92548 - DNA, 481 bp, Heterodera glycines
  SCN-specific regions: Sequence locations=1-481
gtccaattaagttaaccttctgcttgctaattacgatggacgcggttggtactgataaattcggagtcgcgtggcgatcgcctaactctccgccccacaatcagtacccgcctacccaacgttggaggggtcctccccagcagaatgatccatcgattgctgaccaccaaccgctgccacgccaatgcgccgtcgttcctccgtcgctctcttcgcccgcccctttcgccgccgttgccccaaagtgccaattcggccccactcgccccccaatcgcctcagagcaaacgccggcgccatatgtccattatgccgagccaaactccgaacattttgccaatggcatctcttcgaattcgcactatcccctgaacagtgagcaccaatttcactgcaaaagttcgccaatggtcccaaaacaatcgcactttgatcagtcccattttgatcagtctcaacttggccggcaaaggtgcgttgt

SEQ ID NO: 92549 - DNA, 582 bp, Heterodera glycines
  SCN-specific regions: Sequence locations=1-546,568-582
gctcttcggaccaacagcatcaacactatcaacagctcccgtcctgctccaactcgggccgaccgtccgacgcggccgaattttttggagtcgctgctgaacagtgctcactgcaccatgaacttgcacttgttgctgaacaacatgccgatgatgaacagcaacataatgacatgctgatgatgatggacggtggcagcggcggcgcacaatcgtacgatgtgccgtccaaggcattgtttgaggccgtgtgcaggacatttgaggaacgacgacagttcaagcggctcagcccgtcacggcgttcactccgacagcagcagcaaatgatggcattggacgaattggcacgggatgaggcggagacaatgacgacaacgctgcttgaagaaaaagatgtagatgaacaggcgacaccgatggcacatgatgaccgaacattgctcgtcggcggtggagagggacggggaacaacgacgaaagaacagcaacagaatcggaaccgagcaaacaccggcggcagcaatcaatcgacaccgacgaggcgaagggctggcacaactgctcattgtcgtgatgcgg

SEQ ID NO: 92550 - DNA, 498 bp, Heterodera glycines
  SCN-specific regions: Sequence locations=1-207,229-498
acttttccatctctctgcaaaatgccaaagaatcgttggagatcagctgtttgccgggcacaagccaaattcgactgcgtgcaactgcggcgacatgcggcggttgcggcaccgtcggaagttccagcgacgacggcggaacgacggcatttgcaagcggcggaccgaccggtgccggggaagtggttctgctggacataaaaaatgagattgaggagttcaagaaggacctgaaattcctgcagttcatccaatccgacgacatttacaacatcgaacagttcatctccactttgaaagtgtaccatcccgtctccgagacaacgtttcgggaggaagtggcggcggtggtcgatatgttcatcgacgcggatcatttcaattactttttcactgatcgggacggcactttgaagtcgtacagctgctcgtacgtggccagcattcagcccgcctattctggcgtcatccaagcccaattcgctcgtcgttgtgctc

SEQ ID NO: 92551 - DNA, 163 bp, Heterodera glycines
  SCN-specific regions: Sequence locations=1-163
tgcggcgttccaaagtggatttggtggtgctgctccaccatctgcgcgtgggcgtggtgggcctctcggtcgtgggcgtggcgctaccgcagggcgaggacgtggaaaggacgccgataaagaatgggtcccggttactaaccttggacgtcttgtcatggat

SEQ ID NO: 92552 - DNA, 479 bp, Heterodera glycines
  SCN-specific regions: Sequence locations=1-396,418-479
gtttgagcgccaacaatgactcgccatgccaaaaatgcaaccgctgcttccgtctacacgtaccacgagcggagaaaggacgcgtcggcttccggttacggcacgctccatgaacgtcttggcaaggactcaatgaagccatttgattgctgttcgttgagcctacagccgtgccgcgaacccctgatttcgcctcagggcttcattttcgagcgggaggccatcctcaattacattctggaccagaagcaggcgtacaagcggaagctcaaaatttgggagcagcaacagcggacggagaaggaaaaacaggaggcggttttgcaacgtgaagaggaccaaatgaaggcaaagtttgcctcgctggaggcggccccggtgccgtggaagaccgaagtgccgcccgccacgcccgccggcaactcgcggcccccgaagcgggcggcggcgcgtgaagacgacaagtccgggccaaacag

SEQ ID NO: 92553 - DNA, 463 bp, Heterodera glycines
  SCN-specific regions: Sequence locations=1-463
ttccttcttacaccgcttccggacgactgtgaatccgcccgagacgcaatcaacaaatattgtcccaacggttggatatgcgacagtagaactttctgctgctgggatgctttgtcctgcttatgacatgagcggagaggctcgctacacaaatctgtgggatactctatacgataatgttcatgggatctttttcgtcgtgtacagtacttactaattgcgacttgcagtggcccgggatgagttgtggatgttgttggaccacaaggacttaaccttcaaggggacccctttgctgatattggcccacaaatccgacctgaaagatgccgtcccggccaccgaaatccacctgaaccttggactcaatttgatcatgaaccgaagttggcacatcgtttccacgtgcgcattgaccgggtcgggcctcgtagaaggcatcgattggctggcgaataacata

SEQ ID NO: 92554 - DNA, 385 bp, Heterodera glycines
  SCN-specific regions: Sequence locations=1-385
tgtcggctcgaaggttttcccctcgcccctgtccatcctccgttactctgtctccactttatatgccatctatgaccaattgaactgctcggaccacgaacaacgactgcttctactattggactgaccactcactcaaaaagaattgggcccttctgctgatgaaattgaccgacaaaatgaattcacaaaacttcgcgatttttggggattacttggccaacaatggcttttaagggtcacagtgacaaaagaccatggaagttcggatgcgcattatttggaacaatgcattgagatggaggaattgactcgagctaccgcatcaatcgctctcatttatggggtccattccaatctttgcgtcaatcaaatacgacaagga

SEQ ID NO: 92555 - DNA, 481 bp, Heterodera glycines
  misc_feature (243)..(243): n is a, c, g, or t
  SCN-specific regions: Sequence locations=1-5,70-177,200-481
aggacgcggtggtggcggcggtggttacggaggtggcggcggttacgccggctatggggacggaggagggtacggtgcggcaccaaatgcctggggcggtgcaccgatgggacagccggcggcacaacaatggggaggttatgttggaacctacggcactccgagtggcacttacggtggtcagcagcagcaagcggcgccaatgggtggtcaatgggggtggcggtgctgccgcacctgtcncagcgcaaccggaacaaatgggttggcaacaacagccggccggcggaatggcctctgcaggcggcgcacaatggggccaacaacagccggtggacaccaaccaatacgcttggccatcaggcggtgcccagcagccccagcaatgggctaacgacccattctgagctgaagatgcgcgatattgatcgactataccttgaaaatggatgaaatctttttggcactttgccccatttaa

SEQ ID NO: 92556 - DNA, 615 bp, Heterodera glycines
  SCN-specific regions: Sequence locations=1-615
cacaacttccttgaaacttagtgaaactttttaatttatgcctccctcctccccctgcattttcaaaaataatcgactccaataaaaacacatgtcatcgtcctcttcacacttgtgcaatgcctcgcgttttggccaacactctgtggacgacaaaaaaccaatgctccaacggatgttagacggagaattgtaccgatgcaacgacccgttggtgcagaccgagttggagcagaacgagttttggcttgctcgcttcaacgccgcgctttcattgccggtgacggaacgcaacaaaattctcagagaacggcttggccacctcggcgaagggagttcgattaggccaccgttcttttgtgatcacggcgaggatgtgttcctcaattacaactgttgcgtgttggacgtttgtcgggtggaaattggggacaaatcgatggttgggcccgcggtgcaaatttacgcggctgaccacccccgggaccgagcagttcgggaccagggctgggaatacggaaggccggtgagcattgggcgcggtgtgtgggtcggaggcggtgcggtcattttgccgggcgtgacggtgggcgacggcgcaatcattggagcgta

SEQ ID NO: 92557 - DNA, 481 bp, Heterodera glycines
  SCN-specific regions: Sequence locations=1-481
aaaagactcgatgcatttctctgtgtcgccgacttgtcctccaaatcattagatcctattgccgattccgccatgcatccagacgccgcccatgagcccgctccggcaaggccatcactcgcaccacactcgctcgcaacgcccccagtacccgccgatcacaccagcaacggcatcaacgacgcagactcggccatcgttgcccgtgcgctgtcctcatcgccaaacgccccaccgggccacccggcatcaggcggcgactggatcgacattgatgcgcagattggcacccggctcgacccgccactgccgtccatcgccaacgtcctcatcacaggcggcgctggattcattgcctcgttcctcgtccgcaagctcgtccttctctacccggaatggcacattgtcgttgtcgacaagctcgactattgctcgtccctcaaatcgcttgccgacctcgaatcccggccaaattttgcct

SEQ ID NO: 92558 - DNA, 439 bp, Heterodera glycines
  SCN-specific regions: Sequence locations=1-439
cctgtgaaacgcggtgccattcaacgagacgccggtgaatgcacgcaaatgtcagaccattctgtgcagattgctgtacttgctgcacacggggagaccattggcaagaccgaggacacacgactcatttttcgccatcaccaaactgtggcaggccaaggacatgacgctgcgcatgttggtctacttgtccatcaaagagttgtgccaaatgtccagcgatgtgatcattgtgaccagaaatctgacctaggacatgagcggccgtgacgacgtgtaccgagcgcccgcaatccgtgcgctttgacgtattctgaacgacaccggcatgctccaaggtatcgagcgctacatgaaccacgagattgtggacagaaccgatgccgtgtcctccgccgctttggactcatagctccatgtgatacgcaaaagacccgaa

SEQ ID NO: 92559 - DNA, 106 bp, Heterodera glycines
  SCN-specific regions: Sequence locations=1-47,72-106
gtttgttctgtctgcaccccaccacgaattgctggcgatcggagaaaatatattttgtcttcattttaaaattgtctatttttgctacggaatgaacattttaaat

SEQ ID NO: 92560 - DNA, 224 bp, Heterodera glycines
  SCN-specific regions: Sequence locations=1-224
atcaggcacaacttcacaataccagtggtcgcagtagcagcaatggggacagtgcatttgctcgccgtatccagcaacattttcagcctggcgacggtgcgcagcgtttgtacaaaatggtccagcagccatttcgggtcaaattcggaaatggcgaagttgagcaacaacgtgccggttcttctgccattcctccattaacaccgtttttcaaagatgcacac

SEQ ID NO: 92561 - DNA, 629 bp, Heterodera glycines
  SCN-specific regions: Sequence locations=1-1,25-629
gtttttgtattaaattaataaaatggccacagaacagcagccgagtgataaagtgcttacaacaacaattgatgcagaagctgatgatggacgtgacaacaatccgatcagagacatacgccgtagagttcatttcagcgatcgctcccaaagggttctggacgactcggaccatttgctgaaatccatccgaactcgccgagcggcacctctcgccacttccatgtccatgtccacgctacccacctcgttggagcgcaacggtgatcaaagtctgcaggaccatgcgcggaaaacactgatcagagcgcagcgatcggtcagccccgaagagccactgctgagcgcatcaacgagccgttatctgcagcacaccccgaaatttccgagaatcgattttgacgattggattgaggaggaaacgcaagcgaaaaagccggcatggaaagtgctccaagagaatgtcaaatcgtcctacaacaaaccccgggcaaccgcggaaaggcatcgaaatttgaacgattttcaaagtgcacaaatggacaatttggaattcaatcgtgcccgacgacgacgcgaatcggcagaccttccgtttactgaacttacccatttggacggcgaaagct

SEQ ID NO: 92562 - DNA, 259 bp, Heterodera glycines
  SCN-specific regions: Sequence locations=1-259
caattcgacaagcccctttttctcttcaactctttttggcactgaaatatgctagcgcaatggtcgtttcaagcgaatgctgcagctacagctcaagcggagacaggccaataaatgagcggacggacggcaaacaaaactcagccgaacgcggaaacggagggactggatgttgttgctgttttttttgttattgttgtcaaccgcccctttactcagataagatttgttgcaataatgatggaaaataaaaaaaaaa

SEQ ID NO: 92563 - DNA, 470 bp, Heterodera glycines
  SCN-specific regions: Sequence locations=1-62,88-323,345-470
ccatttgaccggaccaagcgcttttacaacatcagcgactacataagcagtaagtgtttggtggtctctttcctctctcctttctgtgcgccggtgcggttgggccccaaaatttcgtttcccccacccgtttgagccaccgtcgtgtccattgcgcccgccagcgaagagttggaattggaaattgacgagaacgagcaaggcatcccggcgtattgcaggacttcgatcggaccacttttgaacacagcgaacacatccaatcgttgcgcgacaaccccaatttgtccgcccaactcggcgttccgttgggctgtgcccgttcctccggcctcccttcactcagtgccaaattcgccgctttcgtgcgccatgacagcggtggcatgtcgccctcatcatcggccatgccaaccgcgcaacagctgcgtgccgaacagtcggccaaattggcgatggcacacgtgcga

SEQ ID NO: 92564 - DNA, 590 bp, Heterodera glycines
  SCN-specific regions: Sequence locations=1-145,167-328,350-539,561-590
catggtcaaagaaactgaggatggtcattaattggacgcattaactgaactagagctaaggtcatttgtgtttgcttatttattggtgataatgccttttatcataaaggaacaattccatgataaatgcaaaaagaaacgattattcctcttccaaatacctcttcccctttaggatccatcttcgccccgaagaatcgctctttttctttatcaacagcgttatcccccaggttttggttgctttaatgttttccatttatgaggtttaccctcagatgttttcctttcagacaatgacaaccatgggacagctctaccaggttcatttccatttgacctttaaaaggttttaagagggaagccaaacgagattcgaagtggcacaaaatcggcagttgtgccgataatccccactggttctttaaaacaaaaaatgggcaaattacaaagggacctttgcttttctattttgattcactttttttgttgcaagttttggtatgtcttttccaaatcgctttaattttttcttgggtttcaaaattaattcttttttcaggaccgccacgaggaggacttgttcatgt

SEQ ID NO: 92565 - DNA, 616 bp, Heterodera glycines
  SCN-specific regions: Sequence locations=1-616
ctcgagtcaaacgatccgttgacaaagttttttgcgctttatctgcttcaacgaatgtgttcagccaacacttcgacgcggaaacccttcttcgcattgagtcaacctggtggacatccacgaaattggcattctctccgtgatgtcgccattgcgcacgtacgcaatgtccgaaatattttccaaatagccactcattgtaaaattctggtgcattcgccgggggttggaagtgcgtcgattagcaagtctttggccgatgcgtccgttttcgacaaatcggaggaagttgacgaagataatgctaataaatcattggtgaacagaaatggcagccttttgttgaactcctcgacgggctcaaccggcgtactgaacgaactttacgaggccaaacactccttttttgttcccccttcgctcaacccgcgctcagctgatgcttttctttccgaacgcgtccattgccgtcgtcgtctgattgttgtgccgcttttttgtgatttcattgtcaacagatgcaaagaattgctttttgctcctgcaccgattgtctcttcctacgacaccctttgcactttatatgcaattaaagctctttccaaagtgatctctc

SEQ ID NO: 92566 - DNA, 596 bp, Heterodera glycines
  SCN-specific regions: Sequence locations=1-391,413-482,504-549,571-596
taagaaatcagcaaattcaatttaatttttctacctaattctttaaaattcttttcttttttccaccaaaaaatggtgtttttcatttgcgaccaatgcggcgagaccatgaagaagaagcaggtgctgcagcacatccaccggtgccgaaacgcgcactattcgtgcatggactgccaagtggtgttcgacaaaaacagttaccaagggcacaccaaatgcatcacggaggaccaaaagtacggaggcgcgagacatgtgccaaaagtgaacaagggtgaacaaaagcaggacgcctgggtgtcgcaagtgcgtgccgccatccgtcaggtggacgagccgcggctgaagaatttgttgcgctccgtccaatgccacaccaacataccgcgcaaggaggccaaatttgtcaactttttgcaaaattcgttgcgcattcgggaccgcgcgttgtgtgtggacgcgtggaatgcaatcaaacgggcggcggacgcggaggcggcaaaagcgaaacggacaacggcggaagacgccgttgtaacaacggcgacggaggagaaggagacggcggaacacaacggcgacgacgcggacaa

SEQ ID NO: 92567 - DNA, 621 bp, Heterodera glycines
  SCN-specific regions: Sequence locations=1-68,90-621
cttaagcgcttacacattttttgccctctctctctgttgcgctatcacaacacaattccaattcgtcaacagctccttttccctcatcgacgagatgacttcttcaagatcgcgaactcgtcgtacgacttcaactgctgcttcaaccgctgctgctggccgtagtcggagccgttcaacacatacgggtcgtcgttccgcgagcagaagagcaaccggcaacagggcaacgggtcgttcaccgtccgtcaggaacgcgtctcgccgagtgtcgtccgcgaagaaaccgtctcgccgacgtcgccggattgtggcgcgcagagccacgccaaagaagcggttcaagtcgaccaagcagcgtggacgtccgagaaagccacagcgtggacggagtgcgcagcggagagttaccatcacgcaaggagtgttggatgtgcccggtcgtggccaaatgacggaagccgagctgagagaaatcttcatggcgggcacggaggcggcggataaacgtaataaaatgatgttttggtcaattatcggcctcctgttttttaaatgtattcatctgtttccctataaatttatcctccgtcaaatccatccatatttatataatttcac

SEQ ID NO: 92568 - DNA, 473 bp, Heterodera glycines
  SCN-specific regions: Sequence locations=1-61,85-163,187-210,331 -426,450-473
cttgaagagcaacgcatcgaagagcaacctcttgtcccggaccacgaccaccaccggcctcgtctctgtctctggctctggcccgctcccgaccaacccccgaccaactcgtttctccccacccaactcaacccgccatcatcacgtaccatcaacttcaacaactgcaacctgcaacctgcaaccatgtcctcctccctctcgctccgtgccgctaccgcctcatcggcccgccgcgccaccgccaccgtcgtcaccgtcaccgcgacctcgcgccgagccctcgccacggtcgcctccaccaccaccgccgcgcccgccgcgcccgccccaccccgcaagtacggcagcctcaaggaccaagaccgcatcttcaccaatctgtacggcttccacgacttccgcctgcagggcgccctcaagcgcggcgactggtacaagaccaaggaaatcatcctcaaggggtctgattg

SEQ ID NO: 92569 - DNA, 517 bp, Heterodera glycines
  SCN-specific regions: Sequence locations=1-464,487-496
gtgcgctcaaccgtccatctggtcatggtccccgcaacattcgtgactacaagtggactggagacgacccgaccatcattcccgccgaggccgttctgctcttgatcccgtcgcttgcccgtggcccgcatcgcgatcgggccaaggctttcgccattgtccgtcagcgacttgccgagctcggaatcaaccgcgacaattgcgccgacaacccagcgtatccgggttggcggaagtcgtgtggccagaacggctggtggctagcgacgttgtctgcgttcgtgcgggacatcttgcctgtcttgcccgcaatgaggaaggccctcaaatgtcgggggtgcgaggcttgcagggccgcgcatgtctaagtggtcaagaatgtgcctgatcgtggccattcgcattgcttgcagacatatgatttgcttttgttgccacatcgtgccgagttgtccgcggtgtgtcggtggaaccccaaaatagttgtcacaatcgaagaaaaaatggtttcatcgaa

SEQ ID NO: 92570 - DNA, 216 bp, Heterodera glycines
  SCN-specific regions: Sequence locations=1-145,167-191
atggcattcgggtttgtgccactgaatgcttttgtggcgatcactcggagaaacggaattgttttggtgagaaacacaacgtcaaaatattaccatcccgccagaatacacatccttttggttgatcaaaacgccatttgatcaattgttgttgttgttaattttgtttttttttgcaaaatttgaattataaaaaaaaaaaaaaaaaaaaaaaaa

SEQ ID NO: 92571 - DNA, 624 bp, Heterodera glycines
  SCN-specific regions: Sequence locations=1-65,87-556,581-624
ctcgtgtttaagccaaacgcacaaatgggccgaccatttttaccattggcattttctttggttttgctgctgctggcggtggtgatcagcaccaattgcgcaaatgcttctccgatcgttggagaggaacagcccatggcaccggaacaaaaagcgacaaaaggcaccaacgacggacaaatgggcgacgacaatcggaccaatcggcgcaataacatggctgctgctcagcatcaacagcagaaccgcaacgccacatccttggtggcacttggctggttgggcttgcgtagcggcgcgagcagcgtcaacgcggtcaacgtggcgtcatgttacgacagccgactgtccagcttcataaacgacggcctccgctattattcgattaagcgtgtccgctactcgggctattggtttgtgcatgcggcaatgatcggcggacaaacacagggactccaatggcagtcgcaatcgaatggggacatttttgcgcagacgagtcggcacggatgctattaccacgacacacagacatacatcataatcatccgatactgagaaagaaaagaaaggaaagtaatgttatgcgaatcaaagaaacgaagtgacagaaaaatttatttt

SEQ ID NO: 92572 - DNA, 627 bp, Heterodera glycines
  SCN-specific regions: Sequence locations=1-14,37-75,161-244,274 -400,446-627
ctgaagatgaaaagtgccggtgccaccaccagcagccccaaaaacagcatctccgccatcaacaacgacagcggtgccgtcgccgctttcgctgccgcaacgccgccgacgaaaattgtcgctgccgccaaaccgtcaccgccgccaccgtcgcagcagcaacagcaacagtcgatccgcgtcagcagcttcatctcttccaacagcagcccgttcaacaacaccaatcagtacaccaactcgaacaggggaaccaccagcagcaccaacaccggtggtggtggagccaatgccatgagcactgtcagcaacaacaacacaaccagcaccaccaccgtcggcagggacctggcggcgacgacggctgcgaccattgcggctgtgccagcaaatgtgaaggacgacaaccgcgacgacagcaacaataacaacaaaagcagcaatattgccaagccgtacaccaacccaaacagtgccaagagcatcaccagctgcggcagggacgtggcggcgaccgttgcggctgtcgcgacggtgaaggacgacaaccgtcgcgacgacagcaacatcgccatgttgacgaacacctgcaccactggcaagagcaccagtggcagcggcggcgac

SEQ ID NO: 92573 - DNA, 618 bp, Heterodera glycines
  SCN-specific regions: Sequence locations=1-377,399-618
gcgatatatgcgagatgcaaaaaagacggtgcacttttacgaatgcaatgcgcagggacaaatggtccatgagaagatggtcaaggattacagccgatcggctgctgatcaggtgcccttattgtaaattgaattcgatgtttggacagaatgttgcatctaatctctttgcttttcccttttaggatactccactcgcacatgagcttcgtccgctgaagacattgcaactgacaatggattatctcattttcaatgttcgcattggatttcccaaattatttggccttaaaatgacagatcgccggcgaaattccgtcaacttcgagcaatgatttggcgcgatggtacgactttctttggtcgaggacaagagcaatcagaaaagtaattgttggatgattgtaatatttattaccaaacctcaatggatgcttataggatataacgcagcaaatgttaaacaatgaaatggccgtggatttggttgagaaatgcgctcggcttcacatttttgcatcttttggacttgttgaactcgaagcggatctttttgatcacaaaatgaacacgggtattacagggacgtagccaggattttggtctggggggtggtac

SEQ ID NO: 92574 - DNA, 536 bp, Heterodera glycines
  SCN-specific regions: Sequence locations=1-536
gctaagcctatgtgcaaattgtctgtgttgtatgagttgctattgtacgttttaccgtgacaccaatttcacaagagagcaataccatcatggttgaatgcaaataaaaaaagaaatgctaattaccggggcacttcctcactcaaggaaatccaccaatcattaatttgaacgacgccaccaaaaacccccaaaatcggcgggaatggcagggccggacagacgcggtccccttcgcgccctcactaccaaatgaaagcactcaaggccgcactgagtcactatttcagcccaaagaagcgctcccccggccgtccggcgcaaagaaaagtgcaatttgatgatacatcatcacattcggaagggtctgatggggaagaagttgaggaagaacgaaagtcggaaaaatgggccaaatgcgattccaacagaagcgatttcgccgctgtcaaatgttgctttgaaaaattggacaatcatttgccttggaagttcaaaaggaatctaaacggagaaacattcggcagacatttctc

SEQ ID NO: 92575 - DNA, 611 bp, Heterodera glycines
  SCN-specific regions: Sequence locations=33-215,237-611
cctcgtgccgaattcggcacgaggcaataaagaaaaagaatagcttgggaatattcaattttttttataaagcagaaaatcgtgtaaaatggctaaaaaacgattaccattgtcggagaatcagcagccgactccgccgaagagaaaagaaatgctgcctcttcagacgtggttcggaacggacaaacaattcgtaactttttctgtcaacgaggatttgcgttgggccgcgagttcgaacaatccctcgacgagcggtgacgccaaaccaaacgaaaagcaaatgatgccgaaaagggacggcggaagtgccaatgcatcgcaacaaaaggcggtggtggaaagcgtgttctgcgcgccctcgcaactccagaagaatctccatgcttctgtcctgtatttgatgtctttgcgtgacaatgaacaacaacatttgttgcgtttgctgtgtaatcatccgattttgctgtatcaaaaagtgttggaaatgtccggcgacttgcaacacaaaggaaccaaaaaggcgaagaaggaatttgtcaacttttccggcgtcatttgccacttccccactcgctacgaactttgccaatgtcgaattgaggactcag

SEQ ID NO: 92576 - DNA, 400 bp, Heterodera glycines
  SCN-specific regions: Sequence locations=1-400
gtggcccgtaccagaaagagatttcgggaggggagggacccgaagagctttttaacgaacttgggttctccccgaacatactaaatagaatgttaacgaatgggacttggtagaactctgggacagttggactacactagcatcagacgcaaacttcgaagacaacagtcgtgttggaaccataattctccagctgttagccgaaaattaacaatagcaaattgaccatactctacacgataaaagactgaattcttacaaaattatttacacataaacattcactcaattattatacagtagtcgtaaacttattcgttaatttaattcatttacaaattagcacataaaagtgtcaaatcgtacggaaatccgtgccattttcgcgcctttctctcct

SEQ ID NO: 92577 - DNA, 625 bp, Heterodera glycines
  SCN-specific regions: Sequence locations=1-625
gagatttcctagcacagcatgagcgattatgacaaattaaaattgtctccttcaaaacttggcaatctgcagatccgccgaacgcaacgaacgaagaatgcgcgtgtttacaaaaaaatggcgaatggaaaagaaaattggtatccacttccggaggaccagctgcccgccgaagttacatcattccgattcattgaaataaaatacgtcgatttggatgtcattgcctttctgaaccgaatccaaaggttgctccaagatggtgagatgactttgcgcgttcggatcttccaccatcagcgacgcagcttgcaaattttctgcgcccaaatttggccactcatcaacaaaaacatcgtcaccgccgttgtctacccatcgatttggctcccaccgctccagcaggacaacgcgcaacaacacaccacgctcaacgacctgcccaatctgaaattgctggagtactgtgacgtatcgcccagccaggaggtgatcgattggctgcacaattcgagcgcggacggacggccgaaggcggtgcgctgcgggttacctcgtcaaatggtcgacgaactccgagcgcgatttgttgctgcatcatcgccgacaattttcattgttttgg

SEQ ID NO: 92578 - DNA, 374 bp, Heterodera glycines
  SCN-specific regions: Sequence locations=1-50,72-374
tgccttttcatgacataaaagcattaaagatgaaactgtggttagccatccaaaacaaaacaatcgattgggcctcacaacatctccacacacaataatatatacttgttgagcaagatactacacgttactctctctcaaagaaaagaatctaaagtagcaaaactttaacaaaagagcttcaaatttgcttcggaccttccatttacacaagctcctacctcaagcaaaaaaaacaatcagagagaagatctaaagctctctcaaacaattccaacacaaaaatggaaacttctagaaactccaccaactcatcactcttccaatggttaggtcttctagaagattctgatcagcctcctgattctacccct

SEQ ID NO: 92579 - DNA, 359 bp, Heterodera glycines
  misc_feature (338)..(338): n is a, c, g, or t
  SCN-specific regions: Sequence locations=1-91,129-138,170-338
gtcaaaatgaatttgttttcattgactccattggtcctctgttccctactttttgttggggcacctgttgtgcaaagtgccggaaaagttgcgccgccgccgccaccaccgccgcctccccctccgcctccagcgtacgagccaccagagccgccaagctatggcgcccaaccgccaccccaaccagcgtattagcctccaccaaagtcgaaaaagccgaattgatgagaacgagatgagaaacaacattttcccaattttgaagatgattaaatttctttgtgctcgattatttaacaaattatgaaattggctgtttaataaatatttgaatgacnaaaaaaaaaaaaaaaaaaaaa

SEQ ID NO: 92580 - DNA, 439 bp, Heterodera glycines
  SCN-specific regions: Sequence locations=1-281,304-439
aatattaccacggcacggtggcactgtttgagagggccttgcccttaaggacaaactcaaaacaatggtttgcacacttgttcaggacgtgtgaaacaagaccgatgaggaaactggtgacggaaccgcttgtgccactgtgttggtacgtgccatcacaaaggaagggttcaagaacatctcccaaggggctaatccggaggaggggcgcaagggactgatgaacgcaatggacaaattggccaaggaactgaaggccatgagcaaaacagcgacaactcccgaagaaatcgctcaagtggcccctattgcaacgaacggatacaaaaccatcggaaaactgatctcggatgccatgaaaaaggtcggaaacaagggtggcatctcggtataggacggcaagaccttgttggacgcattggaaatggattgagggatg

SEQ ID NO: 92581 - DNA, 366 bp, Heterodera glycines
  SCN-specific regions: Sequence locations=1-366
gttgatttggcggagaaaaacttgagcaacccgcatcggataaagaagatcctcgacgggaaactatttccgatgaaagcgctcggctatttcggcgttgtcaccggcatggacaagcgggacgcgagcattgcggagatccgcaaatacgaggaggacttcttcgagagttccaaactctttagggatggcgttttgaaggccacccaaatgacgacgcggaatatgtcattggcggtttcggactgtttttggcggatggttcgcgaatccatcgaagcgcaggcggaagctttccgcgcccatcgcttccatttggagaacggaaggaaaacaacttttgcgcaccaccccgacttgaccagg

SEQ ID NO: 92582 - DNA, 491 bp, Heterodera glycines
  SCN-specific regions: Sequence locations=1-143,165-491
tctgttccccggcagttcgaccatcaaccaaattgagaggataatgaactcaattaaccgaccctccaaacaagacatcgaaagcattgggtcaacgtacgctgcgtcggtgctggacaaaatgccgcaaagacccaaaagaccgttggatgcgctgttggcacagtcattcccggaggccattgacctcatcaatagattgttggtttttgcaccgcacaagcgactgaacgttgagcagtgtttgacgcatccgtacgtcgtccaatttcacaacgcatcggaggagccatcgttggattacgaagtgaaactgtcgttgccagatcatattcagctttctgtgcacgaataccgagaaaaattgtatgaaataatttcgacacgcaaaataaatatccgacgcattcaatacgacaaattaacatcgaatgaatgcgaaggccaccagcggaaacaaatgatgacgaacggaagtcgggaagagaaca

SEQ ID NO: 92583 - DNA, 588 bp, Heterodera glycines
  SCN-specific regions: Sequence locations=1-310,332-477,499-588
ttatgcgcgatttttattcgcttttaaactgtgataaatccgcatccgctgaacagcttaagcaagcgtatttccaacagttgaggaagtgccatcccgacaaaaacaattcgttgcaacagctcgacccatttttggatttggtcagagcttggaaagtgctaagtgacaccgttgcccgtgcaaattacgactgttggctctgcgagcagcaattccgtgtggacaaggagttgatttttgacgaaatttggctgaactcgtcggcgccgtttccgtcttcgccggtgccagttggtggtgattttgaggaggagtgtcgctgtggtggcatttatcaagtgtcggccgaggcggttgaacagcttgcgcttgactatctgctcgtggactgttcaaactgttcgctgactttgcgcgtttggcgttgtgccgcctctccgtctccaccccgtgaagaagcgtcggcaatctccaaggccaacgcttaattaagccttctccaaaatggtcgtcccctctgcgctcgccccaccgttttttgtcgtccatttgcgcccctttcgcccgcgcgcaatgccctcaaaa

SEQ ID NO: 92584 - DNA, 334 bp, Heterodera glycines
  SCN-specific regions: Sequence locations=1-266,288-289
atgcgtttgctgtgctgttgttgctccaacaatgcacaacatcatcagcccatcaaccgggaaggacaagacgaattaaactgaagatttgatttttttgaacgcccgaaaatgaatcatatggcgaagatttttatacaaaattggcattttaaattttttttgatcccacattttttgctttatttttcttcgttttgcaacattttttcttctgcttttcctattctcgccttcttatacaaattgattgtttcaccttctcagaaaagaaaaattcttcttttataaaaaaaaaaaaaaaaaaaaaaaaaaaaaaaaaaaaaaaaaaaaa

SEQ ID NO: 92585 - DNA, 500 bp, Heterodera glycines
  SCN-specific regions: Sequence locations=1-112,142-500
attaagtgctcaatgccaactgcgccttccataattgctcatcgtcatcatcagcacaacgaccgaattcaaaacgggcacaatgccaatgttgtcgtcgccacaaatggcaatggcaacaacagcagcagcaacggcaacggttgcgcaccgatcagccaccaccgatcagcagcagcgaacagggcactcgcaatgccaaacgttgaccaacaggcgaaaatggcaccgacatcgcgtaaaaaagggattattggcacgcgcgatattgttgatgcaaaattgtcagaaccccggtgctgttgtggccttgtgcagattaggcacgtggccattgtgttgggtgtcatggaattcatctttttcgccactcagctgatcgtttcccttgttgaccttttcggcaccgccgacgacctttggcctaaatccgcttccaccctgtccatccttctcacaatcatttcgctgattttggccattgcagctgcaatgcttct

SEQ ID NO: 92586 - DNA, 629 bp, Heterodera glycines
  SCN-specific regions: Sequence locations=1-629
gtttgaggcgtccgtccgttatgaaaatgcttttgggcgctgctgccattttggcatttgcttctgctgactttgtattcggtggtggcaatcaaatggaatttgatccgacggcgccgatgttccccgattctcagttcatcgatttgatttcgcgtgacatcgaatcattctccggcccaatggcttttggccacaaatttatgagcggcggtgccggcgaaggcgaccaacagctcggccccgacggacccttcgagcatcggcagcaagtgaaaagtgacagcgtactgcccgcttattgtgagccgccgaatccgtgtcccgttgggtacagtgaaaaggacggatgcatggaacagtttgataatacggccgaattctcgcgcagttaccaaggccagcagcagtgcctatgtgaccaggaacacatgttcaattgcccgtcaaaggaaaacgccgaagagtacgcgcagggcctggagcaactgctttcgaacaacggactgcacaaatcaatgatcgccaaaaagttccatctgacgcgagcggaggaaccgcgccgtcggaaacgctccgtcgcttttgttggcccggcacacgcgacgcacagccgctacaacccgtac

SEQ ID NO: 92587 - DNA, 386 bp, Heterodera glycines
  misc_feature (51)..(51): n is a, c, g, or t
  misc_feature (92)..(92): n is a, c, g, or t
  misc_feature (128)..(128): n is a, c, g, or t
  misc_feature (157)..(157): n is a, c, g, or t
  misc_feature (159)..(159): n is a, c, g, or t
  misc_feature (169)..(169): n is a, c, g, or t
  misc_feature (183)..(183): n is a, c, g, or t
  misc_feature (212)..(212): n is a, c, g, or t
  misc_feature (255)..(255): n is a, c, g, or t
  misc_feature (267)..(267): n is a, c, g, or t
  misc_feature (318)..(318): n is a, c, g, or t
  misc_feature (347)..(347): n is a, c, g, or t
  SCN-specific regions: Sequence locations=1-21,51-386
gtccaattaagttttgccatgcttttcctccctctctcccttttgcttttnctcctccatcgtccctttgccaatgccctcggctgtatgtncgccgtttgtgccgccggcggtccctccccctcttnccatgccgtcaatcgcaccattcgttgcncntccgaatctntttgtggccatttncgcgctttgcggcgaaatgaccaatttgncgaggcggtcgacctcagttgtcccgaattctccgtggtgcgngctccttctcgntggcgaaatttcggcttatcgtccgatgggagagagccgagcgcaggaggngacaaagggcgaatgtgtgccggatcagngagttcagatcgacggccgaagccaatggcagggcttat

SEQ ID NO: 92588 - DNA, 409 bp, Heterodera glycines
  SCN-specific regions: Sequence locations=1-202,225-409
gggccgtaagaaccggatacgtggtacctacgagaaccatgaccagttccgatagctcaccttcatggaagatgggccataatacgcccaggacgtgaatatgctcgacaacggacgtctccaggccctgtgctttgaccgcgctagcatctcgccaacgtcctccgcaagatgcacaagatggtctggatcaaccatgggtgaccttatcctcctctccctccacgacttccagaacaacaagggagacatcatcattcagtacactgcctacgaggcccgaactctcaagtactaccgggaactccccgagaacgcatggatcgacgagaccgactcgtgcttccggtgttacgatggctaggcctacttcgagtttggtgactccgactcggaagaggagtccgac

SEQ ID NO: 92589 - DNA, 322 bp, Heterodera glycines
  SCN-specific regions: Sequence locations=1-249,271-322
attctcggacgacaatgtcacgtcgatggtttgtgcaaaaaacttcaccgagaacagtgatcagatcaaccacatcaactacacaccggacggctctttgctcgtcacttcgactgccgaccactccatcactgtgtacgactgtgacagcggcaacaaacatcggtcggtgaacaggaaaaaatacggcgtcgacctgatccatttcgcacacacaaaaaccgacgcaatccatgcgtccaccaaaattgacaacacaattcgctacctgtccctgtacgacaacaaatacttgcgctattttggagggcacagcaaaaag

SEQ ID NO: 92590 - DNA, 583 bp, Heterodera glycines
  SCN-specific regions: Sequence locations=1-179,201-583
aaaaatcattagcacaccgacgaagatcacaaaaggtttccgtttcaacggtgctgcaaaaaccgttgaaggtttctttctctttggcactcactaagccggactcatccagctccgaaaattgttcttccgatgagccttccattcgcaagaaaaaacgacggagtcgccgggtcaaactaccagtaaagcaggttgtcattccgtcctctgtcaaaaaagagacaaaaattcaatcgcttccaaaggaaacaacaaaaagtcaaaaacccaaaaaggaaagccaaacgcagccaaaaagccagaagaaatctcaaaaggaacatcaacaacctcaaaagaaaagtcaatcgcctcaaaaagaaagtcaaacgcctcatccgcctccggtggaggggccgtcggtctccgctttggtgccgaacactgcggactgcaaaaggcgcgttaattttggcaacgtggaagtgttcagatttgaatttgcgcaagggcacgacactgtgccggccaaaggaggcgtctctttgggaatgcagaacactcaccacgcgagacacctctttcagttgagcgaatacac

SEQ ID NO: 92591 - DNA, 608 bp, Heterodera glycines
  SCN-specific regions: Sequence locations=1-26,68-179,203-262,289 -370,395-512,534-570,592-608
ctgatgtccatggcgtcgccggttatgccgcaacatcaacaacagcagcagcagcaacatcagccgctgggcaaggagtcgtggcgtggcagtcagcgccaactgatggacatggaggtgcagcagccgaagtatggcggaggaggttaccaccagcagcgcgggatggaacgtgacattggcggcggtggtggtggctacgatatgcgtcgcagcggcggcggtggttacgactattttggtgcttccgccggcacgtcatacggcggcggcggtggtggtggtggtcatgggatgatgcagcaacagcagccgcctccgctcggctcttcactggcgtccgccggtcactacaacacctcgctgtacggcggaggcggtggccgcggtggtgccgggccgacaccgccgaagcgccatcgctacgcgtcgccgcaaccgccgcccgtggagcgcttcttttgaggagcaaaatggacggacaacaaatggacagacgtgcaatgtgtgagagagagaagaaaggctgagatttgggagagcagaaaaccaaaaaaatggttggatgaataaatggaaatgagtttttgcgcgtattttttgcgtcg

SEQ ID NO: 92592 - DNA, 630 bp, Heterodera glycines
  SCN-specific regions: Sequence locations=1-13,35-288,310-355,377-630
gtccttcttcctccattaaaaattcatttattttccaacgaattaaattgcactgcgctagttctagatttagccttctcatcaccatttgatcgggccatcccatcaaatgacggatgatcttttcgatcaaccgccgcattcctagtcttctccctccattaagacgaattcccccctcactttttcccgcaccgatcagcatgctgttgatcccttccttccctttggcactccttccttttgctgttggccttccgtctgctggcattcgctctcttccgaatgtttcccccctctcccattgcttcggtctcagtccgccacggctcaaacgacaaaagtccgtcgtattaaaaagtgtggggacggaagaagccgagccgattgtccatagtgggaaaagcatttggattggtgcagggaagtaccagttctgggacagtgccgcttcgctggtcggccgtgggagttacgggattgtgttccgtggtcaccaatgtttctcttctgatcggccggtggcaattaaacgaatgcgtcgaatgaatgtccgtccggatgaattggaggcgatgaagcgagttcagaaccaaaacctggtcactttgctggacgtgtgcgatgacg

SEQ ID NO: 92593 - DNA, 630 bp, Heterodera glycines
  SCN-specific regions: Sequence locations=1-240,269-630
gtgagcgatcagtggaaaagcgctttcttcgagattatggcgacattttggtttttgacccctcactaatgaccaatccgaaatcaatacactcgattatcacaaaatcccgaaaaagctgattgatggatccatccaaaatccgataatggctccacttgcctgattctgtgcttcgtcaaaagtgtgcgcagatggactgaccatattctggggaattgaatccaaagtattaattgctaattagttaattaattaattattaattctaattagtctcacccggttgataatttcgcgcacccgcgagtccaaagacacctccttgggtgacagaatggagatgaaatcctcgtagataatacgtgccttaaattggacaaaacattattatcggttcatcaatcaatcaatgatcggtgccataattgggccaaaagcattatttatgaccatcatttctaggatttattaactaattgatcatttctagggtagtccggggagaaccggtcccgagtgggtcaagtaattcaatttggcgtagaattataaaatcctgaatctcaagccccgatcgatcccggctttccttgtcccgatttttgatgaaaatcccggcacacggct

SEQ ID NO: 92594 - DNA, 611 bp, Heterodera glycines
  SCN-specific regions: Sequence locations=1-165,187-439,476-611
cttcagtcgattcggtcaagtgacgaacattcaagtgcaatatgaaggacgaactgattctgctttggttacattcaaaacgcgtcgggaagcgatgtcggcctacaaatccaccgaaccactctttaataatcgttttgtgaaagttttctggcaaaatgatgcgaatggaaaagaaatagaaaacgaagatattggaggaggaaatgtaggagaaattgcctctactggtccaacaattccactcgttgactcaaatgctacaaatcggaagacagttttgaaggaacccattcaatttccacgttactttaccaaagtgtttgcacaacagaagaaggaaggtggagatggttccggatctgcggaggagtcgatgactgtcacggcggagccttctgacgacaaaaagtcccttccaacagaccttgccactgcggagcatcctccgcccgtttctgttcctggaatcactgcgcctcaacaccctgtacgaccaatatacaactcaaaattggcaactcagaagaaacgagcggcgatagagcgcgaccgactgaataaattggccgaagttcaacgaatgaagacggaactgtacaccaaacttg

SEQ ID NO: 92595 - DNA, 602 bp, Heterodera glycines
  SCN-specific regions: Sequence locations=1-433,455-602
ctcgcatcagtttctaatcaaagctcaatgttttcgataatcttcaagtttatttaccattacggatttcatccaaacatcgcattatatgagtctttccagtcatgatggatttcatcagactttcttttatggcctcagccaccccccaggatcccggaatgcggaccttgagtccgcgcatccggccctggtggttggcgggggctgaaagcgggccggaccggaggagcaagtcaaagttgactagtgcttcggatggggttggccggccgcgtcgctcgctactcgtagggaggggcgctgcgaagtctgagtcccatgggtgcagtgggtaggactcggagcgccggcgtaacacaggactccttggagtcctggccgggtgccacctggaatcccccacacatccacgggaggtaacctttccgcttcagaggctccagtgctgacggacccctcggggtacggattcccatcctcagagctgctgggaggtttaaatccctcctggcgggggttaggtactccggaggcaacggggtgctcctatgagggtggggtccggctggacactgctgcggggggccctctcgcctgac

SEQ ID NO: 92596 - DNA, 376 bp, Heterodera glycines
  misc_feature (355)..(356): n is a, c, g, or t
  SCN-specific regions: Sequence locations=1-356
attggtttgaaattcataatactcaattttatcctcctcattttgcgtgaatcgcaccacacatgtgaatttttcttgagcagagaatccatcaaaatatgcaaatttatgggccaatggcgacaaattttgcgaggaatggaacatctgaagggtggaaaaacatgctggcgcccaaccgtgagcgcccaactgacgtagaccgtttcctccacctgacaaagtgtgccctcaacaaattgccgacaatgccaagcgaaagaaggcacaaataagcggacaattggaattgcatgatgcaaaaagattgatgcgcttttgtatttctcaattagctgaaaatttttgaaaatcnnaaaaaaaaaaaaaaaaaaaa

SEQ ID NO: 92597 - DNA, 498 bp, Heterodera glycines
  SCN-specific regions: Sequence locations=1-112,134-447,470-498
ctcgacaacacgaactgacgggtaattggagtgcagattggaacccggaatatgccgaactcaaaaggccgactcgggtggactcaaatgggaaatttggcattgagctcagactgaagaaggagaaaaagggattttcgtttttctcttcgaaagatgccaatgtcaaaggcaaaattgtgcaattcggtgctgaacacgtcgcgcaacgagtgttcgagcacattcttcgcgcctgggaatacggtgtcgcggattaacgtacttttgtacgaattaatccccccccccctctttcgtcttttttgcttttcaattctaatcactgcttttgaacttagttctctttttttgatcacggctttgtgcctttcgctttacattcttctcgctttttgctgaatctttcatggactatattatatattcataacacaaactacgtatcatttgtacattttattataaatgtccggcagaaaataaatgtgaaaatga

SEQ ID NO: 92598 - DNA, 462 bp, Heterodera glycines
  SCN-specific regions: Sequence locations=1-213,235-295,336-382,416-462
atcagtcttttttatgccgacagaccgtccattgcttctgcccttcttcgcgatgtactgcttcaatttgccggccccaatccgtccgcccatttcgaatcgctcctctacaaaaccccgtccaacaacactgagtccctccgcctcttccgtcagctcactcagaatggccaagtcgatcggcaagtgttcaccccgcagttctctcgctatgcactgccttttcctggaaaacgcattttttcgatcagtgatcaacacgtgtctctcgtctgatcaattcttgaggacatatagtggatggaaaaggccaagagattcgacacacacacaaaagatccatttcattctttttgttcattatttatgcatttgactaaattttactttgaaaatatttacactttttatatatcttaaaattccatttttaattatctatttgaataaacaattgaacca

SEQ ID NO: 92599 - DNA, 273 bp, Heterodera glycines
  misc_feature (251)..(251): n is a, c, g, or t
  SCN-specific regions: Sequence locations=1-177,217-227,249-251
gaactattgccagggggctggtcagcattggcacttgtatggacttggcagatgccactctgctcatctgcgtgcgctttttcgtctttctcatctgtaattctgtgacatacaatgcacagcattccatcataccaaaccaaaaacagattataattagtctcgaaaactcaatttcatcattttcttttattacatttccctcaaaatttttcattctttgtagctttataaatataaatttatttccnaaaaaaaaaaaaaaaaaaaaaa

SEQ ID NO: 92600 - DNA, 513 bp, Heterodera glycines
  SCN-specific regions: Sequence locations=1-513
gaaatcatccaaatcaaagcagccaattcaaaatgccctctctccgcctccttccgcttcttctcgcccaattgcccttttgcgtcttcggatttggtttcgaaaacgccggcgcttcatgcagctcagatgaatattgtcccggcggttggtccgtcctgcgccgtcccaaggattactccgcgcacacgtgcaacccagctgatccgagacgtgcaaaatgcccgaagccgtacatgtgcgtggcggcgaagtgcggcatcagtttctgttgtgcaagtgacaaaatgttggacaagctgaaggaacagcagagtgttgaaagagaggcaaaagaagcagatgatgaagagagagaagaggccagacgacgagagaaagcgtcattggcggaagacgcagagaaagagagggagacggatgccatcgaacgaagcgcagggggcgacgatctttgaactctttgtcaagcccacccgttggaaattgctttttataaaacacacgtatttt

SEQ ID NO: 92601 - DNA, 653 bp, Heterodera glycines
  SCN-specific regions: Sequence locations=1-270,292-586,608-653
gcgcattgtgctaattgacacaaaatgaaccgacgttgggtttgtaccgatgtttggatggacattctaccattttttaaccgtcttcaactcggcctcaaattggcacttctttcgccacgtttcgatgttttagtggacaaacattttgatggcaaatgcgaactgacaatttggagacatatcaatattctaaaaggcgctggaccagaaccagaattatctgtacggattgatcgcaaaactatgaagtttccattgcccgaccgtccgctgcccaccaaaatccgcattaaggaccttcatatcgagtacactgaccattccgtcatcacatttctccgtgccaatcagcaaatttttgacaaaggcatcgatttggatttgtattgggatgatgctctgcatgacaacaacagcgatgatgttcagcaaatttgggatgtttttgcacgtgaaatttggcccatttttgcgccaaacattcgccatttgaatttcatttttggttacgatcttgaaaatttgcgtcgccacatttcgccgacaattctctccgacctcaacattaattcaatccattccgctgatttgttgcccgaaatgatcgctgatgatgggccaaatgcaactgctggccaagcgctgtcaaa

SEQ ID NO: 92602 - DNA, 455 bp, Heterodera glycines
  SCN-specific regions: Sequence locations=1-211,236-311,333-431
gacacgttgaaatgtgttcggcaattgattttgtacgggcacgagaatcgcatttcctgtcttcggtgcagtccggacggaacggccatttgcacggcgagttgggacgcgcccctccgaatttgggcctaacacttcgcattggccattctcttctgatcagtgatcacattttgtatttagtgcgctattgctttaacatccgttcgatttccttcccttttttctcctttttacctcagaaattcggtcccttccgtcaaatcatttttaattctcgtcaaatgttagctttttcggcattttggtcattcttcccctcccccactctctcttaatgctttagtcataatatttcttctattcagttatatccgacttccaattaatctctgtcaaaatagttttaaatgattagtaaaaaaaattggaaaaaaaaaaaaaaaaaaaaaaaa

SEQ ID NO: 92603 - DNA, 476 bp, Heterodera glycines
  SCN-specific regions: Sequence locations=1-442,465-476
gacaaatcggtgatttgggtgatcgaattcttcacaacttggtcgcctgattgtcgttatgtggcgcccgttttcagtgctctcagcgaaaggtattcgctgccgaatttgcgctttggcaaattggacgtcggcaaacacccaaaagagggcgaccatttccgcgtcaatggccacgcgagcagcaaacagttgcccactgttgcactgttcagaaacggcgttcagacggagcggaggcctttggtgcagcagcgaagggccgtcccattcattttcaacgagaaaaacctcattttggccttgggcctcaacgacatttacgcggaatgcaaaaagacggagcgaactcggcgaaagaatgaatgaataataaagtgatttgctcagccaattgtgaatttggaagaatctcaacgacaaataggatacacaaaagccttttcccttttcaaccattgcttttccctttttaa

SEQ ID NO: 92604 - DNA, 287 bp, Heterodera glycines
  misc_feature (261)..(261): n is a, c, g, or t
  SCN-specific regions: Sequence locations=1-206,232-261
aaggtgttgtagcagtaattgctgtttgcatgttcaacttctgctgcttcggtgccatcgccctcatcgtcgtccgttgaggtgccaatgctccgattgaaaattcggccgtgccctcaaaaggtgcggtggtgccaacttcggcctcgttgagattgtcctcgtcaatgtacttgaaagaagcaatttatgacaaaaacatttacgtgtatttattaatccattaaaaaatgtacttttatcattaaaatagcaattatnaaaaaaaaaaaaaaaaaaaaaaaaaa

SEQ ID NO: 92605 - DNA, 674 bp, Heterodera glycines
  SCN-specific regions: Sequence locations=1-674
gggctgcaggcggctttgttggcacggatcagcgaaaagcgcaaggaactgagcacgaaagaggcattcaaacagcaactgattgaggaacgcgacttttgcttcaaagagccggccaaatggttctcctttctgaagtcgtcggctatgaaagcatacaacgacaacatggagagatacatcgaattagcaattcaagacgcagagctgagagagacttccaacgaaggccaatcgaactacgaggagcaaaaaaagaggaccgacgggacccgaaaattgttggagttttaccgcaaagagcgcgacatgttcacagagggactggagaaggcttccgtcaacgtggaggagttcaaatttccgaccgaaaatgttgaacaaatttttgacggacttttcgcattggaaatcaccggcaaacaaatgaaggccaattacgaaactacgaaggaggcgcagcgagagcatcagaagcaatccaatgccgaagcaatgcgcgcacaaaatttggtcaaggcaaagccaacgaaatgccaaagtgcgtacaaccaaaaggcgattcagtgctatttggacgaaatgactgagaaaggccaacaacagttgggccagggttggaaagcggacggaagtgccgaggcatcgtctaatgttgacatgactgatggagg

SEQ ID NO: 92606 - DNA, 488 bp, Heterodera glycines
  SCN-specific regions: Sequence locations=1-40,62-488
tccttgacaatggtccgcttctctccgaagcattgctcaattttctattttcttcttttgactcgtccaatgtcgccaaattgaatttgatgaaaatgtgtgctgaagttcttcttcgaatgattgtcgccccggacagacgcaatttgtccgttattctttcgtcaataaaaagcagtggcagcgaatttcggccgttcgaattgctccattctttcaccaccggtagcaatttggacagcgacctttacttggccatgctcaaaatcataaaagagctttgcaagcgagagcctgccctaaagtcgcaatggtccaacctcgaaaatgtgcaattcctaagctcaaactcaatgatgtcgagcaattccgaaattgttaatttgtgctcagaagtgcttgagatgttgcaaatgggaggagaggaccaatttcacgatgcttcgctttttgatatttttatgaacgaatacacagggaaatgactc

SEQ ID NO: 92607 - DNA, 542 bp, Heterodera glycines
  SCN-specific regions: Sequence locations=1-97,119-542
taagctctaccgaacacatatatacatattatacaataatccatctctgcaaacacattgtttcaatggcccgcagatcgaatgccaccggcacgaggaagccgcaccgttaccgtccaggcaccgttgcccgtcgcgagattcgccgttaccagagcaccactgaacttctgctgcgcaagttgccgttcaatcgtttggtgcgcgaaattgcacaggacaacaacttggagatgcgctttcaggcggtggcctttgcagctctgcaggaggcttccgaagcttatttggttcgacttttggagaacaccaatttggctgccgcgaacgcaaaccgtgtgaccatcatgccgtccgacattcaaatgtcccgtcacatccgcggagagaccctctgaagagccgaagcgagaaaacggagatgcgcaagaactattgggaaatcgaatgtgatcatgatcatatcctataattattgaatgtttgtaaatatacatataatcattcgtatgtgaatttattgtatgattaaagaatgtgct

SEQ ID NO: 92608 - DNA, 638 bp, Heterodera glycines
  SCN-specific regions: Sequence locations=1-165,188-238,271-315,337-638
tgctttactaataaattattcataatgaaaaggccttcttcggttgtcgcttttggtagtcatttatttgtcggctttattctgttgtcgcttttcattggcactttgggcactgagaaaaaagagacgaaacctgccgctgctcattctcccgccgatgccaaacatccgccgccagtcgccgcccacgcggccgctggcgccggccacgcctccgatccgaaacacgcttctccttctcccgctggggctgctgctgctgcttcccacgctcatccgcccaatggcggcgccgcccacgcggccgaacagctcattagcttgttgatttttgtgctttttcagccaaaacatgctgcggctcccgctatcaaaataactgatgaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaggagga

SEQ ID NO: 92609 - DNA, 643 bp, Heterodera glycines
  SCN-specific regions: Sequence locations=1-643
caaaaagcaataagcacacacaaacatcgatcgacgacccaacaaaaagggaatgacgtcatcagctgcaaaaattggtggtggtggtggtgcatctgttgaagagttgaatcaactgttaagcaaagacgaagaatggctttccagtttccagggcattttggaaaaaagtgccacattgaccggctcagtttgctcactgatggacaattttcaggaaagaattgattcattgtccacgaatgtgcagacgttagtggccaaatcaagcgtcattcaaaaggaacaacagaacattcgaaaactgttgtccaccgtggacgcgaccattcaattccatgggaaaacgacggtgctggagaacaccattcgggacgggggcaatgtgctgttgaacattgacgactatttggaaaagatgcgcaacctgaaggaggcaatcgccttttttgccacccatccagtctacagaaaccacgagcacattaaacaaatttacgaaattggttgtgccaacattgagtctgagttcggcaatttggtccggacaagttgcgtgccggtcgacccgaccaaagtgttcgagtatttgggcgatgattacgaaatgccttccttccgcttatcctccttcgtcacactc

SEQ ID NO: 92610 - DNA, 628 bp, Heterodera glycines
  misc_feature (158)..(158): n is a, c, g, or t
  misc_feature (162)..(163): n is a, c, g, or t
  misc_feature (170)..(170): n is a, c, g, or t
  misc_feature (179)..(179): n is a, c, g, or t
  misc_feature (181)..(181): n is a, c, g, or t
  misc_feature (289)..(297): n is a, c, g, or t
  misc_feature (342)..(344): n is a, c, g, or t
  misc_feature (346)..(348): n is a, c, g, or t
  misc_feature (355)..(356): n is a, c, g, or t
  misc_feature (364)..(367): n is a, c, g, or t
  misc_feature (371)..(372): n is a, c, g, or t
  misc_feature (374)..(374): n is a, c, g, or t
  misc_feature (380)..(380): n is a, c, g, or t
  misc_feature (383)..(384): n is a, c, g, or t
  misc_feature (389)..(391): n is a, c, g, or t
  misc_feature (393)..(404): n is a, c, g, or t
  misc_feature (406)..(409): n is a, c, g, or t
  misc_feature (411)..(420): n is a, c, g, or t
  misc_feature (426)..(436): n is a, c, g, or t
  misc_feature (438)..(443): n is a, c, g, or t
  misc_feature (447)..(449): n is a, c, g, or t
  misc_feature (451)..(452): n is a, c, g, or t
  misc_feature (455)..(457): n is a, c, g, or t
  misc_feature (459)..(461): n is a, c, g, or t
  misc_feature (463)..(465): n is a, c, g, or t
  misc_feature (469)..(472): n is a, c, g, or t
  misc_feature (476)..(477): n is a, c, g, or t
  misc_feature (482)..(485): n is a, c, g, or t
  misc_feature (487)..(487): n is a, c, g, or t
  misc_feature (490)..(495): n is a, c, g, or t
  misc_feature (505)..(505): n is a, c, g, or t
  misc_feature (510)..(519): n is a, c, g, or t
  misc_feature (522)..(522): n is a, c, g, or t
  misc_feature (526)..(534): n is a, c, g, or t
  misc_feature (538)..(556): n is a, c, g, or t
  misc_feature (559)..(564): n is a, c, g, or t
  misc_feature (569)..(582): n is a, c, g, or t
  misc_feature (586)..(588): n is a, c, g, or t
  misc_feature (590)..(601): n is a, c, g, or t
  misc_feature (604)..(609): n is a, c, g, or t
  misc_feature (611)..(623): n is a, c, g, or t
  misc_feature (626)..(628): n is a, c, g, or t
  SCN-specific regions: Sequence locations=1-628
gtcgctcatttgtcgccaaatcatgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcgngacnnaattcgnacggacgcntncggcgccaccgccgctctgcccttcgccggggtgggcagcggatgaccaagaaaaaggacgattaccgattagaaagaagccgggacgagatccggcaaaaaaggggnnnnnnnnnaaacgggaaagcggaaaaccgggggggaaaaaaaaacggggacannnannnagaaagnnttgtgcgnnnncgannanaggcgnagnncgggnnnannnnnnnnnnnnannnntnnnnnnnnnncgaggnnnnnnnnnnnannnnnnaaannnannaannnannnannncgannnnaaannaaaannnnanaannnnnntgaaaaaaanaaagnnnnnnnnnnagnaagnnnnnnnnncggnnnnnnnnnnnnnnnnnnnaannnnnntcaannnnnnnnnnnnnncggnnnannnnnnnnnnnncgnnnnnngnnnnnnnnnnnnnttnnn

SEQ ID NO: 92611 - DNA, 484 bp, Heterodera glycines
  SCN-specific regions: Sequence locations=1-484
ttgggacgcacaaaaaccaaagggccgttctcctcgtacgccgagcgttcctcccgcgaataaccaatacgctcacgtaaaaagcaaagtccggtcaatcactgagtacactcctgcgcccacactcgtgaagattttccacgagtctgtccgagtgaccgcctctcccaaagtcggctcactacaaaatgtgtcccatgtgcacaccggtgaaaatgtggccatccagaacagaaaactcaacttccgggaggcagtcaatcctcgggtggacgaaaaatcggaagtgcccattccaaagagtgagaaaaacagtgcgactcaaaaactggaatggaaaggccagcccagagtccgttcgatggacaatgtgaagcactcacccgcgaggagctaccacaaaatattccaccagtccgtgcggatgaaatgcgagtccaaagttggctcccttgacacatcagacacgtgcccggggggcgca

SEQ ID NO: 92612 - DNA, 330 bp, Heterodera glycines
  SCN-specific regions: Sequence locations=1-69,93-330
gctgctggcggtggcttaagacaacggcaagctggtggggcggcaaacactggtcgtacatcgaactgctggcggaggagggggcggaggaatgaacagcagctgactgtggcccttttatactgcaggactctgccgggttgcaaaattggacctgttcccgtgttggtcatgtcgctggagttcatcggttctgtgttttttttctacatttggggaaaatgcatcccgactcattgaattctgactttgccgattcattcggtctatcggcagaaatgcgattttattcatagtttttacaaatcacttccatttaatggaatattt

SEQ ID NO: 92613 - DNA, 250 bp, Heterodera glycines
  SCN-specific regions: Sequence locations=1-118,141-250
agcgtttgtcaatgggttactaaagactaagccggttgtgatcgtctcgaaggagcattgtcctttttgtgtaaaggccaaggatgccattaattcgctcaaactgaagccaggcgcacttgaaattgtccagctaaaccaccgcaatgactgtgcccaaaccgctttttgtctcatggagctcaccggtgcccgctcggtgcctctcatgctcatcggtggaactttctttgggggcggagatgacaca

SEQ ID NO: 92614 - DNA, 220 bp, Heterodera glycines
  SCN-specific regions: Sequence locations=1-47,102-128,158-220
tattgcctcggtgtgctctctgttggctatcatcgccgcagtcgtcgctctgccatctctgtactcggagatgagccaaatgaacagcaaagtgcgcgacggagttgaagccttcctcgtcaacacctactcggcctggactgacttgatggacgtgaaagtggtcgtgacccccccggccaacccccgtgataaccccttctactacttcttccgtgcc

SEQ ID NO: 92615 - DNA, 614 bp, Heterodera glycines
  SCN-specific regions: Sequence locations=1-341,363-547,591-614
taaatttgcaagtccccgaaagcattttttcatcatcaaccatgtctgccgccaacaagatcatcaaggccgctggtgtcaaggctgacgagctcgagatgcaggtcgcccaggccatcttcgacctcgagaacaacgttgcggagctcaaggctgatctccgcgccgtccaaatctcggccgccaaggaggtcgatgtcggcaagggtcgcaaggctattgtcatcttcgtgcctgttccccaactcaagcagttccacaagatccagcagcgcctcgtccgcgagctcgagaagaagttctctgaccgccacgtgctcgttgtggcccagcgtcgcgtcatgccccgccccacccgtcactctcgccaaaagcagcagcgtccccgctcgcgcaccttgactgccgtccatgaggccatcctcgacgacctcgtttaccccaccgagattgttggcaagcgcaccaagctccgcgttgatggctccaagaccactaaggtcttcctcgacaagaaggatgccacgtacctcgagtacaagctcgacaccttctcggccgtgtacaagaagctcacgggcaaggatgtccacttcgagttcccccagtaccag

SEQ ID NO: 92616 - DNA, 601 bp, Heterodera glycines
  SCN-specific regions: Sequence locations=1-10,32-66,88-601
gcatcaatgcccccggggttggcccgcggcgggtgatcaatgcgttcagttgcaatttgtgccgactcgacgagaacacgcggaagacaaatgcgaaagtatgggggcacaattagtcgatgtaacggacggagaaggcgaattgaacgaggcgatggtggaggacctatcagaactgcttcaagaatcgctggaggcaggggtcaacgaactgatttgggtggtcggggcgggaaagtggcgatcggagtgggacgagtcgggggagagagtgcgcttcagccgcagagaggcgcaacagcagcggcaggagggggaggaggaggagggcatggagaatgtgttggcactacaaaatgttctgctccatcctccctctgtgcaccctttcatttgccaactttggcccctttggcgccgtttgctgctctatgaacagtctctgctccccaaaggtgcgcctctcctggaagagcagccgcgtccctcctatttcttcgaccccaattcctccgcctccaattcgtcctttctcagtttgccatgttccgcttcgggcgtgccctccccgacggtccgttggtttcgcaacggaggcgaa

SEQ ID NO: 92617 - DNA, 617 bp, Heterodera glycines
  SCN-specific regions: Sequence locations=1-36,59-617
atgaaatccttcactctcaagcaaggactgtaatgcaataatgtatcccggccaccacccggcttccgtccgcagcgccacccttggccggccgccgggcactgggcccagactgatggatgagaacgggctcgacgacaccgaccacagcagctcaagctcgtactccaatgcaacggccatggcaccgcccatgtcggcagtcaagcgcatggctgctggcacaccagtccccggcacgccatctttgcaccgaggcctattcaagaaaccggggcatctcacggccgccacgccgtccaaaccgcacgtcgcatccgcgaccccgcgccaggcatctcaaaccccgggatccgtgaaaccgcaaccatcagctgccaaactcaccggcggtgcgcctgcgcgccgcctcctgtttccctctggtacgactgccgtacctggtacgcccgccgccggcagctcgcacgcgtcatttgcgaccacgccgtcggcgcgccacttgcaaatgcaaacgccgcgtggtcccggtcccgcgagcgcgaaaccgacgcctgcgcgcagcatgtacgcagcagcgactccggcagcggctctgtcgacttcgatgagcagcg

SEQ ID NO: 92618 - DNA, 554 bp, Heterodera glycines
  SCN-specific regions: Sequence locations=1-554
gtgaaagagaagggagggcaaaaaggagcagccgaagcagtagcagaacggagcgacacagacgacgacggtcatccgccgggtcgtcgaggcggagacggtcacgcgaccgaagtcgagagacaacgacgacgacggacagagcgcgtaaaaacggttctgctagttccatgatggcaccaccaaccgccacccaatcgaaagtggtaccctcaaagaaactgactgctgaagagttggaggaacggcgacgcgccatgttgacaaatgcctcatggcgagacgatatgcgtgagcggaatctgcgcgatgcggccgacaaattgagaaaggaacaggacgagatggccaataaccgaggtggcgccggatttatgcgtccaatgatgaacaccgcaactgaagacgcgtccattgagaaacgcttacaaagcaatcggatgaacattcaacgccaacatgatcacatggacaagtcattcgtcagaaaatgatatgattgccattgccgatttcgacacacttgtttttatttttaatgaatttttttaccc

SEQ ID NO: 92619 - DNA, 384 bp, Heterodera glycines
  SCN-specific regions: Sequence locations=1-25,57-270,313-359,381-384
cttttgagtttggatacagtatcaacaattgaatgttaagtatttgctgttttttagatttccaaattccgaggaattaaatgtccagtccgagcgattcaaagttcgcctgctcaaccaataaaagttcggttgggattcctcccgccgccattcgttcctttctgtttgcttctgtactccgccccttcgcttccatccttatatactgttaccatttgccctccccacttctattaccgtgtttttcacatatccaccgatatcccgtttttgtgcctttctcccatttctttcatccattttctcaaaaattatttagaattactattatttttattgacctttatccagtaaatttcaacaaaatttcattcttatttc

SEQ ID NO: 92620 - DNA, 592 bp, Heterodera glycines
  SCN-specific regions: Sequence locations=1-280,303-379,427-592
cacctctcgtgctctaactgcgcaacctgcaactcgctcgacaacgactttgcctcgctctcgctccatgacccggcagactgcctcttcttgcgctgcaatgtgtccaagcctcaaggaaacggctctatgggccggcattgacccaaccaaccaagcttccatccagcccatcttccgtgtgctggcaaatcacgagcaagccaagttcgatgtcgtggcggcacattcacctttggagaccacgtcccatggcgccgactccggccgtattgccaatgagatcaaggacattctcgtcaacaagctgcgcgctatccacttcaacaactggtcgggcgacacctcatccaacctcatcgaaaaccgcctctctactcaccgcctccttcacgaccacgaccacgaccacgatcacgaccaccaaaccgacgacacaaacaacaacagcccaatcccattcgaccaaatgccgcccgccatgtctgccctgctcgcctcgcccatcacccacccgcccgacagcggccgcgcctcctccgaagaactgtcacccgaccacgaccacgaccatgaccacgaccacgaccac

SEQ ID NO: 92621 - DNA, 181 bp, Heterodera glycines
  SCN-specific regions: Sequence locations=1-181
acgatgcataagtagaaaattgcctaatcccgggaagccgccaattttgccacctgcaaaaacgaaactgtacactgtgacccaattcaagtggggaaacccggacgacattgccgatttgctgtggcgtcgtcacatttacaacagtgcctttctgtcaatgcgacgcctttttcgggga

SEQ ID NO: 92622 - DNA, 546 bp, Heterodera glycines
  SCN-specific regions: Sequence locations=1-435,460-546
gcaagtttgagttgagattgtgccaacggtgtctattgtttgtctctttgcattaattattgtttttttgccctccatttgcttgctaattgcctctcctccatccttcacttgcaaatgccaaattcgaccgtcaaaaatgtcgctttgatgaacggcacttcccccgccccctctgccgctcttccgcgtttcaatcatccaactccgtccgcttctttctccttccccaagggcagctttttctcctccgcttctgcttccgttgagtcgccaatgacggcaactaaaaatcatcggccaacagagccattggcaacggcatttttgggggccagcagcagcagcagcaacggcacaattgaacatgccgaaaacggtggcaatggccatcaaccgatgacagtcattctgacagtgcgaatgctaatgcaaggaaaggaagtcggcagtatcatctgcaaacgtggcgattatgtgagacaaattcgggagcaaagcggcgccaaagtgaacatttcggacggttcgtgcccagaaagattg

SEQ ID NO: 92623 - DNA, 296 bp, Heterodera glycines
  misc_feature (137)..(137): n is a, c, g, or t
  misc_feature (159)..(159): n is a, c, g, or t
  misc_feature (207)..(207): n is a, c, g, or t
  misc_feature (231)..(231): n is a, c, g, or t
  misc_feature (257)..(257): n is a, c, g, or t
  SCN-specific regions: Sequence locations=1-207,230-296
attccttgtgcgcttcgtctttttattctctttttgcaatatgaatccaacgtacccaatggtcttttttctgctcgttttggtggccgttgttctttcgtccgttcatctgaaggaagacaaaattgatgtgccgnagcgcgtttaacgcggagaaanggcggcggtgcctatggcggtgaccgcggtggcgttggtgcgcctgcnccgggcggtggcggcgcggcgaanattggcaatgttttcttataccaacngaacggatgcaacgggcggggaccgcagtaccaatgggg

SEQ ID NO: 92624 - DNA, 574 bp, Heterodera glycines
  SCN-specific regions: Sequence locations=1-574
gcccacactcaagcccgaccaacatgaactcgctcaagtctgcctcgttcgccatcctggccaccctcctcaccttcttcacactcatccacgcgtcgcccgttcccacccctcaagatccgacgacgcgcaaccgccccggcccgtccggcctgccgcctccgtccccgaccgcgttcgtgcgctacctgggtgacggcaccgccttgatcgaaaatctcgggtattactacacgcaagtcttgcagcagtgtcgtggattgcagggaacgctgccgattgaaaatgtcgacatcaacacccggtacctagacggccggcccgcctacgcgttgcagttctttggcgattggggttgccgagggcccgtgattgcgcagacgacggggttcacgggtaacggcgagccgctgcgtgggaacaacgggcaggtgatcgtgccaaagtcggcgaggtttgtgcctgcctaatattaacggtcggcgtgtgcatactggcgttcaatttgggttggttagacgtcggcaccttgcagttggaatcacgagtggagttggcgggatatgcttgagcc

SEQ ID NO: 92625 - DNA, 595 bp, Heterodera glycines
  SCN-specific regions: Sequence locations=1-9,31-39,61-113,135-501,525- 595
gtttgaggcattaatattacttttgttgcaatgctgccatccaatcttttcttcttgctgatgaccatgctcagcagttccctcctccatcagacattggcaaataaattttcagcagagaccgacgcagtaaatccgacgcgattaatccagagacggcatttgattcgaagccgcgcaattcacaaagaaaaaatgcactcgaacgtaaatgaaggctatttacagtgggaaaaggataaattccacgaagcactgggagaaaagtgcggaaagaaatcaaattgggaacagagagattttggcattttaaggattttgccgaagagttcccgatctctgatggaccccaagtttttgggatcggtggaaccgcggcttttgaaaacatcggcggatgggacgcggacaaaaagcgattcggaagaggaaaattggcggaattggctgcgcaggcatttcccagctgcgagaacaatttctgatcagtgatcactgatcacttttcattttatcaaatgcaaatgatcgctcatctcacctttttgaattggatcggattttcaatcttcaataaactttatttattaaaaaa

SEQ ID NO: 92626 - DNA, 556 bp, Heterodera glycines
  SCN-specific regions: Sequence locations=1-1,23-66,88-228,254-339,361- 386,409-556
gaaaataatgggaacaaaaattgaggaaaactcatcaaaaagtgtgtcggaggacgacacatcggcggaggaagaggacgaggaaaacattgagaatttcagaccgaatggaaccacaaataggaaaagagcacaccgaaatcccacctcggactcggcccaatttagaaacttgttggacaaggcgaaggaggactttaagcagaagtgggaaaaagcgcgcaacatttcctcctcctccaccgccaatgcgtctctgatcgattttgaacgcattcggatgatcggcacgggctcatttggccaagttttgctggtcaaacacaggcggacgggcaaatattatgccatgaaaatgttggagaagcaaaaagtgctcaaactgaaacaggtggaacacaccatcagcgaaaagcgcattttacaggccaccgaatttccatttctcgtaaaaatgcactactcattcaaagacaccgccaatttgtacatggttttggagtttgtcagtggtggcgaaatgttctcccacctccgtcgcattggccgcttctcc

SEQ ID NO: 92627 - DNA, 613 bp, Heterodera glycines
  SCN-specific regions: Sequence locations=1-613
tctgcgattttgttgccgattacaaaatttccggtgctgttgaagggcattggacgcacaaaattagaccaacaattggcttcacttggtgaatttgagtctttttacaaatggcaaagtcagcaaatgcaatcgttggacaatggctacacaaaaagttttacactgctcgacgggcccccatatgcaaatggtgagccccatgttgggcacgcgatcaacaaaattttgaaggactttattctgcgcagtcgcgtacagctcggccacctcgtccgtatgaaaagcagcacaagtgatccgtcgaagagtcctcaaaagatcgtggcagaagccgtcaaggagatggaactttatttcaacgcactgaacaacgcgctcattaagcatttgtctctcaacatcaacctaaaggcctatgaggatttgtctgtaacattggacaatggcgagacccatcggctggtcaagttcgcgcgaatttccctaaaaacacctaagggaccaattgtactcaatttcgcagacaatcctgctgcgataaagccggcacgaattgccatccaaaatatggcagaaaatgtcactccacaagtggacggcattgtcataa

SEQ ID NO: 92628 - DNA, 596 bp, Heterodera glycines
  SCN-specific regions: Sequence locations=1-183,206-596
gacagtttgagacggtggactttttggacggcaaagggacggcggagaaaatcaacaagttcgtgaaagaagcgactcataagaaaatccgcgatttggtcacgcccgacaattttgacgggaacactcgtttggtgctgatcaacgcgctttacttcaaaggcacatgggcggacaaattcgactcaaaattcaccaaaaaagcgaaatttcatgtggacgcgaaaaacttcaaagagctggaaatgatgcatttgacagccaatttcatttatttcgaggacactcagctccaactcctcggcatgccctacaaaggcaaaaaggagttcatgttcgttttgttgcccaagaaacgctttggactgaccgaattgttggctcaattggacggcaaaaagctgatgaaactgatcaaaaagcgggacatagagaccgtgaaggtggtgttgcccaagttcaaattggaggccacgcacggattgaacaaaccgttgaccaacatgggcatgcccaccgcgttcaccgacaacgccaattttgagggcatttccggcaagaaaacgttgctgctcagcgaagtggtgcagaaggcg

SEQ ID NO: 92629 - DNA, 494 bp, Heterodera glycines
  SCN-specific regions: Sequence locations=1-494
ctctcatctctcccctgggagtgactcgaggcttcctcgacgcggcgaagaccaaggtgggcgctgctcagggcatcaccaacgccgccatccaggccggcagcgacggcatcaacctgggtctggatgccgttcagggcgtggaagctgtcaagtccaacgctctccgcggggtcgtcaacatcaccagaaacttgggcactgaggtcatcacccagacccgaaacatcgccaaccacctgccctccgccctcggcatccgcggcgttgccaacctcggccttagtggtgctcagggcgccctggaccttggcgccaacgctgccaccggcgtctttaccggagctcaggccctcgtcaacggcaccctcgaaggtggccgcaccgtgagcaccggcgtgtctaacgctgctcagaccggcgtcaacttcgccggcaacgtcgtcggaggtgtgattggagccaagtccaacgccattggtgccgcccaaaac

SEQ ID NO: 92630 - DNA, 199 bp, Heterodera glycines
  SCN-specific regions: Sequence locations=1-199
cagctgttgagaatgatcggctcaaaattcatcggcaataaagccggcatgagctccattgacaaggagcaagtggcgcgcataattgctgagaataccagcgcaaattttgagggttatgaaaagaaaagggcgagtcgcattgatgaacaaataaaaagaaaccgacaaaggcttgattcattgacggaacaacaaa

SEQ ID NO: 92631 - DNA, 645 bp, Heterodera glycines
  SCN-specific regions: Sequence locations=1-6,29-75,97-367,402-645
ttctcttctcgtttctgttcttcattgcccaactgattttcactgattgccaatttcccgaaccgacgcgaagtgtcgatttgtgggactcttttggcacttctactgcgaatagtttcggctcggatgaatctcgggggaatgtgctggtgcgtctttcggttggcgaagtggtcggcctccgtgtgaccattccaaatttgccatggacgccttggcaagacccaaacgagcaaatcccagccgatcggacccattctgaactgaatcccctcccgggcaataataatgtgtccgttttcgcctttttgggaatgccttacgcggagccgccaattggcgaacgccgttttcgggcgccccagcagctgatccatctccccggcccttcgcccttcttggccaacactcttcccagtgcttgtgcccaagatatcgaggcccacccgtcccttttcgtcaacgacccctttccctattcggtcagcgaggactgtctccacctgaacattttcaccccttctgtgaagtctttttcctcttccgtgtcaaattctctccccgttttggtgttcttccacggcggcaacttccaaacgggcaccgccaacgattggcctggccacgtgttggcttctcggggca

SEQ ID NO: 92632 - DNA, 469 bp, Heterodera glycines
  SCN-specific regions: Sequence locations=1-469
caattttcgcaactgtcctggcaccacccgggcggaatggaacaaatggggcgaattggcatttgacgagatggacggcactttcgctgtgcagcagtggattcagcaatgcattgggagagatgcgcatgggctggacttgatcttggactgccccgcgggcgtggacgagggcgtatggaagtacgaacagttgcgccagttttgcctggagctcatttttttgttcgtacttttacaggagcagtgtcaccccgaaagttgcacacaaatgaccgcgactgagcagtggatttttttgtgcgcggcgcacaaaaaccccaaggagtgcagtgccattgactacacgcggcacactttggactgggccgcctctctgctgaacagcaaccgctacttccccagccgagccaccatcaaagagtcgttcatcgcccaaattgggtcggtgtgccgacgactctgccgg

SEQ ID NO: 92633 - DNA, 535 bp, Heterodera glycines
  SCN-specific regions: Sequence locations=1-266,288-535
cctaattattttttcagtttatcatttgttctgataatttctgttttcctcctctttaccccaaaagctatggttgccacgcgtcccttccgtttcgatcggcccgcgcctcaaccgcagcgagtccatccggtgtcactgattcaaatggtcactgctgcgaaaatcgttgacgaacagcagcgggccaaagaacgaacgcagacgccactagtttatcggatggatccgcaattgctcatccgatttgtcaccttcaacaaaatcgcacagaaacaagcggcggccaaatatttggcgaccaaaaagcgtcgggagaaggacgagcagagaatgcgcgagttcgtccgccgggcggtgacgccgcccgactttggccaaatggacgccgacgcaatggtcaaactgtcggattttatgcctgtactgaatttggaattctttttgagtgccatttccgaatgcttttttcatttgtttaggccgtgccggcccaatttgaccgctcttttcgctacgaaacgctcactgttcc

SEQ ID NO: 92634 - DNA, 634 bp, Heterodera glycines
  SCN-specific regions: Sequence locations=1-330,352-634
atttgccaatacttagagcatggtcatctcttacatttggcaaatgtttgccctgctcattccaatggcacacatcgtcaacagtggacaaattagctacaacttccaaattcatttccggcactttggcctggatgcatgggctcagtttgaaaagccttgcgctaatggcaccaagttgctcatattgacaatgtcgcgccgggaaggcttcgacagcagaaagggcatccgaacttggatgaaagatgctgtggccgctgaagagcttcgttttctgatcgccgatcctggaaagaacgaagcggacgatgtgcaacaacaattagtgaatgaacaaaaagagcatggcgatttggtgctgatgcacggatttgtcgacgtttacgcccatttacatatcaaaatgtatagtggctttgtgtggcaacaacggcactgtgccggtaccgaatgggtgctaaaggtggacgatgacattgcggtccatgtccgacgtatggtcgaatggacggagataaaatttggaaaaatggctacagaacatccgttgatttattttggagtcccggcagatagaggactatctcgggacaagaacagcaaatggtacgtcccttatgaaatgttcccg

SEQ ID NO: 92635 - DNA, 643 bp, Heterodera glycines
  SCN-specific regions: Sequence locations=1-643
tttttcatcaactacagctataacatgcactggattcgaaccggtgaccgcccattttttgactaactcacagaccactaagacgaaaaaaccaacttaatttgctaaaatggcaaaaattacgcaaataaaaaatggcgaagagcgacggattgaaagcattactcggagaaaaaatgagcttgatgagaggagacggcttatcaataaatcattgacgggagaattgaagataaacaaacaaactagatttgctgattccgatgaagaggaaccaacacaaaatagcaaaccatttagttttcttgcttcaatcggacgcatttatcccgaacaaaatgagaagagcaaaaatacgaatgttgtggatgattcagcagagcaattccttgaaaaaacgagacttaccaacgaaacagaaaaaagtgcacccaaactcaaaaatatttcgttgtataaaccacccaacggcgatggtgacatccggcaatgtttctttgtcaatgaacacacacccgaaatccgttcatccttttcttcatttcgtcggcaccaaaaagaagagacattgcgtaaggaatgggacaaaaagagagcgccaattgttaagttttacaaaaaagaacggaagtcagcacttaga

SEQ ID NO: 92636 - DNA, 525 bp, Heterodera glycines
  SCN-specific regions: Sequence locations=1-525
ccatcaccaccaactccaccgaatggcacgactccatcagcgccaactccatcgaatggcacgactccatcagcgccagctccaccgaatggctcgactccatcaccgccaactccaccgaatggcacgactccatcaccgcttattccaccgaatggcacgactccatcgctgccgcagcaacctccgccagtcgccgcggctccgtcaccgtcgccaccggttggcaatgtgttgccgctgctcgccaacggacagtacgcagttggatgtgccgacattatgctttccgaaccttccgctgcctcctcatcttctgctggtggcgttggactgttcgcccgactgttttaccccgccgcttcgtccgtcgtcctcgcggatccgtcgacttcgtccgccacaacagcgtcggcgttcatgcgttggcgaccggactccgagtacatggttggggtggcaaattaccagggcgtgagcatgttcaagaagaacctcttcctcgattggggcgtcggcgacaaa

SEQ ID NO: 92637 - DNA, 544 bp, Heterodera glycines
  SCN-specific regions: Sequence locations=1-456,483-544
ggaagagcgaatcaaaactgaattgcgtggtatacaaccttctgaagaccaagaccttctgctcgacagctgcaaagcgaatacaattagcgggctgacagaacagttcacaagtctcacaacactttcgctgataaatgttggattgactacattggatggtcttccgaagttgcagactttgggaactatcgacctccctgaccacaaactcagcggtggtcttgataaattggacgaatgttgccctcgtctctaccacgtcaatttatgcgcagacaaaattacgtccatggcagcacatgctcccgtgagcaagttggaggaattggcggcacttgatctgttcgactgcgctattaccgagggagaggaatatcgcagcatagtgtttgctatgatgccacagctgaaatacctggatggatttgacagaaacgatgtcgaggcagacatttcggatgaggaagaggaggagggagctgatgacgcgctcgaagatgaacaccactctcacgaacaggacgagggagtcgacactgac

SEQ ID NO: 92638 - DNA, 214 bp, Heterodera glycines
  SCN-specific regions: Sequence locations=1-68,90-214
cgaaaaaaaaagcgcaagaggaaaggatggcaaggatggcaaggaaaaatagagaggaaagggaagctaacatgaaagaggaaatgaaaatgatagcgggagaggaaatgaaaaggcaagggctaacggaaatgggagtagaagcgacagaagaagcagtgcaaaaaatgcttaataagcctaatcttccattaaaaattgctaaaaaaataaa

SEQ ID NO: 92639 - DNA, 639 bp, Heterodera glycines
  misc_feature (27)..(27): n is a, c, g, or t
  SCN-specific regions: Sequence locations=1-639
gtccaattaagcacaggggaatttacntttgggttacacagcttcaagggaatttactttgggttacaaagcttcaacaacatgcaaagtgtccaatcgtcggccaccgcggcagtgaccgccgcttccaccgttccgttgagcattcagaatgaaattttgtggatcaaacaggacgctctccaagttcgcaacgccgtcattctcttggagcaggagaaggacagtcttcgcaaagcaattcgcatactcaagttggagaatggccgcctgaagacaaaggtgaaaaccttgaacgaaaaggtggcaaagattagcaacgaggaaatggacgatgaagagggaaaattggcgcctgaatctgaattggactatgacgaactaaaccgaggggatttctacctaatcggaggtgtccatgacccgatcagtcttcgttttgaagctgcgatccgtgaccaaaatgccgtcgaacataaaagtgccgaacgctactactggtacaaaatggcggaattctttggcgacgaggaagccatgaagagcattctgcacgcgcagaatgtccaacaggccgaagaggccatgaaaaacatcaaaggcttcgacgttgccgaatgggacaaagtcaaacttaaa

SEQ ID NO: 92640 - DNA, 626 bp, Heterodera glycines
  misc_feature (218)..(218): n is a, c, g, or t
  SCN-specific regions: Sequence locations=1-261,284-626
tattctcccattttcccacatgggaattactacaggctggggggaagagaaattcacatgaaagaacaattatagttcaagatgtgaccgacggtcccaaaatgcatatacggtcctaatcgaatacaactggtgcgatgtcttgggggacacataaacatgcgctcagtaactcttgataacgaaagactttacagagggcttttgaagggagattngttctttttctggtaatgcagactcgcgacaggcctgaccacacaacctcaatggtgatgatcagggtacatctcaggaggatgttggaccatgcttacgtcgcccaagcagctgtagaacctgttcacccgcttgggtggcggattttccgtgaagaaattgtcgattatccggacataaatgagcatttgaaggcgactctccttgggatgatttcgctagaacttaagaacgaaatcatccaatggattgaccttaaaaatgtgtgccaaatgttaattgcgttgggtttggacaatcgcgcctattacgagcaccaatttgaagaccttatcctccgatgaaactgccgaatttctatcgtcctgcaagtcaaaaagtttttggcggaaaacagcgcgtgcgtt

SEQ ID NO: 92641 - DNA, 465 bp, Heterodera glycines
  SCN-specific regions: Sequence locations=1-465
aaacagttgggagtgaaatgtcgcgatgtgcggacacgagaagtgggcattcaggaaatccacgagaaagtccgcccctaccaagtcgaactcgttcgtcgcgactattcggcaaatggcggttgggaaacttttctctcctacgaggaccccgaccaggacattcttatcggaatgcttcgtttgcgaaaatgtactgagaaagtgcacagaacagaactgaagggaggggtcagtgtcgtcagggaacttcacgtgtacggcactgcggtgcccgtggccagcagagacccgacaaagtttcagcaccaaggctttggacaactgatggaggaggcggaacgaattgcactgaccgaacatttgtccatgaaaatatcggtgatctccggggtcgggacaaggcattattacagaaaactcggctatgaattggatgggccgtatatgagcaaaatgttagac

SEQ ID NO: 92642 - DNA, 572 bp, Heterodera glycines
  SCN-specific regions: Sequence locations=1-342,364-511,534-572
ttggcgtttattaccgggacgactacgactatttgcgacatttgaaagaagtcggcgaggtactgaaaaggacaacattctcttccccgtttttccctctattttttgcgcttacgcttagaccgtcgatttgatcggagatgagccaattgtggagagggaagtgatcggtgcggacgagcaaacgacgtccaagcagttcaattcgtgcattttcgaaacgcacggcgtggaattgaggatgggcatgctcaaccgcgccgcgccttccaacgaactcctccccgactttgacccagacattgtggcggcattggacggtgaaattgaaaatttgggcgcggatgacgacgacgaattggacgacgattttgtggccaaagccaatgcgcccggaggcaaagatgacggcaaactgtttgactatagaaacgaaaatcgcgggaaggatgaaattttgcagcgttttggtcttcgcaatgtgcgggagaaattttcgggtgaaagttcggcggatgaggaggacgaagagatggcttcgtccgtcacacaatcggaagttgacgagcgca

SEQ ID NO: 92643 - DNA, 233 bp, Heterodera glycines
  SCN-specific regions: Sequence locations=1-14,48-233
caactctctcaagcaaaaaaaaaaaaaaaagaggaagaaagaaaaaagcttcttctatcgattcaacattgaattataattttacagacacaatattcttcatctaccacccacaggattttcatttcatcccaatcgtattcccccacgcgaccccaaactctaaatacgtacattgacatacacttacgtgtacaagaatacgtatagaagtagcttctattggttaacct

SEQ ID NO: 92644 - DNA, 234 bp, Heterodera glycines
  SCN-specific regions: Sequence locations=1-12,39-198,220-234
attctgctggctgtcacaatcatttaccagtactttgaaattttcgtcaaagaacagcaagaaatgggcggagttgccggactctttttctgagccaatttttcttgcgcagaatttatacatatataaacgacacattcactcatttccatctaaagttgaactttgttgttttccctcacttttggcatcacataattctcttttgttcatttaaatgcatttgagaaactg

SEQ ID NO: 92645 - DNA, 632 bp, Heterodera glycines
  SCN-specific regions: Sequence locations=1-55,79-234,257-318,396 -543,565-632
ctcaacttgccgctggccgacatttgcgacatttgcgacatttgcgtgtctcgcgtctcgctcgccccgtttcccacactcctcgactcaacccgtcgtcaactcaccaacctcggtcactggcctgaccctcctcctcaagttctcgcaagcaaatacgctggactgtattctcgccgccgccctccacgacctgtaacactagaagctccgtcgtctgttctctatctacccccttctcttcttcttcgtcttcacacacgcaaacccatccaaccccatcatgaagctcacgcacctcctcctcatctctgccctcctcgccctcgcgccctccgccgccctggccgaccaccccgccgacggcgccgtcgctccctctgcctccggccccgactacggctacggcgccggcggcgacgttgccaaagaagccgagcaaaccgcgcccgcacccgcgccgactggcgctgctgccgacggcggttacggcgcacccgcgcccggcaacgacaaggctgctcccggcggcactgcgtccgagtcaagcccgcagccgccctccaactactccaactcgccgcccggtcccgccaacgagtacgagtgtgtcgaggaagccgcgggcaaca

SEQ ID NO: 92646 - DNA, 604 bp, Heterodera glycines
  SCN-specific regions: Sequence locations=1-345,367-384,406-604
atttctttcatccgttcaaattcgcttcaaatcaaccaaaattacaatttaaaattaaccattcttaatggttgagctgtccgctgtatgttttgtgtataaatccttcatccgtcatcttttgattacccgattatgcgctaccttgacaatggaaaaccctgacgcgaattcgtcgacgattcatcagctgaatggggttgggctcggtggacagaatggaagacatcggtcgagtgattggcgatacaaaattcgaaatcaaacggcggaaagggagggaagggacggagtcaattcgtcggttggattctctgctgctcggcgtcacatcagacccgaagacattctgtggtggctctgtcttctgctcacattccgttgctttgatttgcctgctgttttggtttcccattgccgcatcgatcgtcagttccttcgcttggccttcgtctgcgctttttgtctgccctttctttccgtcgcttatgcctttgtcaatttgacttatcggtcgactgttcccttttctcttctccgcattttccaatttttgtctattttttgcttaatttgtgcgtcaatttttttttgccttgcgact

SEQ ID NO: 92647 - DNA, 538 bp, Heterodera glycines
  SCN-specific regions: Sequence locations=1-36,74-142,164-538
ccgaaagggaatgttctgagggatgagacacccactggtcaattatggcatgtaattatatccatgtttttgtgcccatcgatcggtcggcaaaagcggcgaataaaaaggacaaataaaatgaaaatcaaaaagtcattttaagacagtgattgggagaaaatgccatttgaaagcaatatagtaactgacaagtgccagcggacggcacagattgtgagaaagtgccgttggaagagttggcattggcaccaaaaaaggaattcacaattggttgaggtttaaaaagaagcttttgattttcactgtttcttttccttttgagcactttggtggtgattctgtcccccccctcattaaaaccaacccattttctgtctccccaatttttggataatccatccccctcccccccccctcggctcattgagccccaaaatctgtccggaaataagcagaaatgagggggaataaattgagatttgagatcattgaaagattaatgcatcgagaagagcttattttgcagggattgttc

SEQ ID NO: 92648 - DNA, 501 bp, Heterodera glycines
  SCN-specific regions: Sequence locations=1-89,121-501
aaaagcagcactttgaagccgcgttggcactaagggattgggtgcgaaacaaaattagagaatcggcgaattcggaaaatggacgatttgaggaaggggagggggaggaggacgacgacacggacgaagtgccaccactgccaaaagtgccagcaaaaaaggcggaaaattcactgttgaagcgaaagtctgcaaaaagttcttcctcaaagaatcggaaaaggccaaaagttacgcacagtcataatgcattggtgccccaggcaaaagcgaatggcaattccatcgatggcacaaacaccgaaaaaaggggttccgcctgtgcatcttcaacagcagcagcgaagaatgatggatccattcctatggaggattttgtactgccggcacagattaaagaaatcgtgccgaagacagacgctgcggaagcgccccttttaatcagcgaagtggacgacgggggaacggcaatcgaagaaggcccaaagaatgatgggccat

SEQ ID NO: 92649 - DNA, 471 bp, Heterodera glycines
  SCN-specific regions: Sequence locations=1-60,92-471
gtcgaaatggatgttcggaatcggatcaattgatgaaaaagtatttaatctaagttattgtataaaaattttaaaattaaataaattttttcagatagcaacactccaaaaagaggtgatgacgaacatggagaaagtgctgctgatattagccacccgaagagaaaacggacaacaaagcgaaaaccaaggatttcacttgacaaactgaaccaacattttgccaccaaaatggacataaacactaatctaagtcccaaaattccacgaaaagctcgttcaaaaaggccaattagtaaaaaagtggcagaacgccaaaacaatgcaagtggcggaggagaagcgtcatcaagttcaaaccgtacaacaaaggacgccgccaccagcactgtcatgccaatgccaaaagaatttacggaagagccgttacaacgaaaacggcgaacaccggacgaagaggaaagcgaacgg

SEQ ID NO: 92650 - DNA, 642 bp, Heterodera glycines
  SCN-specific regions: Sequence locations=1-228,250-642
caactgtacgttaaactaccccatccattgaacgtgggcgcaagggctaaccaatggcggaatttacggaaataattgtcgcggcgaatgccagaactcccaatgaacttaacacctttgcgcgatagggagaaagcaaatgtaaatgacactgaggcaaggcaaaacctcggaaaactcagcacccaattgttgggcacatatccgatgcctctgtcggaacatgagaaggtcaaatacactgttcaaacaaagacaaatgcgcccgaatttgctagggtggaaatgtccgttgttagagagcatgacgaatttatttggctacacaattgtctcgaagacaatgaggaatacgccggattcattattccccccgcaccgcctccacccgattttgatgcatctcgcgagaaacttcaaaaacttggcgaaggcgaagcgacgatgacaaaggaggaatttgtgaaaatgaaacaggaattggagcaggaatatttggcaacgttcaaaaagactgtcgcgcttcatgaaaagtttttgactcggcttgctgctcaccccgtttttcaaaaggaccaaaactttcgcgtgtttttggaatatgaaaatgatctctcagttcgaagtcgaaacaagaaagaa

SEQ ID NO: 92651 - DNA, 591 bp, Heterodera glycines
  SCN-specific regions: Sequence locations=1-129,151-591
atcccatcgagtatcccatcgacgtcaacgcactctctgcaatcaagcaacatcaccatgggagtcacaggcctgaccggcttcatcgaccaccacgccctggtgcgcaacctgaccttctccaaggccgccaaggccgcccaagatgccaacgagcacccgcacccgcaccggctcgtgattgacgggtcgtcgctggtccaccacctgtacttttgcaacctcgactgggccatgggcggccagtaccacgccatgatcctgctgctcgaccgcttcttcgggcacttggccgccgccggcattgaggtggccatggttgtctttgacggtggccgcgctaccgcaacaaaggaactcgtccgcatcaaccgcgacaccaagcgcgccgaccactcgtaccacgccatgaaagccatctctgtccaaccgcttgtgcacctgcgccacggcctgcccgtgctcgccacgggcgaaacctcgtcgcgcaaccgccggtccttcggcaccgacccgaccttacccgtgctcgccatctcgcttgccatccgccacatgcgcgacgtactcaacatccctgtgcgtgtggcc

SEQ ID NO: 92652 - DNA, 627 bp, Heterodera glycines
  SCN-specific regions: Sequence locations=1-627
attatgctaaatttattgctgtttttgctgattgtgtccccaattttggcgatcgaaaagccatggattcgccgtgatccgatcactttgactaaattttcgtgccattttgcgctgaaagaagcgcccaaatacaaatggcaagagctgtggtacgacaacatgcccatcgatcacttttcgttcagcgacccgcgcagctttcggctgagatatcttttgaacacggacagttttcgtgataaaaatgcgcccattttcttttacaccggcaacgaaggcagcattgagggctttgccgagaatacgggcttcatgtgggacattgcgccagagtttggcgccgccattgtttttgcggagcatcgcttttacggcaaaacgcaaccgttcggcaatgagagctacacaaaattggaaaatttgggctacctgagctctgaacaagcattggccgactttgctcaactgatcgactacttgaaaaatgagaaattaccgaatgccaaacattcgccggtcattggatttggcgggtcttacggtggaatgttgacggcatggatgcgcatcaaatacccacacctcatggacggtggcattgcggccagcgcgccggtgttttgg

SEQ ID NO: 92653 - DNA, 453 bp, Heterodera glycines
  SCN-specific regions: Sequence locations=1-299,321-329,356-453
gagtatgcgaaagaggtaataaatgcagacaatcagttaacaatggacccgaaattgtacttcgattcggacgatccccaatggctgagttggatcggacaattctcaaaagagatgagtcggtgttcgttgaacacggacgagctgaattctgtccgagtttgtaccagggaacagttttacggtccggcgggggtcgaagcgatgaaacgcagcggcgaattgtacgcagagcacagaaacgactatgtcctcgtgttggtcagcggttgcgtcgtctgtccctcggggttcaaccaaagtgttccatgctcacctcgtgctaccaagaatgggaaagtgtgaggtcagtgagcgaaggaatgccaacgacggatttaaaacattcgcaattgcccaacaactaaattcccatagttctaagcattgtcactctctctttttacttaattt

SEQ ID NO: 92654 - DNA, 587 bp, Heterodera glycines
  SCN-specific regions: Sequence locations=1-587
caccaaactgcgccaggaagggacagccttttgtgccgtttggaacccgcaaaaccataacatagtggcagtgtgcaacaaaaagacggggctgttggtgtacgacctgaggatgagcaacaacacttacgccgaggcgggaaaaatcacgaaaagcgctatttgtgccgattggtccccctcgggtgaattgcttttttgtgctatcagccgttccaacccaatttgtttcaatttgcaaaattccgagcatttgcggctatcagacccaaaatactcaaacatttgcacaataaaatcgtgctcttttgctggcgatcagtatttggtcacaggaagtgacgattggaatatttacgtgtggaaagtgccgagcaattgggacgatttcgccaatggcactgtcaatgttcactccgttttggagggccatcgctctattgtgaaccatgtgaagtacggaccacgcagcaatttgcttttgtcttgcggtgtcgagaaaatcattaaatgttggagtgggctgcctttgcgtgactcgtaccaaaatccgaaaaaacgcgagcgcatttcgacgattcttcccg

SEQ ID NO: 92655 - DNA, 597 bp, Heterodera glycines
  SCN-specific regions: Sequence locations=1-5,27-271,293-597
ttaagaatgaatgtccaacctcctcctaccgccactcattcgcagccgacaattttgccgatgccaattcagaattggtcccatgaattgggcattgaatttggggacgtgctcatcgctgatttgctgcgtcgtatgtgcagtcccgatttttcctcgtctttggcgccctcagctcgttggcatgacatcccattcttcgagcagttccgcagcgatctccaattccaatggactctgctccgatcggtgctcgtcgggggcaatcgtgggaaattaaatgccaaactgttgtccatccttttttggactgtgtcggatcgcgaggaatggcaaaaacgaacggttgcccgactcatttatgcggcaaaagacgacaaagagctggccaacctggtctccctcgtcattgctgtgttgccccaactttgccaacaccgacaacagtcgtcgggtgaacttggtctgatgagtgctgccattttgcttgctttggccgatgcccgtcgctttggcaccgaatgggaccaatttgtgatggccaccgatgccagtggaagcaccgacccaaaaaatggcagcaaagtggtggagaat

SEQ ID NO: 92656 - DNA, 420 bp, Heterodera glycines
  SCN-specific regions: Sequence locations=1-420
attctgcgcgtccacttgacacactctacctgcgtcacactccaaaacgcatcatgccaaccaccgcaaccaccaccagctcaggcgccgtcgtcccagccaacgcgggcggcatctccctcgcggagcacctcccgccctggctcaccaattcgctcgccaacctctcgaaatggctcgtgtggccatttattggcggcatcatgtacggcgtgggcgaaattacggccaaggaactgctcgcgcgcaaggcaaagtggggcgtggccccctcggcacaggctgccgtggccaaggcacatgtcgaggcgcataggaagtttgaggaggagcaaatgggtggtgggaaggttgtggcgattggatcaacctcgttgcggcggtaaaagcagttccgagtctgtgatgcgtggtggagca

SEQ ID NO: 92657 - DNA, 318 bp, Heterodera glycines
  SCN-specific regions: Sequence locations=1-221,254-292
gagaatttccatttataatggccttggcccattacggctttttggcacccaaacgacgcattgagccggccggcatttcttatgaattctcgttgatcaaagatcggctgatcctcggcctttccacacttcccgtccttcaaattgtctttcaaaacagcaggacgacggatggcgacgacattgacggagccgctgttagtggaacaaaaaatggcatatattggccgctttattttcttgatcaaattttttgtttggatttcaatgcgttaaaatcataatcaacgcgaaaaaaaaaaaaaaaaaaaaaaaaaa

SEQ ID NO: 92658 - DNA, 493 bp, Heterodera glycines
  SCN-specific regions: Sequence locations=1-493
gtccatttaagaacaatgaaattgttgcttcacaatttcttttcatccaactttttgaagggtgtcaccaacggttacccacttttgcttcgtgcaaccaaaattgagcgaatcgacggcacggaattcaatggcgattttgtgaagaaaatgatgccccggcttgactacccggcgctgctccaagcagcaaaagcggtggacgaaagggcggcggacgaattgcccaaggaattgggcaccgattgggaaaaggacgacgacttcctcaaaaaggtccactctctgctggtcagttacgaaattgtggagggcgaattggagtgtccggagagccatcgaattttcaacatcaaagaaggcatcccaaactttttggtcggtgccgacgaagtcgaatgaatgaatgatcatcagtttatttgtacaccatttctcgaattttcaaatatttgtttttttcaataaaatgataaatgctgattgattaaag

SEQ ID NO: 92659 - DNA, 511 bp, Heterodera glycines
  SCN-specific regions: Sequence locations=1-81,108-359,381-435,457 -469,495-511
gtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgactattttttgccggacgaggatccggcaaaaaaagggcaacggaacggacacgggcgacgacggcaaaaaaacggacgaagcgggcggagcatttggcgcggggtccatttttgttgccattcttttcggcatggctttgatgttcggactgatcaaaaatgtatgtccattgggagaagcggcgcgagtcgggaccccccgtactatcagatgtattgaaaaaacctggaaaacattggggccaaacaaacaaaaatttccttatttcatttgttcgtgttttttgcaccattttctatcaccttcccattgaaatttctcttaccaaaaaaaaaaaaaaaataaaaataaccaaaagagcctctagg

SEQ ID NO: 92660 - DNA, 214 bp, Heterodera glycines
  SCN-specific regions: Sequence locations=1-214
tgagagtttattgcaacgatcggaacaagacattcctaaacgcgactacctttattatttggtcctcgatcactcgccaatctcacagtacaaccgctcgctcgactacatcaatttgcttctttctgccgaatccgataacccccaggcattgtacctgaaggaattgatcccacacaagatgaaacgggatggattgctcgacttggcactg

SEQ ID NO: 92661 - DNA, 526 bp, Heterodera glycines
  SCN-specific regions: Sequence locations=1-526
gtccgaacgtccgaacgcccgccatggcttcacccatgttcgcagctctgctaatggctctcttggctacaactttggtggaaggaggacggctgcctctgaaacttcctccaaaactacctaagccgaagacttcttcactgccgcgagcctctgaagttgcaatcataaactcctgcatcacggtagcccagaagggattcaaacctaccgattcggctgttaagacttttaatgcctgccaccaggactattggggacgatccgcttccaaaccagccaccggggacttgctgaaaagtttgaaccagtgcactcgtcctgggggcttcaaaagccagagcacagtttacaaaaagtacgaaaagtgtgtcttgcggcgtgctggtcggtaaatatatcgagaattcctcaattctggaattaagttcacaactacttgagcacttgccactcttattggcagttttcagaaatagaacctaaaagccgtgcctttttcctacatagaatcaggtcaaactaa

SEQ ID NO: 92662 - DNA, 588 bp, Heterodera glycines
  SCN-specific regions: Sequence locations=1-588
tcttcttcacaagtcaatacgaagccttggagatgaaagaccaagaagtgcagatggccagggaaccaaccgcggccggtgcgtttggcaacggcacagcggatcaacaaagtgccggggatgaaaccgtttggcgcagaattgggccaagaagtcaaacatcttccgcccaggtcctttctcccggctaccaagaccccttcacgggcacgaaccgatacatgccgggctgtaacaacggagtgacgacggcacaacaaaatacgaaacgtagtccgattgtgcctctgccagacaatttctgcacttttggcctcgacggtgtgtccaaaaaagtgattgaacggctgcgcgagatgaatttgctccaaccaaaagcgttgcaactgaacgatgacgaattcgcttcggcagaagtgatactctcccaagctgactttgccatcaatgagtgccaaatcgtcgcattagaaaaaggaattttgtggtcgcccgaaacgattgtgcccgcgttggatttgtttcgaattgctttgctccatccaaaactgaacgaaatcttttgctcattggagtccgttctcggaa

SEQ ID NO: 92663 - DNA, 344 bp, Heterodera glycines
  misc_feature (323)..(323): n is a, c, g, or t
  SCN-specific regions: Sequence locations=1-290,312-323
ctcgcgtagtgttgtcagttgctgtctgtcccattctcgctgccccaattcattgacaaacttggccattctctcgccacctttcgtgcatcctccacactacgcatctgcacgactctcatttcgccgaagcggtctgtcaaccaagaaatcagaatctcatgtatgacaactgagaatcaccgccgacataaccagcaatttccctgcgcccttagagctttgccttgccgcttttgccctcctgatgcttcttgagatactggatcgtcttctccacgccacccgccttgccaattacaatacatacaattcaagattcnaaaaaaaaaaaaaaaaaaaaa

SEQ ID NO: 92664 - DNA, 572 bp, Heterodera glycines
  SCN-specific regions: Sequence locations=1-572
cacactcaatattcacccgtcccacacacatctttcaccatgctcgctaccggcaacgctgcccacacctacggcaagcctaccatggctattacccacattgattcggtcgagatcaccgtcatcgaagcccgcaacctcatcgccggcgaccgcttcaccaagaacgacccctacgtcaagatccgctcgggcctgcacgacaagtcgaccaaggtgcagtcgggcaccaacccggtctggattttggtgctcaagatcgaggccagccacctctcggacaagctcgtattcgaggtttacgacaaagaccctggtcgtgacgacttcttgggcaagtttgagcttcccctggacgagctgcgccgctcgggtaacatggatcgctggttcacgttggctgacaagcacggcaagatgggtggcaatggcgagttgcatttgatcctgaggccgcgtggtcacaactaagggtcggtgtggttgtagttctcggctcgtgtgaggccgaagagtctatgtgtgtgatattccttgatgatggtgtcggttctagtctcgcttgatttgtg

SEQ ID NO: 92665 - DNA, 134 bp, Heterodera glycines
  SCN-specific regions: Sequence locations=1-5,30-134
acagacaaaacatacacaatcagtggaacaccaacgaaaccacccatttgggagtaatgactaatcacccaatttgaaagcaaaagagagagattggacgaacgattagtgatggcattagaaaaaaaaaaaaa

SEQ ID NO: 92666 - DNA, 482 bp, Heterodera glycines
  SCN-specific regions: Sequence locations=1-482
atttctttttgaaaattttacaaacggtttcttttctgcgaatggcacttccaacaaaaatccaccaaattcccaatttactcacagttttcatttcgtcgtcacgttgtatttacgagaatctcgcccttgaggaatggctttttcggaacaatggcgtgaaggaggacggtgattctcttctcatttggaggaattctccagcggttgtcatcggcaggtatcaaaatccgtggttggaaagcgatgtccgtttctgtgcggccaatggcattcgaatttcgagacggtacagcggcggaggcgctgtttatcacgacgaaggtaacctgaacattagtcttatgaccacacatgaacggcattcgcgcaaaaagaatttgcaaattgtggccgattttctgaatgccaaattgttaggcggttgtgcttctgccaccgctccgcgactgatcgcaaacgaacgcgacgatttgctaatt

SEQ ID NO: 92667 - DNA, 640 bp, Heterodera glycines
  SCN-specific regions: Sequence locations=1-338,360-553,575-640
gtaatgaacaacgccaacgacaaatggacagcgaaaaggaggactcgaggttcgaatgcaatatttgttatggacatggccaaagatgcggtcgtttcgatgtgcggccatttgttctgttggccatgccttttccaatggatggacacgcgtccctatcgccagctgtgccccgtgtgcaaatcggcgattagcaaagacaaggtgattccgctctatggtcgcggtggtggggacagcgacccgcgcgagaaaattccgccacggccgcaaggtcaacgcacagaggagacaaatcagggctttcccgggatgttccattggggcggcgacaacggtggccatggcggcggcggtgtgcaattttcgaccccgatttctctttggccgaccaacttcgtccgacacggaagcgccatgtccattctctgtcttggcaaagtggccgatgtttatctgatcgacgagcccagcgcgtacttggacttcgagcagcgcttacatgccgccaaaggcataaaacgcaaaaagagtggcttcattgttgagcacgattttatcatgtccacttatttggcggaccgcgtcatcgtttttgacggccctcaaccgctggtgaacggaatgaaccgttttctga

SEQ ID NO: 92668 - DNA, 593 bp, Heterodera glycines
  SCN-specific regions: Sequence locations=1-80,103-593
attgcaaaaagtagagaaattagtgaaaatcaaacggagagggaatttacgactccgcaagtaacaaatgggtcgacgggggaggagaagaagcgcaatgagaggagaaaagaagcagacaaagcaccggaccaacgatcgaagaaagggcacgacgaggaagccaatgctaacgaagtgcactccaccaccggtgcccagacactccctttcacagtcagtgcccgattgtttatattcacagctcggactttcacttatgaagtggatgttgcgcctgctgttgcggaacgatttgaaagtgctcaggttgttgacatctacaacagtttaccaccaccaatggatccacgaatgaagcgagaaaatgcgaatggcatttcaggttcagtgcccactcccgaccgtttggttctccggcagggaaaatgtcatcaacgtattgcccaagcctttttctgcggtggtcctttgtctgcattggcaatttgcccacgagcgacaaaaaaaggacgagaactgattgccattggcactttcgccgatgaaaaaatgctaaagatggaaagcgaaagtcaagacgcatttgtcca

SEQ ID NO: 92669 - DNA, 397 bp, Heterodera glycines
  SCN-specific regions: Sequence locations=1-80,103-397
ccatcgaatgtacctgaccgtgtgcaaccgctacgtcaagggcaagaagattgatgccgccgtggacctcctgaccaacggcgccaagctgctgtgcgagcacaagcagtttggatccgcactctacatggcgtcggtcgtgctcaagacatggaccgacgaggaggtggacgtccatgataagacgctcgggcgcctgtttgagctcatggacttgtttgcgggttattcgcgcgagtttaacgagctgatgaagaatggcatcaaatggacatccaagtgtggcgagttctccaccggcgagccggccctccatcaccatgttggcgtcacctttgcaaacgttgccaaagtcgacgaggctcatcgccacttcatgctcggcaccaccgactcc

SEQ ID NO: 92670 - DNA, 637 bp, Heterodera glycines
  SCN-specific regions: Sequence locations=1-514,548-637
taatttccgaccaagaaggagccaattgttgcgatgccaccgtcggatttggaagtgccgacttggagaacaaccgattttcaaacgacagccctgacattgaatatacgcttgagaaattggctcgtcttgagggttattccgtcaaattaacgtcagctgggcaagtttatgcgaattttgggcatcagttgatacaacagctgggcgatgaacgtgacaaacgcagaggacgaaactcattgagccgcgatttccgcaagctctacgagtacataatcgaagttgtggactcgtggtattgggagattccattgcaatatccaatgccggaaaaaacgcaattgcttgcctttttggatgacttgcagaacaaaatggacttcgaatgggcggaaaaacgcgagactgactttgtcaattttgtcgagcagtgcgttgctgaagttggccgaaaatttgatcaaatttgtcgctggtacatggactcttatttacccgcctttgattatatcgccgacacactgaaaaagagttttcaggctaatgaatttggctttttgttcttcgacttcaatttttcaaaagtgacactcgacgacttgctcataagggctggcaacaatttgcgattgcc

SEQ ID NO: 92671 - DNA, 497 bp, Heterodera glycines
  misc_feature (492)..(492): n is a, c, g, or t
  SCN-specific regions: Sequence locations=1-90,171-497
ttctgcccacccataatgtttcacagcgaattcctcccattcgttgtgccattctttttctgcccttctttgccaattgccaatggttcgcttcctttcgctttttcctttcccttcgctttttctctcctttttctcctcccctcgtccgtttttcctttcccttctcccattttccgctttttgctatgatttggccgccatttgcaagtcgtcctttgattgtgacttcgtcgggggaatgacttgttcgatggccctttgtgtcccctcaaagtgccacctctcttctgaatgtcctaccggttgggtttgcaccagtcaattacaatgccggaggggctgcttttcggacgacgactgcgcattgatcggttggttttgcacggcccaaaatgtgtgtgaacaaggcgattgtggcgattgtcgaatgggggaaaagtgcgtggaaggaaaatgcattccgaaatggttcagagggatgaagcgaanataag

SEQ ID NO: 92672 - DNA, 469 bp, Heterodera glycines; identical to SEQ ID NO: 74222
  SCN-specific regions: Sequence locations=1-6,164-239,340-381,403-469

SEQ ID NO: 92673 - DNA, 185 bp, Heterodera glycines
  SCN-specific regions: Sequence locations=1-14,37-125,147-185
gtcaaattgatacgaaaaaacaaaagcctaaaataacgcatgaaggccagcttcggccggtgggctgatcgaatgaaagatgtttcggagacggcacattctcattggcacctccaatgttctaccaaataaattgtttccatttcttcattttgttaattattatatttaacgaaaaatttcat

SEQ ID NO: 92674 - DNA, 384 bp, Heterodera glycines
  misc_feature (359)..(359): n is a, c, g, or t
  misc_feature (364)..(365): n is a, c, g, or t
  SCN-specific regions: Sequence locations=1-281,303-384
gaaggacaaactttgcgtgatagctgaacccagcttggctgagaagggagacagcggtggccctttgatgtttaaaactggcaaaaataataattgggcacaagtgggcgtcgctagcacatcgacgtgtaacccggaaaagcccaaaagcaccgacggtcttacaactgactacactcaaattgattgcaattggatagaagaagcgacaaatggagaagtgaagtgcatagaataatgaacgaagttgatatatttgattgaactgaaacttttttaatgcttttaaatgcactaaaatattctatttaaataatttttcaattctttcaaaaagcatatttaaaataaaaacgaanctccnnaaaaaaaaaaaaaaaaaaa

SEQ ID NO: 92675 - DNA, 546 bp, Heterodera glycines
  SCN-specific regions: Sequence locations=1-203,226-320,343-546
caaaacccttccgaaaccagtgagtgcgctctgctcagcccaagcagagaaccctcgccgcaaatggcaatttgccatcgcctggcttctgatcgcctccaatttgttcgtcggcattacttttgcgtgcattgtgccctttttcccgatcgaagctgaagcgaaggggctgagcacctctttaggtcggcttcgtgatcggcatcttccaactgtgcagcttcttcgtttcgccagtcttcggcaaatacttggttgttctccgcgttcatcgtgccttcatcggtggccttttgttcacttctctgtgcacaattgcacttggtttgtccccatgtcttccgttcggcacgcctttctttgccggcgttttgcttctccgagtgggccaagcaattggcaatgcttcttactcgaccagctcctgggcactcattggccatttgtttccgcaacggattgtgctgttcacgggccttttggaagtggcatacggacttggctatgtgcttgggcctccgttgggcagcgctttgtttgaattcg

SEQ ID NO: 92676 - DNA, 558 bp, Heterodera glycines
  SCN-specific regions: Sequence locations=1-135,160-558
tttctccttttgctttcgttcgctttcggcgccaccgcgcgaattcgccggcggtagagagtcaattgcccagacggacggtccttttgtccggagaaaaccacgtgctgtcagctgtcggatgagggccattacggctgctgccctctgccaaaggccatttgctgcatggaccatttgcactgctgcccgaggacacccaatgcgatttgccgcaactttttgtgtgaattcggacggaaattcgcagccattccatcggaaaatgccggcaaaaactcaaaacggagagacagttgagcaaaaaggaacggacaaagaagcgacagaagaagtgatttgccccgacggaagttcgaagtgtccgccccgtgccacgtgttgtccgctcggcgacggattcggacgccgtcgaaaagacttttggcgactcgaaactaacgctcagcaaagcatatcctacggctgctgcccagctgaacgggccgtttgttgcgcggaccacgtccactgctgtccccacgggacgcaatgcaacgcgagggggggcgagtgcga

SEQ ID NO: 92677 - DNA, 388 bp, Heterodera glycines
  SCN-specific regions: Sequence locations=1-114,136-388
gtggtgccaccggcaaagaaacggcggccaacaaaatcggtgtcgcctccgtctctttggcagaggcggacgattccaccacgccgacgccaccgccggcgccttctgcgggtgacagcgatgacgagaaaaaagacgatgacgataaaaatccggacgaggatccggcaaaaaagggcaacggaacagacacgggcgacgacggggaaaaaactgacgaagcgggcggagcatttggcgcggggtccatttttgttgccattcttttcggcatggctttgatgttcaaactggatcaaaatgtatgtcccttgcaaaaagcagcgccagtcggacccaccaaactatcacatgtattaaaaaaacatgcaaagcattgggccaaaac

SEQ ID NO: 92678 - DNA, 499 bp, Heterodera glycines
  SCN-specific regions: Sequence locations=1-335,358-461,483-499
tgaagaaccgacacagcagatttctcatcccattacgctgttggatggccattctgacgtcataatggctggggaatggctgatcggcggagatcagatcataacggcatcgtgggatcgaactgctaatttatttgacgcagaaagtgggaaaatcatcaaatgtttatcaggtcatgatcgagaactgacctcatgttctgctcatccatcacaaaaattggttgcaacggccagcaaagactttactttccgcttgtgggacttccgagacccaatccattcagttgcagctcttcagggccacaatgattttgttacatcggtcggcttctccgccctccaccacattgtgtccggcggcgatgaccgaacagtgaaagtgtgggacctcagaaatatgcgcagcctaatttcagggattcgggtaaacatcgcggctaaccggaatttcaatatggaacaacaaaaatttgatctgcaatttccccaagacaac

SEQ ID NO: 92679 - DNA, 528 bp, Heterodera glycines
  SCN-specific regions: Sequence locations=1-225,248-253,282-426
gcaacaaatccaagcactgatcggcgccaatcgggagctaatttgggcgttcaacgaaagtcgaagggaacacgacgaactgatgcagcaattacgggtcatggccaaattggtgaacaacggaacttcaacgcgtcccgtgggggtttaaaacaccggcgaaacattgcaattcgaacagcaaaaaacgaagagtgttcgcccgaaacaaatcgccaaaaagaatgccaccactgcttctgctgctaacagtggcggaggagggggaggacgacagagaaaaaagcaatgcacgggaatggtttacgttgcgcaagaacagctgccgccttcgctggccatccttaagaaaaagccgaccacttccgcaccctttcccatttctccgagtgcgccttccgaagacagtgaccaacagccgacagcttttgacccaacgcccaatgaacagatgcgagaccgagtgaagaaggacatcatcgaggcggtggaacgtcgtcaaaatgcgaattcactggcaaacagaga

SEQ ID NO: 92680 - DNA, 652 bp, Heterodera glycines
  SCN-specific regions: Sequence locations=1-15,37-652
acgcgagccaacttttgaaggatggctggaacaaggcgacactctgtacatcccgaaggggtggattttcaaggcgagtgccggtgacctccattcgctctgtgatttcgtgtccatttgtcgtggccattctttcgccgactttcttgagaaggcttacgccgaattccttaagacaatggtttcgggctcaaaacatcttcgtaagaatttgcctccgcttttgttcgacatggccgggaatagcgtaaacgattacccgggcgaagaaacgctcgaggagaaaattattcccgacacggaaattttctcccgtgaatctggtgagaatttcgctgccttcggtccctcttacagcgatttgacggcccgcgaattcttccgtctctctttacatccggttttgacccctgacgaagaaacaaacatttgctttggcggcgctattgactcctcgttggacattggcaatgaaacggaggtcagattggtgcgaaagcacacccaaccacttctttgtgaaaacgctgataaggcattcattgctcactgaatggcaaattctcgaagttgtgaaaaatatcccgaaggaacaattgattttaccattgacgtttgacgacggattcatgactttggtcgactcttatcc

SEQ ID NO: 92681 - DNA, 549 bp, Heterodera glycines
  SCN-specific regions: Sequence locations=1-123,145-549
attttacccaagcagggcctcagttggccgctggccgccttttttatggtcactgacatggccatcggcggaatggtcactttgcccggggcgatctgccgaatcggtctctcccgcggattggcccttctccttctctccggtcttttctgctgttgttcggccattttactgggccaatgttggctgtttgtgctcgacaagtcgccccaattacgtcaaaagcattgccgaaggccatacgtttaaattggcttctgtgccctcgggcgttggatgagcattttggtgtccgtcggtgtcaatgtcactcagtttggcattgccacggtgtttttgctcctttgtgccgtcaatttgagccgcatttgttccacgttgttccatgtcgacctttcccagtgccttttgctgctcattttggcacttttactcctcccgctcactttgctaaagtctcccaacgaattttggccaattctcttcggcggaatgatttgtaccgttgcgacatttggcttcattttgttcggcatttccattgatttg

SEQ ID NO: 92682 - DNA, 200 bp, Heterodera glycines
  SCN-specific regions: Sequence locations=1-86,111-142,165-200
cactaatgagaactcagtgggtgatgagcataatgcggcatcgtccattgtccgtgaacgccgaggcgatcgcccgggacattatcgaagcaaatgaaagatgatgaggttgtaaatggaaaaggaaaaaagcagcaattaaaagaatttttggaaaatatgtttgtcgaaatatgttttacaatttgcataagattgaa

SEQ ID NO: 92683 - DNA, 520 bp, Heterodera glycines
  SCN-specific regions: Sequence locations=1-520
gacgaccgacacccgatggagtaccagcggagcattgtgacaaaagatttttaccgtccgatgggccctccccgcgacgcaattgcgcgtcgcccctctgaattagcagccgttatcactgaggactttcgtgatccgaatgtgttcgtcggtcctgacggggctctgttcatgacaacttcgagccgtttcaccaatgggacggggggcgtcgtgctgcttttccgacagaatgaaacagcggccaatggggggcccgaaggatgggaatttaagggcattctccacaaggacaaccgatggcataatgccgtgtgcgagtgcagtgggctaatccctttgggcgacccgctctcattgcagacattgtgggcatttgtctactcaatgtctaacagcgtggacgaggacggaagacaattcttaaacccagtaattgtcgggaattttaacgggagaaagttcacgccgttatttgaacaaatgttggacttcgccacgggttcttacgcttaccagg

SEQ ID NO: 92684 - DNA, 509 bp, Heterodera glycines
  SCN-specific regions: Sequence locations=1-296,318-509
ataaactttaattggttgggtcctctggaaaaagacccatagaaattttcaggttcagagaatccgtttcttatattcgtttcgagccttgaaaatccgaactcgaacaaaattcgaaaattcattccgcaactggagatactttttttgatgcttacttcctcgagacgagcccatttgtataccattaactatcctcaataatttcgcgtgtttagccaatttttgaccatcaaatgaaattcaaatttttgttagaattcgtttgattataaatttgcttgagatttgttgtcttccttttcctgtatgtgtgcatttttctctttaggcgtgagtttctcactgctgttgatggttacggcacagttgacaattggaaacacccgagggcgacgatgggagcgtcgactttgtccagcaaactgttttaggaagaaaagcaaacaatccaaccttcgtttaatgcaattattaaatcggattaactccaataaactttttgtttg

SEQ ID NO: 92685 - DNA, 567 bp, Heterodera glycines
  SCN-specific regions: Sequence locations=1-453,484-567
acgatctatcaatatggccactgtcaaggacgtcgctgccgctgatttcatcgccgctttgtcggcccacctcaagaagggtggcaagatccaagttcccgagtggatgcagtttgccaagactgccaccttcaaggagctcggcccctcggacgctgacttctactacgtccacatcgccgctgttgcccgccacatctacctccgcaagggcgtcggtgtcggtgaccttcgcaagcgtttcggcggcaaggagcgccgtggtgtgcgccccaaccactctgccgttgcctctggctcgctccagcgcaaggctctccagacccttgagaagctcaagtacgtcgagaagtctgctgctggtggtcgtcaaatcaccgccactggccgtcgtgagctcgaccgcattgccaaccaggttgtggccatcaagaacgccgaggctgcccgtcttgctgaggctgctgctgccgccgctgccgtcaacgttgaccaggagtaagatttttctggaaaatgtcttgaggtttcttgtttcgcttgcggatcaatgtaaatcttgatttg

SEQ ID NO: 92686 - DNA, 640 bp, Heterodera glycines
  SCN-specific regions: Sequence locations=1-49,72-109,131-640
actaaaatcatttcacactaaagcgactccactgccatcggcagtattaccaaattgtttttacatttattcaaatggcactttccgcctggccaattctttcttctgaaagagatgagaaaaaccaacaacagatgttgccatatgcaaaatacgaatgtgccatttcgtttgatgatggaatcgaagtgccaattagtaaagaaggactcctgactcttattcaatccggctttcttcgcgatgcacttttcatgaccacaaaattgctgaacaatattggccaagggatgacaatggcgggacgacaaacgcaaaacagccaattctcattagaggtttgggcatgtcgcttccaactaatgatggccttgcgaatgcacaaccaattgttagacgaattgactgcctttggcgagttggactcatccgaacttttccttccaagtggcgccaatgaattgaaaggttcgatggtgcctttttctcttcgacttttgcatgccgaagcgtcctcattttcaccattgccttactcgtcgatggttcgtgtacacaaacttattgagaataccgtaaaagctatcgaaattgctcgtcggaattttgcggccactgattctgaacttggcatttggca

SEQ ID NO: 92687 - DNA, 403 bp, Heterodera glycines
  misc_feature (384)..(385): n is a, c, g, or t
  misc_feature (388)..(388): n is a, c, g, or t
  SCN-specific regions: Sequence locations=1-62,84-188,211-242,362-403
gttttgccattgctgtggtcgcctccactcttttccatttggactaattgaaaacataagaataatttttatcccaaattatgttttctcatttgaccttttccccatttctctgttcatttgttttgtacacctcagaagcattagccaaaggacggcttaaattttgttagcattcccactgagcattagtaactgttatttatttactcataatataataattctgaattgtttgtccatttgtcttttccacttttctattctttgttatttattggttttcttgtcatttttccttttctggtgccattgtcatttatttttgaattttctattttttatttttctttaattttttaacaaaaataaaaacattttctnnaanaaaaaaaaaaaaaaa

SEQ ID NO: 92688 - DNA, 513 bp, Heterodera glycines
  SCN-specific regions: Sequence locations=1-513
gaatttcatatctctgaattagcctcggcaatgcattctctcgccttaatttccctcgcttattggctctcactaacacacacttgtccgactcaatcctccagtcatccgggggtacactctctatgagttacgaaaagcactctgggtacacaaaattcaaactttacgaccactacaaacggccggacgccgactatttaatgggcacgacgacaacgtgatgaccatgtcacgaattccaaagatcagcgggaaagaccaccgaactgaccaccatcaacttccaactcctcatttaccacaactgcgatgatgtcatgatgccttgccaacgcaaggtgaccttcaacatccccgattcgtacgtcacgtcgggtgcggtgccggcgaaattctttgacattggcacagtgaacatgcaaatcatattcgaccacgaagagcgatcatgtattcattaattgacagatctttatttttttattgaacaatgaatgatttgtgagttaa

SEQ ID NO: 92689 - DNA, 235 bp, Heterodera glycines; identical to SEQ ID NO: 69107
  SCN-specific regions: Sequence locations=1-149,187-235

SEQ ID NO: 92690 - DNA, 576 bp, Heterodera glycines
  SCN-specific regions: Sequence locations=1-477,502-576
ctcgccgcaatggctcctccgccgccacctccagttgtctctcgcccgccaaaacctgtaccgcctcctcctggtggccacgatcccccactgtccatcacgcgcacgctcactctcgagccagcatccacccaagtcattcgcgatctcatcacacgcactggcccatatgcctacctgcccgtcgtgcccacggtcaccgtccacttgaaccccaatgacccacccacgcgccaactcctcgacttggtccccgatctcggccaagccgtcctcgtcgccgccgatttcgtttactctaccctctacggcagtgtgggaatcgctcgccacgaaccagccgaggacagagacgacgaggaaaatggcgcattcaactactctcaagccaacctggcacccaacactgacgacgcattcacgtcccgcccgccccacccatccgtgacaacaactgctgccgaaatcactcccttgccaccaccaccaccaccaccaccaaccgcctcagccctccccaccgcaccactcccaccttgcggcccaccgccctctctccacccaccgctcccaccc

SEQ ID NO: 92691 - DNA, 639 bp, Heterodera glycines
  SCN-specific regions: Sequence locations=1-639
ataaagccatttttttcgtaaaactcttgcaaggaaaatcgtcaagaaaattcgcagtgatgtcatctgggtctcgaggttttggacgaggcagagggggcagaggaattgccccaagccaaactgagaatgggacgattcatctttcgaatgacagaattgttggagcatattcagaggctaatccgaacgaaggaattatcatcaatttttccgactctcagccatcgcagcagccgcccattgtcaacgttcagacgaggggaattttgcgtaattgcaacggcattgacgcagcatcggatgtgcagaaagcaaatggaactgccaccaatgaaggcgaacatcagcttcccatcgccgatcagcctgtgccatttggaggcgcttctgtgccgcgtgtcgcttccgtcactgggcgagggacgcgaggagtgcgcggcggattgggaagaggggcaccagcacaaaacaacaacatcagtcgtccaccagtgaatgcggagatttcgccacccaaatcggtcaccttcgactcgacgaccgttttcaacggtagcagggcgagaggaggcggaggaacgacgagtcgtggttttggaagaggggccaatgcagttgaactcggaccaggagacc

SEQ ID NO: 92692 - DNA, 303 bp, Heterodera glycines
  SCN-specific regions: Sequence locations=1-303
attcgaaatagcatgtatgctgataagcaagctcaatctaggaaaaaaccaaaatatactacaaagtacgcatccaaataaaaaatgctcacttaattttggtagtaagattggttttataagtacaaaaggatcgtagccaatatgcataagactaaaggctaaagaagaaagaagcgctactaaaacatatagtttgcaactatacttttttgcttcatataacataaatcgggagataatttcttttataaatggacttataaagcacccatctagtatataattgcaaaatttagtttt

SEQ ID NO: 92693 - DNA, 578 bp, Heterodera glycines
  SCN-specific regions: Sequence locations=1-308,331-433,455-578
agttccccgattcgggaaagcattgctccgtgccggactgtcgacaactcgactatttgcccatcacttgcgatgcttgttcgcgcattttatgcaaacagcacagaacgtacgactcccacggctgcacagagtcatacaaaaagaatgtccaatttccgatttgtccgttgtgccaacaaacggtgccaattaaacgtggcgaaaagcccgacctgcgagtcaatgagcacatcgaacgcgactgtcgttctgagttggcaaaaaagggacgttgggcacctaaatgcggcgtgaagaactgcttccggagagagcagctcgtgccgatggtttgcaaagaatgtgccgtccatttctgcctcagccatcggcaccgatctgaccaccaatgccccaaaatgccaatggtttcccatcggacgacaaagccaaaaaatatctcctcaaaaagtgccgctgaacaaatggacgccctttttgctgcgcaattgcaacgcgaagaatactaaagctcttcccgtgacggcggtggcactttccctccctcctccaacaatggcactcggaacaacgga

SEQ ID NO: 92694 - DNA, 172 bp, Heterodera glycines
  SCN-specific regions: Sequence locations=1-33,55-172
gtccacgatggttgcctctgttcacattttccacatccacaagaacatccaggacgacgctctgcaggacttgctactgttcacagagtacgcccgactggcgctggacgaggacaaaaagaacaaaccgttccactcgcttttgttccttgcccatgactggagtgtgcca

SEQ ID NO: 92695 - DNA, 547 bp, Heterodera glycines
  SCN-specific regions: Sequence locations=1-191,213-547
gacttggcccagctttttgctgcccgtctttctctcctccgttttaatgtgagcatgttgggacgtcggccatttccaattgtccttcctttggattgtcctcttcaccgttctttatgtgctcaaaacgcactcatggattcgtcgggagcagcatcgaatgagcatgcgcagcatgattatgcgctaacgcaagatggtcatggcgcattacagccgcttcgactacctccccgcgtgggtccaattcccggacaacgaacgcatcaaatgggtcaacaaaataattcaacaaatttggccccatatcggcgagtacaccaaagtgttcctgaaagagttcatcgaaccccaaatccgtgcccaacttccggcgccgttcaaatccttcaaatttgtcgctgtcgacatgggcgacattccgttcagagtgggcggtctcaaagtgtacacccaaaatgtgggccgtgaccgcgtgatcatggacatggacgtggtgtacacaggggacgccgagttcgctgtgcaagcgtgcggcttccgtggc

SEQ ID NO: 92696 - DNA, 484 bp, Heterodera glycines
  SCN-specific regions: Sequence locations=1-484
attaatcaaaaatgactatccattatactgatgattgggtgatgtaacagcactgggtagggtgaaaaccagcaaaaaatcactgtccaattctaattgtaatacttggggatgtagctacatgtggtcccgtccgacccagaggagaatgagttacaacatctgcttgtgatgagtggagatgtaacagcagttgattacgaccggaccaagaataaatgacatcgaatgctgcatgcgatggttgtttttgtaacatcactcgtcttttttttaaccaagcatacatcacttccaattctactgacggttggatatgtaacacccactgtcggactgctaggcaagcaaaggtgaccaattctactgatgattcaggatataacaacaatatgaggagtccacgcgaatggtcgcccgagttcaatggtaccccaggatttaatcgcctacctgtgcctctaatgaacaagttacctccaat

SEQ ID NO: 92697 - DNA, 636 bp, Heterodera glycines
  SCN-specific regions: Sequence locations=1-636
ttgagactgaccttttggtcaatcggcgcccggaaaccggaccgcaccgacaaattggcgcggcatcgacccttccgacgcagcattccccccgaaacggcacggcattcccccccgaaacggcaccaacccttccgacacggcaccggacctctctcccgcggcattgtccccgagacggcacaaacatctccccccgcacccttccatcccgaactagcgaaaaataccttttttttgacattattggcaacttcgaagcgacggtgtacaactacaagggccttagcttcgaaaccgccacacggacgaatctggatgggccgacaaagcgcaactgggagaagtacattaagtgctcggcaagccattcaaggcatcgacaaccgccaagaagttcgaagggatcgtcgcaatgagtgcgtcttttccattgcgcttcggcgttcttttggacatgctgcatgtgttcgagccgctgctgccccgcttctccaaattgcgcgggctgtgcaaaagccgtttgcctgagggctttccggtcaaaatggagctgcccttgttcattggagttaagacatccattttcaacaagacgcgccttcgcggagacaagacgtagagcaatcattcaaa

SEQ ID NO: 92698 - DNA, 578 bp, Heterodera glycines
  SCN-specific regions: Sequence locations=1-17,50-71,142-578
gtttgagcactttttacattccttccacttcctccttctcttcttccgtctccgatgtttcctcccttccatcctccgtcttcctcttcccccttcttcggcccttcccattcgtcctcctcttcctcttcctcctcctccgtctttcttcactcattccctcccgtgcagcccttgcagaaaaagcgctcgtcggcaaatgatggcacttctcctcagctgaaaaacattgttggacccgttgcggcggagaagggcaccgatgggcagaaggagccgtgcatttgcgagagggaccaggcattggttgtgtgccgaagatgtggccacgatttgattgcacgtgttcaattgtgctgcccgcaacatccgaaacggatttcgctgatggatctgcgcgagtgtcccaactcggcgtgccgaagtgtgcagctgagcgaggtcaaattgccgacggacaaatgaaaggccaaaaggcaaaagcgacaacaatttttgacccaaacattcacatcgaatcgttcatcaattcacttgctcacccacccattcagaacacgatgcttaaattaattgac

SEQ ID NO: 92699 - DNA, 635 bp, Heterodera glycines
  SCN-specific regions: Sequence locations=1-18,41-71,93-324,348 -557,584-635
aattcggccaggaaactcgcaatgcttgtcccaacccgatgaaatagcccctcgcacccaccgtctaactgtccaacatggcatcatcagcaaagaacacgatttacgttggcggactggcgcccgaggtcaaccggcacatgctcgagaacctcttcattgcctttggcgacattgtcaacgtcgacgtgccattcgacccgattgcccagtgtaaccgcggcttcgccttcatcacattcgaagaccccgaggacgcactggctgcaatcgacaacctgcacctttcggaaatctctggccggaccatcaaggtgaatctggccaacgccgccgcaatgagcgcttcgggacagcgcattcataccaaagccgtgtgggaccaagccgccattccaaccgacgaccttgttcccgcttcagggcaaccacagtccgcaggcgcctcggtcgccaagttgccgaagcccgtctcggccagcaatcctcgtgtttggttccaggtctcgattggcgacgtgcccgctggtcggatcgtgtttgagttgcgagcggacgtggttcctcagactgccgagaactttcgtcaactgtgcacgcacgagaaggggtttgggtaccgcgggtcgcagttt

SEQ ID NO: 92700 - DNA, 547 bp, Heterodera glycines
  misc_feature (248)..(248): n is a, c, g, or t
  SCN-specific regions: Sequence locations=1-547
tttgttcatggtggtcataattggtcatcgcggagtgggcaaaaccaatttgctccttcccttttaagacaacactatctccaccacttacttcacaaccactggtgagtattccgcaacagtgaccatttccgtgtggggcaacaaaattacatttgagatttcggactcaacctgtcaagaacgattcccatcaataccttccacttattaccgggggactcgaggtgatatccttgtgttcgacntgaccagcattgagtcgttcaacaccgtgaagcgttggcttcacgaaattgacaccgattgcgaaaacgtgcaaaaaatactcgttgggaacaaagtggacgagccgagcagacctgccattcccgaaactgatgctcgacgttttgcagagtccatgagaataaattatttcgaaacttctgccaaagaaaatctcaacgtggagcatatgttccaatgcataacccaaattgtgctcgagtcgtgcgtggaccgggagaagaacgatcctagacaggcgacggatgtgctcaaaatg

SEQ ID NO: 92701 - DNA, 598 bp, Heterodera glycines
  SCN-specific regions: Sequence locations=1-598
gacctttccaactttcctctctccttctccaatcgtacgaaccgaagcttgacgctttcgctctcgaatcaaccatcaacccgaagctggtccttcaccacacacccaccatcaccgccaaatcgacacttgtgctgcgcactgtctcgagactcgctcacgcaatcaactgcgacaagatccatccacggctcccgactcgtctccctctctactcccacttccacactccaccctcaaccaccctctaccaccatgggtcaactcatctggtcactctggggctactacatggcgctcacgtcggcagcagccatcatggacggcggcctctggtccatcctctacaactacccaacggtcgaccaactgcgcgggcttcccatctacaatggcgtgtcatggcccggcatgttgtccatgatctttgccctcgtcacggtcgcggtcgaaaagtcactccggccacccgtcggattgcgtgccgtgttctacttgattgtctcgctgattggattcttgcaattctcgaccgtggtgggggcccagtgctacttttgcacatcgattgtgtttatgactgcggcattcaagggag

SEQ ID NO: 92702 - DNA, 644 bp, Heterodera glycines
  SCN-specific regions: Sequence locations=1-576,598-644
cccttctcgtcgtattgcgagcctttcgatggctatttaaaatttgatggtgaatcgatttgcttctcgggttgggtccaactgccccaaggaatgttcaaacatcgcaaaaggggttgggctgttgtgcggaacaacacattctcaatcagccaagacgacgaaagtcgtactccgttctttgggccggttgaattgtccaagtgcgtttttcttggcaaagagtcagattccgaatctgtggtggtatttatactccgtgatttgtcaaagagaagcaaaaatcagaaacatttgctgaattcttcgggcgaacttaacactgtccgcttcacacctgaggagaatcacgagttttggctgtctctcatggcgaagtgctgttccccacgaaatgatctcttcggagagaaattgccgatggtcgaatgttgcgggaggctgtgggtgaagcaggggatcagtgggcattggaacgagggatgggcctttgtgcacggacactctttgacctattgggtgcaggcgccgaatgccattgcggaggtggacattcgaaaaatatttttggtcaagcaaaacgacattccctcctccgattggtgcaattacatcgaccattcgtcgtccggacctttgctgat

SEQ ID NO: 92703 - DNA, 535 bp, Heterodera glycines
  SCN-specific regions: Sequence locations=1-56,81-535
attcgcttcctatacgtcaacgcgacaaagtctaaaaatcaacaaaaacacgaatgtggtcgtccaaggctttaccggcaagcagggcactttccacggccagcaaatgattgagtacagcacgaatgttgtggccggtgtgtcgacctcaaaagcgggcactgagcacttgggaaagccgatatttgcaacagtcaaagatgcccggaattttactggtgccgacgcttcagtgatttatgtgccggtgccctttgccgcggctgccatcgacaaagcgatcgacaccgaaatccttttggttgtgtgcatcaccgagggaatcccccaattggacatgatccatgtcaagaaccatcttctgaagcacaatccgactcagctgctcggccccaattgtccgggaatcattgcgcctgacaaatgcaatattgcgctaatgccgggtcacatccacaaaaaaggggttattggcatcgtttcccgatcgggcacactcacttaagaggccgttcaacagaacactgagaacggg

SEQ ID NO: 92704 - DNA, 613 bp, Heterodera glycines
  SCN-specific regions: Sequence locations=1-10,43-500,523-613
gtgactcggttgtgctgtcttcttcatcttcgtcgttgtccaaaacaatggagagtgaaactaatgaggacgaaattgaccaagaagagcagggaaacgaacacactcaagcggaagaggacacttcccaccatcagcagaaatgttatgttgcgaaatgcttagactccattgcaaaactgcaaaggacgttccaattaagcaatgcctcggcggatgttttggaccgtgccgccgattatatgcaactttatttggaccgttatgcgaatgggaagttcggcgcagattgggttcggcgtatgcttttcatagcgcgaattcacggtgctccgttgtcaaggcttcgcttcattgacgtgaataaacacaaccgtaaaatggcggctttgtaccagtcgcttggcccgggctttcagacgcgttggctcagcggagccatcgacatggaacaattttttgctcgcatggattttttggagtcgaagtacggagagcgtctttgggaactccattttgtttatggctatgaaaatatcaaccgttctgaggggtcgtttttccgttggcaaatcatctcgactgtccgttcgctttataaaggaattctgcg

SEQ ID NO: 92705 - DNA, 413 bp, Heterodera glycines
  SCN-specific regions: Sequence locations=73-167,190-413
cctcgtgccgaattcggcacgagggaactagtctcgagttttttttttttttttttttttttttttttttttataaaatatattaatcagattcaaacaaaaattaacaattaaataataaattggtctttccgggcggaagcaacaaattgattagtttatacacctttttgttctttcctcttttttgcttatcattcgtccgtccgattaagctcggcgatgtccaacgccacctcacaactttcgcgcacaactctctcttcatccccaacgaattgcctcagcaaccgttggcattcgtcggttgcaattgagccgagtgcctcggcacattcgtgcctaaccatgccattctctccgtgcatttgcagtcgagcggacaatgccgggatggcgacgggcgattgaat

SEQ ID NO: 92706 - DNA, 609 bp, Heterodera glycines
  SCN-specific regions: Sequence locations=1-267,289-480,503-609
atctttatttatatttgagaatatgccaacaccaatttgcgatacgccttcgataagcggtgtaaagaaagaccaatttgaagcgacaaaaaaatggaggaaggccctcaaaaattttcacgagagtatgccattgtccactcaccggcgccagttgcgaacattcacagaaacattcactgggaaagatgcgttggattttgccgaacaaatctttccatcagtttttcctttatgcaacaccagggataagtccagacaacttttggaaagattcttatgctttgggtacattacaaatgtgcgtgatgaaaattgcaaaagcttctcagacaatgccactttgtataagtaggttttgcaacgaacgaattgcccaaatactctcgagtagtcaggaagacgaaatgaattggaggcgaaatgtttttttggcacggtcgtcttcagtgcgcgacaaagacataactgatcggctacaaattgaagaattcgcccccaccaaaaccactaatttgagggaagacttgtcaaaaatggcaaaactgaacggtcgcctttcaatctcatgtcaagacatctcggcaatggaaaaacagaaccaaggca

SEQ ID NO: 92707 - DNA, 624 bp, Heterodera glycines
  SCN-specific regions: Sequence locations=1-624
tgaccggtctccaagtgcacggcaatgccaccgtctagggttacatttcggcacttcgccggggctcacggctgttggaattggatgtgtttgacggtgaacatggtgagccacaaataacgcacaaacgcacattcattggggcgatcagtctgcgcaatgtgttgaaatgtgtcaagaattacgcatttgtacaaaatccgtacccagtgatccttaccattgaaaaccatgtgggctttgtgcagcaacggatcatggccgacattttccaagagattcttggtgaccatttgctgattccatcggacgacttgcacaccaagccattgccatcaccgcagcaactgaagcacaaagtgttgttgcgtggcaaaaccgccggcggtgctaccactgctgacataaacggcggcggaacgcacgccgaaacgacagcggcgacaatggcaccggcgagtgttgccgcaaacaacggcacgccgtgcaccgcagcgccaccaatgggcactgattatgacaccagggaggagagggaggacagcccgaagcagtcgcaacgcaatctgccggtggacccaaaatttggccgactcatcgccttgccatccgtcaaactcagtc

SEQ ID NO: 92708 - DNA, 612 bp, Heterodera glycines
  SCN-specific regions: Sequence locations=1-212,386-398,508-612
caacattcagatttaaaaaaggtattcagatttaaaaaaggtatagcgcttttattattgctttctacaacaatgctcgcatgtaatgcttctaaagaacgctgccgatcagaaaaacagcaaggatatatgcagaaaaataaaataaaaatacaaaaaacaagtaaagcagcacaagaaagaaaagaagcagcaaaagcaaaagcagcggaaagaagaaaagaagaagtaaaaagaaaaaaagaagaaaaagaaataataaaagaagcagaaagaagaaaagaagcagtagcaatagcagaagtagaaagaaaagaagcagaaataaaagaagaagtagaaagaaaagaagcagtagcaatagcagaagtagaaagaaaagaagcagtagcaatagcagaagtagaaagaaaagaagcagtagcaatagcagaagtagaaagaaaagaagcagaaataaaagaagaagtagaaagaagaaaaaaaaagacagaagcaaaaagaagagcaatagaaaaactggacccactaacagcaggggaactggaagcactaacagcagaagaacagcaggaaaatagaaagagagtagcaaaaagaaaaaaaactaga

SEQ ID NO: 92709 - DNA, 639 bp, Heterodera glycines
  SCN-specific regions: Sequence locations=1-50,72-210,233-507,529-639
attggattgtggtcaattaccgcgaggcctaccaaatgtacgcctgcaatggcattctgttcaaccatgagagtccgcgaagaggcgaaacctttgtgacgcgtaagatttcgcgtggagtggccaaaatttcgcttggccaacaggaattggtcgagttgggcaatttgaacgctttgcgcgactggggacacgcgcgggaatatgtcgaggccatgtggatgattttgcaacaggattcgcctgacgattttgtgattgccaccggaaggaattacacagtccgacattttgtcgaattggcctttaaagagatcggcgaaacgattatttgggagggcgaaggcgtcgacgaagtcggccgcgaaaaagagaagggcactttgcgcgtccgcgtcaacccgaagttttaccgcccgacggaagtcgaacttttaattggggacccgagcaaagcgaagaaacaattgggctgggaaccgaaagtcgagattgaggaattggtaaaggaaatggtggccagcgacatcgaactgatgaagaagaatccgatggcatagacgcggaaccaatggattaatttaattatttttgactctgggccattttcacataattgcataactgtgattggctggg

SEQ ID NO: 92710 - DNA, 602 bp, Heterodera glycines
  SCN-specific regions: Sequence locations=1-602
gtacacgccctcccattcatacaccacgatcggcttgcacaaataacgaagacacgccactacactcggccacccaattcctgtctttgcggacctttcttcaaatgccaactcaaaagtcttgcagccgctcagcaagttcaaccaggaaacagaacaattccgctgcgtctttggcgactgccacatccacctttgcgccagcccgctcgacaaggagtcgttccaagtctatctcgtgattgacaatatcgattggccaagcagtacccgacccgagcccttgacggcatccgtctatgtcgtcgttgaagccgggaaaagttcgtacgacaatgtcgacacggccatgctttatctcgttaccagcaagtggaccctggtcgatatgaatgttggcgacatttttactgcgtcccactcgctgcgggggttgcttccagcttaagaacaagatctgggctgcagcaggatggtccggtattacgacaacggatactacaacgacgggtatcgcttgtggctccggaaagtcaccctcaacttcgaatcggccgcaaccgacgctcgctctgcacacctacctcccagcccgaccgcaa

SEQ ID NO: 92711 - DNA, 181 bp, Heterodera glycines
  SCN-specific regions: Sequence locations=1-46,71-86,109-181
aatgaccgtttccgacgacatcaaatggtggggcttgccccttctcgcgcttcatgaggcggctgagctttatctgagtgggatgcttgaggacaccaatttgtgcgcgatccatgcccgtccagtgacaatcatgccatatgatatgaggttggtcccctagattcgtggcaatacattt

SEQ ID NO: 92712 - DNA, 598 bp, Heterodera glycines
  misc_feature (461)..(461): n is a, c, g, or t
  SCN-specific regions: Sequence locations=1-598
acaacccattctcgtattggtcactggcgcggctggaccacttggctattctctggttctgcacctctccaaacgggatgtttttggccaatatctccccattgtcctcgtccttctcgacatccctcctcttactgaaatgctcaccggcgtccattacaaattgattgactgtgcgcttcccaacctcttctgcgtctaggcaatgaccacggaagaggcggccttcacagacatttactacccttttctggtcagagcgatgccccgctcacaaggcatggatccaacggaccttcttgcggcctatgtccgaattttcggatcacagggcgaagctttggccactttttccaagcccacagtcattgtgctctgggtgggaaatcccgccaacacacacacattaatttgcgcctaatacccggccaacaaatttccggctaagaattttagtgccntgactcgtcttgaccacaaccgtgccatggcacaagtggcacacaagtgcgcacatggaaccaccgttgggatggtgaaaaatgtgatcatttggggcaatcactcgagcactcagttcccggatactcgacatgcc

SEQ ID NO: 92713 - DNA, 602 bp, Heterodera glycines
  SCN-specific regions: Sequence locations=1-7,29-46,69-409,431-602
cttgcatttgggcctccaacttctgctccaacattgccttccgcaaccgatgacactgacagtgtccaagaaaaccaagtggagtcatgggtggagttggccccgagtcgggcaagtctgtgcagcagcattgaggccgtaatgttggacagtgcgagcggaggcgaaaatagcgtgaccagagactcgcgactcagcccggtcagtctgcagagtccgcacgtcgagttcgagacgtcgctggagcaggtcaaataccgcctggtcaaggacatgctgccctttgctgacggagcaaagcctagcgattggctttgggattggtcgtcccgctcagagacgggcaatgttcctcagaagtcgggcgccaaaagcaaaaactgtggagcgcaaatcggttccacgctcaccacccctccgaacagtcccgagccagagagctcagaatttgagttcaaatccaaatcatcaaaccgttcaattctgaagaaaacggcgagccgaaagtcggtgtttttgcgattcgatgtgatctttggattcgtcttctcgaaccttgtcactttctttcttggtgccgcgattgggtattgcatttgccg

SEQ ID NO: 92714 - DNA, 423 bp, Heterodera glycines
  misc_feature (396)..(396): n is a, c, g, or t
  misc_feature (398)..(398): n is a, c, g, or t
  SCN-specific regions: Sequence locations=1-326,349-357,380-391
tcattggtgcccaaaaccaaacaaccgcacagctgcagcgaaagtacgccgcattggagacgcgtgtgcgagaatacgagacggaactcgaaaacgggcgggagcagatggaacgtgccaagcgctacattgttgaccaggagaacagaccggagaaggacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaatcggggaaagatcgtcgatttttctgtatttttcttaagactaatttacataaaatgtatttttaaataaattaactgtttgcaaaananaaaaaaaaaaaaaaaaaaaaaaaaa

SEQ ID NO: 92715 - DNA, 377 bp, Heterodera glycines
  SCN-specific regions: Sequence locations=1-314,352-377
aaaacgaaaagccgaaaagaaaagaacagaaaatggacgaaggaacaacggaaaataataataacagaaagagcggtgcaaagaaaaggaagcagaaacagaagcaacaaagcgttgttgctgaagtgactgaaccgcacaacaaacaatcggagacagaagaggcggaaaaggaaaagtcgaaaaacggcgacagcgagaaagacggaaaaaaagtgaacgaagcgtcaaaaccgattccttgccaatcaatttcggtaattggagatacagtcaaatcgacaatattattcatcacctttatcctttattccaaaattttgttttatttttctttaattattaaattttgtttagccaaaaaaaaaaaaaaaaaa

SEQ ID NO: 92716 - DNA, 650 bp, Heterodera glycines
  SCN-specific regions: Sequence locations=1-650
tttgttatcagcctggccattacatcagtgactgtcccgctcgcttcaacagtccctatgaggagctgacgccgtaccaaggccgcaagaagtgctatggcgaatttcaatgtgaacagtgcaaacgcaaatggacatcgcagaacagtgtggcgaatgaagcgcaaagctgcatcaaatgccacgtgccggtctttccgcacaaacagcttcccgtggacaaggctgtcgcattgggattggttaaactgcagcggcttccggtcaccaacattggctccacttccaccgagaatctcatcgaccagtgcaccgccgctggcattttcattgacgacacaccgtccggcaacgcttttaatggactgaacagcgactcggcctcgtcttcgccgtcgtcgttggaccagccgatgccgatgatttctccggcgacctctctgatgatttgatactgtttcttatctccatcactgcgactgcttcattttctggcatgcaaatgttcctcctctcctcaatgacactgttcacttccgcccacctgccaatccaatcggctgtcctcagttagccgtttcccccaacgtcgtcgcgcccatccatccgttcactacacaaccaacaaaactcaacccatcccgcactcc

SEQ ID NO: 92717 - DNA, 476 bp, Heterodera glycines
  SCN-specific regions: Sequence locations=1-3,40-88,110-476
aagaaatttaattaattgaaataaaataatttttaaaatgaaaatgccatttcattggacagaacaacacgggaatgtttgccggaaaatattgatcatagtctccaaactcaaaaatgctgaaaaacggtcggaatcgatgtgcgcaatgattggacttgcgaccaaagaaatgccattgtatggaagggttggcacttatccgaacagttacggacacagaaattccgccgattttgtggcactttttccttctgaagatggccctctttttgtttgtgtcactgcacgattccgagcacaaaattgaggcgaattttgggccggaattcaactttaatcgtaacactctctgaagaaaaaccttttaacgattttcattttttattttgtaaacgatttttcttaatcatttaaaccaatttaactttttttgtattattaatgcatttttgaaaaaataaatattaaattgc

SEQ ID NO: 92718 - DNA, 424 bp, Heterodera glycines
  SCN-specific regions: Sequence locations=1-424
tctaaccgcagtagctgcatgaccacgggatcaactcggcgattcaatcctcatcccttatgcgaagcgctcgacgcagaggattgtcctaatctggaaaatttgttcccgcggaagttcacctttcgggctcgtcatgattcccctgggcgcttccgccctttggaagcccttcaccgaagggccggccatcgcagtgttcgccggcgtgcccaacgtttttctgtagctcttcgctttcacgccaattctgctccatttcctgaccaaacgttttgcccaaaaggtgttcttcaaaaaaagggagcagatgttccccaccctccactaggatttcttccaacgaaaacgcgctcttggctataccgccgatcaattggtcgatgcgtctgacctaccaaaggacaggcgcttttggctgcca

SEQ ID NO: 92719 - DNA, 628 bp, Heterodera glycines
  SCN-specific regions: Sequence locations=1-528,550-628
ataaaattgcctgcaccgtaggcaccgagaagtgagaacctacttctcggtgcctacgcctgcacctctgtttttcaaattttcattttataaactgcagttcaactgttcagttaaatcctcctcgccactgtgttcacttgttgaaactacgaaactcttaatcgtctaatgataatgtagttgaaccataggcaacggttgaacctacctgctcttgttattctcctaactattttgcacttcacatcttccgaggccaacgttttgatacatactttccctttcccaacaggtaattcatccgctagtcaattgatggactcatttgctattaaaatggaaatcaacagattgtgtgaaaccagcccatattcttgttcatactcgctttagggccagctctaccatcactggattttttaaaatttctgtcattactcttgtcatcgcattcattgaaggctcataatcaggggtgtggaatgtctatattcaagtaaatgattgaccagcatggaacggtggttagaaatgtgagaagtccagaagtattttcttctttctctggttgttcaacttttttttaacatggaagcagacagcaatttcagcaagaatgaagcag

SEQ ID NO: 92720 - DNA, 476 bp, Heterodera glycines
  misc_feature (466)..(466): n is a, c, g, or t
  SCN-specific regions: Sequence locations=1-453
ttttttaattatttaaaatggttgccaataattccgacaacgctaaccccaattcacatgaacagaaagtccaattttctgcaccgcgacgaaattcgatgaatgaactttcgatcaacgaagatattaacagaaaagaaggctcatcaacttcagcttcacatccctctgatttgtccaccaatttgacaattcatgttgatgaacagtcacaaatgcttatgattcatccaatgactgaaccatcggttgacggcaaaagtcaacaaaaaagtacggcttcagcaccagcggaatttcagcgtgccaaatgtttagctgaaagtgaagtgattaaggaaaagccgagcattcgaactcggctcattgtttttgtggtatgtggtgcgatcattgcgttctgtttgatcaaacttttcatatggaaatgattattttgttcaaaaaatgaagaaaaaaaatattnaaaaaaaaaa

SEQ ID NO: 92721 - DNA, 264 bp, Heterodera glycines
  SCN-specific regions: Sequence locations=1-55,83-131,184-242
gttacctaagggataacagcgcaaaatttttgagaagttctcatttacaaaataaattgcgacctcgatgttggattaagaacaacttataaagaaaaatttataagagttggtctgttcgcccaaataaatcttacatgatctgagttcagaccggcgtgagccaggtcagtttatatctttgattaaataattctgcactacagtacgaaaggatctagagaagtaaagtttttatatagaaaaaaaaaaaaaaaaaaaaaa

SEQ ID NO: 92722 - DNA, 581 bp, Heterodera glycines
  SCN-specific regions: Sequence locations=1-581
aagaagaaaaagtggcgaagaattggccaattgatccattcatttgaaaagaccgcaaacattggcaaaggtcaaaaagaacggcagaaagtcaaaaggacagcaaagggcagttcggcaatgcctcggcactccttttggcactttctttggtcattccctcgaaaattcgctccattttattcttccaaatgggccgactcattccgacccaaaatctttgcaaagtttgcggggataaaactttcgggcgccattacggtgcgtgggtgtgcgatgggtgcagctgttttttcaagagaagcattcgtcgaagtgctgaatataaatgcgttgcgggcaccggcaaatgtttggtggacaaatgccgtcgcaattggtgccaggcgtgccgttttaacaaatgcattgccgaggcgaatatggccaaagaacgcgtgcagaaggagaggggtccgagaaaggcgaaacggagcaaaagcggaaaaagaaacgaagtgccaaaggaagcggaaaagagccaaagggaaagcggagagacggacggaagggggcagcgaagcgttgtctcctcccttccc

SEQ ID NO: 92723 - DNA, 342 bp, Heterodera glycines
  misc_feature (319)..(319): n is a, c, g, or t
  SCN-specific regions: Sequence locations=1-319
aattgttagcctattaaaatgcgctttttccttctcctaatgcttattattgcctttttatgcgcttcgccagttgttgctgcaaagaaagcgagatcggtgcctctggtaaacgtgccggattggaacattgagtcggcaaatggcggcgacgggacgaccgatacttaatgtgagatgtgccaaaaacatttggtcaataagtcaatgtgatatctgatatgatttgatggatttattgattgatcactttgattaagcaaagttaccctgcttaatgtgttaacaacctccacgaataaataaaacattttaggcnaaaaaaaaaaaaaaaaaaaaaaa

SEQ ID NO: 92724 - DNA, 142 bp, Heterodera glycines
  SCN-specific regions: Sequence locations=1-142
tccccgtctgtcggccggccccgacctcaaccaaatggtgctcggcacggagggcactttgggcatcattgtgcgtgccaccatcaaaatattaccaatgcccgacattcctcgcttcgactccactccttttccccacttt

SEQ ID NO: 92725 - DNA, 630 bp, Heterodera glycines
  SCN-specific regions: Sequence locations=1-630
aaggacagcgactggtcgaggaactgttcgatgccgttctcatctgttcgggcgcccgcctaaggcggtggcgccccccggagtaccgtatggagagggcgttcaaaggcacagttatccattcggaacagttcacacattcgtccgactttcgtggtcagactgtgtgcgttgtcggccttggtaactccgccgtggctatttccattgcattggcacacacagccaaacaggtgtttctgtgtactcgtcgtggtgaatggatattaccattgcttcaatccgacggacagaagccatgggattggcctttcagcagccgatggcatttttggggtcgccgatgggtgccgaaatgcctccgaaatttttgttgggaaatgagtgcccaatcagtatcaccagactgttcacaaaacaacggaattgggcgaccaatgcatcgattgctgagtgccaatttgacatttggagctgaacagctctgcccactgcttgcttccggccgaattcgaattcgcccaaacattttgtcattgtccgactcgaatttggtcgaattcgccgacagaactgttgaacaacacgtggacgcgctggtcatctgcacgggtttcgaattcgacttta

SEQ ID NO: 92726 - DNA, 628 bp, Heterodera glycines
  SCN-specific regions: Sequence locations=1-285,310-628
catccgagtcctttttttgggtgttccttctgttcggccttctgtttgcgctggtggaggtgtctctgttcgctttgctcgtctctccgtacctttccaagctgcccaattccacaattgcccttctcgaccatgccattcccttcaaccctggtggcttggctcagatggaacaccgcttcggctgcatctttgaccagaatctttacgagactttcaaacgtcagatgaacccgcggaacacctgcgacccgttccttctgtcctccttcgtgccgcggcctctcctcttcgtcttcgtcctcctccgacttctgcccattctctgttttctctttttggtcgctgctccccaaaatgctttgagcatttcgctggccaaatgcattcttcgcgttaagcccaccatcagatacaaaaagaacgccaaaagcactccttcaaagagtttgccatcgtattactcgcacaattcgccgacaaagacaacctttggcgtcaaagagaatgtgccaatctcttccccgttgccttgcggcacacaaattccaccaaagactccgccgttgggttacatggatcacagaataaactataacaatgccgcctttttcgccgtctccggcgc

SEQ ID NO: 92727 - DNA, 609 bp, Heterodera glycines
  SCN-specific regions: Sequence locations=1-308,330-346,373-609
gtttgagtaattttttattttgtttgccctccccccaccccaattaaatgaggccgtggacatttggcctggtcaagcccgatggggtggccaacccaattgccgtccgatggcttctcagcgcaatgcattgtgagggctttgtgatcacaaacggttgtcgtctgacggtgacaccggacttggccggcgagctgtactcaagccatcaggatgccttttattacggacgtctcatccggcacatttgcagtggaccgtcggtggcaatgcgaatggaattgcgcaagttgaacccggcacaaaacgcatttgatgaagatgatgaagaaggcgacgagcttcacggcttttcctcctcctcctccgctttccatcggtcggcgacggaatgccaagaaaatgcgaaaaaatttgacccattggaagcgatcaatcggtggcgcactttgcttggcccgtccaaactgttcgccaacatttatttgagcagctgtgccgagtttgatgagatcaaatgcaaaaatttgcgccaaatgttcgcagtgtcggacaccaggaatctttgccacggctccgactcgttggactcgctgtgccgggaattca

SEQ ID NO: 92728 - DNA, 309 bp, Heterodera glycines
  misc_feature (303)..(303): n is a, c, g, or t
  SCN-specific regions: Sequence locations=1-280,303-309
gatgttcatttggctgttgttgctgccttcctttttgtttctcctccgcttaagtcatgccaatttgcttatccctggcattatgacggaacgcgtcgaattggcaccaaaatcgcaagaatacatcggctttcttcagtcggctttgaatggcactgaggtggaaattcgggtcaaatgtgaggaggacgttgaaatcgaattcgatgtcgaatttgccattcggagttcgccttgcgccaaggaatttattgtggacaaaatgcgcttctctcaagtcaacaatttgctgcaattttattnttgaca

SEQ ID NO: 92729 - DNA, 484 bp, Heterodera glycines
  SCN-specific regions: Sequence locations=1-484
cgaccctttgacctgttggtttcgacaacagaccgacgtccgcggacgaatgttggcacgcattcctaacctggccagtgccatttccaagcgcatcgcctggtcatttctgattgagccgggacgtccgcccaccgatctttccaaattctttgccgaatttgacgtgctcgaatcatttttcgacaaagctgaactgtcagcaaccgaaagttcgcaaaaggcattcgacgcgaattcgttgttgaaagtgcgcaatcggagattgacttgtgccgatgggtcccgagttactttcaatgttccggctgaactcggtcgggagggcataacgcacgaggagttcgccgccacgaagcagcacctccgaattgttggggatctcgactgcccacagatttcgacacgcgttgaatttgggcatggcgacttcatcaatgccagctatgtccggggaggtccgcttctgaaacgttcattcttg

SEQ ID NO: 92730 - DNA, 615 bp, Heterodera glycines
  SCN-specific regions: Sequence locations=1-2,41-109,133-615
ctcccttttcccctttttgaatttcaataaattattttccaatttttttttctaaattttgctgaaatgtcggccaaatacttgcgcagaatgcccccctctctttcgcttcttttggccctttcgatggccttttgcctaatcactttggtactgaaatgccccgatgaagaatgcaaaaacaatttgagggaaatcatttcatttccaatggacggcgacgaaacaaatggaacaaattcatcgtaagcaatggaaaaaacggcggaaaatgcacaagagtttttgctaaaaatgtccaatttcgacaaattcgcatgtaaaattggggacaaatattgaaaattaattgaatggattgatcatttgattattatttattttcttttctttcaatttttcgttttgttctgctgccctccggccataggccattcattcgttcattaagtcaattaattaattcaattgttttatatttgtttattttccttcgcttcgttttcattgtttttaattactttttttatttcctatcattcgctgaataatgtcataatttgaaagtgcatttcaattttggattcgttacataaattgactttttccccaaaa

SEQ ID NO: 92731 - DNA, 208 bp, Heterodera glycines
  SCN-specific regions: Sequence locations=1-6,29-208
cattctgatcgttgttgctggcgcttcgggccttccggcgctgaaaacggcgttggaatacggcttggacgcggtgtgcatggaaaagtcggtggatattggagggctgtggcgctacatggaaaatccgggacaaggagaagggaccgtgatgaaatctgcggtgatcttttcgatcaaagacatgtcagcgtacactgatttatcc

SEQ ID NO: 92732 - DNA, 565 bp, Heterodera glycines
  misc_feature (483)..(483): n is a, c, g, or t
  SCN-specific regions: Sequence locations=1-512,534-565
tcgtcgcctcgccatgaccaaagtctgcatgacgcgccctttctgatgtcctcctccaccgctaatttccctcggtcctccgtccgcgacattcccatccaacgttccgcgtccgcgttcgccccaatgtttggcagagccgcgggcggcacggtgccgccgctgccctcctcgcggacgacaacggccgcaccaacggaatactaccgcaaagaggtgctgacgcgcactctcgtcacgcgctcaaccgaggcgctcagtgcgccgcttccgcttggccgttcgtcccctgcggcgccttttctgacgttggaacagttgccaccgcagagggatgaaatgccagaggaatattggcttcgctactcgcgaaacgtcgaagaggaggagcggcgagtgcgcgaagggcaagagaggcgaaagcgcgaggaagaagaacgccgaaagcgcgtggatgagcagcgccggcgatgggagcagcangaggtggagcagttggagcggatacggcgtgagagagaacgaatggaacaggcattggaggcgcaagcgttggaccgcgaga

SEQ ID NO: 92733 - DNA, 581 bp, Heterodera glycines
  SCN-specific regions: Sequence locations=1-581
accaatttgtgttagctgcccggatggactctttctccaccttccgtggtgccaaaggtggcgatttgtcagtgctcagttcgctcgtttcccttctgctcgttgcccattctgttggccaaaaaatggacatattcaatcggctcgccagtctgtcccgtcgtcagttgttgttcgcctttttgcacggcgagtcgctcggttacattggcagcatttttttggtgtgggacatgggacgagggcatttccctgccgtggcaaagaacttctccgaagagtcgaagaatgtccgacagattggcgtggacgaactgtcctttttcatggaacttcaacaaatcggcgcgtcccccaaactttacgcacacaccgacgcacaaatctacaagcaaaacaaaagcctgattgatacggttcttcataatgcaaaaggaagcggtgaacatttccatttcgtcgatccttcctcagtgccttttggtgccgctcctccgtccagttaccactccattatgaaggcatctgataaagtccccggtctaattctgagctcatttggatccgccgactacgaatat

SEQ ID NO: 92734 - DNA, 574 bp, Heterodera glycines
  SCN-specific regions: Sequence locations=1-298,324-574
ctttgttccgtttttaattgtaaaatattgccattttcatgcataaaaattgcgtgccgatgtcgtcgaatgtgagcaattcgccatcaacaccaccaacaaactccgtgccacaaatacttctccaacagttcggcaaggattttgttgcgggcgctgtggccgcttgtgttgccaaaactgtcattgctccggtggagcgcgtcaaactgattttacaactccaaactgcccagcggaccatcgcggccgcgtcccgctactccagcatggtcgactgtttcgtgcggttgcctcgagagcagggcttcctctctttttggcgtggcaatctgtccaacatcgcccgggcggcgagtcaggcaggagtcgcttggcatggcttttaaggagttgttcaagcgttggtgtgtcactgagtctgatcgctctgcaaattatcgtcgttttgttgccggcaatttgttggccggcggtttggccggaagcgtcacctttttcttcatttacccgttggacttctcgcgcactcggctcgctgttgacatgggcaaagatgttgccacccgcgaat

SEQ ID NO: 92735 - DNA, 595 bp, Heterodera glycines
  SCN-specific regions: Sequence locations=73-595
aactttttggatttaacccttccaaaactatccgttttcagcctgctatactcgcatcgccaaaacaaaactaaaaaaaatgttcccgagacttttcgccgttggtggtgccgttacggtaatggccgttttgctgtgcatgcatacggtggtggaaagcgcatacacctaccaaaaattggacgatttaatgccggaactgcgtcaatatttgggccgaacccatcttggcacactgaaggcgcgtcaatactatgacgatgacacggcatttcaacagcaaatccgtgagcgcaaatccaacaatctgcgcaacttgatgaggattggcaaacggagtgtgccaatgccatcacaatcattgccggctgactccggtgccaaacatgcggcagagctcggtgttggcgccgccctcggtcccatctactacatcccaaatgacttagtccaggcttttcgtcctcagtctgtgtggctccgtcgttgaatgagcggcagcacaaaaagctttgtgcaaaaaatccgttgatgaaaaaaaagaaaaaaaaagaaatgggaatttgcaatgatttggttttagaaaaaaatgggt

SEQ ID NO: 92736 - DNA, 636 bp, Heterodera glycines
  SCN-specific regions: Sequence locations=1-142,167-636
ttatatttatttttcgccatgcaaaaatatgctgcagaatctttaatccgtttgcaaggggttcgtcctttgtttttatctctgcgaacattgaaggaactgaaaaatccttttgcagcggcgatccttgagacaccaatggaggggcaaagcaaaaccttcaaacagaggaacccaattccgctggtcgatgaaccaaataaaaaaagcatcaaagatattctcgaacccgcgaaaattaccggagatttgacgcaggaaattgatccgaacaaggaaatcatggaaatcggtggtgttcccgaggaacatagagaaggaagaaatgctcgaatttacatgccagcacggactgcgatgcaatcgggttgggacaacaccggggtgtggaagatcgaactggacgagcgagagcgatgggaaaatgctaccatcggatgggcgagcaatgccgaccctttgagcaacataagcatggcgctaagctttgcttctcgtgaggatgccattaacttttgcgagaaaaatcgctggtcctatattgtcgaagaaccaccgagccgtgaaatcaagccgaaggcttatggttccaatttttcatggaacaaacgcacgagagtcagcactaaatgaacc

SEQ ID NO: 92737 - DNA, 212 bp, Heterodera glycines
  SCN-specific regions: Sequence locations=101-101,209-212
accttgattttcttaagcaagtcatagcctgtcatgccaggcatacagtaatctgttataacaagattcacctccacctcctataaagacacaaaaagccgaaaacaatctcagaatcccagaaaaagaaactgatctgtggccaaaaataaacactgaacacaacacaacaagttggttaaaatttttaaattactaaaaaaaaaaacaaa

SEQ ID NO: 92738 - DNA, 531 bp, Heterodera glycines
  SCN-specific regions: Sequence locations=1-21,43-531
ctccggcagaggaggtgaagccatcggcagaagaagcagcagcgaatgcttctcccccgtcgccctcttcctccgcggacagtgccaaaggcgtcagtctgtggcggatttgcccctttctgtgccaagtgtcctccccctcctcccccgaggggtcgtccgtccgctgtttggagtgcggcgggaacgacgacgagcagcagcaccaattcaacgacttgggtagcacgtacaaccatctgaggaagcaccacccccaacagtttcagcagctgtacgaccattggaagagcgagccgccgcccaaacggcgcctttacgggcaccgacagcagcagcaacagaacgccaaccgacaaatggcggagggggagagaacgcatgtttccgtcaacattgaactgaaagagaaggctttcgtcgacccgttgtctctttttgcggccgatgatcagcaaatttattcggagaatgaccctttgcagcagaatggggcgctctgttcgtcggtcgtttggtccgtcggtctct

SEQ ID NO: 92739 - DNA, 638 bp, Heterodera glycines
  SCN-specific regions: Sequence locations=1-638
gtccaattaaggtttgaaaatgtccgtctgtccgttgtgtgattcgccagtgccctttgggttggccatgctcgccccgtgtcaccacgttgggcatgccaattgcatcaataattttgtccgccacaatggcttctgttgggtttctaactgcgcaatgcctgtgctggaaagtgacgtgctcggcctgcacattgactcacctcagccgaattggattggcttgaatgaccaacaatcggtgcgtgaagtgatcggagtaattcgtcaacgtttggtcggtcaatcgcaatgtgcagcaaatgtaacggacaacgactttgaagaagtggccaacatctttgagcgtttgacttcgcctcgtgtcaacgcaaacacttcggggaaaactgctgccgatccttcagacgaatggcaaaagctgaaggatttgcttttaaaggcttcgcccatcatcgttttcgttgtgtttgcgctgctctgttggtacgccactccgttggttctttcggctggcgctgcactgttggaaggagtttcttcgttggtgatgggtttgggtgcctttctgcgcagttttttcccagaactcgtcgcctcggggctcgccttcttttccgcttacgttttgggcaaga

SEQ ID NO: 92740 - DNA, 558 bp, Heterodera glycines
  SCN-specific regions: Sequence locations=1-370,392-558
atttattaaaaatgccgctgttttcagctcatccaattgctttaccacacgacggctgccattgtcgcaatttgctcaattcggccacgctcttttatgcccaaattccattttattgccactgccattgtttttccggcttcatttaccgtcgtcatgttattctggggactttatctgatggacccggcgacggtcacaaggaaggaggcgcgatttatctttgacttcaaatggttcaaccatgcactccacactttccccctcttcgccatgcttctcgacttttccatttggcaccatcgtcgcccctcaaaagtctctgcgctaaaggcgatcttgtgtttctccctgttttacaccatccacatccactttttctatgtctgcttcaacttttgggcttatcccatccttgcccaaatgtccttcagaggccgtgcgtggttcattctcttctgcactattttcatgttttgtgcttttgccatcggcgacgcttttaatcgggttcttccaagaaagttacgagtgtaatggatggtgtatctaatttga

SEQ ID NO: 92741 - DNA, 632 bp, Heterodera glycines
  SCN-specific regions: Sequence locations=1-598,620-632
tgaataaactgcaaatttttgttggaaaattacgcttaccccccgctccggggccaacaaatgcgcatccttcggtgcgccacagtgagaaagccctcgtctgtccgtctgctatcttcaccgtcgatgagcagcaaatttattgggagaatgaccctttgcaacagaatggtgcactctgctcgtcggtcgtttggtccgtcggtctcttccaacggcaccgtttccgcaacggcacaattggggcactgtgtttggagtgtggccaagtgttgtgggagatggacacggacgcgcagttgacggaccacattgtgaacaaacaccccgaatacatgccgaattcgttggcagcgaacgtggcaccggcgacggctgactcccaaattgtgccaacgtacgtcgatgaacagggcgaactgtggcgatgtgtggacatcgcaacaaatggcgaattggccgaggaaatgttccaacgcaacggagcacaaccacttcagcagcagcaacagaatgaggaggtgggaaggaagggcaatttggacactaatttgctcattaattacaataattgcttttttactattattacgtttgtctccaaataaatttttttagctgaaaaaaaaaaa

SEQ ID NO: 92742 - DNA, 162 bp, Heterodera glycines
  SCN-specific regions: Sequence locations=1-162
gtttgactcacttccgttcgttccgttggaatgtttaaattcgtccactttttctgctcattggccacttttcccctgctgatctctgccatttcttccaattgcttttacttgccacacattgtgctgaacggcggcacttatgacaagttcaatgcttct

SEQ ID NO: 92743 - DNA, 618 bp, Heterodera glycines
  SCN-specific regions: Sequence locations=1-618
gttactaagctgaaagtggatagggttttccctgtgcttccgcccacggatccttcgtccgtttcgttagcttcgtcttcccaaatcccctcccccacgcatccaaaattcattctgtttgaccgattgttgcccaatgaattggtttgagccgcgcgtgttgcgttccgcccgtccctttgtgcccagcggcggcgaacggcgggacgaagtcggaaaaacgggcgatgaccaggcagtggttcatatgatgtgcgatttggtgttgggcgagattcaggcggagatcagccgagtggagaaggaaatggaacgacgacgacaggacgagcggagactgaccaatcagccagactattcctggcttatggactggcgactgcgtgcaaaacgacccctcagcttcagagaaagctccgaagtggaattgttatgttcaaaagtcagagccgaggaatggcggcgactactcaaagaatggcacataaaagttcgctttgcggaaagtcgggacgaagttttggacacatttcgggcattggtcgacgaaatggcgagggaacgaatgcgaagaaaatgcgtagtgcaaagtgtggacgaacagcaacaactcgggga

SEQ ID NO: 92744 - DNA, 181 bp, Heterodera glycines
  SCN-specific regions: Sequence locations=1-133,155-181
ggcggagcgagacaattaccaaacaaaatccgtgttccaatgcgtctgttgtgccccaaaacaatacaattagcggaaaggagaagaagcgaagggacggcgaacggacagaacgatcgatcagcggaaaagtgatcaatcgatcgatcgatcagaaaccaatcacaaaaataaacaaacg

SEQ ID NO: 92745 - DNA, 223 bp, Heterodera glycines
  SCN-specific regions: Sequence locations=1-223
agcggctcaaactttggacaagcgtgaagcgcacttttgtgtgctggtcaaaagctgtgacgaggcatcctttgagaaattggtgcgctcattgtgcaaagagcacatcattccgattttggaggtggaggacaaatccaaactctgtcaaatggttggccagtgccaatacgacaaagacggaaaagcgcgcaaaatcctccgctgctctgtggctgtggtc

SEQ ID NO: 92746 - DNA, 567 bp, Heterodera glycines
  SCN-specific regions: Sequence locations=1-7,32-420,442-567
gtccaataaagatgtcttcttcggttcagcgttctcttcgtccgtacatcgcctcctctcatcaattaaattaccactctgaggacaacgggggtgcttctgctgtgaatgtttgcgcggaactctgcgcttttctctgtgctaatggattcgcacgcgcagccaaacggagaaaaacggcgccgagaatcgaagagaatgtgacgcgcgatggaaactgtttgcctgctgaaatgggcaacaaaaagggtcgtggagtgcagcttggacttcgttcgttgctgcgttttcacaacaaacgttacactgcgccaaagtcggaggagaaaacgcagcggcgtctcctcgtggtgctgctggacgccgacttcgcgaagcccatagcactgcgtcatgtgttcgctttgcttgcactcggtcccaactcgccctccttcttccttctccccggtctctctacgtctctctccgtccctttgaatttgccacgcatttccaccgtttctttcacttccgacgggcctccagaattagtctgtctgacagcgaagatacgaaaactgttaa

SEQ ID NO: 92747 - DNA, 460 bp, Heterodera glycines
  misc_feature (427)..(427): n is a, c, g, or t
  misc_feature (430)..(430): n is a, c, g, or t
  misc_feature (432)..(432): n is a, c, g, or t
  SCN-specific regions: Sequence locations=1-334,357-358,398-430
aagaaatattcggggctgtgatgttgattttgccgttcaaaactgaacaagaagcgattgcacgagcaaatgccacacaattcggattggcgtcgggattatgcaccacgaatttagcacgagctcatcgcgttgctgctcaattgaaagttggcactgtttttgtcaacacttacaatgatgctgaggtgcacatcccattcggcggcttcaaaaattctggtcacggacgcgaaaactgtgttgaatgtttacacgaatattcacaagtgaaatcggtgtacgtgaacatcgacgaaggattgcaacacaatttgggatgaaggaagcggagagagaaaaatgcaatagaaagagctcaaatacaaatagaatatttttaaaattttttcacatgccttattttactaactaataaagagattanctnanaaaaaaaaaaaaaaaaaaaaaaaaaaaa

SEQ ID NO: 92748 - DNA, 597 bp, Heterodera glycines
  SCN-specific regions: Sequence locations=1-239,261-597
tccgtcttcacaaatcctttgaatgtctgcgcccactaattttttgttggttttgacaaatgcgctttttgctaaaaagcttaataacaagagaaggaagagtaagcaaacagaaaggacgaggggcaaaagcagttctgcgcttccgttctgccgtccctccgccgctcgcccacccacacaaacagtgccccccccccctccgcttttcgcgataaagcatttttgccgcctgtgcctttattacaaatgtcccaaaaatcggccgctccctcttctccgcggccgttcacttcgtcggtgccagtgccgttgcaccgttccgcgagttattccccttcggtgctcgccaatgcgaacaaatttttaagtgataggccccaattgatcgattgccctcgctgtaagcagcatggcttcacagaattaaaacatgtcattggcctctttacttgggtctctttcctcgtccttctcatcacgggactctttgtactcccacttttctttctatgggtcccatttttcatcgacactttcaaagacgtggaacaccgatgccccaattgcaagacacacattggcacatttcgaaga

SEQ ID NO: 92749 - DNA, 631 bp, Heterodera glycines
  SCN-specific regions: Sequence locations=28-29,63-66,90-90,114 -334,366-631
atcaacgtcaacgactcggtcaccaagtccaagttcgacaacctgtacggctgccgcgagtcgctcattgacggcatcaagcgcgccaccgacgtgatgattgccggcaaggtctctgtcgtcgccggctacggtgacgtcggcaagggctgcgccgccgccctcaagggtatgggctcgcgcgtcattgtgaccgaggtggacccgatcaacgccctgcaggccgctatggagggttacgaagtgaccaccatggaggaggcgtgccgcgagggtaacatctttgtgaccacgaccggttgccgcgacatcatcacgggagagcacttcatccacatgaaggacgactcgatcgtgtgcaatattggccatttcgacattgagctcgacgttgcctggctcaaggccaacgcaaagtcgcactccaacatcaagccccaggtcgaccggtacttgctcgccaacggccgccacatcatcttgcttgccgagggccgtcttgtcaacttgggctgtgccacgggccacccgtcgtttgtcatgtccaactcgttctccaaccaagtccttgcccagattgccctgtggaacgccaagcccaacgagttccccattggcgtccacatgttgc

SEQ ID NO: 92750 - DNA, 627 bp, Heterodera glycines
  SCN-specific regions: Sequence locations=1-455,477-598
gtcgtttccgccgttttcgacgagttcggcgctctccaaaaatgtggcaggcaaattttacaacagacggcatttgctgaagaaaaacgaaacattgcggctcacctacgacatgctgagacggccccatcacattggcaatcacaaggcgtggatggcgtggaacacgcagaacttgaaggagttcgagcagcagccggggctgaccattgctcaggacgaaatcatccggcgcttctgtcgcgcgctgttcttcgaatttttgcccgaaattgcggggcccaccgaattggtcatcaaacggcgtggcaattgcgcatttgtcaccggctttctctgctggaatgaccgaaccgtcgcaagccaacgcaaattgtattggctgtggggcttcaccgaggaaatcctgtccaatctgctaaagcacccgctgaagttggagctgcaatttgtgcgcagtttggaccatttgatcgtggccaatattgcgcccgcttcttctgtgtgattttggaccggaaaatgagggcgaaccgaccgcaccattcattctctcattttggcctctcatttagacaaaactctttatcatttgcttttttaaagtataaattgttttattttctt

SEQ ID NO: 92751 - DNA, 433 bp, Heterodera glycines
  misc_feature (409)..(409): n is a, c, g, or t
  SCN-specific regions: Sequence locations=1-410
gtcgttcgtacctgctccgccaccaattccgccaatacctccaccacccgtgccgttgaacgccatccaattgtctggagttaatggaatgccaaagaagaaaggccgtcgtccgatcccatctcgctcaaatgccacttatatttcgcaggcgtcccaagacatttaccaatcaaatcttttgagcggaggaggcatcagccaaatatcccaatcaagccaactttctcagccttattttggcgattaaaccaacttccgatggatggaaagagaaaggggtcgacggagcaaacgacggaaatgaaggattgctgttgattaatggaaatcacgcgataaagatttcatcctcattttatatgaattctctgagtcaagttaatttcgataaatccattgcagtttncaaaaaaaaaaaaaaaaaaaaaaa

SEQ ID NO: 92752 - DNA, 623 bp, Heterodera glycines
  SCN-specific regions: Sequence locations=1-623
attgagccgtccattatcacaatgaccgcgtccgaaattcattgcatgatgaccgccggctttgcatgcattgcgggcgctttattctccgcttatatcgcacttgggaattgtccaatccatctgttgtccgccactttgatgaattctgcaatttcgttgggcatctccaaattggtctatcccgaggtggaacattcacagcataaggaggccgaaaagatgaaatttgccgagcgagacaatgaggagacaattttggagtgcattacagcatcctcaattcgtacggtaacacagtgtcattcatttcaaatacagtaatcgccccccccctatccttctgactccgcccggttcagtcccattttgcaattgccattggtgccaatttggtcacttacattgccctgttggcatttttgaattcgaccattggttggcttggctcaatggttggaatagcggaactctcattcaataaaatcctcggcttttgcttcttcccattggcctgggccatgggcgtctctgacgcacaaaacactgaggtaatgttggacgaaacgatgaaagtggctgaactgatgggcatcaaaacggcactgaacgaattcattgct

SEQ ID NO: 92753 - DNA, 619 bp, Heterodera glycines
  misc_feature (41)..(41): n is a, c, g, or t
  SCN-specific regions: Sequence locations=1-336,360-619
tgagcgaatgggagcgtttgtccgagaaattgcgccacccnggaaaatccaattgtcttttttgacattgcagaaggtggagcacccattggtcgtattacgatggaattgtttggggatgtgacgccaaagacggcggaaaactttcgacagctttgcaccggcgaattaaaaaaggacggcgttccaattggctataagaattcgcaattccaccgggttatcaaagattttatggtgcagggaggtgattttgtcaatggtgatggaaccggaatgacgtcaatttatgggccaaaatttgcggacgaaaattttgaagtaaaacattccgagcctggaattctttcaatggctaatgctggccctgacacaaatggctgccaatttttcatcacatgtaacaagtgcgattttcttgatgccaaacatgtcgtttttggacgtgttcttgacgggctgcttactgtgcgaaaaattgaaaatgtgcccaccgttcagaacaacaaaccgaaaataccaattgtcattgaacagtgcggcgagttatgaaataaatctttttggcacttatatagaatgaggggtcaaaaaccaattgggggaggcgagctttttg

SEQ ID NO: 92754 - DNA, 656 bp, Heterodera glycines
  misc_feature (27)..(27): n is a, c, g, or t
  SCN-specific regions: Sequence locations=1-656
attaaaagaaaaagactaaataattantggagaatacaaaagaaaatgatggaaaaaccgaaggacattgttcttcggtgagtgagtcgacgtctaaagaagagagcatttgtaatgacaaaagcgaagcggaaggatccaatgaaaaaggaatgccaaacaaagaggaagtgccaaaaggatcggaagagaaagtgcaaaatgaagcggaggtgccaaatgttgagggagtgccaagtgaggcgggcagcgcttcacagccgagcttgtacagccaatttgtgaccagcttcgagagcgtcatcaacagtttggtctcagatgacgtggcgacgcgtccacagcaaaaattgccatctttggacttggagggcgttgcggcgttcatccgcgaagaacgacccgagattgtgttcatggtcggtgccggagtgtccacgtcagccggcatcccggactttcggacgcccggcaccggtctctacgacaacttgaagcagtacgacatcccaaatccgcaggcgatcttcgacataaattacttcagaaggaatcccgagcccttttttgtgctggccaacgcacttttccacgaaagcataatgccgacttccgcgcatcatttcattcgtttggtggcggacaaagggctgctt

SEQ ID NO: 92755 - DNA, 615 bp, Heterodera glycines
  SCN-specific regions: Sequence locations=1-85,107-476,500-615
gaaagaaaaacgtaaagtacaaattgatggatcaaaacgccccacaatttggcattgatgtgctgccttcatgttcatccgttgatgagcagaaacccgcagaccaacaatcgtccgctgaaatcatttgtttcgttcggaaagatgccatcattcgtccgtccgccccttttggcgctgattttctccactggaaaagttctttttggcgtgagcgaattacatcgatcaaaaatgtggtggcaccgatggtggaccaaagtgagttggcttttcgtatgatgttgcgcagccattccgcccacctttgttacactccgatgatccacgcccatttgtttgttactgacccaacgtaccgcaaagcgtccttcacaacagtggacacggatcggccactgattgtccaattttgtgccaatgatccgcaaactttgctgagtgcgtgccgtttggtggagggaaagtgcgacggtgttgacctgaacttgggctgccctcagctgatcgccaaaaaagggcgttatggcgcatttttgcaggagtctcctgaactgatcgagtcgatgatctccgctgttcatcgccattgtcaccttccaatttcggctaaaa

SEQ ID NO: 92756 - DNA, 58 bp, Heterodera glycines
  SCN-specific regions: Sequence locations=1-24,46-58
gtattgtttttatgtattcttttgtatttctcatgttttttaaatacataaatgtttt

SEQ ID NO: 92757 - DNA, 402 bp, Heterodera glycines
  SCN-specific regions: Sequence locations=1-197,219-402
cactgaaagcggcgctgccgcccgaggcggacacccaacgcgacaccaccctttcgctgctgacccgagcacggaatcacattcggaccatcaaagagcaacatgcgcaactgttggccaaacggacggcacttttggcagagcatttgcgtcttaaaagcgttcagcaaagacagtaacaacagcagcagttgagctccttgccctccgtttctgtgaccagcaacagtgccactgacaataacaacaagcagcgcaaccacaaacaattgctggcggtgccagcgacgacaacgccaatgccgactaagtcagtgccagtgtttgttgtgccgacgacgacaatggcaccaccgccgccggcaccaacacaatacatgacgattgacgatgatgctgata

SEQ ID NO: 92758 - DNA, 550 bp, Heterodera glycines
  SCN-specific regions: Sequence locations=1-550
ttcattttaaaaacggctctgtttacccgttagctcttgttctttttctcgtcataacttttctcaaacgtttttgaacaggaattcgtcatggagtccgctggcagcagctcacagccaattttaaacagagatttgcaaattttggtcggcgagcaaatatttactgggatatgtggtcctggccaatacattagcaatggatttttcaatttatttgaggcgggaccgactgttaaaagctctgtcgtctcagttcttagcaaaatgactgtttttacaatgaatgaatgccgggcacagatttcgtcgccaaccgacaaaaggaagtttctttgtatcgactttcgaaaatcgtcggggtatttgttcttaaataagttggtccaaattatgaatgaaagcaaagggaaattcttcgaagttttgcatctgatctgtctgaaaggggtttacattgagcgattgttcgatatttttttgatgctgaatgatttgaccatcattaatcttccgtacgaattcgattccttttctcgcaacggggaaa

SEQ ID NO: 92759 - DNA, 421 bp, Heterodera glycines
  SCN-specific regions: Sequence locations=1-421
tccgggcgtcatcgacaacggcaccgggtacaccaagatgggatacgccgggaactcggacccgcaatacatcttgcccaccgcgatcgcgaccgcaccaactgccgctggtgcgtctggcgctggtgctgccaagaacctggcctccaagcgcgggatcgaagatctcgactttttcatcggtgacgaggccatgggtaatgccaagacgtacaacttgcagtacccgattcgccacggtcaaatcgacaactgggacttgatggagcggtactgggaacagtccatcttcaagtatttgcgctgcgagcccgaggatcaccatttccttcttaccgaacctcccctcaacgcgcccgagaaccgcgagtacacggccgagatttttttcgaatcgttcaacgtccctggaatgtacata

SEQ ID NO: 92760 - DNA, 263 bp, Heterodera glycines
  SCN-specific regions: Sequence locations=1-185,208-241
atttcacacaatccttgggttaggtgatgcgcaacagaggcacaggggaggaatgcgaacagtggggtttcgaatacatcgaagtgccggtcgcctgtgagtgttatctgagcaagagatcgatgtggcttgaagcggtgcctccatcaatcggagacgaacatttcttataaattgtttctcgaatatttaaatttacaattctaacaaatgttggtttacattagaatacacagaattcaaaaaaaaaaaaaaaaaaaaaa

SEQ ID NO: 92761 - DNA, 631 bp, Heterodera glycines
  SCN-specific regions: Sequence locations=1-54,78-235,261-631
ggcactccctcaaaactcaattttcaatcatgttggcctattgataatttgtcagcaaatggacctttgttcggagggtcttccaataatgccaacctctgccactgctaatgatccccaaatcgagcgggacgttgcggcaccgacaaagcaatgggagaggaggcggcacttcggcagagatggcactttccctttgtcagccgtttgccccccaattttctcagtcgccgcctttttccttctcctttccctttgcctttcagcagaagttgcccttgcacaggacgaatcccggcaaaagtgtctttcggcggaagcgtccaaaagttgcggcgcgtgcgtttccgccagcgtcgaatgcgcgtggtgctccgatttgcgcttcaacggcacccaaagatgcgatgccaaatgggcatttgcggagaacgaacggtgcgctgtcacgcagctgtactcgccaagcacggagatcaaagtggcgccgcaacacaatttgccattgggtgtcaaaagagcggacggagtgacagtgatccaattggaaccgcagcaagtggaaattcggatgaagcctggtgacattgtcgaggtgcccttccgctacctgcacaagcttccgctgagt

SEQ ID NO: 92762 - DNA, 438 bp, Heterodera glycines
  SCN-specific regions: Sequence locations=1-232,272-438
cacaaattccgtccggcaattcttcttcatttcccattgtttctgcaaaaacgacgcaaattcataccgattcaaatttcagaacgactaaaatgccaacaacacttgcaaaaacaactccctttttcattgatccgccgtcaaatgaacgaattattttcaacgacccgcgaagacaaatgaaaaagcacaacagcagcagagaaatggggaaaagcgatgccaaaacatcggaaaaagaagacaaaagagagggaggagaaggcgaacaaagcgcgaaaaagatgaaccaaacggaaccaattcaaccgacactcaaccatgaagcaacgattggcccacaacatttggccattcggcgaattcgctacccccaaatgatggagcagagaacggctctttttcgtccctccgccgcttcgccgatgggtcggccga

SEQ ID NO: 92763 - DNA, 353 bp, Heterodera glycines
  SCN-specific regions: Sequence locations=1-331
gacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttggcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgttaaaaaaaaaaaaaaaaaaaaaa

SEQ ID NO: 92764 - DNA, 394 bp, Heterodera glycines
  SCN-specific regions: Sequence locations=1-371
aagcagcgcaaatggcacagcacggaatgaaaaagaagacgactttacctgcgggggcaaaacaaaaatcaatgaagcgggcgcaaaagggggcaccgacaagaggacccaaaaagggctttaaatcaattgttccaccaaaaaaggcatcggctgtcaaacaagcgaaggtaaatacggaagtcagtcggatgatcaacgagaagaacgaagaaatggtcagagaaagggccgacagagacgtcggaaaaacgacgaagcaaacaaaaaacacttgactatttttgattttgtgatgttacgggaagatttatgacaattggtacacaattttttttttgttttagtgtattaattatgcatttaatatgaaaaaaaaaaaaaaaaaaaaaaa

SEQ ID NO: 92765 - DNA, 646 bp, Heterodera glycines
  SCN-specific regions: Sequence locations=1-107,129-646
tttaagactgttcaattgcaattccgctgcttttcaactttttctttttcgcaatgatttcttccgccggccttttaaatgccgaaacgaatccgacagaagatactcaccaacaaaaacagaccgatgagccaaaatatgcaatgccaacaaataacgtaagttcccacgttttggacattgcggtgggacgaccagcggagggagtcaaatgcacagcgtacaaatggaaaatgagtgaacaacgttccgaaaagaatgtcaccggcgatgagcacgacgaagaggggggcacttgggaactgtggggacaaacagagacaaatgagcagggacgaatcgcaattgtgcatccgggaaaggcattgagcgaaggcattttcaaattgcacttccgcacgaaggaatattttgaagggcaaaagcgcaacactttttaccctttcatcgagatcgttttccaaattgatgatcccaccgcccattaccacgtgccaatcactttgagtaactttggctattccacgtacaaaggccaataatagcgatggaattacgacgcaattgcacttttttggtcatcgataaatgttttgagcatttcccgctgatttgttcatgtaaatccatctttttttttgtccga

SEQ ID NO: 92766 - DNA, 335 bp, Heterodera glycines
  SCN-specific regions: Sequence locations=1-232,256-314
cacagtttgggccatttacgccgactggtctcacactagagagtggaaaaattcccttaaactaaaaaatgtcgatgacatggccaaagtatctgggtagctacatcacgctacagaatgcatttcggatgaccctcgcagccctcattcctgctgttgcaaaaatgtatgaagactctgaagtagcaaggctcaccaggtttcgggaccggtctgccatgtttggcagaccacctccacctcctggtgttgaagaaattccatcatggtaacacttatgttacatggctagtttgaataaacttctcagttgcaaaaaaaaaaaaaaaaaaaaa

SEQ ID NO: 92767 - DNA, 392 bp, Heterodera glycines
  SCN-specific regions: Sequence locations=1-392
gtccaattaagatttggcaacagttttctgctttccatcaccgttgccaacccgtccaaagccatcggtgccaaattggacaaaatggtccgtgatgcgatggcttcgccgcagtgccaagacccgctgaattctgccatattgcgctgggaattgccacgtcaaaaggacaccacttggagcgtgctgttcgaacgagcgcaggcattggccgaccaattcccggtcaaactcaagaaagcgaccgacggactcccccaaattgtggacttttcgctcactcagaattcgctggagcaagtgttcatgagcttgaccaatgtggacgtgtaactttttcgccttggattcaagcgattttctgtatccctgcggctctgttcagcacaata

SEQ ID NO: 92768 - DNA, 309 bp, Heterodera glycines
  misc_feature (279)..(280): n is a, c, g, or t
  misc_feature (282)..(283): n is a, c, g, or t
  SCN-specific regions: Sequence locations=1-107,129-181,277-280
caagaaagggccaaagaacactcgcatttgatccaactcggcgccattttcctcggtttcctcgtaattaatgcgctgcaactttacgagcagctgaccaattcgggccatcatcaccatcaccactgaatgaatgaattgaatcgtccaattccaaggagcgaatttatcaaaagcgggcaatatatttattattttaattgtttttataataaatttaaaatgaatatatttgtacaaacttttttatttttttaagaaataaagaaaaatattgcnnannaaaaaaaaaaaaaaaaaaaaaaaaaa

SEQ ID NO: 92769 - DNA, 434 bp, Heterodera glycines
  misc_feature (424)..(425): n is a, c, g, or t
  SCN-specific regions: Sequence locations=1-385,407-411
attcagtctcgaaaaagaaatgaagccatcattcaacttcaagcttttcgcatccgtctttcttgtgctttgtgtggcctcgcttgtcctctgtgagcataagcgagcagccgcagcagaagcatgtaatcaccccaaaagcgctggaactggcaacttggcactcaaacgatggtggtgggacggtcgtcattgtaagcaattcacctacaaagggcagggcggaaacacaaacaatttcccatcaaagaagcattgtgatcaagtgtgcaagccatgaaatgtgccgtggaatgatggtatgaagcgtgaagagacatgcaaagaagaaaagcgaagaaaatttaatgaaatttttcattaatcaccaataaataaagatttgattgaataaataaaattgcatcgttcaaaaaaaaaaaannaaaaaaaaa

SEQ ID NO: 92770 - DNA, 584 bp, Heterodera glycines
  SCN-specific regions: Sequence locations=93-93
ggaccattccaaccctaatttctctgctaaaccctagttgtttggcatttcctctcttctccctcgtaaatcttctcccattccctccggtaactttccagatccaaataaatcatggttttctgggtttttggctacggttcactggtgtggaaccctggattcgattacgacgagaagattattggtttcatcaaggactacagacgcgtgtttgatttagcgtgcattgatcaccggggaacacctgaaaacccagcgagaacttgcacattggaggagaaagaaggggctatttgctggggagctgcttattgtgttcgaggaggccctgaaaaggaaaaattggctatgcagtatttggagcgacgggaatgtgaatatgacagaaagactcttgtaaacttcttcaaggaaggagattcactgcatcctactttaactgatgtaatagtattcacatctactccagacaaagtgaacaacaaatactacctgggacctgctccacttgaagacatggctaggcaaatagcaactgcatatggcccttgcggaacaacagggattacattttccttcta

SEQ ID NO: 92771 - DNA, 577 bp, Heterodera glycines
  SCN-specific regions: Sequence locations=1-246,297-529,552-577
ccatgctctccccaagtcaatgcactcggccccatccgcccggccctgactccctgacgccgtccattctgctactctgccaccattggaacccaacaactgaacgcgccgcctgccgcctgccgcctgccgccaagactcgacccacccacctcaccggcacaccaacgcttgacgcccaatcaagaccatggccgaatcctcattccaatcctccttccgcgccttccaacaagcacgcaccaacccgccgccggcccctccggtctcggcgcccgcccccgcgcccgccgcgcaatcgggatcatggacgcgatggatggactcgatgcgcggtgggccaaacgaagaccaagctgccgaggaaggtcgcgggctgctgtcaggcctaatgcccggtaatacaccgcagcggcagcaggtggatgcaaggacaagggcgtttgaagtggcgtgtggatgttgtccagcgctgtctgtgtcgcagcggtttatcgtgtttgcgtgctgcaccggcggcgggctgctcttctttttcctctccttcttcatgctgcccatgttcgtcatcgccccg

SEQ ID NO: 92772 - DNA, 576 bp, Heterodera glycines
  SCN-specific regions: Sequence locations=1-576
cgtccgatgtctctctgttggccttctcatgccattccgaagcgtttttggtccattctttgggttgactgtcgcgttcgttacgccgttctgacctttctttttcccaattgctccatccctctggtcgagccccacctgcacagtcttctgctcacattgcttcaccatgttttgcttgtgttcatttgccttttcttcgtaccaatgagtcggaatcgttggaaatttaacttccaatcgtttctgctcggcgtggtcaacggatggtccatcgccttcgctttggtccattcttctcgactacacacagtgactttttgtatttacgcctattttttcagtctttttcatttctccgagtttcttatgacagctctgacaaatgttgagtcccttcggccggattctttccttctcgaccattcctctgcttattggacagctgccatttgttcgtggattgaattttggacgcgggcgtgggcttttccaacgttttgttcattgtatatttcgtccatcggtgtttgttgctgtatatgtgcgcgaattttttcgcaaattggcaatgtg

SEQ ID NO: 92773 - DNA, 160 bp, Heterodera glycines
  SCN-specific regions: Sequence locations=1-160
ggatgaccaacgaacacttctacgatttgttggcacgagctcagaaagagccggagcccgactactccaaccagttcgatgcggcatgtgccgagttgttgtgcaagttcaaggagggcgggaagcagctgaaccaccgggtgcagaaacgaatggccac

SEQ ID NO: 92774 - DNA, 633 bp, Heterodera glycines
  SCN-specific regions: Sequence locations=1-402,424-574,596-633
gaagcgccttcctcagtcgcggtggacgacgcctcattcgattacagcgccggtggcgatgaattggccaacaaatccacgccgaggcgtcgtcgcgggtacattccgtactcgaccatttacgaacggcagaagggcggctattgggtgccgggattgcaagtggaggcaacaattgtgcatgtggagcgcgatgtttcgtcgagttaccacattctgaacccattcatatacaccatcgaacttgagcacggtcgctacaaatggaggacaatcaaacggtacaaagacttttccgcgctgagcagtcgtttgttggcgcatcggacggcggaacggatcaaagcgcccgtccgaagggcccgaaacatattggaggaggtcattgaggggaacgacgacgcggaggaggagggaaagggcgaaaagccaccccattcgcaagacaacgtattggtgcggggactcgaatttgacgaaagtgatgagcgggagaatgggcttcgtccggattcgacttgggacgatttgcaaggggagagcagcaagacggacgaggacctgccgatgagcagtgttccctattttccgatggtgcccgactcaatgattgcggaggagcacatggaagag

SEQ ID NO: 92775 - DNA, 313 bp, Heterodera glycines
  SCN-specific regions: Sequence locations=1-313
aaaacaattccaaatttgacggattgcccctcttcacaaagcgacaaaatgccccccccaaaaattgcccaatttgtttgcccggcccattaaacggaaattggcccaccgaactgttgaaaagcgacatcaaatcgttgccatgaaagctctcgtgaattggcacttcccgcgggaaggactgttcattcacatggccatgaatgtaaaaacgaatgggccaaccccgggacaatttgtgttgcaattcggtgataatgggcaaattaaaagcgaggtcggagatcacctgagtgtactgccaaaggtaaaa

SEQ ID NO: 92776 - DNA, 495 bp, Heterodera glycines
  SCN-specific regions: Sequence locations=1-450,472-495
gtccaattaagtattcagatagtttactactcttctccattttttgttaaaccttgttgcactcccaattagccatacacaaatagtgtgtaatatggctgattcttggcaaacagaaacgaaggacagtgatgaaagtggtgacaggacaaactcagcacaccaaaatgagtctggcaatgagaattggcgactttctgcataccaaactcaatcgacagaagaagtgcctttgcctgatgatttgtccgccattcctgtgccgacggaacacgaaatgaatccagcatggctaatagcacaagaagcacttccttccatcggtggcagaccggaccaacaccaacaacaacacgaacagccgcaacaatttgagggcggaagttacgaggcggcagcagcgctgtacggatggccaccaaccatgggcagttcgttcaattcgtactatcatcatcagcagcagcatatggcttaccaagaccaacaatacca

SEQ ID NO: 92777 - DNA, 479 bp, Heterodera glycines
  SCN-specific regions: Sequence locations=1-281,305-479
gtccaattaagctaatttgttcttatttttttgccttcgagtttttccatttgccaatgcattggcattttttgatggccttagaattttggccattgctcttccgttagcttattgcctcgtcgatattaaagaattggaatatttgcgggccctcgacgattccatttcgtacagagtcctggtttagccatttgaccaattacctgaacaatttcctccatcaaagccacaacaataagtcaaagaccggtttccccaagaaaaagacgggggccaagaacccattttaaaacattaaaaattcttgccccccccccccctgaaaaaatattaaagaaatttgggggggggaaacccccccgcggagggggtctttccccttttttccccccccggggcccctttttttgaaagagggcccccgggggggaacccccccctttgaacaatatttgggcgcgggcgaggaaaaaaaa

SEQ ID NO: 92778 - DNA, 622 bp, Heterodera glycines
  SCN-specific regions: Sequence locations=1-622
aggtgctgttaatctattatttaaattcatttaattgtggcttatggatgtaaacgccgaactcccgccggacttcgaatggtatcaaaatcaaatagcgggtcatcttccctctgttatacgtaatggcgtaaggcaaattggcattttgcacgaacgtggccgaaccgatgtaattctgaagttggttcaggagggaattcgcggccaacgtgagataggattttaccgacggatcgcagcaatttgtgagggccaagggatcaattgcgaagaaacggacgaagtggagggcacactgctgaaggagttggccatgctcatcccccgattttacggatgccgacagattttattggacgaaaatggtccaccgaaggaattcattcaattggaagatgtcactgagaaattcaaatgcccctgcataatggatgtaaagatgggccgcatttcggccgacccattggccagtgaggagaaaagaatggccgaagaagtgaagtcgccgttgcagaagaaaattggatttcgtatactcgggcacagagtacaaaatgaggacggattgcagataagcagagaaagaatttggggacgcgaaaggacggaagagaacatt

SEQ ID NO: 92779 - DNA, 636 bp, Heterodera glycines
  SCN-specific regions: Sequence locations=1-107,136-505,530-636
aattaaaccaagtttgttcaatgaacgaacatttgcgcgcagaaaatgcgcggctcattcagcaacaggtcaacaatgtgtcctcctcatcggccacttcatcagcagcaggtggcagcggcggcggcatcgctttgccatctgctaatcacccatttgtttcaccaacctcattagtgccacaactggaggcagcaaactcattttggcaagcagttgtcggtatcagcagcagcagcggtagtggtggcgttgggaccactaatgacggtaattacgctgctggccatcaacagcaagcagtagccacatcatctgcattattatttaatagggcaacaacattaacgccagcagggattggttcgtcgtcagcagctgacgacgattccaaggtgggctcatcgtcgcgatcggccaaactgaagcgcgagttgcgttttcactgcgattggcccggctgtgcatatgcaactgcttacgggggcgacttgaacaagcacaagcgcaagcacacgggcgaacggccttatcagtgtgatcagtgccatgccacgtttggtcaacactcttcactttcggcacaccgatacacgcacagtgacatgaagcggtttcattgtcctcagtgtgaat

SEQ ID NO: 92780 - DNA, 135 bp, Heterodera glycines
  SCN-specific regions: Sequence locations=1-135
aacaattcgacctcttcatgaacgggcaggcaaaaaggaattgttactgaagagacttttgcattaaaagacaacgatgtaataaacaacaatcatacgttggttatatttacaaataaatctaccaatttggtc

SEQ ID NO: 92781 - DNA, 638 bp, Heterodera glycines
  SCN-specific regions: Sequence locations=1-380,402-505,542-638
caccgacccaattaaggccaatcaggatgcccagcgattgtggcgcgccggtgaggcacgcctcggcaccgacgaaatcgccttcaactctattttggcggtgcagaactttgcgcagcttcgcatggtctttgacgaataccaacgacagcatggccattccattgaacaggcaattagcaacgagtttagcggtgacattcgtgatgccaatttggctttggtgaagagtattcgcaaccgtgcctcatatttcgctgagcttctccacaattcgatgaagggcattggcacccgcgacaccgatttgattcgcctcgtcgtcacccgctccgaagtcgacttggccgacattcgccaggcatatcaaaatatgtacggcacttcactggaaaatgccatcgctagcgactgctctggcgcttataaggatggtttggtcgctattgtgaagggatattaccactgattgcgatggcactgctgtgaagaacttccaaacgataaaaaagagattaaaataaaatagcagttgctaattactaataatttaagtgtgtgaatatgtatcactttgtattgtaatgacccatttcgaaaataataacttgcctgccaatgtgccgcataaataaaca

SEQ ID NO: 92782 - DNA, 619 bp, Heterodera glycines
  SCN-specific regions: Sequence locations=1-112,135-619
gtccaattaagggcttttaattgctaaaatgtgtaaaaaaagttttaataaattgctaaattcacaaaaatgttccttggctcttttcatccgccatttttttcgtttcccaacaaaattttgtcaaaaaatttctgaccaattcatgcaaaatgccatcactgctgaagcactgtcatcattggcatcgccggtgcattgttttagcactccgatggcattggcattcattgaccatttgaggaatgaaaagcagcaaaacattgttttcgtcgatgcattcacttggcttcggtggcattttcaatgcgaccgtccctatgagctttcttttacgtcttctattaattcctccgatggaattattgatcatttctctcgcatttgcttcgtccgtccttttccttttgctttgctaaattttcgatttgcaattctttcgccctttactgcttttaatctgtttggaatctcaacaattggaaatgaattcacaaatgtttttctcgttaatgcaatttgcgttgagtcatcgcctaaatttgcgccctcttttcatgtcaaattaattgaccaacacattaactcatttccttttgagtgtccattggagcctgaa

SEQ ID NO: 92783 - DNA, 515 bp, Heterodera glycines
  SCN-specific regions: Sequence locations=1-215,237-248,274-340,368 -461,494-515
gtttttctgtttcggcgcgatttgaaacaaatttttgccgctcttaacgtgacgatcagtgacactgaacagagagacattgagcgtgaatatgaaaaaatgaaagtgattggaaatccgaaggaaatgagagaggaaaagcccaatgaacggacccatttgctgagcgaatttgaagacgaacacatggcgaagaacaacggcggggggcaatttggcacaaaagaaacagtgacggcaccgatagcggaagggggaaaaggggaagagggaacggaggcgagcagtaactgcaacacaacaacaacacaatgggggacgacagggatgagcagtgactgcaacacaacaacagcagcagcagcgcaattggagtggcataatgaagcggaggaacaaaggacaaagaatcagctggcaaaaggaaaagaagaaggtgattctggagtgattgtgccatgaaattcaaaacaacaattttattttttatgttggttaaaaaatacaatcaaaaa

SEQ ID NO: 92784 - DNA, 606 bp, Heterodera glycines
  SCN-specific regions: Sequence locations=1-606
atttcaccagcggaattaaaaaaacgagaaaaatttatgggttcgaattctgtcgaaatgctggacgaacgagaacagcagcaaatggaggaggaggaggaggacagctgctactgggtgaccgtctttggcttttctcctgaccatttacaacacattttggaactgttttctcgccacggcgatataatggcacaaaagactccaaaacggggcaattgggtgcacattcgctactccactccaatccatgcaaaacaggcgttgggcagaaacggcagcatttttgaagggcaaatgatcggcgtggttccgtgccaagaccgcgaagcgctggaagacgatttgtcactttcccgaagtgcaactccgctcatcccgcgacattctgtgacccctcatgacacttctcgacagaacggctctttgttggacggcaactattccatccatgacgactcacaaatggtcccttcaacatctcaatacaaaaccaatggacttccaagccgggctcgactcagcatttcgtctcgtgccggaatgcgtccattgaatgccagtgccatttcggacggaccgaaccaaagtatggatttgagtttc

SEQ ID NO: 92785 - DNA, 638 bp, Heterodera glycines
  SCN-specific regions: Sequence locations=1-3,25-638
agctaactcatcaaatattcccaatcaggaggtctcttgcctcgatgtattattccttgtcacagattgagaatcatctttttcttaacagtcgcgacctcaatccaaacatggcagcgggtgcttcgacttcacgaaacctcttaaatgttgcgtcagttgaaattgcagcgcagaacgaatgtttcaccgtttgggagccgctgcaacttcgtcaggaatggactatcagcaactttgccaaggcattggatttggctactcccggcatttgtatgcgaagcaagaatttccgtgatgagtcaatgccggaaatttgctggcaactttgcctttacccgggtgggaagcgcgaggagaacagtgggaatgtgtcgctgttcctcaaaatgtcaacgacgcagtcgcagcgcgagttcactgttcgtgccgagtatcatttttatttcgtggatgagcagggcattgccaaattcagcaacgtgaacactggcgatttcaaagtgaagccatccaaaggctcacactcttggggactgcgcaacattccgcgcacaaaagtgaagagttgcattcgtcccgacttgtcgctgcacatcgtctgccaaatcgaactggtccccgacttcagcaaagtg

SEQ ID NO: 92786 - DNA, 561 bp, Heterodera glycines
  SCN-specific regions: Sequence locations=1-561
gccattcttattcaaactgattgcaacctgaagcattagcctttaaacatcccaacacgctacacaatgtccacgctccgcttcaccccgaacccagccgacgccccgacctcgcacacgctccccggcacgcaccccgagttctctgtgcacgacgcgttccgccacggcctgcactcggtcaagcatgaagtgggcgccgttgcacaccacccgctcgagcccgtcctggcacaggccgaccagttcgccatgcagcgaaagctcacgctgcagcgccaagtgtacggcctgcacgcgccgctccgggtccagatggagcggtcgctgttggcgctcaagcatcagagtcccgtgttcaagagtgtgaatttggggctggaggtgatggcgggcaaggatgagtcgattgatgtcgaggatgtgcttggtgatcgcgacgagtgtgtcgacgacgttgatttccacgccgtcatggagcgcaagttgaagatcaaggtctgagcacgggacgaggttctcgttgctttgctttgttgttctcgtcacagtcgttgatgt

SEQ ID NO: 92787 - DNA, 611 bp, Heterodera glycines
  SCN-specific regions: Sequence locations=1-228,252-380,402-611
ccgcttcctccgatggacaacaattggtcggtggtgttgatgaggaacagcaacgagcgcgaccagcactcgtccttgaactcgacgaccaccgtggcattgatgtgctgtacagtgttcagaatgatccgaatttgggccccctgccgactcagacaaagggcgaattctgacggatgggcggccgacggtcggtccaggaaaacgtggcgaagcgcctccagaattttgctggaaattgacaaattataatttgtttctttcataaaaaaaatccggaaaatttcatcccaaaatttcaaaaatttataaaattgagggatacgaaaattgtttaaacaaatccatgcgaatcagtagcagtagaaattctatgggtaaataattatttgaaatcaaattcgtaagggtctttgaaaaattctttccaattttgacatttaccgaaaatatctgtccgggtgtgccaacaaatgtttggggcagcagtcgtgcggtgaggcggtcaatgcgctggcccatgccaaataaatgcgaaccgcggcgcgcaaagtgtcgtggcattgggtgggcacaaagggcaattggagggcatggtttaccaccgaaag

SEQ ID NO: 92788 - DNA, 630 bp, Heterodera glycines
  SCN-specific regions: Sequence locations=1-584,617-630
acgcctgtcacattggcctcaaaatccttggcactcaatttttgaaggttcaaaaaacagatcaaagcgtgggttggagttctgtgttcgcaacatgctgtgttccggcagaaagtgccggcattttttacttcgaagtgcgcatttttcacgtgctcagttgcttcaccatcggactggccaccaagcaaatgccattggcgccacaattggccgtgccggaacacaactcttcttccgctcctgcatctgatcccggtggcaccacccatttgtttgcattaagccaacacagcaaggaccaacaacattaacaacgaaaagaacaacagaatttttatgtggcgatattgttggatttggcattgaattggcaaatcgacggatttttgtcacgaagaatgggcgccgtttggttattgccgatttgttcttttctgctgcgcaaccgctctttccgtttgtctctttgagagattttggtgccacaattgaagctaattttgggccaaacttcaaatttaatccttaaaaagcgtaagaaaaaaacacacattttgttcattttatgcgcctttccgtggttttatttattttttttattttatttattaaagtatgcattaaaat

SEQ ID NO: 92789 - DNA, 584 bp, Heterodera glycines
  SCN-specific regions: Sequence locations=1-209,238-253,275-584
aaagaaataaaaaaaatagtgtaaatttaaataatgtacaatggaaaaaggaacacatatgttagatgttgtgtgtatcaattgattttggctaatttgaggcaggcacaacatcttttgccggccagccgcctcctgctgtagttgcctttttgcaacacaaccaaccaatgcgcacaaatcccataccctcactcaggctcaaggcctcagcaccacaaccatcaccaaggtcactgtagaatagacactgatgagagcaagcaaactgctgacacgtgaagaagattgaaatggaaagatgggatgtgaggaaaatgagggacggtagtggttttggtggtgcgtgtttggcgtgtgtgcatgggcaaaggacgaggacaacgcacagaacacaacggcagaaatggcggagggagtttgaggtgtacgtacacccaaggatggggggggggggatccgatgctaaattgaaattccaacaccaaaccaaaattcttatccattcgaggttgaactataagctattaagaacaattaggaaaatatttgttgtgagacagttgagaaaattgcgcctaata

SEQ ID NO: 92790 - DNA, 636 bp, Heterodera glycines
  SCN-specific regions: Sequence locations=1-233,255-636
atacatttacataacaaattttttgcttaatgggaaagacttcaaaggataaacgtgacatttattatcgacttgcgaaggaggaaggctggcgagctcgttccgcttataaattgcttcaaattgatgagatttgcaaaatcttcgacggtgtctttagggtggtcgatttatgtgctgcgcccggcagttggagtcaggttttgtccaaaaaattatatgtgagcgagaaggacgaagaaaaacggaagagagtgaaaattgttgcggtggatttgcagccaatggcgccattgccgggagttattcagctacaaggggacatcaccgaggttggcacagctcaacaaatcatttcttattttgatggttccctggcccaacttgtagtttgtgatggagctccggatgtcaccggtcttcacgcctttgatgaatacatgcaaagtcaactcgtttattcggccttcagcattacttctcatattctccaaaatggcggcacttttgtttcaaagatttttcgggctaaaaatgtgaatttgctctacgcccaaatgaaatgctttttcaaggaggtgtcgtgttgcaagcccaagagcagtcgactgagcagttgtgaggcgttcatcgtct

SEQ ID NO: 92791 - DNA, 303 bp, Heterodera glycines
  SCN-specific regions: Sequence locations=1-303
cacaatggcaccggcactaacattggttccggcactggcaacagtcacaatggcaccggcactttagccttgaggcgcccgtgggggtgtccgccgctggtccgaaacgtggacagacgccggccgcgtaggtcaaggaaacgcacccgtggctcctacagcgacaattccgacggatcggcattcactctttttcatggaatgcatggtagttttgatacttggggcactgcgggcattgacgaatgggaccaatcggcacagagtgtacacaattacgccatggaattgatgactttgccg

SEQ ID NO: 92792 - DNA, 577 bp, Heterodera glycines
  SCN-specific regions: Sequence locations=1-199,221-520,542-577
gccaaataaatattccttgaaatttttttattgcaattatggagttggagccgatcatcaaacagaaacacaaattgccacgagaaaagtttcccaacgacgtgtggcacagagagcgttatgcccgtgacagtctgataatgctcacctttggcagtgccactgttatcggtgtcatttacaccaccagaccgacctggtccaagtggcttttgaagctttctcgcaacagagttgggaccaaaggagcaggttcgtttcgccccaaaagtgccgcccttcttgtgccattcgtcccgatgttgtccaaccgtgccaatcactccactttcccgcacaatttggtctccccaacagtgcatcgccgttttgtgattgtcggccgggtcattgctctctccacctttttattcgccatgtatatttttcggatggatgagcgttttattaggctttgcgagaacattatgaaagagattgacgatgacgatcattgaatgattgatttggaagggatgaccaatgttaggctttgtttgtgctatcgagataaaaataattcataaacggacgaatt

SEQ ID NO: 92793 - DNA, 131 bp, Heterodera glycines; identical to SEQ ID NO: 82401
  SCN-specific regions: Sequence locations=1-131

SEQ ID NO: 92794 - DNA, 424 bp, Heterodera glycines
  SCN-specific regions: Sequence locations=1-215,237-424
gttggttctacctgtatcgctatgtaaattgcgtggaatccgtactgctcgaacatcaccttaagcaaagggatatcgatcgacctttcgagtcgcttttgttggacgaacttggaacattttttcgcgattgctgttcgggttcagcggaggctcgcttctccggcccaaacgtgtagtcccagagatggcccatgtcgtcccaattccgcacaatgccgttctccatcgggtagctcacgtccaacatgtgccgtaactcggagcattcctcgccgaccatcaaatcctaacaaaatttactgtgattgtgacggtactgacaaaatgactcactttaatttggatgttgttcactaattgttgttgggatctgaccaaaggccgtccaaagcgtgaagcggccacaaccatcaaacaatgt

SEQ ID NO: 92795 - DNA, 418 bp, Heterodera glycines
  SCN-specific regions: Sequence locations=1-418
gcgacggaattgggcacatcagaatgttccatttcctgggagtgtgaagcccgtgtacggtgcacggtatccgcctttacagtccagcaacgaaagcaatgaaacaccggcaaaaaccgacaacaaattcaaaaattatgaggaaagtgtttccgacgtttgggacccgggcgtaccggtggacgattcgctcgttctttcagcggctgccaaagtattggaaaggcatgcggccgattttcagactagcggtcagtctgcaggagggacggcgatgagccaacggcacaatgccgtgatgcccgtgcattacccttccgttccgtcgcggcacagcaaaatgcaagcgatgcaacgtcttgcgacacaacgcgagccgatcccgggagtgaaccctttgccatcttctgccaattcg

SEQ ID NO: 92796 - DNA, 640 bp, Heterodera glycines
  SCN-specific regions: Sequence locations=1-320,342-640
cacaaattaattaattggaaaaagggaaaagcgtgctaattgaaccaccaaaatgaaccgacgttggatttgtggcgacgtgtggatggacattctgccatcatttgaccatgctcaactcggcctcaaaatggcattgctttccgaccgtttcgatgttttggtggacaaacatttcgacagaaaaagcgaattgacaatttggagacaaatcaaaattagcaaggacaaaggaccaaaagcgaaactgtctgtggagatcggtgccaaatttgtggcatttccattgccgaaccattcgctgccaaacaaaatctgctttaaggaccttcggattgactacattgaccattctgtgttcgcatttctccgttccaacaagccaattttggacagaatgggcaccaaattggaagtgtttgtgcatgcaattgatacggatgtccaaccgatttgggatgtttttatccgtcaaatttggccactttttgcgcaaaacattcaccatttgggctttttggatggcgatgatttggacaatttgtgtcgccgcacatcgccaacaattctcactgatcttgatcaattgatttcaatcgattctggtgctctattctccgatggaattgctgatgatggg

SEQ ID NO: 92797 - DNA, 490 bp, Heterodera glycines
  SCN-specific regions: Sequence locations=1-277,299-490
ggtgtgctctctgttggctatcatcaccacagattttcactctgatcttctctgttactccgacgatcgagcccaagtgaatgtcggactgcgccacacgattgaggccttccatttcaacaccgactcggcctgaactgacttgatgggacttgcacatggtcctgcctccccctggccaacccccgtgaatcccccttcaactccctcttcattgccaaacatccactgcctcggacactgatctactgagacataggcctctactcgccacaattgtccccctgatcagcctctggccgttgccggacctcctggacactccggattccctccacgcacaggacaacccctactgtctgtacaacctgtgaaagcccctcctccatgtccgaccatcattatccgctgcctgctctgctttgataagtctactcgtgcccctggaggacggggactccttggacagacatgcaatgcctctgtacct

SEQ ID NO: 92798 - DNA, 320 bp, Heterodera glycines
  misc_feature (295)..(295): n is a, c, g, or t
  SCN-specific regions: Sequence locations=1-239,268-295
ccaagtttgagtttgctaaataaaatggttaacgtgaagaagggcaccgtcattcgttgtgacccggcaatgcgacagttcctgaagcatttggacgagacacgggctctgggcaggccgttcatcgtcaaggaccttgacgagttttgtttgttcgtggagcgtgacattgtgccaatgttggagcagagaatggatgcccttatggatgctttaacacccgacactcaaacataaaacccacaattttttgtttctcatttcctcaaatatttattgaaaaatttaattcgcnaaaaaaaaaaaaaaaaaaaaaaaaa

SEQ ID NO: 92799 - DNA, 632 bp, Heterodera glycines
  SCN-specific regions: Sequence locations=1-77,99-534,556-632
gtttgagaggataatacaaacagtcgacgttaatcaagatgatgacaccacatcaagatttccataattcaagcgtcgcaatgcaacaacaacaaacactttgtcctcctgaatcaaccttgtggatgggcgacttgaaaccggaatgggatgcaaattttgttcgtgaagcgtttggagaaaatgcaggcgatgttactaatgtcaaaatgcggtcgacttattgtttcgttgaattccgagacggaccaactgctcgaactgcgatgttgagggttaatgggatgacgttacctaatgatccaagtgggacgtcgcgctttaatttggcctttgcaaattcgccccatcatatgtctattgaatacaatctttttgtgaacaatttggctccagatgttgatgatgtggcactgtttcgattgtttggtgaacgctatatgtcttgccgaggtgcaaaagtttacagaaacgaagatggagcatcgaaggaacaaggatttgttcggtttacttctgaaactgaccaacaaaaggctttggttgaactgaacaaacacaaatttcatggtcgcgatttatttctcaagcttgcaagaccgaaaactcgtggtggacctgccgagaaacga

SEQ ID NO: 92800 - DNA, 616 bp, Heterodera glycines
  misc_feature (584)..(584): n is a, c, g, or t
  misc_feature (605)..(605): n is a, c, g, or t
  SCN-specific regions: Sequence locations=1-117,139-146,169-449,471 -510,532-616
gttgaagccattcgtttttctatttttaattttgtcatcaacaaaatatatttgtccaaataaacacaaagacattcgcgattatacggacgctgacatcgaaaaattatatgatcaatgggaagaaaatgatgaagacgaactcccagaagatgagaaacctccctgccaacgaaaaaggccccaaattgacctcgaatcgcttcagcaaagaactgattctccggatgagttattaaaattaacgaaaagtggtcaaactgtgatgatgtttgtgtcggtgaaggatcaaaaatctgagggtaaaacaagcaaagacttcaccgacaaaatttcttcgttatggctgtcgaacttccacaacaatcacatcgatgccaaagtgttcattgtcgataatgatcgagttctttacatgttttctgaaggttctcaagcatgggatgcgcgtgattttttgctttctcaacccgaatgtgtcgaagttgtgttggagggcaaaacaatggcgggaaaagggtcgaaggagggaaaacataccgaattttgaacatttcatttacaattttattttagaatagcanaaaaaaatttttaaaaaatangccgctgccga

SEQ ID NO: 92801 - DNA, 614 bp, Heterodera glycines
  SCN-specific regions: Sequence locations=1-242,275-614
cttcccccgagtttctgattttcggaaggctcattctcggcgcaaatatgggcctttctacaggcctcgtgccgatgtatctaatggaaatcactccgacaaaatatcgcggcgctgccggcacatttcacatggttgcggttgccttctccgattggttttcgcttttactcggactgccggaagtgttgggcagtgccgacaattggccattggcttttgctttccccggctttcccgcctttttgctttgtttggttttgcctttctgtccggagagtcccaaatacacacttttcgcaagaggtgatcatgctaaagccatggaggacttgaagaaattggtggacgaagacgaggccgaatttatgtacgaatcgctgcaaagcgaagcagcactcatgcaagatggctcctgctgcactttccgccaaattttcttcgaacgcgaattccgcctgccccttctgatcaccatcgtggtgatggtcacccaacagttcaccggctgttccgccgtgttcgcctattccactgatatgttcatcgacgccgggctcgacccacgaaccgcgcgcttcagcactttggccgttggcgttgcttattttctg

SEQ ID NO: 92802 - DNA, 547 bp, Heterodera glycines
  SCN-specific regions: Sequence locations=1-547
aaattcgcataaaatgaccggaccgccgttgagccgtaaacggcgtggggcggtgcccacgcgcatcgaacaattggagcgaatgttggacatgacaaaatttattgaccaattgaaacgtctgatcgaccagccgattaaaatccctggcactctgtcaattgggccaggccaggcgcggaacaaacaaatccccggaaaagccaagcgtgaccttctcttttttgaagacatttggtctgaacgtgccgatcggatggcggacaccagcgccctgtacaacaccagcgacatcggcgaacgcaaatggctgctcgatttgctgatggaggagtcggacccggactcgggcggcgaggagcacatcacggagcaggacttgaaggaaattgtcaagattcatcacaagcgcaggaagttccaaaaggagtaccacagtgacctgaccaattcacagtacacatattatggggccggactgatcagtgcgttcgaccgtttctccgaaaatcagaagaatgttcggaaggaatttgaagttggcacc

SEQ ID NO: 92803 - DNA, 377 bp, Heterodera glycines
  misc_feature (356)..(356): n is a, c, g, or t
  SCN-specific regions: Sequence locations=1-356
cgttcatctgctgttgatgctcgtgagcgctgttgtgttcatcatcttcagccaatgctgcggttgctgtaagaaaaagagaacgattcaaagtatgagacattggccagtttggatgcaaacatctttgtgaagtccggatcaccacaaccagcgccaaatgaattccagtcaaaggtggccggctccaaattctcaccgaatcctaatccacaacaggcaaaggctgggggatcgcaattcgctccgagtaagagcaacaaccgcaacaactcggtccgggcaaagagcaatgtttttgtgttccatccaaatgcatttctgtccccattttcagtaaaagattcaaagtatcnaaaaaaaaaaaaaaaaaaaaa

SEQ ID NO: 92804 - DNA, 643 bp, Heterodera glycines
  SCN-specific regions: Sequence locations=1-359,382-562,591-643
cagagtggaaacccatgcaacgagcacgcacttgaatactcttcgcatccggcactcttgaccgcccctagcctttgccatcgctgtgccctccaccgccatgtctgccgccgccgccgccccaatggacccaaggaatcaagccgactccgttagtgtcgcatccattctcgacaatgtcgacctggctgcggcatcgaagtcactcagccccgtcggtcaactcggctctggggtcgaatacattttcaccaacgacgtcccatttaccggtgcctctggcggctttgttccctctcgcgggtggaccgacgatctttgctatggcacggggactgcatacctttctggactcatggtgggtggggcctggggctttttccaagggctccgcacaccgctggaaatccgctccaccaagcttcgcatcaacgccgtccttaacggcatgacccgccgcggtccctttgttggcaattccgttggcatgctggcaatgatatacaatggcctcaactcagccatttcatcgcaagttgagcctcagcacaagccggtggcatccattgccgctgctgccgccgccggcgcattgttcaagtccactgctggattgcggccaatggccatcacatcgctcgct

SEQ ID NO: 92805 - DNA, 621 bp, Heterodera glycines
  SCN-specific regions: Sequence locations=1-497,520-539,604-621
ggtggccgggctattgaaatacgcggccgaatacactttctttctggctccgtttataaattcgtacaagcgactgcagccgaacagttgggcaccaacaaaaatttgttggactgtcgacaatcggacgagttcgttccgtttgtgcggccaaagttcgtccaacgttcacatcgaatgtcgtattggtggggccgacctcaacccgtacttggcattcgccgcactgatcgcagcgggcattgcgggcattgaagaagggttggaattgccaaaggccgttgcctgcaatgtctacgcttcggccgatgccattcccgaattgccgaaaagtctgcgaattgcggcggaacttatggccaattcggaaatgttgaaaagagcgttgggtgaaaatgttttacgacactacaaaaattcggcatgcattgaattggaggactttgaaaaggaagtgaccgattgggagctgagaagggcatttgacagatgttgaagacggacggacggacggacggaagaatgccccggggggaaagaattaaaataaataattgatcaaaaaaataatcatttgtaaaattacactttattattatatttgcattggcaaaggcaact

SEQ ID NO: 92806 - DNA, 508 bp, Heterodera glycines
  SCN-specific regions: Sequence locations=1-219,252-508
ctccgaagacaaaggccgcgtgttcggcgcttctcacgtccctttgccgacaatggacgaggaggcgcgtgagcagaagataaaggaactgatagcgatgacggaggaaacgcatcggaaaagggcggaacggaagcgacaaaggaatgaggaggaagcggaagaacgacggaggctgaacagagtgagggcgagaatgggactcgaacccattccaagcagtgaggacgaagaagaagaacaaaaaggtgcagcagaagcaacggagttggatgtttccgccattccgttgcctccctcttcgcccgaagcaaaaacgactaaagagcctgagcagaaaaagcaaaggtttggagtgcgggagtgggaccgtggcaaaatcggatgcatgcgatgggcggaggaacagcgggacgaacgcgaggacgaatttgcacctccttcattttattacggcgaagaaaacgacgcaagggggaagaagaaacgcaaaaactgaagctaaaga

SEQ ID NO: 92807 - DNA, 621 bp, Heterodera glycines
  SCN-specific regions: Sequence locations=1-271,293-621
gcgtggcaaaactgatgaccccggaggagttgaccaaccctaacgtggacgagaagagcgtgatgacttatctgtcgcagtttccgcgtgctcgtccgctctactcggcctcgacccgcgcccccttggaacaacaagactccgaaggcacaaccttggacgactccaatcaatcggatataccggtcccggctatccaaccgttctcttttgacgaagaaccgcttgacaatgttggggaagagtgccagcaattgactctgtcgcaaatggacgacgacgacaacaacggagtgaccacggcactcacctgtgtgaccaaaacgaccacatcttacacaattgggcagcagaatgaggctgatgacgagtttccaaatgagccgtctttgcccactgacatggaaaacattccgcaacagaatcatcagctgtacaacctcatggtttgtgagtcggacttaaacgacggaattgccgagacggcggcagagccgacgactgactttgacgctgtacggatgacttatcggcacgaggagctgcaatatgagccgttggtggtggtgtcagacgaagagacggttgccctcgggacgaccgccgtacgtcctcagcccg

SEQ ID NO: 92808 - DNA, 524 bp, Heterodera glycines
  SCN-specific regions: Sequence locations=1-246,268-524
gggaaaccgataaaaaagcaaattcaggaaaatttagaggaagaaatcgtgaatgaagattttttcaatgtgcaggaagatcagccgccgcggagagtgccgatgatggtactgaagagcaacattcaacgggacaaagtccgtcacaacagattcaagttgcccgagcgttcacacgaagatctttttcgagaaaaagttcgcacaggtccggccatgaaaagtttgtatgaaaacgatgaactgatcgatgtgcgcgggggtgacggaacggcgttaataatgagtgattttgatggttttgtgccccaactgaccaaaaatattgcggagaaaggcattgaacgaccaacgctgatccaaaaatgtgtgatgcccataatacttacgaaatcggaatttgacttgctggcgcgtgccgagacgggcaccggcaaaacggcggcgtttctctttccgatcattcatttgttggaaagcgatcgtttggcaattgggacgaagccttccactggaaggaaatc

SEQ ID NO: 92809 - DNA, 313 bp, Heterodera glycines
  SCN-specific regions: Sequence locations=1-278
gtttgagtaactcacattccttgcgcgactgaatggctctgactgtgtatttgcccagcaaaaaggtggagaagcaaagggacagcgcgagagatccgtactgaagaagagaaagggaaaaacggacgagcagagaaagaagggacgaaagtgcggagaacagagaaccaattttgcccatttgggtgaagaagaaagtgtaaatcgtagtaacaaagcgaagaatggaaggaatgaattaatctgctgatttggaaaagttgggtgaaattggtaataaaaaacagaagcaaaaaaaaaaaaaaaaaaaaaa

SEQ ID NO: 92810 - DNA, 260 bp, Heterodera glycines
  SCN-specific regions: Sequence locations=1-40,63-65,98-260
gccatcacaaaaacgcaccaccgccagctcctgatggtgatcctcctcctcctcctcctcctggaccgcctccgcccccaccgccgccgccaccgcctggcggtggcggccgattcagtccgcgttgaggctcgtccaaaaagtgcagctcacggtcaccggcaccgacaaagtaacgtgcaagccacggcagaacaggtcgtgtcaactgagttttaggtggatggttgcatcccacaaaaatttgccaaaaaatgcca

SEQ ID NO: 92811 - DNA, 621 bp, Heterodera glycines
  SCN-specific regions: Sequence locations=1-24,50-84,116-621
ctcacacttacatagcattatctcctcaaccaaaccaaaccaaacctattcaattcaatcaacccacaatgaaacccaccgccttcctcaccgccacggccacggccacagccaccgcctgcctcctgctcctgtcatgcacgggtcccgccgccgccatgccccacccggaccctcaccctcacccccaaaacgactgcaaagcctgcatcgaaatgatcccggcctgccccgcgtgtcccgccggcgaactgtgtgcgcgctcctctaacacgtgccaagaatgtgcgtccgcgcggtgcttcaagctcgccgagctcgcccagttgccgcccgggtttgcgcctgccttggggcagcagcagcccggaacttttactttcccgcccatgcccaccatgtcgggcggcaccgtgttttctacgtcgattgggatgactgtcatcaacggcacaaccgtcacgccaaccgcaaccgccacacccgacacttcgtcggtgtcgctgactgccccgcccacggctagtcccacgggcacccagggtgccgcgggcacgggcaacggcgcaggcaaatcatccgggtcgtcggcagccatggcgttggtggtcgcgtgcgttg

SEQ ID NO: 92812 - DNA, 310 bp, Heterodera glycines
  SCN-specific regions: Sequence locations=1-310
ccgaatttacgtgggccatattccatacgaagccagggaaagggatgtcgaacgcttctttaaaggatatggacggattcacgacattctgatcaagcgcggctatgctttcgttgagttggactatcctcgtgatgctgatgacgcggcgtatgaccttaacggtcgctctttgatgggaatgagagttctggactaaatcgccaaaactcgtccatggcgcaatggcgattcttggagttcacgccgtctctcgcgttctcgttcgcgctctcatgacaaacgctcgcattcacgaagtcgctctcga

SEQ ID NO: 92813 - DNA, 304 bp, Heterodera glycines
  SCN-specific regions: Sequence locations=1-304
ggacggtggaggagcgggaatggccggttgacagggcgcaccgattgcattcccacgccatagctgcacgagtgggaacgagtgtctggtggattctcattgcaacggcaccatttgcgcgtgccgctagggattgctcactttgcgaattgccgactcgcacaattgtgtacctggagacccacgaaaaacgcgctctaccaacaacaacggaggacttgtgatcgcatttaatccaaacaacgaaacggatggcagcgattctgccgcacataatgaacaaaatgtctgtgtcacgaccaac

SEQ ID NO: 92814 - DNA, 514 bp, Heterodera glycines
  SCN-specific regions: Sequence locations=1-165,187-514
aatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggacaagatgaa

SEQ ID NO: 92815 - DNA, 547 bp, Heterodera glycines
  SCN-specific regions: Sequence locations=1-49,71-547
ggaccattcggagagtgccaaaggccttttgggcgacggactcatcccaaagggacacggagagattggcgatcccctttggctgttcgacatggaccgaccgttcattatgcgctctgatgggtcggcacttgctgtcctccgttcccctgatcgctctttgggtggagacgctctttggcacttgtgcgacggtgtgccgcccacgccgttcgtttcgcccactgaactgggcttcaccgtcttcaagcatctgtgtctgtcgcctgatcaaagggcgctgtactgtctggccagtggtccccggagggcttcttctctgatcagattggacttgtccactgattgtcacacagtcgccgttatccgtgaagcgcgtgcgcactccgaactctctcagttgcccctctctgtttcatcactgatcactttcaccgctaatggtcattccctggaggggtatttctacgctcctcacagtcacacgcattgtgcgcctgaagggaaactcccgccggtagttcttttcgtccacggcgggaccacc

SEQ ID NO: 92816 - DNA, 400 bp, Heterodera glycines
  SCN-specific regions: Sequence locations=1-20,42-282,304-400
taaaaacctgctcattggtaaaaaatgaaatccttctttaatttcccatttgtcttttgtattcttttgctcattggctgcgttgacaaatgcgtcggaggagtcgcggcattgccgccaaaatatttgggcattgaaaaccatgacaaatgcttaaccgacgagccaataggctcttcgcgtcggctttgtttgccagcgcagaaaaaaatcgaatgccaagatgaaacgttgaaagcgcttaatgatttggaagaaggccaacatccgccgacttgcgcatgaatccgaagacagaagcgaaagaagcaaatgaagggattgaagaatgacagggaaaagcctggctgaacaaaattttgtctacaaaaatgaaataaaaagttattgaaaataaaaa

SEQ ID NO: 92817 - DNA, 554 bp, Heterodera glycines
  SCN-specific regions: Sequence locations=1-33,56-173,195-415,437 -516,546-554
gccgcttccgctgggtcgttgctgtttgacagcgctgcttctgctgccgctgctgatccatccaatttcatggcgatgatgatgatgaacaacaacggcggtgggacagcgcatcgttggcaaaacggcagcaacggcgtcaccaacaatagccataacaacaatggcatcgctgctgctgccgccggtggtggaacatttgacggtgaccagttcaagtgggacgatgcggcttcacgcgtgcggacattggacgaggcgttcaccaagctggtcgacatgaacaatctgatcaagcagcagccgccggtgccatccgtgaagagcaacaacaccaacccgtttgttgtctgatcactcgctcactccgctcgctgatcaacaaccatcgagaccgactgatcagttttgccagtggtcgcgcgcgcgtgtgtgtgaccgatcaattattgattgtttttcttccattttttgtgtccgtgtcttgtgaatgtgtgtgacagacattattacctatatcattattattattattaattattattttaattttg

SEQ ID NO: 92818 - DNA, 250 bp, Heterodera glycines
  SCN-specific regions: Sequence locations=1-250
gtgctctctgttggctatcatcgccacggtcatcactctggcatctctgaactctgagacgtaccaaatgaacctcaaggtgtgcgcaggagttgaggccttccgggtccacaccgactcgacctggactgacttgatggacttgcgagtggtcgtaacgcccgcgacaaagccccgtgataaccccttcaactccgtcttctttgtctaacgtcccctgcccggactctgccagtgctctgggctccaa

SEQ ID NO: 92819 - DNA, 413 bp, Heterodera glycines
  SCN-specific regions: Sequence locations=1-13,35-56,133-134,193-413
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactcgataatcatcgagtaacatacattaaaaa

SEQ ID NO: 92820 - DNA, 439 bp, Heterodera glycines
  SCN-specific regions: Sequence locations=1-439
ggaaagggaatacgctaagcccgcggcggaagtgcgacgaaatttggacaaggaatgggccaaatgggcactgcccgccaaagtgaaggacttgcgggccgaactgctcgccgtcgcatgcgcaacggaaccgacggaattggccaccgtcggcacagaattgggccgaattgtcacgtatttcgacgccttcggcacttttgtcgacaaacatttgtatggaatgttccccgtcacacgctttctcctcccttcgcttgtcagtggcgacgcaaaacggccgctcagcgaattgtccgttttcgaatggcgccacggacagagaccaaatgccgtactcgtcgaacaattcggcgcagcaccccacaatcagtctcccccgacagatgacggacaaataacagccgccgatgacgatgaaattgactttggcgatgat

SEQ ID NO: 92821 - DNA, 316 bp, Heterodera glycines
  SCN-specific regions: Sequence locations=1-131,153-316
cgcgtgaggagcaaaagtcatccgaatttggtgaccattggcttctcagatgacgaaattggaccgatgctttcgaattctgctgcgtccatttcgaggaacagatcgggctgagaaggaattcaaactgcggatcaccaacagatgagccctaagcacaatggccacttggatggaattatctctgatcattatcatttcataaattatatatttcctatcagcagacgtctgattttttgtcactgatttcgcgtgtatattctgtgtgcacatatattgtatgtatttgtcttggtaaaggaagtaaagcgcc

SEQ ID NO: 92822 - DNA, 545 bp, Heterodera glycines
  SCN-specific regions: Sequence locations=1-147,169-545
ttgctgtccgctcgccttttcttctgaccaatgggccccctcttctctgttcggcaccttccgcttgtcctcctcctcgtgctgcttcttccctctttccttctgtccggcatggtcaatgtttgcagcgatgtcaaagactgtgccaattgcactcgctctttcctgaacatttttgcgtttcgtgaatactgtatgtggtgttattccacaaattcctgcggtggtccgttggtttgccccagcggcgtcgctgtcgccacgcgcgaccctttcaaatgcccgcagaaagcgtcgacggcgaagggccgccgatacactgacaaattgggacgatcattgtacgcgttgactttggcagctaaacagaaggatccgagttactgcttgaagaacagcagaagcgatgtgaaagtaatcaaatattacgaagttgaatgtgatcaggccaaaaatacttgtgccggaatgatagccgtgtcggaggaagccaaagctttgtacatcatttatcgtgactcgaccatcgatcgccagctattgca

SEQ ID NO: 92823 - DNA, 459 bp, Heterodera glycines
  misc_feature (262)..(262): n is a, c, g, or t
  SCN-specific regions: Sequence locations=1-459
atttggtgaacttaactatttcagtttactaaaaagtccgtctccgaaggcgacttgtggcaatcgttttttcgccgaatttctctccgcgaccattttctcgatgtcagagtttacttcgtccgacggatcagggaaaagcgttagcagtaaggtcagtgagtcggaaagctacgacgcgaccacgcttggtaaattgatgaacctcgacgccaaagtctcttgatggctccgagaaagagccttatacggacgacgatcngactgttggttattgtctttcgttggctggccttaacaatcttcatgtggactaccgccaaaacaaggcctttctggaccaaatgtagggctggcgctgcagggaggagaaggacagccaagacgacctgcgaagcctgatcgacccgtgcctacttgcccgccccagaacatcccctgcccacgctgccctgctgg

SEQ ID NO: 92824 - DNA, 361 bp, Heterodera glycines
  misc_feature (354)..(356): n is a, c, g, or t
  SCN-specific regions: Sequence locations=1-324,346-361
gcctttatgcggaaaacagtaaaattgccgattctttgttggctgctcacattgacaggagcaatcagaagggaacgatcaacttttgctgcattgcctccaaatgggaccatttgcgtgcgctcggcaccctccgcacgcggcccatttaccgtcggcacacgcgcgtggtgccgtccaacatcaaatatgagaagctgttcgccatgaatgttggcatcaacattttctgaacattgcgcaaaaaaagagggtgatcggaacagcagagatttgattgaacaatgaaaaaatcaaatgaacaaagtaaagtgatcagaaaagtttttattttaaattataaatgggtaaaannnaaaaa

SEQ ID NO: 92825 - DNA, 477 bp, Heterodera glycines
  SCN-specific regions: Sequence locations=1-477
tgagattgttcaattagaatgggcgctaaagcgaataataagcgcaatggccgagtgcaatacgaaccggccaaagattttcgtgggaaaatgttggagctcgtctattggcgtgacccccaaaagagcggtgccgttttggcctctctctttctctgcgtttacgttttccaacacttttccgtcctttccgttctcataaatggcgccctttgccttttgcttgccaccgtcggcttccgcgtgtttaagctggccgaagcccacttcaaaaagttgcccgatgccagcgccaacccgtaccagcagtacttggacatggaggtggccgtgccaatggacaaactccaccaccatgtagacttggccgtggaatacgcactgttcctggccaagaaaatccgtcacatttatctgtccgatgctttgctcgactcaattaagttcggtttgattctccactcgctgtcctacgtg

SEQ ID NO: 92826 - DNA, 229 bp, Heterodera glycines
  SCN-specific regions: Sequence locations=1-229
tattgaggtatcactggatcgttcaatgcaataggttaaatcgggttagcgcaatttgcgtcgagcgagcgcttcaaacaatgccaagtacccagtggacgccgctgcagttggcggggcggtgatgggcggaccggtgggaatcgcggccggctcattggtggcagggattgcggcggccgtaaggggcgcttttgcaggcctttacggagggcgtgtgctgaaacgg

SEQ ID NO: 92827 - DNA, 625 bp, Heterodera glycines
  SCN-specific regions: Sequence locations=1-48,71-625
caattgctggagaagttgaaggcaacaaagtgaaggaattgaaggcgaaggaaggggaggaggaaaaggcagttgacaatggggacgagtcggttgaggacgaccgcgcattcggcacaaaaacgccgccggcgtcgcaactgcgccaaacgccgcctctctcggccagcattcgggctccgaccgtgcgcaagcgttgctccgcagtctttggtgcaaggacgagccacacttccactagtggcggcggtggtggtgggctgtccgcgttgaccagtgcgatgttgggcaagaagccacgcaagcagtccgtgctggacaacgcccagtccggctggcgctcatttgtgcaggaggaacagttggagcaggagatggagtcgcacatgcgcagcaaggacgcctatttggacaagcaggagtttctgctccgcgcggactacagccaatttgagcgggagcgcgacttgcgtgcgcaggaaagacgggttcagcaacagcagcaggccaacagcggcagcaagccgagataaatgcgtattttgtgtaaagaaatggggaaaatgattgatatttggatcggaactctcaaattcgactgtctttttgatgaaatttttgtttc

SEQ ID NO: 92828 - DNA, 388 bp, Heterodera glycines
  SCN-specific regions: Sequence locations=1-37,60-268,290-388
acgcgttgtgcaacagaaggcgtgcctgcatctgccgcccctgcccaccaccaccatcggttcgttcccgcaaagggcgacggtgcgcgcgatgcttgccttattccaagcgcacaaaacggcggacgcggattattgggcatttatcaacgcggatacggatcggtgcattcagatgcaggatgacattggtttggatgtgcttgtccacagtgaattcgagcgccatgacatgggcgaatatttcgctgaacatttgcacggcttttgcgtcacttccaacggatgggctcagtgctatgggtcgcgctgtgttaagccccccgtcctttacggcgacgtgctaaaggcggggccaaagaccgtggaaatgacccaatttgcgcaa

SEQ ID NO: 92829 - DNA, 491 bp, Heterodera glycines
  SCN-specific regions: Sequence locations=1-60,167-491
ctggctcgagagttttgtccgaccaaaatttgctttttggtcaccagctttggcaccacctttttttctttacctttgttattgtttttgttgttctgtttgtagatttggtgatgtttagcttttgtgatgttccaattttccttttttgtgtgtttttgtctcttaatttgtcctccattcccccccccccccctccgttgtgctgcttaattattttacaataacaattctgcttttttaatttttcttgtcataatttttttttctatctccctccattcactttcttcgttgttatttatggttgtgccctgccccccccccccatttccatgcaattgtttaattccgaaaatccccgcccaactgactacacccaaccagtgtttgtcgcccatttatatgatctcttttgtctcatcccttccttgctccctcaatggcactttgcgtgatgataatcttctttttcccgaatttaattttcg

SEQ ID NO: 92830 - DNA, 517 bp, Heterodera glycines
  SCN-specific regions: Sequence locations=1-517
ttttgtcgtcactgagcgctccccgacccaccaaattcaaatttacaaccaatacggccaattcattcgcaaattcggcgcttccatcctgcaacacccgcgcggcgtctgtgtggacagtcagggccgaattgtggtggtggagtgcaaagtgatgcgcgtgctcatcttcgacatgttcttttacattctgcacaaattcagctgttcacgctatttggagtttcccaacggcgtttgcaccaccgacaaagaagaaattctaatcagtgacaaccgggcacattccatcaaagtgttcaattacgagggccaatttttgcgtcagatcggtggcgagggggtgactaattatccgattggggtcggcatcaaccaacttggcgagattgtggtggcggataatcataacaatttcaacttgaccgtcttcagtcaggacggcactctgctgagtgcctttgagtcgaaggtgaagcacgcgcaatgttacgacgtggcgttgatcgacgattcg

SEQ ID NO: 92831 - DNA, 575 bp, Heterodera glycines
  SCN-specific regions: Sequence locations=1-575
ctcggacagtaatgaccaatgcagaagcggaattgccagataacgcgccgaaacgtcgcttcattaaccgagggatcaaccgtgtggagttgttgggtggtgtcggtggacaaccggtggtcaaacagactgcccaagggtcagccttcgcgtcgttcaatctgtacaccaatgtggaccgtcggctgtccagcgggggcacaatgacaagcacggaggtgcacaacgtgatcgcattcggtgttatggccagatacgtggagaagaacgtcgaccgagggacccgtgtttacttgaccggacgtcttcactacactggcggtcagctgaacgcggacgggtcgcgctccccgcgcatttgttcagtcaacttggagagcatctacccgttgtccaagccaggcgcgatgtacagcctctgcggcggcggtggtggcgcttctcgcgaaggtgctgatgacgggcttaaggattgaatgaatgaaatgatatcaattgttttgttgttgatgcggacaatatacctatgtgttgtacgcgagcccacttttttgatttttgataaattttgacac

SEQ ID NO: 92832 - DNA, 499 bp, Heterodera glycines
  misc_feature (270)..(270): n is a, c, g, or t
  SCN-specific regions: Sequence locations=1-499
cacgaaggttggtcaccaaaacttatggtacaagacacaacaattgcacagggaacaaggaataaaatatcttgaagaaatgcacagcctttcctggaccaacattttcgataatacctaaataaaccaacgcccattgccattttggcggacaaggtgaacatgctggacaccaagcttgaggatgtgctgtacacggggttcaactgggccaacatgcaccagtcgcgcttgagcgttgtggccatttcaaacacattggacttggcnggaacggtttcttttcccaacggattgccaggccaatgggtaacaatcgactcaattttcaaccctacgaattcaaagaaattgaggagattatcagaggtcggctcaccgaatgccctgaaggcgcattcgaccccaaagccattgaattggcatcaaaaaaagttgcggccatttccggcgatttacataaagcgtttgaactgatacggcgtggcattgacattgc

SEQ ID NO: 92833 - DNA, 638 bp, Heterodera glycines
  SCN-specific regions: Sequence locations=1-129,154-638
gtttgaggtccgttcatttttctgttcccaaaatgtcggctcttccgtcgccactgttggcttttgccacttcgattcgcttttgtacgtcgacgcgacaaaatctaaaaatcaaccaaaacacgaaggtggtcgtccaaggctttaccggcaaacagggcactttccacggccagcaaatgattgagtacggcacgaatgttgtggccggtgtgtcgccctcaaaagcgggcactgagcactttttaaagccgatatttgcaacagtcaaagatgcccggaaaaaaactggtgccgacgcttcagtgatttatgtgccggcgccctttgccgcggctgccatcgacgaagcgatcgacgccgaaatccctttggttgtgtgcatcaccgagggaatcccccaattggacatggtccgtgtcaagaaccgtcttctgaagcagaatcggactcggctgctcggccccaattgtccgggaatcattgcgcctggcgaatgcaaaattggcataatgccgggtcacatccacgaaaaaggcgttattggcatcgtttcgcgatcgggcacactcacttatgaggccgttcaacagaccactgagacgggccttggccaaactttgtgcgtgggcattggt

SEQ ID NO: 92834 - DNA, 568 bp, Heterodera glycines
  SCN-specific regions: Sequence locations=1-415,440-450,472-527,562-568
ggtttgagctgttattaaatgggcaccgcggaagataagggagccgctgaaggccgagcggcagagtctgcgaccggtcgcattcgccgccacgtgctgggcgacggtggcaatcacctcctgtctgatcattttcccgctgattgtccattacatccaaacattggaggccaacgttcagttggacctcgacttttgcaagtcacgcgcccgggacatgttcaaggaaatgttcgaaattaaaacgggcggaaaaggcggcgaagcggcggccgcgcgattggccaacatggcaatccagcgtcgccagttggagaagcgtgacacgctcggcgactattggtcgcgccgtctgcatgacatggcgttgcgggacgacccggtggacgagcgggcggaaggcattggcggacgactcggcggcagcggcggcggcgccacgtcgccccaggcgccgaccaccggcggcgtcgccaaaacggcggtgacatccaacgcgagcaaaatcggcggcacttcgtcgacacgcggcggaagcagcagcagcaaagagagtgcaccgcgcgcg

SEQ ID NO: 92835 - DNA, 362 bp, Heterodera glycines
  SCN-specific regions: Sequence locations=1-362
tcccatggctatccgtttctttcgctcccctcaccctcattaacctaagttttgcgcctcattctcggccttttctttatatggcgtcattagcaacgtaagcaattagcaaagcacaaatcggagcatcaacggacggaatgccaattaaaatttggcggttcggtgcctttccttttatttgaaaactttttgtgttttccaattctaagaacagtcagtcttttgagagtttgtcaacacattgaggcctctgccttcatttgatagtgttgctttgataaggtgcgaattcgcttcccttttggtcgttcgtttccgccgtttcggcgtgccattggcacttcgctgcgctgttccct

SEQ ID NO: 92836 - DNA, 641 bp, Heterodera glycines
  SCN-specific regions: Sequence locations=1-4,26-641
catgacagacaagcgggagaagaagccgtcggcgcagccgcaacaacagcaacacgaagatggagcagtacaacagcaaaaggggaagggcaccaatgccaaaatggcatttgatgacgaggaggagttgcaggacgaggagacggagcagttctaccagcaattcgcgggcagcaccaccagcagcaaattggcggccaagagcaaaaagttttccgaggatgagcgcaacaaatacgttggacagttcagtgtcgtcatgggcatgttgcagaatgtcaatcacattgagtttgacaaaacgttggcccgactgagtacgaatggcgattatcgtaaggcgtttccgtccgctgccgacctgctcgcattcatcaccgtcaattgtccgaacatcaaggccatcaaagtgtccaagcaggatgtggcactgttgtggagcgagcgcagtgacgagttggtgtcgctgctgttgcaacacgtgggcaaggtgatcctgaagaagagcgttggcaaggcctacgattactaggacatctcatcatcatcatagcgaacggcacattttgtttttggcatttttctttttcattgacactattgaaatgttttgttgcttctcattttgaccttttgtcgcc

SEQ ID NO: 92837 - DNA, 615 bp, Heterodera glycines
  SCN-specific regions: Sequence locations=1-615
ccattcattgatcattcgttcgttcgttcttcgtttcgtcaatggcattctcttccgtcttttgccgatctccgtcccttttgtcccttttgcccattttgcttctgatcattgcccagtttgttaatggcatggactttgatgaattcgaattgccttccgatcgattggacgcattccaaaaacggagggcgcgcgaacttttcggaaagcgaagcgcaccacctccggcagcagtcgcaaattacgaacgacactcccgaagaacacgagaattgttcgggaagagagcagctgctgttgaaccgttcacggaagcggaggaagttccactgatggtactctctttgaccgagggggacgagcagtacaatgccaacacaaacaacgaaaacgacggtcggagaaggcaaatgccaattataaatacgcggctcagaatgtttcagcctaaaaatacggccgatgcgatggcggaggaagcgccgtttggcaccgacggtggccgactttggcagtggcaaaggccgcgccggggcgtccatcgcgaattgttcggacgatgaggcgaaggaaatgaaaggacgactatctgccgatgtccaatttgttagc

SEQ ID NO: 92838 - DNA, 592 bp, Heterodera glycines
  SCN-specific regions: Sequence locations=1-99,126-402,430-592
cgactttttcgccctgacaatgtctttcaaattgattcttctgatcgctgtgccaatgtttgtcatttgttgtgccattcttttgaagtattgggaccgcctcaaaaaaccaccaaaacaacaacgagaccatcgcaaaattgaaagagtgccggaaattgtcttaacaatttgctccgacgaaatgtcatcagacaaccaaaatgaagcagaggcgaagatggcgaaagcaattttcatttctgctgactgttggctttgtgtattcgatttgcttacgccttcacaacttggccacggaattgcgatgatcagccaccgatttgacttttacgtcgatgaacacttcaaaactcgcaaatggacgctgaaacctattcaaattgaaataacaattggagaaaatggcacaaaggaaatggaaattgtcaatgatgatggagaagcattgccaattccgaaaatgaaaatgccacgcaaagtcatcggattcaaacgcatcgaaatctctttcatcgacaaaaatgtcatcgcttttctccaccgttttggccaacttttcgccgtatgtccgattaatttgttcatcggc

SEQ ID NO: 92839 - DNA, 550 bp, Heterodera glycines
  misc_feature (9)..(9): n is a, c, g, or t
  misc_feature (16)..(16): n is a, c, g, or t
  misc_feature (41)..(42): n is a, c, g, or t
  misc_feature (49)..(50): n is a, c, g, or t
  SCN-specific regions: Sequence locations=1-50,107-123,148-158,180 -256,278-550
gagaaattncccgggntgcatgtactaaaagggagggaggnngaaaatnncatcgaccggaagaagcacattttcaaattggcacagggcgaatatgtggcaccggaaaaaaatcaaaagtgtttatgtgcaatgcccacttgtccagcaagtttatgtggacggcgacagtttggaacgaaatttggtggcgatcgttgttccaccggagaaaaccctcaagcgattgtacaaggaattgcacggcacagcccaaaatggcgatttggagaagcgctttcaggaaatttgtacggacaaaaagattgtcgaagctgtgttgaaacaaatgcaacagatgggcaaagagcagaagctgagcagcattgagcaggtaaaggcaatttttctcgaggtggagccgttcagcgtagaaaatgggcttttgacgccgacactgaagtcgaagaggccccaacttcgacaaaaataccgggaacaaatcgcggcactgtacagaacgggcgaaaagtaaacgaattgccattggaaagacggagaaaaatgcctc

SEQ ID NO: 92840 - DNA, 385 bp, Heterodera glycines
  SCN-specific regions: Sequence locations=1-93,115-212,235-385
gtttcgtccgacgcccggcccacgatggcgcgaggaggacggcctcgaaattgaggtgacccacaaaattgaggaaagcgcttgccgtcgttcggcacccggcgacaccattcaccagcactacacactgaacttggcggacggcacattcatcgactcgtccttctcacgcagcaaaccgttcattttccgtctccaccacggcgaagtgatcgccggaatggaccgtgccatgacctcgatgtgcgagggcgaacgtcgtcgcgttgtgatcccggccgcattgggctatgggggacaggggcgtgacaatatcccccggcggcgccactctctacttttaactttgagctgcgcaaacttgatcaaaccgacggcagaagaa

SEQ ID NO: 92841 - DNA, 382 bp, Heterodera glycines
  SCN-specific regions: Sequence locations=1-382
ctactacatcttctttgctaaacttcaactgcccagacgactgtcaacgcagcgtggcctccaacattcaaggtgttcccctggttcttccggaccgttcggaccgcctggacagcccggtactttctgtgaggcgcatgacaggccggacagtgctggacagcctgggaaaaccgctcctccttgaccgaccaaaaagatcccctggccacactggcctgctggcccgccctgccgcctcggagagactggaccgcccggagagcaacgagaacctgctaaacctgtgacgcccgactatggaggaggacctgttactcctagggctgccggaccccaaggacagtctgtactgcccggactacccagaggctctggccaa

SEQ ID NO: 92842 - DNA, 595 bp, Heterodera glycines
  SCN-specific regions: Sequence locations=1-48,77-595
ggaatgtcaacaaattgaggagcgtactgatcggacaggaagtgacggagagcagcggagcaggaccagaagcagctgatacgagcggaggcagcagtcgcagcggtggccattcgcccgccttttctccccaattggtccggccccattttgagtttgtcgaccttggcggcggcagcttcatcaaagtggtgtccagcgaggcgtgtgcccttctctccgcgctcaccgaactgatcaagaaaggcgagcccgaggatgtgttgttggagcgtgtgccgcttctgctggccacgctgttgcaggtgttggccgcgcttgtggacacgcaatactcaagcgcccaaaagcacgccgttgtgccggaacgggacgccaccgtcggcaatggcaacgggcggaagcgtcgcttccgcctcatcgacgacgaccactcaatgccaacaatcagtgagcagcagcggcacagtttcatcatcacagactgcagcaaattctgctgctactgctgcggcttcaacgacgccgtctacgcccacaatggtttcaggcggcgttgcaatgcaatcacctactaaaaagggcgccggaggtg

SEQ ID NO: 92843 - DNA, 451 bp, Heterodera glycines
  SCN-specific regions: Sequence locations=1-60,90-154,177-451
tcacattgttctctggattgcctcggtgtgctctctggtgaatatcatcgccacagtcggcactctgccatctctgtactcagagatgaggcaaatgaacaacaaagtgcgcgacggacttgagggcttcggcgtcaacaccgactcgtcctgcactgacttgatggacgtgcaagtggacatgacgccgacgtcgaaaccccgtgataaccccttcaactccatcttctttgtcaaacgtcaactggccggacactgccagtgcgcttgcctccctcttgtacgctgcagaacatgtcccgccccgccctgacctgactgcctggcacggctggcccggatggaaggggacggaccggacgggaaggatggccagggacaacccggctcgcccctttctgggtggacgaaaatggtacctttggcacccttcggaccccgaggaaaacct

SEQ ID NO: 92844 - DNA, 187 bp, Heterodera glycines
  misc_feature (162)..(162): n is a, c, g, or t
  SCN-specific regions: Sequence locations=36-187
ggagatgagccaaatgaacagcaaagtgcgcgacggagatgaggccttcccgcgcagcaccgactccgcctggcctgacttgatggacgtgcacccggccgcgacgccgccgtagaagccccgtgatcacccctgcgactctattttttttgccaaacgtcnactgtccgggaactgccagtgtgct

SEQ ID NO: 92845 - DNA, 232 bp, Heterodera glycines
  SCN-specific regions: Sequence locations=1-129,154-232
ctcgacgtgctctctgatgggtatctgggccacacgaatggatctcgcatctgtgctctctgaaaggacccccatgaacaccagagtgcacgactgaattcacgtcttccattctaacgcctgctcaaactggactgacttgatggacgtgcaggtggccgtgacttccacaacggaatgccgtgataagcccttcaactccatattgggtgccagatctctgctgcccagc

SEQ ID NO: 92846 - DNA, 378 bp, Heterodera glycines
  misc_feature (358)..(359): n is a, c, g, or t
  SCN-specific regions: Sequence locations=1-196,220-317,341-378
caaacccaattgatgctgggcggggggccggcagcggcgcagggactgccgccaacgcaaacgaaagcaattcgacgacgaaaacggggcattaaaacgtccggactgatcgccggggcactgatcggcacgggggcagccgttggagcgaacgcatacaaaaaatacaaagcgaataagggctaagggagcggaggacagacaaagagagagaaagggacaaatggaagcgacggagaattaattggaagtgatcaattaacactaatatgcatcattaaaagaccaattagcacacaattgacatttattatgaaccacatttaaaatcattttaaagagaaccatcacagtaccnnaaaaaaaaaaaaaaaaaaa

SEQ ID NO: 92847 - DNA, 139 bp, Heterodera glycines
  SCN-specific regions: Sequence locations=1-139
cacggagaggactgagttgatggacgtgcaagtggtcgagacgacgccgaggaagacccgggataaccccttcaactccatcttttgtgcaaaacgtcgaatgagcggacactgccagtgcgctggcctcaaacagcca

SEQ ID NO: 92848 - DNA, 384 bp, Heterodera glycines
  SCN-specific regions: Sequence locations=1-384
cgcaatttacgaaaattatataatttgttcggcctcaaacagcgaatttccggacggtgaaaaggagcgtatttacgtattccatgccgaaaaacaattggatttgtacgaagcaaattccatccaaacaaatcgaattttgcaaatggccctcaatcgctctcatttgctcactttcgacgtgaattcgctgatcgccatttattctctgtcgctttccctcgaaaatgatcaaagcgcagattcgctctctttggaatgccttgccgaaattcgtattgctgaattcctgccccatccgaactgtctcgtctcaatggaccagacgaggctcaatttctattcggatgctgttcccttttgtgatgatttggactccctttt

SEQ ID NO: 92849 - DNA, 601 bp, Heterodera glycines
  SCN-specific regions: Sequence locations=1-406,429-601
tttaaaatgtccgacgaaatcaaagaactgaaggccattacgctgcaaattctgaagaatcagacgttgatgatcgctcatttagtcaatcaggcacgccaaaataaaccgcagcaacacgtccaaccgccgctgatgttgaagcaggtcaagacggagccgtgtgagcctccgtcgacggtgtcaaagcgaaaggcgccgtcggccgtggagcagccattgaatgaaatcagtttcatcaacaaaaacaacggcggatgcgctacggtcaataaacgtcgcaggatgagcgcaccgaacaccgctgggatggccaccaaacagaacaacaccaaattctgcaaaatttgcgatgccgtggtggacgagaatagtctcgtgagtcacatttgggagcacattctgaaaaagatgatgaaagagaaggcggacttgtccaatgcgtacagtttcgtttgcgacgtcaacggatgcgtcttccgtaccaacaagttggaagcggccggtggccatgccatcaaacacccggaagtggagcgtaacaaggttgtgttggacaatcgtgaaaattcggagccgctctttctcgccactctcgcgc

SEQ ID NO: 92850 - DNA, 418 bp, Heterodera glycines
  SCN-specific regions: Sequence locations=1-418
acgcacaaggcccgacagagttcaggccttccgcccatccccgagtctgcctggaatgccttgtatggacgtgcaaggggtcgagaggacgccgacaaaaggacgggataacccacttccgtccaacttccgagccttatgttgtctgcccgcacattgccaatgtcctgggctccgacgtgctggctgtccccctggtccaccctgaccgaccggaccggatggacagtctggacatcctggaggcgggggaccccccggacactctgaagatcctggccatcccactcctcgttgatcgtcccaaaatgtaccccgaccacgatgacctgctagggcccccggacgaccctgaggacatgaatcggccggagcccaaggagtcgcggtgaatgctgacacgacggatcagggtggt

SEQ ID NO: 92851 - DNA, 369 bp, Heterodera glycines
  SCN-specific regions: Sequence locations=1-369
caatcttcatggcgactacaaccaaaacaaggcctttttggtgcagaagttggtatgccgctggaggggctagaatcgccgcgaacgtggacaacgttatcaaatttgcgacttgggacatgtttttcgaagcgcgtcgcattttgcaggctgacatggaagtgcgtcactttttctacaatccaaatccggcaattgctcttcaaaacaacattaactcaatttccgatcgtctctacaaccgtggttacgttttggtcagatgactcgcagaaattgaagacgcagccgtgtcagttcttcgagttttaaaggatgatccattgttcattcagcattttttgttgcaaataaagacttattgccttt

SEQ ID NO: 92852 - DNA, 230 bp, Heterodera glycines
  misc_feature (11)..(11): n is a, c, g, or t
  SCN-specific regions: Sequence locations=1-230
ccggactcggngtgagaacggacagcccggccagtctggaaaccccggcccgcaaggataccctggcgacggcggaagccccggacaacccggcaaccccggaggcagctgcgagcccggacagcccggagcacagggatccagcggccaatgctaccattgcccatgttataacaccgcccccggctactgagtgtgatcagtcgactatcgacaattggagaagaacc

SEQ ID NO: 92853 - DNA, 646 bp, Heterodera glycines
  SCN-specific regions: Sequence locations=1-585,607-646
cttctttataaattttctgtgtttaccaattcaaaaaaaagatgtctgacaatccaaacgaagcaaataaagaaatggaaaaagagatcttcatctctgccgactgttggctcaaagtgttcgatttgctgccgccctctcaggccttggcattgcgatgatcagccgccgatttgactattacgtcgacgaacactttaaaacgcgcaaatggacattgggcgtaatgaaaattcaaagcaaaattgtacagaatggcgcaaagaaaatggaaattgtcaattccgatggaaaagaattgccaatccctcaaaatccgttgcccaacaaagtcatcggattcagaaacatttggatattcttcctcgaccacaatgtgctcatttttctccgccatttccaccgttttttccccacttgcgcaacaaaattggaagttgagactgaaaatgttcgcgtttcggagttccttctgctcaacatttggccaatgctcaaggacaccatccgtgagatgtctttggacgacttcaaccgtcgtcaaattcgccaattggccccgtcaatgctaaacgattgtcaatctctcatctctgtcactttctatggccccatttaccccgaatttccgcctgatgacagtgcc

SEQ ID NO: 92854 - DNA, 361 bp, Heterodera glycines
  misc_feature (101)..(101): n is a, c, g, or t
  misc_feature (279)..(279): n is a, c, g, or t
  SCN-specific regions: Sequence locations=1-294,316-328,351-361
agtcggaattgcttcccattgttcagtggtcgcgattttggacactcttgtggtgatcccgcaactgtgtcctacaatctacgaaatgaacaaccgcgtgntggacggtgtataagctttccgcgtgcaaacggattccgcgtggactgagatgatgttggtgcacatcagtgtcacgccgccgacacatctgcgagagcatcccttcaactccattttcctacgcgcttctttttacggcattgcctccccaatgcgatttcgcgactgcagcatccncagctgtccctcctggtccatgcctggggcagtctgggcccgcccgcgacaccccggacgagccacggggggcgtcggtgga

SEQ ID NO: 92855 - DNA, 624 bp, Heterodera glycines
  SCN-specific regions: Sequence locations=1-624
ctcggaatgcgaatttatttttgcttaatcttttatttttgctgtttttctttgttggtttgccgtccaaagaaagccaagacgaagaaaccgaagaataaaaaatttgactacaataaattgcgagatccggacagaaaaggatgttatggtggcactgctgactttcattatttcggcaacaaaagcgaagcggtggataatagcaaatgcattcgttggcttagcgtcacaaaatggattatgcaccaattccgaggctaccaactttattattttgctgacgaattcactgagcacaaccattgcagaaacattgacctgaccatttacacgccgaacccgaagctgtccaatgcaagtgcgcacctttttcttggctacgacgagcaaattgcgaaggggccgtggtgctatgtggagaagaagggggatatgcccgaacatttgacggcgaaatggaaaggatatcatttgacggaccctgggaacagcaagaaaactatccgctttcccgacaaaatcaatcaattaaaaatgaaatacgaaccgaagccatgcttcaaaatgtgcaaatgaattggtggtagacgagatgagaaaactttggaagttcttaatttg

SEQ ID NO: 92856 - DNA, 570 bp, Heterodera glycines
  SCN-specific regions: Sequence locations=1-138,160-570
agtagtgctttatattgccattcttcaaattaaacttttgctaaaattccatggacgaatcggcgaaaaagacgctaaaacaaattccactgctgaaaacaaatgcagggccacgagacggacccctttggcttgaacggttgaaggaggagtacaacagtttgatcgcgttcattgagcacaacaagcagggcgatgccgactggtttcgacttgagtcgagcgcggatggcactcgatggttcggcaaatgttggacctaccacaacaaaatcaaatacgaattcgatgtggagttcgacgtgccgattacatacccaaaaactgctccagaaattgcccttcccgaattggacggaaaaacggcgaaaatgtacaggggaggcaaaatttgtttaagtgatcacttcaagccattgtgggcgagaaatgtgccgaagtttggcattgcccatgccttctcacttggccttggcccatggatggctgtcgagattcccgacctgatcgaacgtggcgtgctcacactaaaataaaaaacattgttgctgcaaaagaagagggcaccgg

SEQ ID NO: 92857 - DNA, 579 bp, Heterodera glycines
  SCN-specific regions: Sequence locations=1-579
gtgaattttgtgttggcactgaacgtgccgatgagtgtgctgctgcgcgaagcggtggttgaacggctggtcgagccggcttgggctgccatgtccatgtcaccgaaagagttgctctcgcgccaattgatgcccaaaattggcaaggctaccggtcttcgtccgtcgctgaactcggacctgacgctgaccgtcacattggaaaatgacgaatttgtgcagtccgactttgactttctcgtcctgtattttcccgacgaattcatgcgaggccatgccccaaaacggaggcgccgtggcggagggagtcgcacaccaaattctggtggcacaaatgtcgttgttgaagaccatgccgtcgtggacatggcctcttctctgctgaccaaaatgaagatcaaagcggcgcgcgaccaaatgagccgtgccgtggcaaacattttcaaattttcgcccgcctcgcttccctgcacttgcaaatccgtcactttggagcggttgccgttgttcatcggcggtcgctattgcaaatactcgcgcgcactgccccagtcgccatggattggcgccagcgatgaa

SEQ ID NO: 92858 - DNA, 361 bp, Heterodera glycines
  misc_feature (2)..(2): n is a, c, g, or t
  misc_feature (20)..(20): n is a, c, g, or t
  misc_feature (81)..(81): n is a, c, g, or t
  SCN-specific regions: Sequence locations=1-361
cnatggagaagacgctacantcatttccactgctgaaaacaaatgcagggccacgagacggacccctttggcttgaacggntgaaggaggagtacaacagtttgatcgcgttcattgagcacaacaagcagggcgatgccgactggtttcgacttgagtcgagttttttttttttactcgatggttcggcaaatgttggacctaccacatcaacaccccatacgaattccatgtggagttcgacgtgccgatgacatacccaaaaactgctccaaaaattgcccttcccgaattggacggaaaaacggcgaaaatgtacaggggaggcaaaatttgtttaagtgatcacttcaagccattg

SEQ ID NO: 92859 - DNA, 634 bp, Heterodera glycines
  SCN-specific regions: Sequence locations=1-265,287-634
gttcattacgttcacctgacccgcgcatttgtgccaaatttgcttgtgatggcaccactgatccaatcagaaatggccaatcatcgctgtttcaacaacgaagaaattatgagaatgtaaattcaacaacattttgtgcaccagcaacggaagaaattgaggaagatggaatttgcaaaacggacgatgactctttcaatgactacgaatttttccatccacgacaaacgacgtgcagcactattcggggcgaagaagcggaggcgaaaagagagaagaaggggacggaggacaacaacaatttgtcatcgtcatcttcggtcagcacaatcaccgcaatgacacggacaaaaacattgccaaatggggcgaaacaacacgaagaagggcacaagaaacggtctctccaccaggaacccctttcccggaaaaagagcagcaaccaagttttggaaaggagttcgctcatatcttcgccgtcctccgatcacacagagctcgaagtgttccacccctccgactgtagcttggcaccctcaagttcttcatgttcctcgtcagatagccttgaaaaccaccggcagtcccggcattgtcccgagttggcgaacaatttgcagtcccagtcccacca

SEQ ID NO: 92860 - DNA, 535 bp, Heterodera glycines
  SCN-specific regions: Sequence locations=1-41,63-108,130-535
attctattttgattgctttaatttaaaatctcaacttcgatatggattccaattccaattcacataaaaaatcgaaaattgtcggaattgtcacccgtggcgtggaattgggagcaggaaaatcgctcatttgtgtttggaactcacgttcccccctcaaagagtacaaattcccacgctgggcctccgaatacaccgtttggttcaattggggagaaatcgtgtggattgagccgagcaaatccgttgatgaggtgcaagacccgagaaacatcagcaaattggagccggacaatgaacgattgcggaagatcaagtcacttacccaattggacacgaggcactgtttttgatcaaagtgatcgtcgcttttccgccgccttcggtcgaccattatcgcgatgagctcgctgcttcgaagtctttgggttgccgtgcgatcggatggagtgtcgaaatgggaaaagttgcacttttggacgaggcattggtctttaaaccgggcgtttgttacagcggttacgtcgcacgcatc

SEQ ID NO: 92861 - DNA, 525 bp, Heterodera glycines
  SCN-specific regions: Sequence locations=1-34,59-111,139-199,225 -272,298-525
cccccccctaaatttgtcctcctcctgtgtgaactgtgaatgaatgaatgagtgatttattattaattattgtacatatatatggcgtagttttgtgttgtctaaaaccgtcggcgccgccgggccgccccgccgccgtctgctcgaaataatgcgcaagggactttttggtcacaaaatttatcaattgggggggctgtgtggtggtggtggtggcggcggtgtctcgacaaatttttttccccatttgctaaatttactccctcccgatcattatatatttatttttaattattacccgttaattagatgggaggaggagggtttgtaaatttgtcttcgatgtattttttcaaaaaaaaaaaaaattttgtttgggaaaagtgcaatatgcaacaaataaattaaattagggcttgacacaggggcggggttccgcgcgacattttgcgggatcccactccaaaatcagtcctgcattcttggaatttgcggggatatttattactcccgcggaatcccttc

SEQ ID NO: 92862 - DNA, 598 bp, Heterodera glycines
  SCN-specific regions: Sequence locations=1-105,210-295,317-557,579-598
ccatcaaagaaagaacaacttgccaatgccaaaagtgcggttccaccgaagaaagaacaacttgccaaaactgtggttccaccgaagaaagaacagctgaagttcgaggacagtgaagaggaggacgaagtgacggatgaagagctggacgacgaagagatggacgatgaggaattggaggacgaatccgaatcagacgaagaggaggaacaacagatggtcaagtctttaaaggctggcactccaaccgttgcccaaacgcagcagcaaattgccaatgccaaaagcgcggttccatcaaagaaagaacagttgtctacccaaactgacaaatacaagggaattgctgcggaagaagagcgtcgtcgtgctgagagggataaggtaactcttttttttacgctgtgaaacgttgcaaaagatgaccgatggtgagatcaaagctcttcatcccgatgccttagctgtacgcaccaacaacagggctttttgctggatggtttttgcatcggaacctactgcggataaggcatttgccgtgttgtcaaagaagggacgaattggggggaaggaattgtacgttgacaaatgtggaacc

SEQ ID NO: 92863 - DNA, 606 bp, Heterodera glycines
  SCN-specific regions: Sequence locations=1-25,49-513,535-606
gcaccacgatcagttgcggatgaactcaattgtcgaacattttcatctgatctggaggcaatgagtgcctcaggccatgtcattcgactcaagaatatgctcaggtgaatttgaacattgctgggtacacagtccgttcattaatttattttgtggatgattccgaatttactgtggcccgggattacagtgtaattgtcggttgggatgtctttgaaaaattgcccccaataaaattcgatcatttaaacgggaaattttttgttggggacaacgaatccaaattgtgctatcgttcaattcttactgaacgatttgcgcgtgtcggcagagaaaaacacactcattccggccgactcccaaatattggtcgatgcttcaatcgaatcatccccaaacccaaaaaattcattttgcattgatcgccctgacataagtcttattaagaagggactgtcagtcattaatagtgtctcgcctgcgggccaataacaaataaaagtggcagtggtcaacccaaccatggaaccaaaatggatttggaaaggaacacatttggcatttgccaatgaattgttatgtgaccgaaatggacttttgaaggaa

SEQ ID NO: 92864 - DNA, 458 bp, Heterodera glycines
  SCN-specific regions: Sequence locations=1-458
gtgagtgcgggtggtggtcggcagaatggtgagttttccgggcccttcagttcccagagtgtgctgccgtggttgttcggtagtccatggtccgtgacattggtgtcgtcgtggttgtccaggcattgggccgtgtggttgctttggttgaccaaattgttgagcgtgttttggttatggtcgccgttgtgcgtggtggatttgtagtcgttgtgcgtggtggatttgtagtcgttgtccacggtggatttgttggtgccggtggagtcgttgtttggctcagactccgattaagtgcgaggactttgtcaatgtatcgctggacgtatggactgtgttttgttgccgtcctcttgtcacgttccgtgaataggttgaggaagttggaaatgtagccgccgtgccatgttttgacttccgcaaattttttttgtcgggttggttgtccttgtgccgca

SEQ ID NO: 92865 - DNA, 578 bp, Heterodera glycines
  SCN-specific regions: Sequence locations=1-300,322-400,428-578
ccgcgaggggacgaaaagcagaagcaagagagaagagctgaggatgatcagctgttgagctgttctcttccgtcccaccttttcggcgatttgacctccgcttccgtcgcgacgccttccgccgttgcgccaacgagtgccgacctcatcgttcatcgccgttgtgctgctgaccagtgctgttgctgtgcttccccccgctcgttccccgtttgccatcgtcggcccctcccctccggcacttttttgccatccgcaaatgctgtaactgaacagcacgggggaggagggggacttctactgccgatgggcatccacgagaacaaatacgcgacccaacaaaggcaaacattcgccgaagcgaacggcggcacttttcgccgcgagggcggcgaagagcgacagaagcagcagcagcaacagtacttcacattccacccgaaagcactgcacaaagaattcccccgcgtggaggagcgtcccagcgttttggagatggaacagtccttcctgctgcgccaccagcagcgccagcgtctccgttcgggcacccccgaacggcgttcgtttcccctctt

SEQ ID NO: 92866 - DNA, 579 bp, Heterodera glycines
  SCN-specific regions: Sequence locations=1-579
gaacgatggcttcgaagtggactcagtcaagagaaagcagatgccgacaatgactacgacttgaatttggacggcaccacactgaacgaattcgcagcagcggtcggccttttttacctgacaatgttcgacggaaaattggcgcacctttcggccgacggaattcgctcaatggacagaccgctgagtgaatggatgtatgagccaagtccgctgatgttcagcgaacgcatcgacggcattttcagatttttgctccgtcagcctggtctgatgcccggcctgcatatgagtggcgaactgcgcgacaaactgtttcgccagggcggtccccatgggttggacttggccgcactgatcgtccaaatgggccgtgaccatggcctgcccgggtacacgcgggtgcgcgaggcgtgcggcgaaatgccgcaggtgaaatccttcgacgatttggcagaaattgtcgtggagccgaagcgaattttgcccattttggcacgccattttcgccgtgttcaggacgtggacctttttctgttggggctggccgaacggccccggcggggcgctttggtgggc

SEQ ID NO: 92867 - DNA, 526 bp, Heterodera glycines
  SCN-specific regions: Sequence locations=1-526
tttgagagttgtataatttcaatgcctcacgtcatcgaacacaaaatccgtctgctcggcagtccctcgtcccctcaccgttcgccacccccgtcggaattcggacggcacgtcgaactccaaaaggacaaaagttgggccgaaatgccatttgagcgaaatgatgccaaggaaaagcagcagcagcagcagaagaggaggagcactttctcaggcggagaagagacttttggggtggaaagttttgagagaaaccttcgctattcaccgcacgaggtcgatcgccaacacttttctgtccgaacattcgaagaaaaaattcccctggggggcggagaaaatgaaaggagcggcggcgttaggttcgtaggccaacacgagcagactcaggaaaatgcttctgaccacggcgaaaataatcactttcttctgcgccgttccccccatttggacacgacgccaattcgaattccacgagttcgaattagtccatccatcgagagggaactcggcacggggtgggcgg

SEQ ID NO: 92868 - DNA, 577 bp, Heterodera glycines
  SCN-specific regions: Sequence locations=1-17,44-426,452-482,506 -519,541-543,565-577
tttccagaatttttccgtgtatttaaatcatttttattaaaatcgaaataaaaagtgaagaatattgatgggattaaaaatattaggtaaaaattacgaataatgagcaaaagaagggttatctagtaacgtattcaaaaaacaaaatttcgaagcttattgttaactttttatttaaatgcttacaattagcagttgcttacaattagaaaaagattcttctatcttaagccttcgaattgatatcaagatcgtccaatttggatggacacaccttcaaaatctttatttaacacggcgattcaattttgggctctaagtacaattaagttggatttttcgtcttagtggtctgtgagttagtcaacaaaaaggggtctcacaaagggaggtggccaagtttcccgtattcccgtccaataacattttcattcattttttcaaaatgtacgttaaccccaaaaatattctttttctactccaaaaatattttaaaaaatataatgaagaaacctcattaaatgatcctgaaattgctattgccaaaaattttgcttctgaaattgaacgatgcctc

SEQ ID NO: 92869 - DNA, 477 bp, Heterodera glycines
  SCN-specific regions: Sequence locations=1-51,114-477
aaacaatccgctaaatttggaagtgttaggttccaattaactatttgtcctccttcgacttggccatgtctttggccctttgcgcagctccctttttcctttttgctctttcttcggcttctcctcccttcttggccactttcaacggttgtccccaactgatcgatggccaattgctcgactttgttaactccgggggcattcggctaacaaaaagcaaaacggggaattgcgatcggttgatcagctgcgatttgatcggggctccagtggaactaacaaaagtcgaatggtacgtaaacggaaggaaaatccaacggacgaacgaagggacggaaagggaagagacagcggaaaacgcacaatcagaaaacgaacggacagaacgaagcgcaattggagtaggcgaggtgagtcaccgtttctgtgccgacaattggctcgttgatgagccttcgcttaatgagaatggcatgg

SEQ ID NO: 92870 - DNA, 474 bp, Heterodera glycines
  SCN-specific regions: Sequence locations=1-89,111-180,277-277,313-474
tttgtgtgttaattaatgctaatgaggagggatcatcgggcgactttttactaactgatggcctcttcccttgtgtttattctaattctgcctaattggatgctgtgcccttcagctgttaacaaaatttattccgttgactttaattgccaaggagccttctttgatgaaacagcgggtccctccccccctttccccgcttcttcccttccttacccttccctcccctcttctatctccccttcccttccctctccttccctcttctctccccccgtttctctcttctccctttttcccctcctttctcttggcaaataaaagcattcccttccattaacttttcctttccaatcctcatcgcagaagggtgccaaccgcctttccgctgtccaccgcttttcagcttctctgattctgattgtgagagattcttccgcttttccattcattcccctttatatacgggggggg

SEQ ID NO: 92871 - DNA, 525 bp, Heterodera glycines
  SCN-specific regions: Sequence locations=1-72,96-346,376-525
atcggtctcattttgtttttcgctaatgatcaatgatcattttatcactgtctgaccaatcacttaactgatcactcacattttgacattttgttgcatccttcaatttccatttgccaaatgccacaacattcaatcaccaaatcaatcctcccgtgccatccctctccgtatccaaaaaatgccataaaaataaagcatcgcctgcgccgtgcactgctcggcccatgttttgccgtcgttctcccgccaccaccaccgagtgccattggtgccgaatttgtgccaccccctgtgccgctgatgtgcacctgcgacaccgttgtcgcgattgcactggcaccctcccggttgtcgtcccgcatgttggccggcaaagatacaccggcgctgccacgccgtgcactcagcacgctggtccgtgccacggtctacgactacgaactgggcaaacgccgcaaactgtccgcctcaatgcgaaccgagtaaacaatgatggcggcacaatgccttttatgcccataa

SEQ ID NO: 92872 - DNA, 486 bp, Heterodera glycines
  SCN-specific regions: Sequence locations=1-486
attcactcgatcaaagaacggcttgacaaatatggaggttgaggtgaaacagcaagagggtttctatctgaaggcaattgtgaccgatgtgttggagaattcgctggacgttgtttatgaccgtggatgccgaaagccggaaactgtggaattcagccaatgtcgtgctgtcatcattgaaaatgcgcagcaaaagcgaccgtcaaaatgcggcgacattgttgatgcccttgttccgattgacaattctacgatgacttccaggcctacaagaagatgaagattcgggagatcaagggcgattttgcggttgtgtgcagcgtggacaattccggagacggcaacgtgtcagcattgggcagtgaagtgatcccgttggaccaatgccgtcatccggcaatgtgtatgctaattgatgccagctcagtgaaacagtgcgccatttcggtgccggacgatttggtcaactattttgtgcatggcgaa

SEQ ID NO: 92873 - DNA, 599 bp, Heterodera glycines
  SCN-specific regions: Sequence locations=1-79,127-250,283-330,365-599
cctgaacaacgggtttaacaccgcaaccgcacaacagacgtgccattgtgtggccaatgccggtgtaaagtaagcaaagaatttttatttaattaaatttaaattaatttatattttcaaaatttagggacttgaagtcggtctgtaacaaagtcgtcatttcataaatggacaaatggacgaatatattcgataaaattcatattttgatcaaagaatttaactctggaattttgataagcgaaattaaattattttgcaaatgaggaaattgaaaattaacgataaaacttttgcattacattagagaaataaaattcacgataaatcaaattaaataataaatttcaaaaatttaaattttgaatggcatttcaaataacacaaaggcatcgtttgcattgccacttttgactggcaattaaattgtaggcaatataaatttaaaatgtttgttcaaacaatttgcttagatttatgcccctgatatacttaatttcttaattctctctttctctctcttatcctctgatcattgttcccccgtcaatgtcagcccggggggcggtccttcttttcactaatcgagactctttata

SEQ ID NO: 92874 - DNA, 649 bp, Heterodera glycines; identical to SEQ ID NO: 72365
  SCN-specific regions: Sequence locations=1-9,31-649

SEQ ID NO: 92875 - DNA, 508 bp, Heterodera glycines
  SCN-specific regions: Sequence locations=1-408,439-508
agcgtggataatgggatcgacaacaaatgagcaaaatgaagaacaacaaaattgcttgatgaaacaagacttcgaaaagctcaatctggtaaaaattgtacaccgtctgacagaagaactgatcagtcggcaggtaaccataaacattgggacaattgcacatgtggcacatggtaaagtcaacactcgtctaaggaatttcgggagtgcatacggtcaaattcaaaaacgaattggaacgaaacatcactatcaaattgggctatgcaaatgcaaagatctttcgttgctccaatatcaaatgtccccggccgcattgctacaggtctgctgggtccagccactcccgaccgtttcccatgtgaacggcccgattgcggtggtgactttgtgtgtgttcgccatgtttctttcgtcgactgtcctggccacgacattctgatggccacgatgcttaatggtgctgctgtcatggatgctgcgcttcttctggtggccggcaatgagc

SEQ ID NO: 92876 - DNA, 554 bp, Heterodera glycines
  SCN-specific regions: Sequence locations=1-23,45-165,187-330,352-554
ccaacacatttcatttttgtgccttttttttattatttttaaaaccatttgtcaatgtttggtcttcacttttgggactcaatacggctttggtcatttaaatccaacttttcatttatatcacttcagatcacctgaaggagtggtcaggtcttattggtgtatttgacttttttgatcagaattgaaagattataactagggataagaatttaagtattacttttaagtaatttttcaacggtaggggtcagtttcggttttatgaaaccaatgaatttaaaatagtctttttttgtgtaatttgtggcgctgatcacaaatatgacctttgtttttcaaaattcagaaccccaaacccgaacgaaaattcgaaattcataaattacaatgaagacatatttttaggggttttcgaggtggctgaaaatggatatggcagccgttttgccctagaaaatacccgaactcgaacaaaaaaatcgattttttctcaacaaacactcggatgtaatgacaactcgtaagaaatgtaactcgtataattgcttgag

SEQ ID NO: 92877 - DNA, 617 bp, Heterodera glycines
  SCN-specific regions: Sequence locations=1-101,123-284,306-355,377-617
gtggactgccacgctgacagtctttgcttgatggcgtcaacgcgtttggtgttcgttcggcgagtgttttcttgccccaaataagctttcaatgtttgttctaatatttttttttataatttcctctttgatttatttgcattttaagcattcgcgggccatcattttcaatccgttgaacccgaccatacgtattcacggcagccgttgtagtttggcatcaattcacccgccccctcaactattacattggtcttgaagtaacccatcttttctgtattttttacttgtaaacccccaaaaaacttaacaaattttacaagtgtctgccatcgcccgaccctttccgacttaatttttgaagtcagcagaaacatcgaccgacaagtggactcagcgaattgagctcggaatttcgtgcactatgaaaattttgaagattcgatcatacaattccccttttttcgattcattcaatatttaaaaatatcattatttttcgtgaaaattgttatttgtttatgcgattctgataaagtattaatgaatttcgtattttgaagctttaggaatgtaatttcaagactttttcgctaatttttatttggcgggatttc

SEQ ID NO: 92878 - DNA, 541 bp, Heterodera glycines
  SCN-specific regions: Sequence locations=1-369,399-451,499-541
gaattgcatggtacgagaaataattagcataaatttatacaaacaataccctatatcaacaaaacatattgaatcaatcaataagacctgaacgaaaaattgctaaaaaacatgtattaccataaatccaaaaatgctactttatccaactgagccaccaattttaagtgaaaacactgccaaaatttcgattttcgaggccctttaactcctggaaattttttcgacacctaaaacaaaattcacaatggaagtctgtctatccaatggtatataacctatatgcattttccgagttaccgatcgcgaggttcccttgtaaatactaatttgataggattcatgacaaggtgtctgaaaacgaaaaccaaaaaaaaattttttttcaaaaataaaaacgaacgaaacaatttatttttttgaattgtcagtgggtaaaagaaaaattgagaattttttgtaaattttataaaaaaaattttgtcaaaattaatttttgctgcctttttacattttttgtgcctttttcgcattttaatgg

SEQ ID NO: 92879 - DNA, 549 bp, Heterodera glycines
  SCN-specific regions: Sequence locations=1-422,444-549
aaataacagtacagttagaaattttcatctaaattaaaatggacaaaaattttacgcaacaaatttattttaaaaacaacaacaattaaatattgaaaaacatctaaaacataatagtgagaatttcaagcgggaaaaaggttttgtgatcaccgcctccaaattctacgacacacggcaagttgggatgatgcaaacggattccatgttttatgtagtaatgcattcgtacctaaaatctttaattatgtccaccaaattgccaaaaagtaccgtaattcccaagaagccgcggtaggccgggactgagtgggcgtcgagaatggagaggtcgttacagcgcaccgggaaatttcgaacaaaagggcgcaggtgggcggtccgcagctgagcagagcgcaagtgctcgacaatgtctcggcgcttctccaagttttggaacaacacgtgcagctcatgcgcgctacagttgaagcgcttgcataagtgctcgacgagcgggatcgggcgcgggcgttctgcacaagcacaagtctttggggtacctaa

SEQ ID NO: 92880 - DNA, 530 bp, Heterodera glycines
  SCN-specific regions: Sequence locations=1-122,144-344,366-530
gttgttcaacagcaggtggtgcatgtactggttgaacatgttgttgcccattttgctttggcgattcgtccgattcaaattatagtcactgttgtcgttgtacacacaacagtgggcgtttgttgtccatcattgtgtgttgttttcacttcaccaacgggcatttgcttctcattgtttgagaatttggctgtccctcctgtgaattttttttttttgagaaattcaatttttatattctgagattttccatttttttcgaagttgacaagtatgtttagattttcacccgttataaaaatgataaataggaaaattaaaatataaggaacaattttgctaataaatatactaattctaagaaattcataaattcgggagacggaagcttttgatgggcctgtgccacagctaatttattatcgtaactattatcatttattctggattagttaccgtatccttttctatgtaaatgatgaacaatcaatggaatatgagggcatttatccaatacatttgcagcatta

SEQ ID NO: 92881 - DNA, 637 bp, Heterodera glycines
  SCN-specific regions: Sequence locations=1-2,24-637
ttataatttttatggaaaatcagggcacttcaaccgcttctttatcctcaacatccgaagcatctccagaaaatgtttcagagctttgcaagaagctccatgtagcaactgcaaatttggttcgtcagtcaaacaaattgccaatgttaggcgatggccacgaattgtactcatcctttgctgattatgcagaatttatgcgagtccaacgcaaccgggccatcattatgcttcgaagactcacaaattaccaatgtcgtctgaatgagtccgttttgaatgatggcatgggcccattgattggcttttgtgatgcgttcgtcgaccgtgccgtttgttttaggtcatttgaaggctaaaatcccatttatttgtaggccattgcattggatgagcatcagcgatcattgacccgcgatcggattaaagcccggcaaatttcgttgggcgctgaaccaattcttagaagcgccacttccaccattgttgcgagcgcttcgaattcacaaattgtaaagtcaggctcagctgcggacgcgtacagccgaaatgcgcacggaggcggcgctttccgtgacggcggcggtcgttttgcagtgttttctacgcacagcgaaatgatgacggaaaacacagc

SEQ ID NO: 92882 - DNA, 395 bp, Heterodera glycines
  SCN-specific regions: Sequence locations=1-107,130-136,158-320,343-375
ggccggtgggggccagggatagcacggaattccgacttccgaaatttttgataaaaagtcggaatttttttgagttttttttttcaaaaaattagcaatttttgtacaattttctgttaataaattgcattgaaatttttaaaaatttcccggcggcgcctatcggcaccgccggacctaaaaatccttaattctcttgaaaatgtgctagaaatcgctaaatttggccattttcgtggacaaatctgttaacaaatctcattaaaaatcactaaaatttttccagcggcgcctatcggcaccgccggacctctccccctattacccaaattttctttgaataaagcgcgccgcaaaaaagggtgtaactgtcccaaaaaaaaaaaaaaaaaaaa

SEQ ID NO: 92883 - DNA, 632 bp, Heterodera glycines
  SCN-specific regions: Sequence locations=1-54,76-463,485-548,570-632
gttagtgttggtgatgatcgatcctcccactgctcctcaacctgtataaggcaatccacctcctgcctttggttaattaattgacgccatgcggtcgatgatgggtcattttctctgctgatttaattaaatttccttactcggtacacatgagcctgcgaagtgaaccactaaaattgtgccaacttatcgtccaacgagatgctgcctactcctgtgtggttgagctgggccaatattcgcttgttcagttcaaagatctcaaccatcatttgaccaccttccaacggacgtatgtacgcgaagttcgccgttgtgcagaaattgagcggtgccttcgctatttggagactgaagtcgtggaggggggcgtcagcgaccacattccgccattggacaccactcgaacggacatcactctgttgcgtgaaatgtacgatttggagtcacacttatacgacatcgagagggacatccggcagtttcttgccaacgaggcccagctgaagcgcaatttcaacgatttgaagcagttcaaaagtgtctatgaaaaggtggaagctttcttcagagtgcacattgagaacacggcaaagactgagttggaaagtgaacagctcgagattaacgac

SEQ ID NO: 92884 - DNA, 578 bp, Heterodera glycines
  SCN-specific regions: Sequence locations=1-251,273-368,398-427,479 -492,514-578
caattgagtcaaatttggtttttaattttattcttacagagatgagagatgcctaaagacccaatttaattctgctttgatcgtcattggatttaaaatttcatgaattatcgcctaaaagcattgaaatgattttgattagcattgtgctagtgaaatggataacaatgatattttttaaataatttcatttatttcttgagcagttttgtttcaatttttggcaaatatttggcctttttaggattttagcaaatatttttggtgtttttggcacacatatatatatatatatgtagtatatatttgggtttttagcaaataaaatccaggcactttccataagtaaaaataggtaatcagctaaattttgtttataaaagtttttaaatttacaagaatttttcaatactccgcatatttttggaaatattaaaatgatttattagataagaaaattaatataaaaataattttagctatctgaccaacatgaaagattcaaaccaagtctttttaaaaaattctttcgtctttagtggttgtgcattttcaattcaaaacttaacccaacaaaa

SEQ ID NO: 92885 - DNA, 639 bp, Heterodera glycines
  SCN-specific regions: Sequence locations=1-58,80-529,552-639
gggatggacacggccgaatcagcgtcagttgcaccaaatcctacgggggaagtcggcgaaacggttgaaccttctcgcgttgtgtctgatttgatgtggctgaccgaccagtgcgaacggagatgcatgttcgaatgtgccaagtgggcgagtgaacagctgagtcatctgcccgaccaacactttgaagcatttgaattacaaaatcccgaccagcgacaaagcattggctgtgaagcgacgaatcgaatgccaaccaaaagacgagcgttggtcagctttgtccgggctttgattctcaacagagactacgacagagcgaagtcttttttcctttcgacggacattggtcaaatgtcctgtcttgaggccttcttgttttacttctcttggtatatgctttcggttcgaaatcgcgtggaaaatgaagcggatgaattggatcggaatgacgaatttgagaacaacgaattggccaatttgaggaccgaaatggaagcggcaaagctcaaacaacccgaccttttcgactgttttttgaattatttattgggcaccgttcaaaaagaaagtggcgccgacgaactcgcaattcgcacatttactgaggcgatacaaatggacaaacgttgttggccc

SEQ ID NO: 92886 - DNA, 549 bp, Heterodera glycines
  SCN-specific regions: Sequence locations=1-549
gacacggagccggtgatcatggaaaatgttcaggacaaacaggtccttctcgacaatttgcatcccgggtcggaatacgaagtgaccgtcactctccgacaaccgcccggcgttgaccgccgtgtcgcgcccaaaaaggcagtccaacgcttccaaacggcggatcagccgccgagcggcgcaccgaacaaattgcgagtggaggttttatgggataccaaattggcattcggatgggaaccgccggagtgcttagagcagaacggcgagatcagtcagtacgagtacgagctgaacgggttggacgagtggaaccaggggacacgccagggcgtcagcccacgcacacgcgcagacattggcgaactgttgcccggctcactgtaccgcttcagggtcagagcgttcacttctgccgggcccggaccgtggtcagagccgatcgacgcgcgcacgacgggctccgagttgggaccgcctcgcgaactttcgcccattagttctctgcagaatgccatccaattggcctggctcccgccccatcccgaa

SEQ ID NO: 92887 - DNA, 221 bp, Heterodera glycines
  misc_feature (146)..(147): n is a, c, g, or t
  misc_feature (186)..(186): n is a, c, g, or t
  misc_feature (211)..(211): n is a, c, g, or t
  SCN-specific regions: Sequence locations=1-154,178-221
accagaacaaggaaagcgaccggccatttcttctgctgttgggaaggcaaaagcaaccaaactgcctgcagccctattcccatgctaatcacctaattagccactaataacaccaaataacaaaactgtcccctgcttctcccaannatggcccccaaatgccttccgctcgaacttttgtacaantttgtgcctttcatccctgccgaanatgccacacc

SEQ ID NO: 92888 - DNA, 567 bp, Heterodera glycines
  SCN-specific regions: Sequence locations=1-14,37-41,64-68,90-567
aaatatttttagcgattttttgaaaaaattaaaagccaagtactctgataagatatctaaaaaatgcaaaatcataaaaacttagaaaatacactgtaatggaaggactacggtaggtttccatcctccaacaaattacgctgcaaattgcagagattgtcctcataccgtatccatttaaaaaacacacagtatcactgacttatactttctgctttcccaatttcgctttaaggaattcagtgtttatcagccattccctacatttttcttcccattcattagtggtgcggtgggaatgccattttttgcttttgcgtcgcctttgtcaccgccaacggcgccgcctctttttggcaatccgtcgctctttgctttcccaccatttttactcttctcaaccgctgtcaacagttctttttgtgcctgaattttcattaaattcaatgcataattattattttttattcatctaaaaaaatgaagtgatcggatgaaggaagtcccggaactgagagggaattttcctgggacatttttacaatagcccaagatagggactgtatc

SEQ ID NO: 92889 - DNA, 535 bp, Heterodera glycines
  SCN-specific regions: Sequence locations=1-74,96-102,124-152,174 -466,489-535
gttgtgtgaatcgaatcggacaattgctggctattttaatgtgaagattttgacggacgaccatctgaatgagtacagaaaacagttcttcatcggcccaaaagtgaacttcaccatttgcaccgaagctgacctcagcgttcgttcgccggtcaaagaattttgggatcatcgcgtattgggcatcagtgaaggcattgaacatgtcggttctcttcgacaagacttggcgctgtacttgctgatctgctggatcatctgctacttttgcatttttaaaggcgtcaaatggacgggaaaagttgtctatctgaccgcatcatttccctatttgatgctgttctttttgcttttgcgcggcctttcgttgcctggcgccagcctcggcctcgaattttatttgaaacccgacttttccaaactgttggagagcaaagtttgggttgacgcggtcacacaggtgtttttctcttatgggcttggcgttggtgcacttgtggcattgggctcatacaacaaatatcacaacaatgtt

SEQ ID NO: 92890 - DNA, 571 bp, Heterodera glycines
  SCN-specific regions: Sequence locations=1-393,417-571
gagaactagtgggagatcggcaagttgcagaacgaattggaggcgtaccgaacgcatgtgcaattgctaagccaaaagaacagcggattcaactgcgtcatccaaatgtttgacaaccgattgcagtctataatgacggcattggcaaaactgcagcagaaacagaacgtaaagcgagacgaggtggaaaaactgtgcaacgaaattgaacaattgcgagcgatgagtgtgaaggccggcgtaacaccgtattggaacacggaaggagcccagggtacggtagcgaaggggggcaaagaggaggagcaaccgcaacagaacggacggggcagcaaaaagagttggattcgaagttcgttcagccgcgcctttcacaaaggcaacaaaaagagcaagcagcaacagcagaaggagaacaacgacgccgcggacaacaactcgctcaattcgttctcctccttcgcccattccaatcccagcaaaagtgccaatgccatcagttcgtcttcgtccgtttcggtgacctccaaaatggacaccgccaacagaacgcaattgggcgagctgagtc

SEQ ID NO: 92891 - DNA, 452 bp, Heterodera glycines
  SCN-specific regions: Sequence locations=1-452
tcactttttcgaattcacttgaataccaataagctagtgaatctcacgaaatcaccgacgctctgccccggctctttttcgaactgaacttctagcacttttctgcctttctgcaagtgtcccccacccatttcctccattattggttcgtcacctcccaagaagactcatccaaagacccattggtgttttggttcgacggtgggcccggctgttcttcgctggacggactcgtcaacgaaatgggcccttatttggtgaacccggatggacaaacgctgcgagagaatcccttctcctggaacaaatttgcatcgatggtttacatcgaagcgccagcgggggtcggcttttcctacgccaccgacggaaacacaacaacaaacgacgacttgacttcgcttcgaaattacgaggccatcaaacagttcttcgccaaacacccgtctttc

SEQ ID NO: 92892 - DNA, 535 bp, Heterodera glycines
  SCN-specific regions: Sequence locations=1-535
cggcgaaatgccagcgtcggtatcctcaccaaatgataaccagaatggtcccgtgaatgaaattgcgcgcattgacaacgcccacacgggatggatttggtgcatttcggtggcccccgacggacgccatttttattccgccggatgggacgcacaaattcagcaatggcacttggccgaaagccgaatcgagcgtggccttgcgctcaatttcccctctttggccgcgctttggtgcgttttggaggatcaaaatgtgctgtacgccagcacgtacagacgtggcccaattctgttcgacttacgggccggcacccatccgcaacatgagctgaacgtgcacaacaatttcccagtgttcgaattggccacggggccaaattgcaaccaattgttttctattggtgaggataatcggctcgtttcggtggacaaacgacgcttttcggcattgctttctgaacatcgtgcgcccgtcagtcacgtggactatgcggacgggcatttgtgcctcagtctgaagaatgggcagctg

SEQ ID NO: 92893 - DNA, 244 bp, Heterodera glycines
  misc_feature (176)..(176): n is a, c, g, or t
  SCN-specific regions: Sequence locations=1-244
gctgactgatgcccaacaaaaacggaaagagcgtattgttcgaaatctgcaagaagtgattggtgatgaaaagctcacgaaacaaattggagcgggcaaaaacatccacgtctattggggcaccgccaccaccggacgtccccatgtcggatatttggttccaatcccaaaaatangggactttttgcgaaacgatattcgtgtgaccattctttttgcggaccttcacgcggtcctcgaccac

SEQ ID NO: 92894 - DNA, 328 bp, Heterodera glycines
  SCN-specific regions: Sequence locations=1-262,285-328
ccaggactcaaatgtcccgctcaggccaaaaattttttctatttccgggaaaaaatcgaaatttttccgaaaaaaataccagtcgatagagctcgaaaaactatgttttggaagtggtcttcgtttttctgggaaaattcgttaaaaattcttaaaattcaaaaacccgaaaaccgttttttaggcctagctcgaaaaattttgaaaattttcgaaattttaaaatctgaaaaaatcgagcttattgaactctacaataagtctgctggccaccctgcgctcaggtcaaaccctaatgagttattcgcctggtactgaagtgaaaaaa

SEQ ID NO: 92895 - DNA, 353 bp, Heterodera glycines
  SCN-specific regions: Sequence locations=1-103,126-353
tttctcagagtttcggtgtgatcgactcagcaaatttacagatcggcactcgtttaggagggggcgcttttggttgtgttaacgaagcgaagtggaccctaagttgtgcgaaagaggcagagaaacagcagggcaaaaccggaaaagcgagcaaaagctcgaaaagggtggccattaaaacattcacaaattttgctgacatggagaaagaagcgggtctgctcaaacagctcgaccacccaaatattttgcgaatgtttggtgtgacaaaattggatgacaaaaacgcaatggtcattgagctgatgaacttgggcgatttgaaaacgtacgttgatggaaggaagccgaag

SEQ ID NO: 92896 - DNA, 330 bp, Heterodera glycines
  misc_feature (97)..(97): n is a, c, g, or t
  SCN-specific regions: Sequence locations=1-175,199-330
attaaatcagagggggaaaaaaattcgtaggggtcggaacggtgcactataaatgttgctgctgaaatgcatttcgccgaaacataacgtcaccagngaaaaacaaattttaatcgaactttttgtaatttttttgtaaaaatttcaagaaattccaagaaaaacctaagattgcattaaaaataaaattcagaattcggctattaagttaaaaaaaatttatcggcaacctttgttctgcaaaaaaattttctaacaaaatttcaagcaaaaaaaaatggatcgctgaaaatttattcaaaaatgttttacatgccctgttccaaggtc

SEQ ID NO: 92897 - DNA, 598 bp, Heterodera glycines
  SCN-specific regions: Sequence locations=1-84,106-423,449-469,500-598
agaccaataaaatcatcagcagaattggctaatcagaaagaaacggggtacttttatcatcaaattaatttaaacgccatttacaatattttttaaagtgttagatcctttggcgacgatccttcgccgcccaattggctctcaaattggccatcttcggatgcccccaattggccgacttccgccgcttctcccattttggtgccggccaccactccgccgtcgaatttaaccgaacaaaatgaccgactcaaaaaatggaagcaaaacagcgaaagggccaaaaggccattcgaaagtgacggaggcgaagagtcatcagacggaaagcggacgattttatccatgggaattggaattgttcacgcaatactcacactttttgcctccctttttctaatgctatgaaagaattttattcgcttaaatatttattttaaataatttaccacataaacaatttattcacttttcaataattttaaataacttaattaaggattgaaattgtttctgactttttttagttttagttttattcgccaaaagtcaataataaaatggtcaaacgattatcagaatgatcaatttcattttg

SEQ ID NO: 92898 - DNA, 246 bp, Heterodera glycines
  SCN-specific regions: Sequence locations=1-246
agtggaattgggagcagtggcggcagccaaacgaacgacgcaaaagcgaaagtcggcacgaaaagcgacaaaaagcaaagggaaggagggacggcagaggacggcacaatgccaaaacagacgcaaaacgacccaatggcgggcgccggcgccgatctgctcagagacggcagcgaccttttctcgccctccggcacgttcaacagcagtttaaacgaaagcacttcgcccattggtggctccacc

SEQ ID NO: 92899 - DNA, 612 bp, Heterodera glycines
  SCN-specific regions: Sequence locations=1-289,328-612
aggccccgaccttgttgaaatgattatctccagcacacctcattgctcaacgaaaaacaccatggtgtactacctggagggcattacactcggctcataaatgtgcgatttgagtgccgatgtacccattcacttcgaaaagatggcgcctaatttggagcgcatactctaaaacttgctgatgagtgatcattctgctgatcatgacgtcgctggtatatgtgacccatttttgcagggcgaaattctcaagctattgaggattttgggcatatatgacccaggggacaatgaataaatgaatgacattttggcacaagtggcaacgaatactgaaacgacaaaaaatgttggcaatgtcattttatatgaaacggtattgactataatggccaacaaaagtgaaagcggcttgcgagctttggccgtgaacattttgggtcgttttttgctttactccgacatatacattcgatatgttgcactgaacactctgctcaaaactgatgcaattgatttccactcagtgctgaggcatcgctccactgtggtggaatgtcagagggatgccgacatttccgtcttaaagacggctcgtggacgtagctttgc

SEQ ID NO: 92900 - DNA, 569 bp, Heterodera glycines
  SCN-specific regions: Sequence locations=1-569
gttcggtttttctgctgtgctaatgataaggattaataaatttgaaccgaaggaagagccacgcgatgagaacgaatttgaaggacaatccccccgaaaatcggacgagaaaatcattgtgaaaacggactttcgacaacaaaattccgcggaaagcgatgatcccccctccgacgtcgccgccgtcggattgtccgacattttgggactgtcagaaaaggaattggcgaagcgcatttatcaggcggagacgggcatcaaatgcctttattttgtgctcatcagaaagacggaacaaatgcgctatttggtgaaggcgcgcaaattgaagacaatttttgctgagcaaaagccatcgacggaagaaattgtaccgggccgtccccgcaagtcactgaccaatttcgacccgacatgtgccgactatcgttccctgcaccgcattttgatgagtgataaggagagggccgaaatgtaccggaagcggaaccaacagcagcgcgagcggagacggcaaatgacgaaggacgaattggcagaggcgagggccaaggcacggcaaaaggcgg

SEQ ID NO: 92901 - DNA, 633 bp, Heterodera glycines
  SCN-specific regions: Sequence locations=1-633
gcatttcccacaggcgaaaaagggagggactgaaaggggcggcgacggaattggacgaagaagtgaagcgaagcaacgcactcagggcggaaatgttgcggatggaaaagtacgacaaatttgtgattaatccgctgtttggggccaacattttctgccaaaggcaaattacggcaccgcgatattttgtgagaaatcactcgtcaaaagcaaatggacaattgggaggagaagacacagccaatggcaagggacggggcccactttaaaggtcgcccactgagttttgggagcaacagtaccctctgcataagcacgcctttgatgggaacgcggagcgcatacgggaactgcttgcccagggcgatgaccccaatgagcaggacaatgacctttggactccgctccattactgtgccttttacaaccgattggaggcgtgcgaaacattgcttctccacccacgcaccaatgtgaatgttgtcaatggcactggggcgacgccgcttcatttcgccgctctgaacggcaacatttacgtggccgagttgattttgtcccaccaattggccgacattaacattcgcgacgccaccggaaaaactccgttggacctttgcgttttggtgccga

SEQ ID NO: 92902 - DNA, 353 bp, Heterodera glycines
  SCN-specific regions: Sequence locations=1-353
acattcgtcaacagtttgacgaagcggaagttctgcaggaacaactacaaaaccaagaagagcagcagaatgatgagaatgtggacccgcgactgcatcagcaacgtgcagcacagcaggcgcaatatgaacgtctcgtgcgtttacaattgcgagagtcccgccgttttcgaattggggtcgcttcgtcagttctcgtcccccctcccttgttttgggagggggagtgtgtcatttgcactaatgcacgtgcaaacttttacaacattcgctgtgggcatgtgtgcctctgcgctgattgcgcagttgctgccgtaatccagcgaattactgtttgtggttttgtgccgtgc

SEQ ID NO: 92903 - DNA, 562 bp, Heterodera glycines
  SCN-specific regions: Sequence locations=1-366,394-398,421-485,507-562
ccccaattacccttaattactcttaattaccctttcgacccctccccttcaaaatggctgcttggttggatgccttcgtgcaaaagtaccgttccaatcgtcgtgtgttgctatgcattgtgtacgttgcgcttttcctggacaacatgttgttgaccacagtggtgccgatcattcccgaatatttgctgcgcattcagcacccaaactcaacggatgttgctgaacaaccggtacagcgagctggacatgggcacggaagcagcaatgggcacagcctcatcactgccgcaggaaaaagtgcggatgaaacggcaaacggcgatcggatgggacagcgcggcgtgggaaaagccaccggtgaacgatgatcagcagcagcagaagggggcgaaaaaacacagaaaagccaagggaaacggacgcgtcgccggagggatgggcaggggacggacgaggacaacgacagtgccaacgtacgacacggacgacgagtacgaggcgttgccggacgagttcagcatcgggagtcccttggacgaattggacttacccatgggac

SEQ ID NO: 92904 - DNA, 607 bp, Heterodera glycines
  misc_feature (596)..(596): n is a, c, g, or t
  SCN-specific regions: Sequence locations=1-249,271-607
taaaaattgaaccagaatatatataaatgtttagatttaagaaaaacaactttttttaatggagcaaaattttcaaatattcaatgtggatgacacaaaatttcgacacccatttacattgacaatatctggcagtacgggaagtggaaaatcagagtgggttatgcgctttttgaaaaatgttgatacgcttattacaaatgggccaataaataaagttttctattgctacggagagtttaaccaaaacattgcttctcttcaaaaaatgggatcgatcggcggggtacaagtgagcacccattcaggggctcccgacgaagaaatggtaaaacaaaagtcacgcgatgctaaaggaaagttattgatggtactggatgacctgatggttgggattggacaaaattttttggacacaattttcacacgcggttcgcacaactggggggtcagtgttgtgttagtgactcagcatttgtttagcaaggaattgcgcatcgccaggaacaactcacactacatggtgttaatgcgaaatcctgcgggggcgctacaagtacgcaccctggccacccaattgttccctgggcgtgtanggcatttgatg

SEQ ID NO: 92905 - DNA, 591 bp, Heterodera glycines
  SCN-specific regions: Sequence locations=1-166,189-255,284-536,558-591
aaacagccggcggttggggaccagcatcagccagaaatcacaaacaccatctctgctgctgaggtgctttcatcaaagcgatttataaaagttgtcagctcgacctcaatgtgttcgggagttgccggcgggatcgaattcttgtcatagctactgcatccaaccatctttattttattataattcttacatacatttaaatattctcatgcaattctggtctttgcttatgttcttcctctaacccagaattacaaaattagaaaaataatatttaattttaggtacaggatgaagcagattctacggttacttctgaaacaattgtgccaaattccaacagaattgcgaaaacacattggtcaacccttgaacagaatatcaaagccatgaaggttgttgttggactttatccatttgttattttggtgcgtccttttgtaggtcgctgaattacgtgatgaacttgaagcgcggaagctggaatcgcgaggcgtaaagaatgtgttgatgcaacgtcttcatgaggcgattgaaaaggaaaagaatgaggaaaatccgactgaaggacaaacgaaggaattaattgaa

SEQ ID NO: 92906 - DNA, 632 bp, Heterodera glycines
  SCN-specific regions: Sequence locations=1-272,298-601,627-632
taaattggtgaacattcaataacgaaaagaagaaaccatgggtcaaattcgtggatgatcgactcgaaacggacaatggcaaacagacgagaagcgaacccaacaaaccaagcgaggccaagcacaacaaaaacgagcagagtggaataaccaccaatgctggaggcgctgactgcggcagtaaggctctttttctccttattggcaagttcactcattattgccgctaaataaaaggattattatacaagccaattttagacaatgctttggtttcaatgaaaaataaatatgagaaaactaacaacagggatattgagaaaagaaaaagaaaatacaagacaagagaaaatgtagaaaaaaacgagaacgagacgcgctaaaagtcaagaaaagagacgagaattctcttttaacgaacacctaattattaattaatcagaaatttttggttcgtatttttacggaacataatcgggccggccggaatttgtatttcaaactgccggaataaaacggggcgggaataaaattgtttgccttcaatttagaaaacaaaaatcatctcaaaatttaaccaatcaacctttttttaaaactatcaaaaattctaaatttaaaattttctaaaa

SEQ ID NO: 92907 - DNA, 569 bp, Heterodera glycines
  SCN-specific regions: Sequence locations=1-292,314-569
ttcctgtgtctgtcagttatgcggtattttgtggccattagtgctgctttctcctggccattatacgtcgactcaaatcattcctcgggtatatttatgccccccccccccccctccgtccaaatgttcacgtcgatcgaagtgccaattgaacaattgttcgccagcataaaaaggggctgatgggtggatatttgatgtgaaaagcatttccgtttgcttttccttttgtaaaattcgtttgaaatgccaaatttcggcccgaaaatgccgtctccgtttcgccttccatttttgctgctccttttcggcactttcctttggtttgcgctgttttctcccatttaaaggcttctttcgccctttgtcagtttcgtcccctttttcccctcatcggctgcccaaaggttcggcagtcagtcgaagcagcagcgaagtcgccaaatccgtccgtttcgacccctttttaatggccaaaaaatgccgaagttttgcagatgcccagtcccaaattgtggccaatctcttcgccaattacgacccgaaccaacggccccccgtccgaggtc

SEQ ID NO: 92908 - DNA, 159 bp, Heterodera glycines
  SCN-specific regions: Sequence locations=1-159
atgtaaaaattaacagaaattcacgggttcattcgatagttgcgagaaattccccggagaaactccaaaataatgtgaaatttattttttgaactcgcatctccaaaattttgtcatcccatcagaactcattttagcgaaggtgtaaaggtggccttc

SEQ ID NO: 92909 - DNA, 390 bp, Heterodera glycines
  SCN-specific regions: Sequence locations=1-67,98-130,153-320,362-390
agatatccaatttacacttacaaattattctgaaattttctacgattctaagcctaaaaatgacaggaaaaattttaaattaaatttcattatttttggaccgattttttaaaggaattatagggagacaaaaacaagaaaaaatacagaaataatgattttgaattttcgcttttaaaaattaagcgttcattcaaattttagaacatgaatcattgtttttatcatatagaactgaaataagtttatcatctaattaatttctctcactcaccttaacttcatcactgagccaatttggtcgtacagaaacctgtgtcaattatattaaatatattttaatattttttcaaataatttacttcgttgtgcacttctttgtaaaatcta

SEQ ID NO: 92910 - DNA, 175 bp, Heterodera glycines
  misc_feature (6)..(6): n is a, c, g, or t
  misc_feature (27)..(27): n is a, c, g, or t
  misc_feature (51)..(51): n is a, c, g, or t
  misc_feature (101)..(101): n is a, c, g, or t
  misc_feature (122)..(122): n is a, c, g, or t
  SCN-specific regions: Sequence locations=1-129,151-175
cgccancgaaaagaagaggcaggcgangaagatcgagaaggacaatgccancgaccgggcggacgccgcggaggaaaagggccgacaaacgcaggaacggnaggagcgcgtcgaggaggaantgcgggacacgcagaagaaaacgacggcgaccgagaacgaattggacaaggct

SEQ ID NO: 92911 - DNA, 633 bp, Heterodera glycines
  SCN-specific regions: Sequence locations=1-56,78-633
aaatgacccaatgtaatgaattatgttcggaattgctccaaaatggaagtccaaataattacaacagcagcaacactaccaattgtgacaacgatgccgattcggcaaattcgctagcaacaggcacaaaattagtcgccgcggggcgaaatttttcaaataaaaaagtgcccgtgtcatccccaaaatgtgtgccgaccactgctgaaaatgtcatcaaacgaccgccacttttctacgattcgaaacggcgtcgggttgacaaattctaccaaaaacagagcagcttggtggaatactttgaacaagacagcaaacagattcagaattatcagcagcgtcgtctgaattcgaattgttcgcttgatgttcggcgaacactcagctcggactcacgaaatttcagctccgctaatttcaatggccaacattcactcgagaatggtggcgaagaaccggcgcaagagtttgacgactccacagtgagcagactgttggagccgcctcctctgtcgctgggtgtgaagaatgtcggaaatggcacaatttcgttgcccaaagttcgggtcatccgacccgcgggaagcttgcgtaactgtgctgcacagcactgcccttctctcgcaatgtccg

SEQ ID NO: 92912 - DNA, 638 bp, Heterodera glycines
  SCN-specific regions: Sequence locations=1-638
gaaagttgcgcgaacaccaaatccaccgtatgacgcattacggttatgacaaccgtaccttcatggactcggccctgtccttctatgcccacatgctgtacaatttgggcgtgttggctgcacggatacaggtaaaaaaagaagaaggatggcatgccaattggtcataggtctcccggacaaatgcatttgtcaattagtgatatagtatcccaaaaacctattaccgtatcttattctccacatggaaatttcttttttttctactaaattagcgcacaaataagggtagaattgaaatctcattgggatgtgatcaccaatgtttatttgatcactaagtcatatatttcaaattgaattatgcgccaattcaaaaatgaacaattaaaatatccccctagggcttttccatccaaatccgattggtttaaattaccccaatggcatttcctttcgattgccttaaatgcataaattattgatcaaatacataaattactcacccccccccagggcttttccatcgaaattcgctccaacaaatcgttggcgccgaccggcacaaagctggtcagccccctgctgcacatggtgtacggcatggcggatgttctgctcggcgactccatcatctg

SEQ ID NO: 92913 - DNA, 662 bp, Heterodera glycines
  SCN-specific regions: Sequence locations=1-662
gtatcaagaacgaggctgaacagctctccggcactgcgttcaccgctccgcgctgctccaaccggcgcagttggctgtaccgcgtccggccgtccgtcctccacaggcctttccgccgtttggagggcaacggacgcttcacgaatgatttctctcaatttgcccccaatccaaatcaaatgcggtggaaaccgcatccaatgccaaattcggtggctaatggcgccccatcattggactttgtccagggcctttacaccttttgtggggccggacatccgacaattcgcaatggattggccattcacttttacacatgcaacgcaaaaatggatcaaaaggcaatgtacaattctgatggtgactttctaatcgtgccgcagcacggcattcttcacatagtcactgaaatgggcgtaattaacgtgggaccgcaggaaatcgccgtcgtccctcaaggcgtccgtttctccgtcgacgtttccgtgccgagccgcggttatcttctcgaagttttcgacgaacattttcgacttcccgaattgggcccaatcggtgccaacggattggcaaatgcccattggtttcgcattccgaccgcttggtttgaggagagagagacttcattctgcatcatcaacagattccaaggacaactcttc

SEQ ID NO: 92914 - DNA, 609 bp, Heterodera glycines
  SCN-specific regions: Sequence locations=1-609
gaagacgccgtcgaatgtgaacgggcggattgtcctctgaccagcaaagcaatcatccaaaatgtgcttgcggttggtgtggaggacgaagacagaaagcacacgtggatggaagacgcagaatggtttatcacgcagggggcactgcaatgtgcacgtgccgtattctcatttacgctgaacacattcccgaagaagaaaggcatctggacgagagcagcgttctttgaacgtgagcacgggacggtcgaagcgtacgaggaattgctgaaaaaagcaacggagaattgtgctgacgccgaaaacctttggctgatgcatgcgaaatcgcgttggcaaggcggcgacgtggagggatcacgacagatcctttcacaagcattcaaacataatccgaactccgaggaaatttggacagccgctgttaagctggaatcggaaaaccaggaatttgaccgtgcccgaaaattattagaaagagcgcgcaattctgccccttctccgcgtttttggatgaaaagtgctcgattagaatggtgtctagacaacttagacagagcaaatgaattactcgctgagggaattggccgttaccccgactttgagaaa

SEQ ID NO: 92915 - DNA, 631 bp, Heterodera glycines
  SCN-specific regions: Sequence locations=1-631
gcaggttgtcgacgtaggcattttcagccatttcaatggccaatggggacccgtcctgcttcaggtgcttctggatggtggctgccagcaaaaagggtgaggcaatgactccgaatggcacccttgaccatcggtagatgaccacgttatccggcaacggtggtttacggacgtcgttaacccagagcactttgcagaattcgcggtcgcgctccagcaagctgagtgaattgaaggccttttccaagtcaccccacagcgcaatgccagccaagcggaagcgcatgagaatcccagcgagttccggcataattacgggccctctgaacatgcacttgttcagagagttttgcccctttggatgggcagaagcgtcaaggacttgacggaatttgtgtgtgacaacacaatgatgcggcaggaaatgctcgagtcctcgagtacgaacggctggttcgatgagccccagtcgaagctgttcctggattgtggcttcgtacttggcaagaagttcgggaaaatgttgaagacggttgagaattgaagacaatcggcgatgggccatggcaaaatttgagggcaggtccggcggaaaattcttccatggccatcccacgctgtatcttccgtt

SEQ ID NO: 92916 - DNA, 628 bp, Heterodera glycines
  SCN-specific regions: Sequence locations=1-59,81-628
tttcaactactcgaccaaatttttgaaattttattggcttccggcattaccggactcagaaattttactaaaccaaatttaccaaaatgtaaaactgatcccctccctgccctccaaaaattattttttgaataatgagctaaaaaatttagtgacaccgaaaggcaaaaaaaaaaattcgttccctcatttaggagaaatgtttatgaaaatcttattttttgagtcaaaataattagattttaagacttttaaaagaaaaataatccatttttgccaatttcggggtttttgttccgcacattttggcattttcttttccatacaaacaaacagttgcccttttaaaagaaaaccgtagaatcaattctaaatttaaaaacctaaatttttttttgcactttttgacattttttggtgaaatttgattcatttttttgtgcgtgcccttcggcgggagaccgaccgcggcaccttttgtgtgccatggtgagaaaaaatagggcgtatggcccggcaccgccgccggcgccgccaaaattggatttgaatttgcttttggcgcctatttgtggcgatgtgtcgtcaatatttgccatcaaattccaccaccatcattcgcacaacc

SEQ ID NO: 92917 - DNA, 582 bp, Heterodera glycines
  SCN-specific regions: Sequence locations=1-582
ctggcgatagcaggaaagaacacgttcggcgagcagaaagtaagtggccgtcaaatgattatattcgtttaattcaatggcactgaaaatggcaaaaaagtcaacgaaagtttcttaatggaaatgaaaaaaattggtaacagaaaagcctggccattttccctggaaaaaataaaaattcgaccctatagcattttttaccaaagaatttcctcctctccgccaattttcccggccaccatttgctcgacaatcgtcgcatgagcacacgcgggcaaatggtcgcgtattatcagtggcagtgcctcggcgtgtcccttgtcgccggcttttacctatgaaaaggaaataatgacaaatccttcatcaaaatgtattccattttcaccgacttacccatttgttctgcacaatttgctcaagggttgctctacgcgacggatcacgcaaaagcatcgacgaaattagcctaattaatggggcgggggaaacaatgtaatcacacaaaatgccggcgaaggaataccttcgacaatcgacggacacgtggtcgggaaacgaaaatttgcagtccaaaatcct

SEQ ID NO: 92918 - DNA, 591 bp, Heterodera glycines
  SCN-specific regions: Sequence locations=1-293,318-400,422-591
gattgacccaacttttgtgcaccaaatgactgttgccgaggtgaacaatcaaatggcatcgacaggacatgaagcgccacccccggtgaaaaagtactatggaatgagggaaaagcatgatggtgggcgaccaaatgaacgacagacatacggcgaggaagacaaaagcaatgcccaaaatcaaatgctgacgagggatgaacgacggaagatcagaagagagcgaaaagcgatgagtgacttagcggacgacggcactcgaattcccgaaggtttggtcgagctgaaatttgaagcaccggcagcagcggcggaagaacaattgatcgaaggagagacgtcgacaaagtcggctttcgtttccaaattttccacgcatccgctgggcccatgggttccggtcaaaaaggaggagaaaaggcccgatctcgactcggccgactctgagcttcaacctcatggaaagaagcgagcaaagcattacgacgacttgcccgagcagtcgtacgggcccgggtcagctgactactcgcaaacgccggctgaactgcttgaaattgccgaaatggaccctgacgatttgtcattcaa

SEQ ID NO: 92919 - DNA, 288 bp, Heterodera glycines
  SCN-specific regions: Sequence locations=1-129,151-288
atttcacacggatttaattggtccgatcgatttcaaagaatgttctctgattaaagtttgatcggaagtgtgaaatccactctgatcgttcctcacacccattgtccctgctaaaaattgtgggaaaatacaaatccatctcactcagcccacccttgcccaacgaattcacttccctcccgcattgtgatgatcaatctttcttcccccccccccccgccttcaccaattttattttccatctgtgttttaagtcgacattttgttaactttttgcagaaaacccgc

SEQ ID NO: 92920 - DNA, 596 bp, Heterodera glycines
  SCN-specific regions: Sequence locations=1-121,143-472,494-532,554-596
acgcaatgcaaaagcgcgtgttggactgtatccattacatccgacggcacgcgcaaatgcatgacgaaagggtggacagatcattaagaaaaattgaaaattaaaaatgaaattaatgaaacccaggccatccttggctccattttgcccgcccgactgcgcggcgaattggccgttcatcttcactttgaaaccattgtaaaatcacccgaaattgcttacaacaatgaatggtttgaatgattcccttccaattaagagccgagtgcaattgtttgcccattgtgagacttcgcttctctacgaattggtcttacgcttaaaaatgcaaatggtaattaaattctacataaaattaatcctgaatatcagcaaaacaaaattcaaagattcgtgataaggtcggggtttaattgattgtcagaattgttaaaagctaagtccttctgcatttttctggtcgagctcggtctgtttttggtctgaacaccttcagagtgcctgggcccgaccaaagtcgggatttcttatgctcaccaattaactcgcaattagagaatggcaaacagaaatgcctaattcggccactgatttga

SEQ ID NO: 92921 - DNA, 562 bp, Heterodera glycines
  SCN-specific regions: Sequence locations=1-562
atatgaggaaggacggaggaaattactggaggaggaagcgaaggagagaatggagggattgtcgtctgaagaatcggatttcgattcgtatataccgggacggcaacggaagcgagagcaggagcatctgctattgttgctgaaaaacttaattcactcgtccgccctttctgaatcacaagcggacaaagagtggaagcggcagacggaagaattattagcacaaaaacgcaaaaagaaagaagaggagaaaaaggcggaggagtcgaagaaaagtctgctggaaaaacacaacgaattgctgcatcaggagcacgacgatgacagagaagaaattgataagccaatggaacaggaggacaaaatcctgcaaagtgtgactcagacgagtgcactcgcaacggtggcggaaatagcgaagggtgtcagatacacagagtccattaaaacgtggtggaaaccgccgcgtcacattcggcaccaaactctccaggaccacgagaagttcagaacgctggaaggccattcaattgagggagaacactgccctcaggcaattggc

SEQ ID NO: 92922 - DNA, 591 bp, Heterodera glycines
  SCN-specific regions: Sequence locations=1-123,152-591
caattgcctactcacacttcggtggacgattcgacatggttttggtcttcaaagaattgctaatggaggggctcaacccatcaatgattaaaaaaggaaatcgcttattcgaaatgaaggtggattaattttcttattatatttttattttcaattcaggtcaaaagcagaaagaagatgaatccgaatgtaacttttcgggactcgtggaatctgatcccaggaccgctttcttcaatggtcccaatgtttggcctggatgtccaagacaagccatttttcccacatttggcaaaccgaccggaaaattatggatgccaaattttcccatcgaaaacggattatttggctgacggaatgaacctggaaaagcgcaaagaattcgacacttggtaccaacaaaaccgaaacacaccatttctgctcgatgaagcattggctaggtatctcattctttgttaaattaaattttctaattttaagctactgcaaaaatgatgttgatattttaatggctgggcttattgtatttcgtttggaatttttggagatgaccaaacgaccggctgggtccgatggaaaagcggacag

SEQ ID NO: 92923 - DNA, 576 bp, Heterodera glycines
  SCN-specific regions: Sequence locations=1-576
ctcaacttgggattcatttgatttccaagcggctgcccaaaaggcgttcgatattttccgccaagggcctgtcggttggaatacttcctcgtcataccgacgtctgaatgcaattgttgagggactttctgagtgtgaaaaaagacgatgcgatcgcactgttggatttggtgggtctccggatgaaagaggcgagacgactttggatgcactggtgatggatggcccagggcataaaagtggggcagttgcggaactacgtcgaataaaaagcgccgccaaggtcgcgtgggctgtgatgaattacactgaacattctttgcttgccggagagaaagcaacagaatttgcactggcaatgggctttgaagaggaatcgttgtccaccgaagaatcgttggaaatgcatcgaaattggctaaaagcgaaatgccaaccgaatttttggaggaatgttcaacccgacccccactcgcagtgcggcccatacaaaccgaattggagggaagcggacggagccgactttttgtcaccaacaaaacaactcgataattcaattggattcggttttaggaa

SEQ ID NO: 92924 - DNA, 133 bp, Heterodera glycines
  SCN-specific regions: Sequence locations=1-133
aatttgtccaagcgcattgtcttcggatgagcaaaacgaagcacaaaagattcgcaatttgttgtcgtcatttaagggaaccgaagacgatcttcttggttatttgttcgaagactgtttggaaaatccaaaa

SEQ ID NO: 92925 - DNA, 591 bp, Heterodera glycines
  SCN-specific regions: Sequence locations=1-381,410-414,436-591
ctcttctttttaatattgatcactgacttatgcatttaattcgtttatcattgaagcatttggtttaattgattagattttctaatccaaaaaacccctcaattctgaatcttcatgatcagcccaattattcaagtaaaacatttttgcccaacttttttggcattttttgatttacggatgggactgattgctcgatgatggtggctttaaatatgtttacttctgagtttccggtcactgttgtgatgtacaccttcaggtcctggtgatgctcgttcagctccgacgagccgctgggcgagaacatcgctcgctttgagaaggaatgaacggaaatggaaaaggaggcggaaaatggcacaagaaaaacgaaaaagctaaaattaaatataaaaaaagataattacccaattaaaattccattttttcaaattgaaaagccattgaaaaggcggcggataaacaattggtgcagccggttgggtgttttgttaatggatgatcgacgaagtgagaaagggacggatcagagcggaaggaacactttctttcccgcttttccttgctaaattggtttgtcttggggcg

SEQ ID NO: 92926 - DNA, 552 bp, Heterodera glycines
  SCN-specific regions: Sequence locations=1-552
gaatagcccaattaacagtgaatataatctaataaacaacggatataacccatacagaaatggatattacagtgtatacaatccaactaacaactataacacacacaataatggatacaacccctacaataatgaatataacggtggatacaatccaatgaacaacggatataaccaatacagtaatggatacaacccctacatcaatgaatataacggtggatacaatccaatgaacaacgcatataaccaggacagtaatggctacaacccctacagtaatggatacctgaacaacaacggatacaatcaaaacagcaacgattgcttcaccgcgtcaatggtacaggaccaaagagcatgcaacgcaatgcaaggacaatgctcaaacccgttgatcgcccaaacatgtcgccaaacgtgctgcaacatgcaattcgcgagtggtgttgcttttcctcaattcggcggctgatgatcaaatttatttatgttatttggtatttatttcgagcaaaaaagcatttaaattacataattactacttaaaaa

SEQ ID NO: 92927 - DNA, 513 bp, Heterodera glycines
  SCN-specific regions: Sequence locations=1-513
agttgaaaaaatgactatctttgcttaaaccgtgactaaaaatttattaaaaatggatacagactctgcatgcatacaaattactccaaacctatttgaatcaacaaaaaatctatttgaaggggcctaaacggagctgaacttgttttcaaggacgaatgtcctttattgcttcgatacacccttttcatcaatggggcttttcgcgtcgcttcacactttcaccggctgtttgggagcggcacattaaattgctagcacagaaaacatcttcaaggatctttttaaacatccaaaaattcatctagctttcagaataacctaaagacaaaaatgcttgtctcaaatttggtaacgaacaacaacagataaagacgggaatattctctccgatatttacccattggtcactgttcctttgcttataaccaaaggagccgtacccgggaattcctgaaatttgtgacgaaattattgcacatgtcagtgcccaattacaacatcgtcttaaca

SEQ ID NO: 92928 - DNA, 615 bp, Heterodera glycines
  SCN-specific regions: Sequence locations=1-527,549-615
catgcttagttaatattagatcactttacaacaaaattgatgaaatagctttaaatttggtaaataaaaatatagacatttttctgttaactgaaacatggacaaaggaggaaaacccaatcctctttagcccatggatacttgaaaactataactttgttttatgtcataggaaatcacaaattatggaaggattgaaagcacaaatgccaatggaaattttgtaaacattttggagaatgtgccacgttttggcacgggcgatgtggtcggatgtggactgaattgggcaactcgtcaagtgtttttcacgattaatgggcaacgcttgagtttgtgtttattatgccaatttacataaactggctaattgcctaataaagacaacaccaatttgtacgttgacgatggcacggcggacctttacccgaccgtgtcaatgctcagccacagagcagcggtcgaggccaactttggtcccaacttccgatacgatttgtccaagaaattttgagactttggaaatgaattaattgcttatccaaatgttgaaaattaattaaaaattcattttttgattaatcacaaaaatgcgtcgtcattcatgcccactga

SEQ ID NO: 92929 - DNA, 378 bp, Heterodera glycines
  SCN-specific regions: Sequence locations=1-199,221-378
ttttcaaagcattattgacagtttgtacacagaagggacttctcgaggcgaatcgtgaatcgcccatcagtcagcctactctcaattttttgatcgaaaataaaaaggacccaatgtcaatggtcaacatttactgctcggttttgggtgatcccaattttgagttttttggctttcatcttgttagtcaggccaagcaaatttctttttatcactgaattgagaggtcggcccgtttatggcttttgcgcagcgtcaaaaaaggaggccaaaaaggcctgtgcattacgacttctcgacattttgatgacataagaacgactcgaatgtgttaatgtgtccggacggaaagtgaggaaaatgccgccaaaaccaatt

SEQ ID NO: 92930 - DNA, 600 bp, Heterodera glycines
  SCN-specific regions: Sequence locations=1-600
aatgagggattgaagccatgataatcccagcatttttagcttttggggcctacgcgttaaaaaacatgtttttaagtccctatttgcttttttgggctgccccaggtttgtccggttgttggcgctagagctcctcgagagtcaaaattccgagactcgagaccgaggtttctagagcatccctaattggcggattggcggcaatctttttggggacggtccaattttaatggaatccaaaaatcccatggaaatatgtcaaggcaaaatcaccaaagagcagctccgttttgggtacgaagcattgggccgcattgagcgccacgtgcaaaaagggactttcggcagagactttgtggaggcaatgaatgagtgaggaaaagcaaagaaaatgggggggggggaaaccccacgaaaatccaaaaaaaaccaaaatgggcctaacagttgatcctccgccgttatgtttacccgggttatttagtgcccctctctttcagttattacacgcgcattccgcacagttttgggatgcgaacgccgccgccaattaaatcgccggaggaattgaagcgggaaaacgaactgttggaaatgcta

SEQ ID NO: 92931 - DNA, 638 bp, Heterodera glycines
  SCN-specific regions: Sequence locations=1-61,83-128,150-420,443 -511,533-638
caccgatcggctgaccttttccacctcggccaatcattatgccatggccgagaatgaggacttttaccaacagcagcagcagattaaaaagcatcaaactgcggcaccaccgatgagcagaagcaatgtggcatttctggctgcaagcaactgcacaaagaatttggtttggtctgccttggacaaagatccccgcttgttcatgtggcgcgactcgcagcttcaaaagacgctgaacagtgccaatattttgccggtcagcgagtcattgtccagcatggacaatttctctgccaatttccaatcctccgccgacgatggcattggcacccagcaaaatgccttttccattactgcgttggaagtgatggacttgagtaattgcggcactgataaagaaagatggaggaacgaaaagggcgacgagggggaggaagaggagcaattattggttggcacaagcaacggagtggtgctaattgtacgcggaattgagatgtctccgatcagcgcttttcgtcccttttgctccgttcagcggatcatttgctgtcctccgccatttggccaatcgtccagcagctgtcgcattctccaaaaggagctgcttcattcgtcaaccaaaaaagcgcccttgt

SEQ ID NO: 92932 - DNA, 612 bp, Heterodera glycines
  SCN-specific regions: Sequence locations=1-26,53-251,273-423,445 -456,478-612
ctaaaattgcagagagatcaattaacagacaggaaatccaatacaaaccatccattatgagtggaattgtgcgggattggatcttcctaggcacagtgtagcccgaacgttcgatgttcttagccagcagctcttcaaagccagcttccttccagttgctgacgcacaaaatcaacagtgtgctgttaccagaaaaaaaaacaaaaaaggcacacttactctaaggtctgttgacattctccactgttggtccccgttatttccacatcatcgtcgtcctcacgaatgtccaagtatttgtcttttaccttcaaatcatcgccaaaaatgtcctcgatggtgcgagtggttgggatgtaagactcagcacgtgcacgctcttcttcggctagaattatgaattgagcccaattgattgatgaatacaaaacatactggaaaattttgcacggtcatccccagaagaaaatgtgcctcctctaccgccgcgctcacccgcgccgaacgaaaacgagccacctcgaccgccgcgctcacccgcgccgaacgaaaacgagccacctcgaccgccgcactcacccccgccgaaagaaaacgagccgcctcgaccgc

SEQ ID NO: 92933 - DNA, 504 bp, Heterodera glycines
  SCN-specific regions: Sequence locations=1-376,398-452,475-504
gaccaaccgacaattggtcgccattgttatgttggcaatttcgaatctgtgcagcactgtggtggtcagttgcataggaccaatttacccgggcgaagctaaacgaagagggtcacttttgaattcacatgcaaaaagctaacaattacggggcttcagaatgtcagaggctcaaatcgggttggtcttcggtttgttccaattggtgatgttcatttctgcacctcttcttggcaaatacgtaaacatttttttttgatttttttgccattttactaattgaaaacaaaattcagatgcatgtgattggctctaaatggatgtgcatcgctggccttcagatagccagtttggctgcaattgcatttgggtacgttgtttcttgaattcagcagaatatctttagttgggggttctgttttgcagttgggttccttcctaatagtcatcattgtttaaaattttgaactgcttcaacttcctaagccttatccatgctgaatg

SEQ ID NO: 92934 - DNA, 510 bp, Heterodera glycines
  SCN-specific regions: Sequence locations=1-199,222-254,276-373,411 -423,458-471,493-510
ttttctaaaaaaaagaaagattttccctcaaattttttaaaaatgttctaaacatagtggtactattttcaattaactcataatgactgtgatgtgctaattataaacgtttctaaactaagtaatttatgaacattttgctaatttgttaaaaattaccttatttatccccccccccctttttttgctaattatgccatttgcttttccttctcttttcaaaacccacccgagtgaagtgcactttgttgatgattgtgcagaagcgttctccgctgttttggccattttccgccgttttgcctctgctgcagacggcgaacagttcgatgaacaaacgttccctcatgtgccgtgccaaggcgcttatctcggcactgagattgcacatttcttagaaaatgaaaattcaattccaaattttttaaacaaacaaataaataaattaatgaattaactcacggtcatcccaaaaaataatgcccattaatccggcaaattcctcatcag

SEQ ID NO: 92935 - DNA, 612 bp, Heterodera glycines
  SCN-specific regions: Sequence locations=1-273,295-612
attttatggaaaattttatgaactttttatcatccaacaaaattaaatcagtatttgtagtccaacattgggatggccttgttgaaaaatatcaacatttctgcggttttcggctttaatctcgaacgtcgataatcataaacatccctcgccactttgaaagtctgttcgctcggcacgcttgttgcaggggctgacaaatacttcatcgccaattttgataacattggaagttttggtccatgcttcttccaccattcaaacgggtcagaaaatggcaaaattttgttaaaattttcgtcaacttcagtgaatgccttaatttctgattgggttggaattaactttttcttacctttcgcatgtttgctgcagaatcggttacaaaagcaaacactcgtccgtcgtttattttccaactgtccaataatttacggacattgcacgcaatcgcattgccagaatgttggccggaaaaatggtgaacagcgagtacaaaattcttttgcacccaattttttgtgacgccgtgaccagtcaagcttaattattttttgaaataccgcttcttgaagcctaaaattaccttaaaaaattgtttgatggacctgc

SEQ ID NO: 92936 - DNA, 597 bp, Heterodera glycines
  SCN-specific regions: Sequence locations=1-44,66-70,93-449,471-597
cgcatctgttgatggccgagtccgtgcctccgtttggcggtgtgtccgcttttccctttccccttgcttttcatttgcttttcctcttgcttaaggttcgcccctcctccatcggcacggcgcccttttttcccaaattgtatccgatggccccgatcggcttggccgtgttgtgctttttgtctacgactttaagtaattgacttccgttccgtccgtttttgccttctcccccttcccccctcttcttaagccgtcactcccttctcaaagtgttccaccgtttgtccgttgttcccttttccgtccttttgctcgccatttaccgaattccgtccaccaaaaaactccacgcaatggcaattcttccgaacgaatatttgtatttggcgacggaggaaaaagtgctgcaaatattccttaaatacggtcaattagcttaattaaaactcctcaggtctcccaattccgtcttggtcagtgcgctttgtacggctccgattgcgtccgttgtgcgcgtgacccgtactgctcgtggtccatcgctcgtcggcagtgtttccccacagtacggaggcagcaaagaatcggactgat

SEQ ID NO: 92937 - DNA, 616 bp, Heterodera glycines
  SCN-specific regions: Sequence locations=1-575,599-616
agtgcaggttcagcccttttcgttcacacccggccaacggattatcacttcaatttcactgactgtcgattttcaaaagaaaccatcgaatccatccgaaccattggactcagatgcaatggcccgtgaatttctcatgcaattcgccaacatggtgttcaccgttacccaggaacttgtcttggagtatgtgcagcagaagcggagtaccggcggaggcgagaaagcgacggcgatgaacgcgacgacgtacacactgaaattggtggtgaaacggatggaaggcgccaatctgaactcgtcgccggaggagatttcgatcggtccgctcagtccgaatgccgtcgttatttttgatcggcccgaaaattcacagatcaatttgatcggtcgtagtaaaggaaagtccactcatcgttcgctgataaaccccgactgggacttccaacagatgggcattggcgggttggacaaggaattctcttccatttttcgacgcgccttcgcttctcgcgtttttccgcccgaattcatcgaacaattggcgatgaagcatgtccgtggcattcttctctacggacccccggggacgggcaaaacgctaatcgcgcgacag

SEQ ID NO: 92938 - DNA, 633 bp, Heterodera glycines
  SCN-specific regions: Sequence locations=1-17,39-241,270-633
ggcatttattgtctcaattagttaatgaataatgaaaatgatgtggcggttgacgaccgaccacagaccgccacttttgttcattttgcttaaattgggcagcaaatcatttgtgaattgtggaaattttttttttttggagggggatgacataatgacaataattggacaattaaattaatgagaagtgtgtgctttgtttctacaacaaattgctgacaaatgagcgtgcaaaaagtgcaaaaataaatatttaaattgaaaataatgcaaattcagccaaatttatagtagggaaaaacagcatttcctgaatgatattatgtacaatgagtgcggagctgtgggggacatgttttgtaaatttcggaaatttttcatttttttatcataaaaaaatttggggttaagcgggagaccggcggggctgatcaaatcgggattctttagtcagcgtcttaaaacttgcagaatcggggtaaaattttgcgcaaacaaacaatggtacacactgaatctaacttttagggatttattaatttttaatccggctgaaaacgctaaaaaaaaagtgggttggaatcagggacgggcgaaacccggcttagcactcaaagtcgaagcttgaaacga

SEQ ID NO: 92939 - DNA, 464 bp, Heterodera glycines
  SCN-specific regions: Sequence locations=1-464
ggcggacgtctcgctgtcctccgtccattggggcggccgatacttctaaatgccgtaccaaatgactttccacgaccacgcgctcgaaagggggcaaccactgttcgtctatgggattccccgccggcgatttccccgtttcactgatcaccaacagtttggaggagctgttcataatgaatgcactgcttcgacaagcaaattgtgggccaaaatgcccaaacggacaaataatggggagccgaataaagtgaaggaggccctttcccgttcataaagggctaggggttcaacttgatcattctgaacaaaccattggaactccaaatttccatcaatggcactcccttctgttcatttttccaccgcaccatcgatgcccacaaagactacacaaaggtacgcattaacgctgaggtggaattgaccgggcatggaaagtgagtctgtgctgggaaagtgtt

SEQ ID NO: 92940 - DNA, 601 bp, Heterodera glycines
  SCN-specific regions: Sequence locations=1-275,297-601
gcactttgtgcatatttggaagggcaatgtccgacggaacagggcgaagtgtcactgatggaagacgagaaactgtccatggtgattcagaagagaagggaatacaatcggagtcaatcgtcctcagcaataactgccaaaattggcgaaagtgccgtgaaaatgggcgaagaacaaaaagtcgtgggaacggagaggacggaacgacaaacgccggaactgcgacaacaaaaagcgacaaatggcaatcgaagcggcgcaaaagcaatgaaaacgacgaaaatggggggaaatggcggacgaacgcaaacgaaaaaacaaagacaacggaagtaattgccaacgagaaaaacgaagcgaaaacggcggaggaacagcaacagaagacacccactattataatgagcaaaagtgttgtacaactgatcagcaaaacgacggaagaagcggaggaggaaaagccaaaagaacggagtcattcggcgatggacggttgtgacacgaatcggacagtctcaacgcttgtcctaccgcctgtttcgcccacccgcaccgttattttgtccggcagcagtttcgacaccgtccgattgaatttctc

SEQ ID NO: 92941 - DNA, 439 bp, Heterodera glycines
  SCN-specific regions: Sequence locations=1-226,248-439
cgcttttctccgccgccgtgccaatgtccgccgctgcttccgctggccaaacgcaccgatggggcggaatggccgcaccgcaccgcagccgaccgccgctgcgctttgaccgcacctttcttgaggagcgcgacaatcagttgaagctcatccaaatggtaagtgatcggagtgaccacttccgatccccgataattattgacacgctttttatgccgaaaaaagactaataattgaaaatgtgtccgatcaaccgataataaacatggcaaaattccaaaacttcgagaaaagcaataccaaacccacaaatggaattttgtcaaaatgtcaatttatcttcagctgtgcggtctggtcgcccttctgctgacagtccaatgctggccaaatccgcttttccccttctgtttgggccgtgtcgtcgacttctttcagt

SEQ ID NO: 92942 - DNA, 561 bp, Heterodera glycines
  SCN-specific regions: Sequence locations=1-125,147-561
cgccgtctgcgaccggtcgccacaatcgccgccagtcgtggcgacggcgtcgatcaccgatgtgccattgtcgacgctgtgcgacgacagacgaatcgccgatgccgctgaacagtcaaacagcagcgatcggcgagcggtcaccgatggctgctgttgttgccgctgccgcggagatccgtcgatcagtgccgggaaagcggtgcgcggggagtccaatggcacagccgtgccgacgtacgcctcgtacatggacacaccggcgctgctggggacgtttgctgcaaaagcagggaatgagtggagctgtggaaggagttttaccgtatggctatcgtatcgacattaaaaatgcgttaccgtgtggtaccggtttctctctctaacagcaattttagtcctaccgtattctaccgtgtttccttaaccgttacttattagggaagaagagctaccgtacccgccaatttataccgtaactatcacgtcgtaaacgagaaattgcaaaaacaatcccttgaatagcaaatttaaaataatcaagattaaatttagtccaag

SEQ ID NO: 92943 - DNA, 516 bp, Heterodera glycines
  SCN-specific regions: Sequence locations=1-63,85-90,125-300,380 -380,403-430,453-493
tttgccccattcggcgacaaaaccgcacattccgccgtctgatcgcgaagaaaaataatcccaaatgaaattccaaagtccaaaaggaagaaataaaaaataaataatttaaaaaataaaaaaagggcaaaaattattctgaaaattcaatggacgaataaattttaaaaaagaaaagaaaaggacacactttaaaatcaaagcaaacaaaggggaaaagcagcacactttattctgaagagattgtgctcaattagcacaaattgttataagtgcaaacggaagaagacaaaattcacgtaatttaaatgaaaaattaaaaaatataattatataattatataaattgtaaaaaaattattgaattaatgtaataaaacaaccaattagattgttaatttatcagcgtgcgaagacttaagcaaataaattgccaataaaataatgccaataaaaaaagtgttggattaatttgggaggcgacgattagcgaatgaaagaaagaaagagtgggtg

SEQ ID NO: 92944 - DNA, 596 bp, Heterodera glycines
  SCN-specific regions: Sequence locations=1-596
aagaaatatagcaatgggaaaatatgacccggaggaaggttatgattcgaatctcaccgacttgaaactgttcgaagcgggcgaaccttttgaaatgcaaattaaattgttgaaaaggccttcggaggacaacctgcccatgacagaaattctttcttcaatttctttgagtctgacaatgacagtgattgtgagcacgccgaaaggaaccagccaaaccaactacacattggacagtgaaagctaccgagacatgaattacataacagtgcgtggtgacttggaactgttcgcggaaccttcattgctgaacgatataacacatcccattcttcccgtgcttattttgcatcggtatcgcctttactggtaccggtagttcattttttcgctaccgtaaccctaaaaaccaatgacgagaacacgggaaaaaaaatggcttttgaagtgttccctttgctcagtgttggcgattccattctgatcgagggaaaactgaaagacaacgcaaccattttcaaaatcaatttgttccaccgatgtgaacgagaaaaacccatacgccagtgatttggttctgcaaattttgttcaact

SEQ ID NO: 92945 - DNA, 567 bp, Heterodera glycines
  SCN-specific regions: Sequence locations=1-20,42-213,248-286,308-567
tgtctgtctgtttagtgctctctccaaattggcttctatttccatattgattaacaaccctccatattgcctcgggcgtagtaagcctactccctcaaggaatagtgtttgatgtcgagaggaaaagaaaaagagtgatggcgccgatgggtgtgcttttccctcccgctgtggctttatgtgagtgactaaaagatcagttgaaccccaacaagcagcttcttcttcttcctctcctcgttctgctttgctgtctcttccctcatcaattgggccggcggttaaagcaatggtagccaataaatgaagcatttttgccatcgggggacattcaacgaaaagaagaagcggaggaatggacaaattgtcgtcccaaaatgtatttagagagcaaatgagcatcacattacaaacaattccatctaatatgtatccaaatttaaatcgactatttaagggatctctctatttttcccgaactccgaattcctaaatacctgcaaaaaactacaaaaaaaaatttttagatactgttgcttctacctcctatgttttcggctcgaaaaa

SEQ ID NO: 92946 - DNA, 551 bp, Heterodera glycines
  SCN-specific regions: Sequence locations=1-441,463-551
atttggtcgaacaaatgcttgaggtcatagcagtcggaacaaatactcgaaaaagagcaggatgggtcgccatacgaaatgcttttccgattaagaacgagaaatatcaagcaaatcggctccttttctggacaaaataccggcaagaactttgaaaagggaagtcgcaaaccgaggaaaaaccaataattcgagaaatgatgacgagaggaaggaggaggagcaattctgatctctgaaaaaccgttgttttacaatcgcatcgacaagcgcaccttttgcttcgacaaaagtgcaacagaacggcgtggacagcaatcattctccggctgcaaaacagtcatctgcctcttctcccgttgcatccacaaaaacttttcgacggcggactgcctttgaaacttcggaagcaatgcgtgaaattttcggtgcatattctcctttctcatcacagaaaaaagagaattccggagaatttaatcggaaaaaaatggaattggaaaatggaaggacgatgaacggaactcagcaaaacaataaaacagcgattc

SEQ ID NO: 92947 - DNA, 544 bp, Heterodera glycines
  SCN-specific regions: Sequence locations=1-58,81-199,221-544
agaaatgccaatcattcaccagcagaagaagcaggaagtggtggacagtgatgacgaaagcacaacctccttctcgtcctcatattcgtcctcctccagctcttcgagttcaacagagtgccaaagccctctgttgaaattgggcggccgcacgctgttcaacaagccgacaatttgcagaaagggaacgccaattagcgccaatggcaccgcttttgccgatcagcaaaacaaaatgtgggtccgagttgatcaggacaagtgcagttttattggacaaaagtttgaacgagcgcaagcggcaattccaaaacgcgaaaaaatattgctgttgtcttccgagaaatgtcgccaaaaaaattgaggaggtctttgtcatttacgggaaggtcatgaacgaggtgaaggcgcaattactggccaaattggacagcacacgtgaagagcaagtgcggttgaacgacaaagtggcgaaggaagtgtcgttttttgagtggacgatcaaggaacaaaaagccaaattcgaattggggaacagcgaaga

SEQ ID NO: 92948 - DNA, 221 bp, Heterodera glycines
  misc_feature (173)..(173): n is a, c, g, or t
  misc_feature (179)..(179): n is a, c, g, or t
  misc_feature (214)..(214): n is a, c, g, or t
  SCN-specific regions: Sequence locations=1-221
ggaaacctcgagccgatgccatttgtccgcaaatggggttcagcggttgatggcgaaaatggcgcagaggcctcgcaaccagttatttcagacgagcgattcgaaaatgatgctgcgaaaatggcttcgtcggccaaacatcgaaatcgctctcattcgaaatcgccttccanaagacncagaaagcgtttggcgcgttcacctgagaagaaanaacacaa

SEQ ID NO: 92949 - DNA, 419 bp, Heterodera glycines
  SCN-specific regions: Sequence locations=1-274,298-419
cttgggtccagaaaaaagtccaagcgttcacgtgttgtcagcagcatttcgcaagcatccaccataccaacaacaacaacaaccacaacgattgtagcaacggcagcggcggatgtcacaaccgcatccaacttcatttcttcatccggacactcgtcgttgtacaactacaccaacattaataacaacaacagcatcatcaagttgaatggtgccgaactgaatggtcattgtggcaccggcgtttgtgcgtcagtagcaacaaccatctgcaacaccaccaccaccaggaaacggacaacaaccacaacagtagtaatgaatgtgcactgttgcgtgagaatgctcaacgccttagtgagatcacacagctgcacaaggagcgtcaaactttggaactgtcgcttgacaagacgaag

SEQ ID NO: 92950 - DNA, 528 bp, Heterodera glycines
  misc_feature (428)..(428): n is a, c, g, or t
  misc_feature (469)..(469): n is a, c, g, or t
  misc_feature (486)..(486): n is a, c, g, or t
  misc_feature (490)..(490): n is a, c, g, or t
  SCN-specific regions: Sequence locations=1-528
gattatatgccgtacgatcaggacatcgtgcgggaggctcagcccgcgcgactgcccaccgccacttccttctcatcgtattcccccgcggaacaagagacgtacaagccacactcaccatgggtggaccagagcagcaaataccgtaacgagtacactgttggtgagccgcccgttgcccctgccgcttacactgccttttttgatgatatggttgccaccggccccttcgccagctcgctctactcgacttcgcgtctgctggagcggtcccgttctcgcacccgagaacgccgccaagcactccgttctcaaagccaagcgcgcaactatttccgatttgcctcccaataccccgccccgttgcgcacccgcgattactccaccccgccctcctcttacatcacgcgaacaccgaccgctggcanttcatttgtttccgtccttgacaactacggagccaagcagnacgacttggctcgcagncagncgcttgaccgaagctccgtgtacaacagcaacttggca

SEQ ID NO: 92951 - DNA, 193 bp, Heterodera glycines
  SCN-specific regions: Sequence locations=1-74,96-193
tatccatttggtgtgcaccgtttccaaccaacagcggcaagaattggcacgcgaattcaaaatattgtacgtggaaaatttgttttttaaactgaacaatgcactctctggcgactttgaggaactgaatttggctttgttggaaccgccagatgtttacgatgcgcagcacatgcaccgggcgatgtccggt

SEQ ID NO: 92952 - DNA, 529 bp, Heterodera glycines
  misc_feature (455)..(455): n is a, c, g, or t
  misc_feature (486)..(486): n is a, c, g, or t
  SCN-specific regions: Sequence locations=1-211,233-529
agcctttgaagtttttgtgcacattatgtatttccggtttctctccaaagactaattagttgtcattaggcaaaggcatttgtacatacgccaaaattcccctgctgctgttaatcaccgtctccgccttttctctttttattggtgattttgattttcagctgcaaatcaaaagcaagcagcagtaaaatagactacaccagaacatcagaattgattttattttaatattttaccgaataattttcttaagaccacgtaattctgagtgggaattgttcgtcgcacatgcaacaaaatgaatgctttccgcttaatcggtccgatttcccctttttgtttgtatctttctatttcaaatttagctgatctttcccacctttttgcaattcttattttgctgtggaagatatggaaaacaccttcttgtgccggactcagcggaaagtctcagntgctttttgctttggtgttcacctggcggtnacttggacatcctttcactttatttccatttacaaccacgtta

SEQ ID NO: 92953 - DNA, 554 bp, Heterodera glycines
  SCN-specific regions: Sequence locations=1-65,87-209,232-554
gttcttgtctttcattccatcgttcaaatacaatcaaacaaactgaattcctacacaaacaccataatttttccctctcaaaaaattggtcaagctggatccgcaacaactgtctcaacagcaggttggcgagtcgcaacagctgcagactgctgttagcggtgcccaacaacagctttccatgccgactcagcccaatcaattgctgtcccaacagcaacagcctcagatggcatccatagaacagcaagcggtgctgaacatttttgaagcattgaccgtcaatgattcgggaatgcctcccacttatgtgcctgctggccttctcggggggagcggtataggcggccccagtgggtcccaatttccacttgggtctgtgcatggcggacctccatttgcacaacctccgatacagtatcccgaacatttctatatgcaacaaatgatgcaatctgccacaacgccggtcctttcgaccggaggcggaggtttgggcaatacgcagtttctttatgagcgccaaagtgcgttggggagtggcacgatgggaa

SEQ ID NO: 92954 - DNA, 598 bp, Heterodera glycines
  SCN-specific regions: Sequence locations=53-72,94-162,203-385,461 -493,515-598
aattaaatacattttatttataaaattttataatatattttttatttaaaaagaaagaacagtgaatggaggaggaatttggcacatcatcttactgtaggcgtacgataccctcgtaatttgggcccaatcggtcgctgctccctttgctccctaatgaattctcttttcccttccttttgctttttctttcccttcctttttcactgtttgtttcccattttgtcattgtcagtcgctttggccaaataattttctctctccgcttaagcaaaaacatgtttttttcccagcatttggccgaacgcattcggcggatggtccaccaaatccatgctcaaatttgcatattttggccaaatgccctcaaatttgtcccaatcattcttttccttttcgccctttgcttcttcttcccttcgcttctctttcttttttctttccctttcgttctctcctcagcaaattttgtcaatgtgcgcttttccttccttccgctttttctgttcttaacaccgaaaaagtaatcaaattttgaaacaaattgcaatttgaatgactgacgccattcttcgccttacgcatgagcacagtttaa

SEQ ID NO: 92955 - DNA, 615 bp, Heterodera glycines
  SCN-specific regions: Sequence locations=1-96,118-387,409-546,600-615
ctcacatctgggagccctgcatattgtagtaagactggtcccccctttttgaaaaaaaacaaaaattttaatgccattaaaacatgttctaggaagttttagggccaaaaaatggaataaaattccaaaaaacaattttaggagttaactgatgcgctgagcagaatcaatattttcaaatgttgaaattttgagttttccggatgttctaattcgggttcgggattcgaaatttgccaaaagggaggccggattcgtactcagcgcctcaaacaccattagcaacatgttattagaattttcagaaaagatttaaaaaaaaaacttttttcgggactaataatctttcggaagaacgacactcgcgttgcaaattgaaaaaatgtcgaaatttgccgggggaaaattggggagtcgccgattcagtgaaaaagtgcacataaatggacttccatggaaaattgaagcacaaataagaaaaaagacggaaggaactgatgagaaatgtttgggctttttcttatggtgcgaagcacttgaaagtacaattttaattaatattaaataaaaaaaaaatccattaatttttaataataataggaggatcattgaacc

SEQ ID NO: 92956 - DNA, 380 bp, Heterodera glycines
  SCN-specific regions: Sequence locations=1-24,49-79,145-226,317 -335,375-380
aatcttgcgaaaatgattgttaacattaataatataattttttttatagattcttaacatttctagttctttatacttcaattaatctttattttttaaaaaatgattatttcataattttataaaagaatacaaattattaatcaacatttttagcgacttaaattaattttcagatgtttttaaataaatctgggtgattaaaaaaattgcttattttttatttactgactgattgtccactgacggattgtccacttaccgacggattgtccactgacggattgaccactgacggattgccactgacggattgtccgggagcctaaataaggttttaataaaattattattttaattgataatttatttttccacca

SEQ ID NO: 92957 - DNA, 634 bp, Heterodera glycines
  SCN-specific regions: Sequence locations=1-81,107-392,427-528,587-634
gggagcaatcagtggcaaataaatcttgatcaaaccctgctgaccaatctaacaagcttagggaaataccatttcgcctaattttgggaatttttcttttaaaaaacgtttcaaactttgaaaggcatgggataaaaagattttggcctccaaaaacgttttttcaaggattttaaagtaaaaactttgcccgggaaaaattttaaaaattcttttgcattttttatttgtaaattgatgaaatttatttaaatccccccttcgcccgtcagtcccccgcttggccaaatatttgagcatcacttcgtccagcgagacgcgaatgctgcgcaacgcacttttcccgcccctctcgtgccatgccgcatttgccaacgatgtgcaaacacttgaggtaaatgataaacaaaacaaaacaaatattatgccaaaatttgctattttgtgccagaatttgcgcctcagcggtgccaatttgtccggcggtgactacaacatgcgcaccccactccatgtggcggtatgaacattttttacaattaaatagattttttaatttaaatattttattttaatttaattttatgcatccgccggcaatgaggcggcagtggaatatttgttgaagcatggc

SEQ ID NO: 92958 - DNA, 229 bp, Heterodera glycines
  SCN-specific regions: Sequence locations=1-4,29-229
tcgcattgtgaatgtgagcagcagtgtccatctccatgccgattcggtctatccggaggtggtggagtcgtgctctcgatttgggataatcgcgacatacgctcggtcgaatctagacaatgttatgcatgttgttgccctcaccaaacgcatcctaaccaatgacagcgggtcaaaagtcatgtcaaacgcatgccatcctggtagagtcaacgccgaagtcgttcgg

SEQ ID NO: 92959 - DNA, 320 bp, Heterodera glycines
  misc_feature (141)..(141): n is a, c, g, or t
  misc_feature (202)..(203): n is a, c, g, or t
  misc_feature (209)..(209): n is a, c, g, or t
  misc_feature (214)..(214): n is a, c, g, or t
  misc_feature (226)..(226): n is a, c, g, or t
  misc_feature (234)..(234): n is a, c, g, or t
  SCN-specific regions: Sequence locations=1-320
attaaattaaaagtacggtagcaaatgatggaaaatatactgtagagaattaaattaaaagtacggtagcaaatgatggaaaatatactgtagagaattaaattaaaagtacggtagcaaatgatggaaaatatactgtanagaattaaattaaaagtacggtagcaaatgatggaaaatatactgtagagaattaaattannaaaacngaagnaaatgaaggaanaagatgcnatagccaatagtgtttataggtatggcatacctcaaaccccacatgaaaaaagtatggaattaatttttacaaaattgcaaatgat

SEQ ID NO: 92960 - DNA, 547 bp, Heterodera glycines
  SCN-specific regions: Sequence locations=1-244,268-288,310-547
cttggtctgaatttaaccgccgcagacactgctatttttctcgattgggacttcaatccgcagaacgacaaacaagcggctgcacgatgccaccgcatcgggcaggacaaacctgttaaaatcattcgtctcgtggcaaaacatacggtggaggagctgataaagcagagagccgcaaagaagctgaagctgtccgagaatgtcttgggaaccgacgaaaaggaaggcccttcactaatgtttgacctgtccaaactgttgctagaggggctcaccgacctggagaaagagcagaagaagcacacacagtttcacattctgaccgacaaacagcttgaagagcggttgggtcgaaccgaccaaaacggacattggcaaataaagggcgacgacaaagaaaacattgaggatgagcaaatagaagatgaagcggagggaagaacgctgtacatgttcgaggggttatatttccacgaatttgccattacctaccaacgacgatggaaactacttacgaccgggtacgagcaccagcacacgtgtcgaa

SEQ ID NO: 92961 - DNA, 630 bp, Heterodera glycines
  SCN-specific regions: Sequence locations=1-1,25-142,170-630
attttaattttttccttaatttcttccgtaaatggcggcctggaagtagtgtcagtctcagcagacacggaggagtgcattgttgaccatggggggacgaaatgcctattccacagtgtcacctcccttactcttttacctattggccaaagggtggaattggttttccataccccccatacagtacccatgggcagtctatccttcgtcctaaaagggttggccctccggtgcatcagagaaacccgcagttggacccggtcataccgactcaacatatcctcaatgctgcgttgtcctgcagcagggtcctggcgtgcttattttacagattgtttgtggcacctctttccccctacccctatgagctgtacaagtgcccggtttggcaattccaattgagactcgggattattttgcagcttaatgggtccacaaaagccgaagaaataactatgtctccaggggttacccaccattggccgttggctaagttgtctgtcacctttacccccagcggtttgccacccttaccaattttgggaagcgattttattgctaaccgttcacatgcgggattggtccccgaatggcactcccacctccactgtgattctgaatttgcgggca

SEQ ID NO: 92962 - DNA, 348 bp, Heterodera glycines
  misc_feature (195)..(195): n is a, c, g, or t
  misc_feature (236)..(236): n is a, c, g, or t
  SCN-specific regions: Sequence locations=1-54,76-348
cgaaagtggctggacagaggtttttatacactacacacgggggggctctcgggggcactgctggcacacatcatcactgcccgcttgatgttgttaagacgcgactgcagagcctcaatggggacgaaatgcgactgcaagtgcagatggaacgactgggagcggggacagcgtccacaaagtcgaccagctcancaccaacggaagcgtcgagcagcacagcaacagcccaccgntttgcgcggtgtcttcgtctgctccaccaatctgtcattttccgctcttttcactccgtgtggcgggaggggcgccttcgcgcgctctacaaaggccttggcccaaatttgg

SEQ ID NO: 92963 - DNA, 298 bp, Heterodera glycines
  SCN-specific regions: Sequence locations=1-101,123-298
gaaaatccatgtcagctacgccctgacagataagttcacaatgactttgatctctgaggtcctttctcgaccttagtgtggctaacgtcaggccgtgccagtttgcttgtctttgttttccattatcacaggtgtgtttattacgactgcgaccgaattgcaattcgatggcttcggcctttgcttctcattactttcgaagagaattcttgcttttttgaatgttcttgccaaaaaggtgctcaatgagacgccaatgcatccgatcaatttggtctctctgaactcccaattgggt

SEQ ID NO: 92964 - DNA, 162 bp, Heterodera glycines
  SCN-specific regions: Sequence locations=1-162
agcgaacgcaaaaacaccgtccagcgccaagcacaactcatgctcaaagtccgactgatcatgcattttctcgtacagtctgtgatcagattattcaaaattggaattttttaaaatttaattgctttttggaaaatcattttaattacttttcaaaaaaaa

SEQ ID NO: 92965 - DNA, 388 bp, Heterodera glycines
  misc_feature (369)..(369): n is a, c, g, or t
  SCN-specific regions: Sequence locations=1-14,36-205,227-329,351-388
tttttcgcctttagaccgcttcaaaggctttccaccgctgcgtggacatcgacccgtcccatttcgaggctttgaataacctcggcgcttcctattttcttatgggggagaggcagcgtgccgaaaaaatatttttagaagctcaaaagttaaatcgtcaaaattcgcacgttttggaaaatttacacataattgaagcagaagcaaaagcgaagaaagaagcggaaaaactggccaaaaatcaagaagtaatagcgaagaaaggaggcgatagctccaatttgggctaggacgacaatgaaaaagatgatcatcatttgttgagacgcattgattgtattgttgaaaaaataagtccaaggatgccanaaaaaaaaaaaaaaaaaaa

SEQ ID NO: 92966 - DNA, 232 bp, Heterodera glycines
  SCN-specific regions: Sequence locations=1-99,122-210
gttgacattactaagccaaggagacgaagattctcaatctcttaaaagaaaacgtttgatctaagtgcttttgtgtgttgtgtataactcttttagactagtgtgcttattgttcccttcttgatgcgtgatttttttttttgggtgtgtgtgtttattgtttaatgagcttggttaataaaatgaaaatcgaaaccagattgatttactaaaaaaaaaaaaaaaaaaaaaa

SEQ ID NO: 92967 - DNA, 612 bp, Heterodera glycines
  SCN-specific regions: Sequence locations=1-612
attttgttacggttattattcaagtcgcccctaaaactcggttgtcggcggtacgcttcattaattgctcaatttgtgccctggtaacctatccattattaattttcgttacattctccccaactttccgacagccctttccatgggcattctcgaatggtccgtctcagcgcgggactcttttctctacttggccttctgtctgagcatcccttcggcggtgctttacctcgccgaaatcgtcaacattctgcggcacaaacaattccacaagtccttctacgcgctgtccatcatccgtgccgttccgacttcaaaaatgatcggcggattggcttttttcctcaccggttacaccttccaggccaacaatttggcaaccgctttcatccttctcaaccggttgaccgcaattgcgtggccaattaaacacgaacagttttggcgtaagtttcgcccgatggttgcgcttgtggtgttttctgtttacctatttgcttttattgggagatgttcaacgcgcacggactgctcgcgttggacagcgccaactcaacgcaacacaatttcttcctctatgagacagatgatttttacttcttatgcgaacac

SEQ ID NO: 92968 - DNA, 342 bp, Heterodera glycines
  SCN-specific regions: Sequence locations=1-342
aaacggccgggcaagagcgaacgatgacacatcacaccaaaacacaagcaaaaattgaaccttttccctttttcttcatatgagaatcagatgaagatgggggaggggtcttagaaaatatttgcgggcatgtgtaatgactattttccttctttcattagtagatgaacatcgtttttaatgttacgccgacaccaattccccacactcacaaagacgtgttaaatttatttcgaaagtatttatcaatcccatcgttcctaccaactctgtgttgtgttcaactgtataaataaagccgactgagctctataaacacaagaatcagaccgatcctgatca

SEQ ID NO: 92969 - DNA, 652 bp, Heterodera glycines
  SCN-specific regions: Sequence locations=1-19,44-652
gtccaattaagctgcccattgctcctctcctctctttcctccttcgccacttgcacagcgactcggcaattcccgtcgcgggcggaagcaattaggccaacccatcgccgctttcattagcatcgcaccgcttaagtcagtcagtcacaaaccgacaaaagaaacggcaaaattctctcgcacattattcagaaaagtcgaggctctgccaaacctccgaacagcgaaaaattcaatcggaaagtgagtctcgaggaaagggagtcgagaggggacgagcaaaaggtacggcacggcaaaacaccacggcacacgccggtcgatgagcgacgaactaaacattgacggcgcctttgcgatgaacatgggcatgcccgcgggcgcgacggaagtgcccgagggggtcgtgcagctgaatgtcggcgggacttgttttctgaccacaattgacacgctgaaaagggacagcggagcactgctgtcccagttgttgacgttggaagggttggagaagaacagcaaagtggccaagcgaatgagcaacggcaccattttcatcgacagagacggcgaactgttcgcctatgtcctggattacctgcgcaccggcaaattgcttctgccggagaattttcgcgagttggcacgcctt

SEQ ID NO: 92970 - DNA, 493 bp, Heterodera glycines
  SCN-specific regions: Sequence locations=1-379,415-469
cttaagctcttttcaccatactttcttccaaaatgttgtccgcacagcggctgatcagcttgtccaaacccgagcgtgtgttgcccggccatttgttcccgctgaacaacaaccgtggcctcttggacttggaggatgtgtacgccgccactgttttcgccgattcgtcggtggacggcagcgacaaagaggcaaaagtggtttcgcccggctctgacggtacacagacaatggaaggagcaaaggggcaggaaattgttggcttcggactgttccacaaatgcacgcccaatcagttttactgctctttgttgtccgtatcgaagcacattgaaccgttgttcgtcaacgtggaaagagtggccgaactgaaaaagtcagaaacggaaaaggaggaaaatgccaacaaagggacgggacggcacattttgttgaggctcaccgatgtgcaccaatcgttgcccaatctctcctccctcccccaatatttttc

SEQ ID NO: 92971 - DNA, 571 bp, Heterodera glycines
  SCN-specific regions: Sequence locations=1-233,274-571
atcagtccatttcggacccgaccacggagctgactgaggaggacattttccgcatgaaatcgatgtccattgaacagaacgggtggaaaaacggcccttgtgccagcgaattgcaatccgccgtctcgcaggtcgactcggcctccaattacatcgccgatgatggggaacagcaaagtgacgagcaacaacaaacggaggacgagggatcggaagaagaggggaacgcagccgaagaggcggaggaggacgaggaggaagaggaagaagagggccaggccgggccaacatccttcgaagcgatggcacgcagtttggtgcgccgatactacgtggactccaaggtgtatctctgcgatggctatgcatttgggcgaaaccgtgccaaaagcccggttctcaacagagacacggtgaccgttttgaactatcccttcgagccggtcactattccgccgggcatcgattcggacgaatttcgacgagcattcagcgcagcgcaattgtatttggttggaacggcacatttcagcaaggaaagctgccgtgatgtgatgcaaacggtgctgga

SEQ ID NO: 92972 - DNA, 367 bp, Heterodera glycines
  SCN-specific regions: Sequence locations=1-285,307-367
cggtgccctgcagctgttcaatagggaaattttgcagcgcgaggaggacgccaattggctcatgcccatcctttacgtgctgtgcagcgacttgcgactcattgcgcgaattgctgacaagcgcggctgtgtgctgtggggcgttcaccaccagcggaagtctgccgactcgcaaacggcgaccttttacgaagaggccgccgcctcaattatggacagttaccgcatttgtgtggaggagcgatcggacactaccacagagaaagtgtccgtcctcagtctgaccaaccaattgtttcgcatttattttgtgatcaaccaggtgcatctgctgaaaccgcttatacacatcattgaccacaccggc

SEQ ID NO: 92973 - DNA, 672 bp, Heterodera glycines
  SCN-specific regions: Sequence locations=1-111,138-497,524-672
atgacactttgtttttaaaaaaaccttcaatggagtgggcggaatgacaccggtgccaatgctgagaaagcatccaacgttcacggcattgaggaaaattctgaaaaaacgaaaaaaaaatttaaaaaatttattttgctgttgttattggtgttttaccttgtacttgttgaagctgttccaaaattggatttcctggagcagttccaatgacgggttgttcgcaataatgcctgacaaaaatgagtgagggttatggacagaaaaaacacatattctaatgggatggaatttcattaaaatcaaccaaaaatttcaaaaaacagaaattcatcatttaaattacgaaaaaccgcttttttcttgtcaccaaatgcattttaattgtccaccgattaatacaacaacaacaatcaaagcaccactgttcacccacctccatcaatgtatttgttgtccacactggcaaaataggtaggtgctgaaaatttttcgcgaatttattaaaaaaaaattttttttacccgccgatgaacgcctcaacactttccacagcaacaaatcgtcgggcgtccggtagccgagctcctcattctcctcgtcatttgtcggcagtttgtagttgcgcatcagctccagctgaaccgggaagaactcggcccgcgtggtggt

SEQ ID NO: 92974 - DNA, 552 bp, Heterodera glycines
  SCN-specific regions: Sequence locations=1-552
gtattaggtacatttttttatttatccactttttattggtcccttccttctcacacttcttcctctgacttaacatatcactcttttcgccgtttccttctgccgatggatttggtcgcttcgtctctgcattatgttggcagtctttttgacatggtcgatttggttgtgatcggtgcgctcgctgtcttcgccattgcctattatgtcagaagtcagtcgctgtccgcgcacaacaaaatcaaattctcggagagcacgccgacgctgcgcaacggcggcacgctgcaggacagcggcaggacggaccgttcctttttgggccgcatgaaatcggaggaccggcagattttgattttgttcggctcccaaacgggcaccgccgaggaattggccggccgcatggccaaggatttgtgccgatacggcaaaaagccgttgctgatggacccggaagagattgaagtggacgatttgccgaaaattgttgaactgtccgacccggtgctgctgctgttcgtcaccacttatggcgagggcgaccctacggac

SEQ ID NO: 92975 - DNA, 574 bp, Heterodera glycines
  SCN-specific regions: Sequence locations=1-193,215-289,311-574
gtttttttttggaaatttttgctcaccaaatgcaataaattcaaagccccacacacaatcaccaccagaatcatcataatcaccataatcccaacaaccaccggttcatccatccgacataccgtatcgtccgcgccgaatgacgtcaccgacgacattcaacggggcacgggtttttgccaaactgtccggcaacagcaaccaacaacagcaggccattgagcacaaaatggcggaacttcgagcagcatacgcaatacaaccagcacagacgccgacggtggcaaaaagtggtgccaattccacccaaaataaatcgtcggcaccaccacctcgtcgacctggacgaacctcattgccaactccgtcactaggcgacatgcttgaactaccacaattgagctctcgcagttgtgtaccgtcgagaagagcaagcacagtgactgcctgtttttcaccagccccatccctaatggatttggcatcgtctgccggacttttgtcgctgtcgccaagcgatttggtcttcgagtcgtccgtgctcggcattgcctattatgactttgtgttgtcg

SEQ ID NO: 92976 - DNA, 616 bp, Heterodera glycines
  SCN-specific regions: Sequence locations=1-274,297-306,328-616
ggtccaccaaaatagatttatttatggcacttccgggttccgctgtaaagctgtccttttaagccccgacgttcgtcgtaccgctttttacgcggccattaaagcacgttctctgtcaaagactgtcggtctgatgatcaccggttcgcacaatccaatttctgacaatggcattgaattggtggatcccgacagacgaatgcttccgtttgaatgcgaaattgagctgacgaacattgtcaatgccactgatgacgaattcgagcgcatcgaaaaagaaatgatggcgaagacaagcgacgccaccggcggacgacgagcggcggtatttgtggggacggacacgcggccctccagcccggacttactcggcacggccgttgagtaaatcagccgcgtgaatgagattcacgaggagcaataccacaattgcacaacgactcatctgcatttgattgtccgttctgtcaacagagatgcccctcatacttctccatgctctgttttagcccaatatcgcagtgctattgccacatcgcttgtaccagtcccagagtccgattgttcccgctactccatacaacttttcgtcgattgtgccaatggcgtcggcgcc

SEQ ID NO: 92977 - DNA, 479 bp, Heterodera glycines
  SCN-specific regions: Sequence locations=1-24,56-215,237-479
atttgatgcgagaaaaaaagcgattgttaaaatttgctgaatatttgggacattgttcacgagaagcgacagattacggaaagtgtgtggcaacgaacgcggagagaattcggaaaggcgactgttcgactgagttcgaccgactcatcgcctgtttaaagaagaggcaagtgcgtctgtaaatcgctgctccgatgaaagtcaaacggcttaagcgtgccgctcacattttgactttttaccgttacaatttccattttcttcccccattttccgtccttctcgacggaactttttgccaagcggcgcttcagtcgaaaataaatcttcgagaacaaatgctaaaatatttggcgcaatccgtggaaatggtcgtcacgaaatgcgttttgaatgagctgcatcagttgggaaaaccactccacggcgccttggtcatctgcgaacaatttcgaattgccttttgcccccacaaaccg

SEQ ID NO: 92978 - DNA, 595 bp, Heterodera glycines
  SCN-specific regions: Sequence locations=1-288,310-595
ccctttcgcatcggtcgcttcggctgttccatcattgagccccatctcgcggtgaatgtgctggcaaatgcgcagcttttcgcctcctttgccggtcggttggagtgcagtcgcttccgttcgccccgcgccgttttcctttcctcgtgcactgcgcatgccggcgaactgtcactacttttggagaacgaagaaaagttttggtgccgtcgcatcaacgactataaatcgtacgccgactcaaaattgttgctcggcatttacgtcaaacatttgagccatgttttaaaaattcgacagagtaaaatcgccgttgtcagtgtccatcccggcgttgtgcctggcaaattgtaccgaaatgttttttggcccttccgattattcatcaacggatttttgagaccatttttgaggtcgccgctgttggccgcgactcgcgtgttggacgtcgctttctccgacgatctctgtgagggtgcctattacgaggacagtcgcgtcaccgcgttaaaatgtgccgacgacccggaattcgtttggtcagtgggcacttccgtcagggacatgatcgtggacagcaacgcgaactccttca

SEQ ID NO: 92979 - DNA, 597 bp, Heterodera glycines
  SCN-specific regions: Sequence locations=1-597
ggtttcagtgaattgtttttgccaatgggtacgttggaggacaacaccggtgccaccagcgcaatctttgggaattctacggggccaaacggtgatgaaactgtgcgaaaattctgcgaccgtaaaatttcctctgtgcgtttccttcatgaccattctgagtattcctcccgtttcgtcaccggcacttggtgttcccctgcgggttccggtggaaatgtgacactttggacggtccaacaacagcgcgacgaacagagtcgggaaggcggaagacggattgttcagaatggacggattgagctgcccaattgcgatgtcggcgacatttgcgtggtaaatgctcaacaatttgtcgtctcaacaacagcgggagacgtgcaaattgtggaaagtcctttggcatcaaatggagcgaatttggcggacggaattgcgaaaatatcgtcggtagccaaatatccgcgagtgcataaatttgcttcttcaaccgcactttgtctgctggacgaagaaatattttctggcagtgattctggtcaaatcattcgcattcgcccggacagccaatcttcacagtcgactcgggcatttgcg

SEQ ID NO: 92980 - DNA, 590 bp, Heterodera glycines
  SCN-specific regions: Sequence locations=1-1,26-590
tattaattaattaactaattaattatccgtaatgcattttccgccgaccattcataacgcccaaattcgccacggtccgctgaagccgccgaatatgagccgaagcccaacacagccggacacaagccttggcaaggtgtacttggagtgtgtggccagcttttcggagccgacaaaggccaaatggctattcggagagagcgaactgagcaaaacggacggacggtttgagttcagccaggaacagcaggacacgaacagggacaagttcatctgcgagatcaaaaatttggacaaatcgctgaccggagtctacaagttggtgttgatcagtgcggaaggccgtgagaacatcgccacgttcaatctgcccctggtgggcatcgaaaaatgcaattggactaatgtggccgcttctctgacaatggacccaatggtcgtgcgagaagtgccactccaacctctggtcccgatcagataaagcgcaagaatggcggaactcgaaccgatcgatcgacggaaaaaatcaatcaaatcgatcgatcgttccccggtgatttaaaaaataatcctctcaaatgtttcctttt

SEQ ID NO: 92981 - DNA, 190 bp, Heterodera glycines
  SCN-specific regions: Sequence locations=1-128,150-166
gagaataatgtgatggatataacgcaattgagccaaattggaacggaattttggacgttttgaatttgcattacccaaaaagtggcgtttttaagtgatgccttttatacattaaaatatatttgttttacatatttatgaattaaacccttcgagaataaagcgcaaacaaaaaaaaaaaaaaaaaaaa

SEQ ID NO: 92982 - DNA, 476 bp, Heterodera glycines
  SCN-specific regions: Sequence locations=1-164,187-327,349-375,400-476
tgattaacgtagcctcgctagaatttaatctaaaaaacttttgtaaaaaagcatttaacaacgtcgcaagcattgtagttttaataggttctaccactatccctttttgaaccttgaaactacgttaatgtccataaaaaaaaaaatccacaaaaaaaaaaagtagtgcaaccttgcttaaaagaggaattacattgctataatttaattttttaccgttgattgataaaaactctcctcattagaactattatttaaatagttcaagtttctaaaaaaaactgaaaatttttagaaacaataacattttcccttccgggaaaaagttttctctcgtaaaaggctgatcactaggagcttccagaaactctattctataaattaattataaaatatattccaaatctcctatatttcacttatgtgaaaggacctcgggtcttaatctacacgaagcccgtagcgtaccatggcat

SEQ ID NO: 92983 - DNA, 607 bp, Heterodera glycines
  SCN-specific regions: Sequence locations=1-546,570-607
gccacgcgtcccctccgtttcgatcggcccgcgcctcagccgcagcgagtccatccgttgtcactgattcaaatggtcactgctgcgaaaatcgtcgacgaacagaagcgagccaaagaacgaacgcagacgccactagtttatcggatggatccgaagttgctcatccgagaggccaccttcaacaaaatggcacagaaacaagcggcggccaaatatttggcgaccaaaaagcgtcgggagaaggacgagcagagggagcgcgagttcgtccgccgtgcggtgacgccgcccgactttggccaaatggacgccgacgcaatggtcaaactgtcggactttatgcctgccgtgccggcccaatttgaccgctcttttcgctacgagacgctcactgctccggtcaaagttccctcggatggagtgtactcatcggacgacattctcatcatcggtgctcagatggaactcgcgaacaaaacaatgacggcaaagtgacggactgctgaaggaaggacagacatttaagagactgaaaatttgccttaatttgttcaatttttatttttcattgactcattcactctatctgaactgtggacaaatc

SEQ ID NO: 92984 - DNA, 596 bp, Heterodera glycines
  SCN-specific regions: Sequence locations=1-596
attataatcagaaaattaaaacatcgaatccattgtacggacgtggatattttatcgagcagaaggaatacagtaattctaacggttgcggatttcgtaaggcgaatagaccgcttgttccgagtaatgcggccgacattgagagttgggagccaaaggtaatgagcacccaagaaattagcaaattgactgctcgttgcgtgggtgtcactgatgcgtttatcaaacttgacaattacgtggacagtgtgaagaagtacaacccgtcgaatcatgatttgcttcggatgcaacgaatgcagcaccagtcaaagacattgacggaagacccggacaaatacgccgaacttattgtccaatgtgttgcaaatccaaacaagtttaatgggactcgccactgtttggagcttgtcattggcagacgagcacttgaggaatttattagtcgcaacgaatggacggaggaaagactgaaggactacgacattaatgcaaattggaagttcgagcccaatgagttgactgtcccgccgattcccatttacaccgggtcactttcttctgcttgatatatttgaccggttaatgtgactatt

SEQ ID NO: 92985 - DNA, 621 bp, Heterodera glycines
  SCN-specific regions: Sequence locations=1-122,145-621
aataaagcgaagtgccatcaccgctcggcaatactgtagcgcaacagtcgctcggcacaactactgtatcgagggattcctaccgtatccaaataaacactttccaatcaatggctgatcggcaacaacaacaacaacaacaaccatatcttatcaacccaattaacaacagatacagcaggtcaatcgccgatttggtaccactgggcctcaatggcacagctttgcccatccgcgcatttgaaagaggccaagccgactcgcccgagagaagtaccatttctacaacattgtcgacaatgcaaggtgaaaacagtccgccgaccttccttggcggcgcggaagtgccacctccgatgggcacgagtttgctccggcaacggcttggctccgcatcggtggcacttaggggctctgctgattggaggcgatgcactttgcagtcagaagctgagcgatcattaggctcaagccgtgccgcgaccaccttcttgggcagtccaccagaagcagcagcaacagattttggacaaaccgtcaccaagacatttggccaaaatggaggaatggacaatgttggacaaagtgtcgaccagcaatttggacgaagaaagtttttcg

SEQ ID NO: 92986 - DNA, 548 bp, Heterodera glycines
  SCN-specific regions: Sequence locations=1-417,440-548
cttctccatttccaatgcctttggcctccaaaagcgtcgcttttcttccgtccttttcttcctcactttgctccgcttttttgctccttcaatttctcctccctttctgtgcgtcggctgatttcgacctgagcacaaagtcgggcagcaaagtctgtgtcggtgaaatctgcgccgattcgtctccttttcattattatgagtgctgtggacagatttacaatgagtgctgtttgcgccttcagacttggctcattgccgtgcttttggtggtcgccatttgcgcgatcgcttcttttctgatcggtctgatcaaatgcatttgctgctgtaatggcaatcgttgagaagtgaacgaacaaagcgcaaattttaacaaattacgcattgaatgttccattttatcgatgtttaaattgtcttttgtgtttaagtgttagtttaatttaaacttttcaatgctcataaattgtatgaagacaagaataattaaatatattatgtttaagctttcattaattccccgactgaaaaaatccctatagctt

SEQ ID NO: 92987 - DNA, 594 bp, Heterodera glycines
  SCN-specific regions: Sequence locations=1-97,121-594
aaaatttgttttgtcaaaatgtcgtcaaaacccgaaactttggtggagcggatgaagcatttgttgagctcgggcgatgacgcggacgttctctttttggtgggggaaggagagggaaaggagcatgtgcccgcgcacagagcgattctgaattcggcttcggacgtttttgaagcgatgttccgttttgacaccacaaaaaatgcgactgacaatgaatcagcgggtggagaagcgaagggtcccgtagaagtcactgacatcgatgcgcatgtgttcaaagtgatgctcaacttcatttatgcggatgatttgagtgaattgaatggagacaacgcaatggcagtgctttacacggccaaaaagtataatcttaatgcattggccaaagcgtgtttgaatgttcccatttccgagctcggcaatgtgtttctcgcttatgaccaatctcgccttctcagcgaaaaagatttctctcgtcgctgcttggattacattgaccaaaatgcgggaatcgctgatccaatcggatgcctttttggaagtgaacaaaatttgctgtatgaaattctcgaacgtgaccagttgaaaatc

SEQ ID NO: 92988 - DNA, 638 bp, Heterodera glycines
  SCN-specific regions: Sequence locations=1-186,221-223,246-638
cacgctgtcgtgtgatccacgaatttaatgcgggccgttggccatatataatcgcatcggaatgcaacgacatctttgacggggacaacgagcaggagcaaaatggggaacaagaaacagcgaaaaacggagatgaagcaaaagaacagcaaggagacacgaccaaacagcaaaagattcgcaaacgaaaagaattgaaaaagaagagcaaacggcggcagttggacaaagagtcaggcattggccgtggaatcgattttcattcggtttcgaacgtgatcaatttcgattttccgctctcaactgatatgtatgtccatcgagtgggcagaacggcacggggatttaacaaaggcacagcaatttcttttgcttcccaggaagagttgaacctttttgaggtggttcgaacggagatcaatgaacgaatgggccaggcggttatccaaccttatgaagtgcgtatgaaagactttgaaagtttccaacttcgagcaagggatgttatagcggcgtgcacaaagacggtaatccgtgaaacgcgaatggctgagataagggcggaactgctcaagtcgaaacgattggacgcatattttgagaagaacccccgggagaagcgtgctctggagcaggac

SEQ ID NO: 92989 - DNA, 533 bp, Heterodera glycines
  SCN-specific regions: Sequence locations=34-533
cctcgtgccgaattcggcacgaggccatgctgtcctggcagccaacatgttgtttcgatgatgaaagatcacaccggcacattctccgcttcgatgccaaagtcttcgctttgtctgagtgccgaaagagtcgccgctgcggtggaaaaccaactgaaaacaatttggtgccctggcaatggtggtcaaacactcatcaacgagatcaacgcagctcaatcatcatctgatgagtgtgctcgctctctcggcttcatccgtgccatgttcgaaattgccgcttccgccgcttcccatgccggtgccaacgccgaattggccaatttggctgtccagttccgagaacaagttggcacaattgacaccaactgtgctgcgctgggcattcatgttgggcaaatcagcttgggcactcccaaaggagaccatccgcaagtgcatgactctgagagtgtgcttagtaaccctggcaccagcgggtctcacaagcgcatttaagtgcattgcgacgattccgatgatgtcatcatttg

SEQ ID NO: 92990 - DNA, 548 bp, Heterodera glycines
  SCN-specific regions: Sequence locations=26-28,50-65,116-146,204 -220,269-317,500-548
tcatggtcggtttcgcgcccctcacgtcccgcggctcgcaacaataccgtgccctcacggtccccgagctcacgcagcaaatgtttgacgccaagaacatgatggccgcctcggacccgcgtcacggtcggtacctcacggtcgctgccatgttccgtggccgcatgtccatgaaggaggttgacgagcagatgctcaatgtccaaaacaagaactcgtcctactttgtcgagtggatccccaacaacgtcaagaccgccgtgtgcgatattccgcccaagggtcttaagatgtcggtcaccttcttgggcaactcgaccgccatccaggagctgttcaagcgcatctcggaccagttcacggccatgttccgtcgcaaggctttcttgcactggtacacgggcgagggtatggacgagatggagttcaccgaggccgagtccaacatgaacgatcttgtgtccgagtaccagcagtaccaggatgccacggctgacgacgagggcgagctcgacgaggaggaaggtgagggcgaggccgaggctgcc

SEQ ID NO: 92991 - DNA, 601 bp, Heterodera glycines
  SCN-specific regions: Sequence locations=1-85,107-601
aggttttgaccgggcggcgatggtgaaggacatgaacatgttctagtggttgaacggcaattgctatcgcacaagtcattacccttacgcggaagagagagcgtactgggcggaccggcggggaattgcggtcattacggaagtgccggccgttggaatttggaagctctactcctcggcattgctgaaactgcgcggggaaatgatcgcggaaatggtcagccgcgaccgaaaccatccttccgtcataatgtggtcactgtcaaatgagccgaaaatgcccgccgactcgacaccttacaaatatttcaagaatttggtcactttgaccaaacgattggacgccacgaggccggtcaccgctgtttttggccacgcgtctgcggccgttaaagtggcgtcacttttggacgtcatttgtgtcaacgaatattttggttggtacagaaacattggcatgttgggactgatccgcgaccaattgctcgatcaatttccaaaatggcgtcacaattacaccaaaccggtgattttgagtgagtacggcgccgaagcaattaccggctttaatgatcagccgagcgtgcccttttccgaacgt

SEQ ID NO: 92992 - DNA, 594 bp, Heterodera glycines
  SCN-specific regions: Sequence locations=1-161,184-443,465-484,507-594
gaggtttacttatatttacccgccaactgaaaatggacaacggctggtctccagaggagttcggcaactgtgattggggcggtaacaaccggacggaggagttcggcaactgcgattggggagacaacaaccggacggaggaattcggcaactgcgattggggcaacaacaacaacaaccggtcggaggaattcggcaatcgcaattgtggcaacaacaaccggacggaggaattcggcaaccgcaattgtggcaacaacaaccgatcggagggattcggcaaccgcaattgtggcaacaacaaccgatcggagggattcggcaaccgcaattggggcaacaacaaccggacggaggaattcggcaaccgcaattggggcaacaacaaccggacggaggaattcggcaaccgcaattctgggaatggcactgcccagcgacgggatgccaatggcagaaacaacggcggcggaccgtttcgggtgccgtcgccacccccgcagcaggtgccggtgccaccaccggtcactccgcttgacttttgttgccccggcactgagccttcgccgcctgttcgatcgaatatcgtttacg

SEQ ID NO: 92993 - DNA, 641 bp, Heterodera glycines
  SCN-specific regions: Sequence locations=1-641
caagtttgagcgaaatggacaacacaaataataaattcattttgttgaagaatggggcaaaattattctatgcttctgaagaatgcgtacgtcaggaagcgaaaaactttgtgggtggaattgtcggtttgaatgggccttcggatttggaggagggcatttatgagggtggcctcaaaatttgggagtgtacggtcgacttgtgcaattttctactcagcaattatcagacaatgagcggaattgacattttggagttgggctgtggcgccgctttgccttcgattttggcgctgtcaatgggcgccgattcgatttgtgttcaggatttcaatacttttgtcgtcgaatgtttcaccaaaaggaatttcaaattgaatggccataaaattgacggtggaaaatgcgcttttataaacggacgatggggcggagaaattttggggaaaattgggcagaaaaagttcggtctgataatcacttgcgaaaccatttacaacgaggcgaattacgcgtcgcttcacgaaacaatggacgcccttttggccgacgatgggaaaattcttttggctgccaaatcgcattatttcggcgtcggcggaagtgttttggcattcgttgaattcgtccgctcgcgagga

SEQ ID NO: 92994 - DNA, 90 bp, Heterodera glycines
  SCN-specific regions: Sequence locations=1-90
gtccaattaagttgggatggaattttccaatttctacgcctattatgacaatttggctgcgctaatcgaccaacaaacgtgggaagcagc

SEQ ID NO: 92995 - DNA, 520 bp, Heterodera glycines
  SCN-specific regions: Sequence locations=1-479,501-520
gccaactcagcaccgacggggcgctgacggacggcgcttacgcggccaaatgtgcgcggattgggcgcgaatgtggggacaaattggtggccggattcatctgtcagcagcggtgcagcggagagagcaacgacgcaacagaacagcaacaatttttgcattggacacccggcgtcaatctcagcggcgccccgggcgacggactcggccaacgctggcgtacgcccgcggaagcggtggcgcgtgacgcgtgcgacattgtggtggtcggccgtggcatcaccggcgcggcggacgtcggcgcggaggcgaaacgctacgcgcgcgtcgcttgggacgcgttgcgcgcggcccgcgcgtggaccgactgatcaatcaataatttacctaaaatgccattgatcaaaccgatcattttggaaaatttgtcactcatcgatggtttctgttgtttttttgttctgtttcttacatatgcctttttatttaatttaatttatgttcgtttttgttttgtttg

SEQ ID NO: 92996 - DNA, 576 bp, Heterodera glycines
  SCN-specific regions: Sequence locations=1-195,218-413,435-576
gtctgccagacattgtctgatttgtcagattttcttgacaaatttgacgggcgcgacaaaacgatcaggtccctccatttcgcccttgttttgatcgccaatcgctttcgcgatcggaggaaaagcgaccgactgatggcattcgctaagcaattcagtcagacccggttaatttgtcggctcttctcccaaccgtccctcctcctctccgtcctccgaatccctcgtgcttttcgtctttctcgtgatcgcgtggattgtgctttggcttcatcagtcagtgtgctttatctgttctgcggatggaatgaactgatcagtttgctcgccgagtcgggcttcgtcggtcgtgcgaaggcgaacattttaaagtgtcacgggaatgcgttacacttttgggtgttggcattggcattttgcatcgttcgatgtctccgccaaattgcgcttcgagggatgccaaaggcaaatgcattagcacggcatcagcacaatgacaggcaatggcttcgctcaattcatttctctcattggcttttccgccgattttgtagccgctgtcaatttgttgccccg

SEQ ID NO: 92997 - DNA, 659 bp, Heterodera glycines
  SCN-specific regions: Sequence locations=1-42,66-157,179-492,514-659
tccaaataagccatttatttgacttccagttcagcaattacattctttgttcttcttcaattttcgcaatggccaaatattgtttaaaaaagcaaagcaaacggttgacttgtaagaagaagttcaaaattcagcgcaaagttcgggaacactcgcgaaaacttaagaaaatgtccaaagaatccgagcggaaaaagaagacggaaaagcaaatttccgtgcccagcaaatgtccattcaaagaggaaattttgatggaggcggagcagaaacggacggaggcaaaggagatggaacaggagcgcaaggcacgacagaaagcggccaaaaaggccggcggcggcgtcgtcaaaaaacagtccaaaaaattggcgacgaccaatccgttgtcgtccattgaggcgctggcgaagcgagtggccaaagacgaagacaattacaatgccaaccaatttttggtggattcgcttccggaagtgccgggcgcgacgacagaaaacaatgacacaaaatccggtgcccgtgccaatgccaaatcggtgcgttcatttgcggccgaagttcgacggaccatcgaaaatgcggacattgtcattgaggtgttggatgcgcgtgaccccctcggcagtcgcagtgcacaaattgaaacattggtgctg

SEQ ID NO: 92998 - DNA, 648 bp, Heterodera glycines
  SCN-specific regions: Sequence locations=1-321,344-648
gaaaaagtgcccaattttctgtactctgccaatgtcttccgctccaccctcaccagcccaattgttggcacacaaagtggcgtcgaaaatcatcgaaacggagagcgttaacgggataactgacgcggaaatgatggcattgttgaaatacggaacagagctgctcgagaaggagccggcacgtgtgccattggaggccccctgctacatttttggcgacatccacggcaatttgcctggctttttactattctttaccaaagccaacgttgagtcccgtctgctccaactgcattcacccaagtgcaatttgctggtgctcggagactttgtggaccgcggcctttacagtctcgaagtggcctctttgctcatctcattcaaactgctgttttgcgacaaaatttttgttgttaggggaaatcacgagatagaatcaactaattttgagtatgggttcaaagaagaagtcgatgcaaagcggccagaccaagccgaacaaatttacaacgcatggaattgtttgttcgccaaactgccactgtgcgcggtcatttccaacacctttctgtgcatgcacggcggtttgccacgacctggcggatgggactttatgatgggaagcgcatttgtgaaaccggccgacga

SEQ ID NO: 92999 - DNA, 476 bp, Heterodera glycines
  SCN-specific regions: Sequence locations=1-62,86-150,173-192,215 -338,360-454
gacgataattgatcgatcacatttcatttttcacgtgtatttaatgttcgccatttcaagcgaagtatcttcagtctctccggaataaagccacttatcccagtgtgtccatcaaaggcgggatagaatccctgggcttgatcatcccatggggcccttccttcgggagtttatgagttccctcccaatgttccccatctgccctcccaaattgcccactcccaacgccagcacgtccaccgcgcacggccgcgctactggtagcaccggatggttctgcaatttgtagacttttcatcggcctgggcggacaaaggaacaatggaacggaggtgagtcaaagagggagactaaggaggcgcctgctgagagaggaaaaagcgcttcggcggtataaaaggcccacgggggaggactcaaaaaaataccccaaaaaggaatgccccgaaaatagggaaggaaataaataccccaaa

SEQ ID NO: 93000 - DNA, 667 bp, Heterodera glycines
  SCN-specific regions: Sequence locations=1-118,140-431,453-667
tgaacaatccgccgcaattgaacaacgccaccgggcggtcatccaacgctggcagcaattattagcaaattcgctggaacgacgtcgcaaattgacggaggcccaggcgcacttcaaacaaattgaggacctgtatctgacgttcgccaagaaagcgtccgccttcaactcggggcttgagaatgcggaagaggatctgacggacccggcccgatgcaattcattggaggaaattcgggcccttcgcgaggcgcacaccgaattccaaaagtcgttggttggcgccgaggacgacttccgccagttgcaggagttggaccgtcagatcaagtcgtacaatggtggggccaacccatacacgtggttcaccatcgaggcactgtcagagacttggcaaaatttgcaagagataatcaaagagcgcgagttggagctgcaaaaggagcacaggcgccaggaggacaacgacaaactgagacgagaatttgcacgacaggccaatgaattccaccaatggttggcggacacacgtggcgaaatgatggaagcaagcggatcattgggagcacaattggaaacaatccggcgcaatgggcaggacatcaaagcacagcgggccaagctgaagaaagtggaagattggggcgcactgctggaggagcatctg

SEQ ID NO: 93001 - DNA, 279 bp, Heterodera glycines
  SCN-specific regions: Sequence locations=1-279
tggcgccgagacttcggcacgcccaccaccgcctgcagaagaattgtgcgcggatgacgtcaaagtggcatttattgaggcgaatttcatgccggactgtgaacgcgcgtgccggtactatgaagactttgcggacgtcgcttttgaaactatgtttttcggaaagaccgacgaggaaagagtcaccaaattgtctttttaggctttttcatctgttttgactttttcgaatttactcgacaaacaatctcaacacaagcagaaaaaaaaaacaaaatg

SEQ ID NO: 93002 - DNA, 132 bp, Heterodera glycines
  SCN-specific regions: Sequence locations=1-132
aattgtatgtttattttatccttcaaattgttatatatattatgcttctagtgactcggaatcagactgaaaaattctggaattattctcaagatattagcttgtttgattaaaattttccgattttagttt

SEQ ID NO: 93003 - DNA, 600 bp, Heterodera glycines
  misc_feature (593)..(593): n is a, c, g, or t
  SCN-specific regions: Sequence locations=1-408,430-525,547-600
cgcaaatgggaatttgtagatggcttggacgaaaggaagaagtttctttgtttgataatgggcttcgaatcgaatcaagcctcaaaattcttaccgatgacaagtggcaaaatcgttatgttgtttgccagaggcgctgcttgtccgaggctcctttgctaggtattttcaaaaatggaggttgtcgtgaaagaggcgaacatttggaacttttctatttgcagaattacatcggatacgaatatggttttaaattcaaacgctcgaataagacgctcgccatcttgatacaaggccaaactttgatcttctcatttagcaatgtcgagagcatggtgttttggaaggagtggttgaaggacgtttgtgggcgaagtgccatgtattttgtcaagtgccataccattccaaaggacaattccgtcatcaaattaaactctcgaagtgcacgaattcacatcactcgctacgccctcgtcattgtccaggaagtgccgccgaaacagcgattgtatctcaacttggaagatttgtccgatgttgaatgcgttcaaaatcgctttgcgtttcgcgcattgacctacccctggtcnacaccgc

SEQ ID NO: 93004 - DNA, 467 bp, Heterodera glycines
  SCN-specific regions: Sequence locations=1-35,68-467
aattaatctcattaaaagaataattctttaatttgaaataaatcagttttgttttcagttttttgttcaaagagcaccgctttgacgagccgttggacggcgcgcactttcaatggacagccatttacgacgacgacagcccattttttggccatgggtttggtgactgtgtatggtttaggtgttaggaccttgagaaggagaacatgttcaaatcggactacgtgcgaccagcgggaattaagcccaggggccgacccaaacaacaaatgccaaatttattgctgtaacaatgccaattctgtagtaacagtacaccaccgtctgctcgtacttttccgttttggggatctgctgatcggcgcccttattcggacaaattcatttttacggtggccatttttgtcgcactcgttgccagttggcactgaatgattgacagaaaagaagcaattgttgtgatgata

SEQ ID NO: 93005 - DNA, 535 bp, Heterodera glycines
  SCN-specific regions: Sequence locations=1-95,124-145,168-213,238-535
gtgattctgacggaggacgacgtcaaattctacatggtctgagatcattttggcgctggagcacctccactcgctgggcattgtctaccgcgatttgaagcctgaaaacatcctgttcgattcggacggccacatcaatctgaccgactttgggctgagcaaggagtcgttggacgtccccggacaggtcacctacagtttctgcggcaccgtggagtacatggcacccgaggtggtcaaccgtcggggccattccgtcgccgccgactggtggagcttgggtgtgctcatgtacgaaatgctgacgggccacctgccgttccagggcaaagatcgtcatgacacgatgaacctgattcttcgtgcaaagctgcccatgcccgtctatttgtccggcgacgcgcagtcgctgctccgcgcgctgttcaaacgcaacccggcaaatcggttgggcggcggtgcgcagggggcggccgcgctccgtgaccaccgcttcttcgcctccgtcaactggcagcggttggcccagcgccag

SEQ ID NO: 93006 - DNA, 617 bp, Heterodera glycines
  SCN-specific regions: Sequence locations=1-310,333-382,414-617
ttttttcgttaattatgcgccgtcgtccgtttctttcgcttttcattttattcctttctctgcgctttacgccaattttggcacacactgacaatgaaaatgccgaagaagcagagaacagcaacaaagttgagcccgaaaggccaaaaagtgacggagaaggggaaatatccaaagacccctcgggcggttttggcactgacattgagtgggtgccgtgggatcaagcagtttcggtggcgcttgacttgaatcggccaatttttctgctcattcacaaaacgtggtgcggtgcatgcgatgcgctcaaaaagagttttgccacttctccaaaacggaaggaactgttggagctgagcaagcagttcgtgatggtgaacacggaggacgaggaggagccggaggaggaggagtacgcgccggacggacggtacatcccgagactgttcattctgaataaacatggcaaacgccttccggtggataataagaagaactatccgagtaacgtggcctacttcccgcaggtgccggatgtgatcagagcgatgaaagagggcacggaagagtttgagaaagagcagaaggggacagagagaacggaagaaggagagaat

SEQ ID NO: 93007 - DNA, 98 bp, Heterodera glycines
  SCN-specific regions: Sequence locations=1-98
atttgaacgatatgccaggccttggatgaattattgtacattattgtgaactttgggttggtggtgctgattccttgttaaatttatggataaaacga

SEQ ID NO: 93008 - DNA, 382 bp, Heterodera glycines
  SCN-specific regions: Sequence locations=1-382
ccagatcggcaaatatcgttcatatcgtgactatactgctgcggtggacacaggcacggagctgatcggtggaccagttcatctgatgcaaatgatcattgctgccacaaatgctgattactgcgaggaggacaacctgtacactgttccatgtgaccaacgacccaaattggcctcaattgtgctgaaagttaatgggaaagacattgtggtgccagcggaggaatatataattgatttgaatctgccggatggaaaatgtgcccttgggctgtttggccaatatggcgtcggattcacgacggattgggtccttggcgctcttttcctgaacgcatattgcacaatgttcgactacgacaagggccaggtgagcttctcg

SEQ ID NO: 93009 - DNA, 459 bp, Heterodera glycines
  misc_feature (456)..(456): n is a, c, g, or t
  SCN-specific regions: Sequence locations=1-407
caggagttattgcgacgtcgcaattcaccggtggacccgagggatcgattcggctcaattgcggcgaaaaaggtgcacatgccgcagacggaacgcatttattacggctttcagccggacgtttggaacgaaggcgcccaaattgaacggctgctgcatgagcgacagaatgcgtttatggcggacgatgaacgcgtggaggacgaattcgctgagggacgcgttccacagattgtagagccagcgcaagggacatgtccgggactgaagaagcacgcgcgaatccaacgaaaacggagggagtggcgcacactgatgaaagcggagagaaagcgcaaggcggtggcgactgacccgggctgcgtttaagcgaggagatgcttcaccttcgccgatttcattttctcaaatttttaattttgtgtaaaataaatatcttgtttttaaaaaaaaaanaaa

SEQ ID NO: 93010 - DNA, 564 bp, Heterodera glycines
  SCN-specific regions: Sequence locations=1-125,147-564
gaaatgaggtcggatccgactcagtcgaggaggtacaagcacaatacagcagcagcagcgaacggcttcaccaccgcgggtgtttttgtcggccaccgcacgcggcgccagtggcgctttctgctgctgctttccgtgcttttctccgtcactttcatcttcggcttttgggctttccaatcggatgagtggtccagcttctcgcctccttaccacaagttggagcagttagcctcagcaccatggaacaacacaacatcaacgacaacggcggaaggaacaaaagaaccaaatggaaaagaggagggactttctgctgaaaaggcaaaaacgaatcgtgccgaaaatgcaactgaaaatgtgccaaatgtctcctcgactttcgcggttccctcgcggcattccgtccccgatttgccacctgcgtgcgctgaccacccgccgggactgatcggtcccattccggtgtggatggacgggccgggattcgagacggagttcctaattgaattcaaaaacatccgtctcaaatgtcgggcggagttcgccaattcgtgtccggaa

SEQ ID NO: 93011 - DNA, 547 bp, Heterodera glycines
  SCN-specific regions: Sequence locations=1-180,202-547
ggaatattacttttgttaagacgttgctatgggtttcaacggcatgcatctgggaaattattgtatgttagggcggtaggtattgctgaaacggtagctagttgggtgttctattcttatgcacctgtttatgctgcgctgctttatgatttggcacgctacagtagtttaccgctttcttaccttaaggcaaattatgatccatctgttttttatttgatagaaatgttattgcgtatagacaaacagatacaactaagagaccttccgtcagttataaatgattgccgcagtttcggattaagagaattaatactttctataatttatattaaactagctgaacgggtttatgatttaaatcacgctataggttataccagtctagaaacagttaaacatatggttcaagaaactttgtctacctatgtggaactagcggaaagattacagagccctgaaattaagaatttattaacatatgtagcgaaaaaagcgttggaaaatgggcgtaaaaaatagcaatgctaccatttcataatcgaca

SEQ ID NO: 93012 - DNA, 521 bp, Heterodera glycines
  SCN-specific regions: Sequence locations=1-521
gcctgaagaaaatgccggatgagccgctgatcaccgaacgaatcaacgaaattctggaaagtgccgaagcaacgcgaggatcccaacagccgtggccgccgcgggtgcgtttgaaagtgatttactcgggacgatggttggacattccgccaattaacggaagaaaatgggggccaaatcattttgccggcaaagtggcgaacgcagcggaaatgatcgttgtccgtgctgttcacccggagaagaaggcgaagaatgtgaacgacgaacagctccaaaacattttgggaagtcgtacggacgacatttgcagcgtggacgaaatggtgggcaagtactacacccaatgtgacttcaaaagtcgtctgagtgttctgtccgaaataacgatgggaaaacagctgcaggaatattccaacaccgaggcgaccactcaattcaaattcacggcagcggacaaagcactgagcgatagcatccgaacacaaatcgacgcgatgacagccaaagtgaagggaatg

SEQ ID NO: 93013 - DNA, 132 bp, Heterodera glycines
  SCN-specific regions: Sequence locations=1-2,24-110
gcactttttgtgttgtatattttcccaacctcttttttcattttgttttttttttttgctactttttcaaattgtctccattccttttattgtataaatttattctaattaaaaaaaaaaaaaaaaaaaaaa

SEQ ID NO: 93014 - DNA, 310 bp, Heterodera glycines
  SCN-specific regions: Sequence locations=1-56,78-310
gtgttggacaaagtgtgccgcacctcagcggtgaagcaggtgttacgccgccaatttgccaatgccaatgttcaaattgtgaagcggggccgagggacagttgcgctgaagaaactttaaaacaaattcgagcagcatacaacttctaacatggacatggctttaatcccacaaaaaaaatttacttaaatctcaaaactttttcctcctatatgctgattgattttaatccctgttttaacataatgttttaaatggattaagtaattggtaaataaagacgacgacacccccaataaaactttattac

SEQ ID NO: 93015 - DNA, 412 bp, Heterodera glycines
  SCN-specific regions: Sequence locations=1-412
tcttcctgcaatgctacccccgcaaaccactccactctatttaatgtctatccatttgattcagaattcctgacgagactttggcggggccgatttccacacaaaatcccgactgatcgtacttgtgcttacgaaattgactctttataataaggaggacttgtaacggtacaatcgttacgcgatgcaccgatccatgacatatataatgctaaaacaacgatatgctctccgacaacagcaaccataagtctccctctacactcaagcgctgtccatcatgtcctgggtgtacatcgggtcaatcaacttcgacatctgcgaggagcacctgcgccaagtgtctgcaccgaacgggcccatcaaactgatcaacatgtgccgggatccgcccaccgacaatcacaaggct

SEQ ID NO: 93016 - DNA, 486 bp, Heterodera glycines
  SCN-specific regions: Sequence locations=33-486
cctcgtgccgaattcggcactaggagaagatgaattgattccatgtctatacattatgtttaattcttataaattgtcaaaacttggcattgccatcgattccatgtcgtacatttttcaaaatctcaacggcatgcaggaatttgttggcatttctccacaatccgccaaaaacagctaagattttgtcatgcttgaaaattttctgtacaacaccaacccgctcattttgcatggcaatgggccgtccaagtcgcaactgaacgtgctggagaattacttgactcgtggcaaaatttatcaagtctttgaagtgagtgtgttccaacaaagttggaaaaatgttgaggacattacattcgtacccgaagaacacatgggcaattctacaaaaaattgtgaataatatgataagcaataatcgtgggtgaatacacatttttaatttggtgcaatttttaattaataaatttgtgtaattggcaa

SEQ ID NO: 93017 - DNA, 584 bp, Heterodera glycines
  SCN-specific regions: Sequence locations=1-584
ccaccttcgtacacttttccattaacatcgttttttttgtgccgttcatttcgggcattcttccgcttatccctttcatcagctcatccgccgcttcatttggcgtcacctccaaacaatcgccgctgctcaatttgggaggggcagtgaataacgccaaagaattgccggtgttggcaggtgctatggttatgctcagtttgtttcagttggccgctgcctttagtcttctcctttatggctgtcgaacattcgggcgcacaatgcgacacgtcgagaacattcagcgagggattaacgccctccaatcacaacaaaaccccgggggcgaaattggggagcaagaaaaagacgccggaggggaaatgaggcgaaagctgtgaagaaaccgatgaatttctccataaattaataagacttacaattagtctaaaaaatcgcaatttttcgcatcattttgttcattttcccattttttaacttattttcctttccttgccactcacgcaaattgacagcgaaggactgtaaaagtcatttgaatttagttggcataatgaaatgaagtgaatagcagtgaaaaa

SEQ ID NO: 93018 - DNA, 409 bp, Heterodera glycines
  SCN-specific regions: Sequence locations=1-165,189-409
accagagccaattgtcattcgtggagtggggcacctaaccatgtgtggccttaactcacatttttcaacggaaattcctagagctctgacaggaaaagtggcaccggaagagtttgacgacactttgcaacgtgcgaattacgatcttcataggaatgagagcagaaacttgcgctgggtgatctgcggagtgctgttttgctgctgcaccttccggatttcagtatggtcggtggtatgtctgaacggaacgactattgccgctctcgagaaaactctggaccatgataaccaactagtgtactacaagctcagcttgcattggaagatggccaggatgcccgatgacccgatcaatcgcctgacataatatgtgcttctgcttgaaacgctgtcacgaattccgctt

SEQ ID NO: 93019 - DNA, 294 bp, Heterodera glycines
  SCN-specific regions: Sequence locations=1-216,245-273
gacaatcaaaatccgggtgtccaatccgaactattcgacgtcgacagaacgccgtttcggcgcttggattggcggctccattgtctcttcactgggcaccttccaacaattgtggatctcaaagggcgaatacgaggagaccggaaagtccattgtggaacgcaaatgcccatgacggtcaaccgacactaaataatttgcttcctttcccggccgatttaattttttcatttttatttattttggttggttaaaataaatggctagcttatcaaaaaaaaaaaaaaaaaaaaa

SEQ ID NO: 93020 - DNA, 637 bp, Heterodera glycines
  SCN-specific regions: Sequence locations=1-181,214-450,472-637
ttgagctcaattctctaataaaaacgaattttcccctaataatattgaagaattgaaatgtgttgctcggataaatggacctgttgttgctgttgccatgtgactaaaggtgcgcatgttcttgcctggttctgcctggccattggcatccttatggtgccagttttatggttctttttagctgcttcacttttcttgtttttcattggacttctgtgggttctaccgtacttcaccggaataccgataattttgggcgaattgcgcggaaagcgaacccatcgaatgtatttgccattcctgatcgtttttggaatcggcctcgttttcatgatattttatggaggagctgatatatttgtgaaaatgaatgaaaatgtaccgaacaactcaaccaacgcatcagcagttgaacataatcgcaccataaaaaaagctgacaccgaactgagcaaaaccacacttcacacaattaaaattggttcctatttcttttcttggtttctcacattggctctgaatgtttggctttattcaattgttcttcgtgcctacttttttatgaagcgccaaaatcaaaatatgaatggcgcagaacgaaaccaaaaatttgaaaacattgcactttgattactca

SEQ ID NO: 93021 - DNA, 623 bp, Heterodera glycines
  SCN-specific regions: Sequence locations=1-7,29-464,486-623
gttattcaattttctattgaaataattaaatgccgaagccagaagctttggtggatcgtatgaagctgttgttgagcacaggcgaagacgcggatgtccattttttggtgggggacgaaaaagacaaaaagctcctgaaagcacacaaaattgttctgaagtcggcttccgacgttttcgaggcgatgtttcgttttgattcgcaaaatgcaaaaaacgccgctggggaggccccttcttcttctgccgaattgttcagtgctgtggaggtccctgacgtcgacgccggtgcatttgaggcgatgttgcgattcatttacgagggcaatttgagcgaattgaatggagaaaatgccatggcattgctttacgcggccaaaaaatatgacatcggcggactggtcagggcgtgtgtgaacattcacattcccaacctgcgcaatgtgttcctcgcgtttgcacaagctcgctttctccaagaaaatgacttttcccagcagtgtttaaattacattgactcaaatgcggactctctgatcagatcggacgccttcttgcaaattgatcagaatctgctgactgagattttggagcgcgatcagctgaaaattgagcacgaaatt

SEQ ID NO: 93022 - DNA, 638 bp, Heterodera glycines
  SCN-specific regions: Sequence locations=1-494,570-638
tttgagcccgacatctcggctgtggtaacaggcgatgagacgtcttctctaccgatcaatcgattccgcccagttatgtacacggagggcgagctggacaaaactgaccttggccaaccaccatcgaggctctgctcgaatacctctaattccgtcggttcagcaggcgatagaattgccaaacttgtcgtggacagtgcagttactggtggttgaacatcccgcaggagcacatgatgccctggttgggctggttgcagcgtcagttccttcaatctccgtgccgacgaacttcgcctggcaattgtcaaggagccaaggctgatccaatttggcgccggttccaattcaggcgacaaaatttcgcagagtctcgttatttggccaccaattgctgttgctccgttttcgtcgttcctcattttcgccatcgtcgtcgacggcattgttgttttgtccgttatttcgtgccgccttcgcaacggttggagcaaaacaacaatcaaccgcaacagaacaacacgagcagaaacaaaaagaagcgcaacaagtacaacaacaacaacaaccgttgaaaatgcgaaattgcgcatgggcaacaatcggcggacggcacggctggcccacgctaacgacaa

SEQ ID NO: 93023 - DNA, 637 bp, Heterodera glycines
  SCN-specific regions: Sequence locations=1-12,35-352,374-586,608-637
tttgagtgttcgtcaataaacatttatttattgatcgtcttccttaaaccctcggaccgaacaattggcgcagtcacaaaaatttggactttgctcacatcttcgggccagttttcccgagttggtcgacctgttgcccattcaattgtccttctccgccctgtactttctcatttggttggccgcaattttgggcaatgcttccgtcctttatgtggttagcttaaaacaggtccaattgtcatcggtgcgttcggtgttcatctgcagtttggccgcatccgacattctcatgtcgttcacttcattgccgatcaccgccatttcaatctttacacgtgattgggttttcccttctccattttgcaaattgatgggcattttccaaggcggcacagtttttgtgtccagcttcacactgaccgcaattgctgttgaccgttacattctcatcaaacacccgacaaaacagaaaattgaatttcgcaccgcaatttgcattgttattggcgtttggacattgggttacgcttgtgccttgccggttggccttttctcatcaacacaagaatatccaccattttgcggcacattttgtgaagaaaattggccagacacggaagaacagacggggaga

SEQ ID NO: 93024 - DNA, 479 bp, Heterodera glycines
  SCN-specific regions: Sequence locations=1-47,69-143,165-479
atgttttcattaattttcttttttatttttgctacaatttctcacttaaatggaaatgatgatgaactttgggacataaatttaagctgcaaacctctttattaagagtttagcagccaagtactcggatttggttagatgtgctgtggaaaacaattctccatcccaagtctgcacaaaatgtgttcgacagtatatcaacttcagcgaacaacattatcagagtctgcacctggcaaatactacttcattggacaaccgaacatgcacaacagtcatttacaacagttatcggatcagttacgcacagaaaatgaacagcgcactgagtgaaagcatatgggaagcatcaaattgtcatgattgccttcgcatcgattggaattttgaacatggtaattccacctttgagttcgacaataaaacggtgcaattcaaaaattacttgtggcaatggcgaaattgcgttgtccaacaga

SEQ ID NO: 93025 - DNA, 79 bp, Heterodera glycines
  SCN-specific regions: Sequence locations=1-56
tagcgctcttaggctccaatagaacggaagtgtccacaatagaactgttccatgggtaaaaaataaaataaaaaaaaaa

SEQ ID NO: 93026 - DNA, 58 bp, Heterodera glycines; identical to SEQ ID NO: 76953
  SCN-specific regions: Sequence locations=1-58

SEQ ID NO: 93027 - DNA, 516 bp, Heterodera glycines
  SCN-specific regions: Sequence locations=1-134,156-270,292-516
tgtattcgcggagatggcaaaaatagctctgacaatgtgcaattttgtgagccaaactacatggagcacaaaagggcacaacaaaggaaaacaaaacaattgaaaatgacaggtgctgcacaccgctgaacggtcctgtcagtgatgaagaacggaagagaagggcaggtaatcggatgacggacccttcgattgaatttgcctctgcgacgcctctccgtcatcttcctcatgttgttgctgctgctgaccatcttcgacgtgattattcgtcctgcctccgtcgtcgctgccatttacaacacattcgttctcatcttcatggctgtcgacgtcatcgtcctccgacacacagttccccgcctcgtccgaactaacagccgctgccgactttcgtacaccgttgtaaagaccggcacagcttccgccacttgtcgtcgacgcgttgcttcccgtgcgcgatgccttttcctggaacaaatttgcgattgttgttaatgtataaaacgttttggc

SEQ ID NO: 93028 - DNA, 565 bp, Heterodera glycines
  SCN-specific regions: Sequence locations=1-275,297-338,363-485,507-565
acggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaaggaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacggcgttctcctcgtcggctacggtaccgacgaaacgcacggtgactattggctggtgaagaacagttggggcccgcattggggagagaacggttacattcgaattgcgcgcaacaaacaaaaccattgtggcattgcgacgatggcatcataccccgtggtctgagaaagtgtgggaatgaatgggacgagaagggatcagaagaagaagcaggcagaccaaatagaagcaattcacaatcattatcattgttatgctttttggtaata

SEQ ID NO: 93029 - DNA, 306 bp, Heterodera glycines
  misc_feature (284)..(284): n is a, c, g, or t
  SCN-specific regions: Sequence locations=1-231,276-282
cccacttgtccggcacagtttggcaccgaaagggaattacgtgcccatctcaaggcaaatttggtcatctgcggtttttgcggcaagcactactgctccgagacgcactttcagtcccatcggtgccctctgttttaaaagtgccatttgatgtaaaacacaatgaattggagatgatccttctgttttattttacgggattgtttcacttttcatttcttatttccaaacaatttttcttaatttgtaaattctttattatttatattaattttcacctttanaaaaaaaaaaaaaaaaaaaaaa

SEQ ID NO: 93030 - DNA, 286 bp, Heterodera glycines
  SCN-specific regions: Sequence locations=1-92,114-263
gttaatgtaacgacgaattcaaatcaaatttctgtttacgctgcttcgaaatttcgcgttgacataaatgtctcaactcgtgacgagtcgcatttgaataacaaatacgaaattctcatggaaataaatacaacagatggaggaaagcagacaattttgcttgattcaaaagcattggtatttttacatgatcaattggatgcgctgactcggacttttcccaaatgttatgtttgtgttgatgaaaaaaaataaacaattttaaaaaaaaaaaaaaaaaaaaaaa

SEQ ID NO: 93031 - DNA, 597 bp, Heterodera glycines
  SCN-specific regions: Sequence locations=1-58,89-416,467-597
taatttgaaaaaatgtcatcatccatcgcttcgccagatacatttttgcgttcagaaactgatcaaacaccagcagcatcagcagcagaagaagtgggcaaatacgaagtgttcagttggcacggaaatttgagtgatcaattgtcagctgaactgttcgtcactgatcagcagctgctgaaggaatgccgagaaaaacttgcgaagtccgaattgaaggaaacgaaattgctgtggaataacggtgaactgaatgctgaaaatagggctctcaaagcagagttggaaaagcagaaactgatgacggaacacattgaattgaaggcaaaagtcttcaatatggagcaggaaaagcagcaatttgagaaaaaatacgtttctgtggatgtgttcaattcattggcggaacgcatcaaacaattggaatatcagcagcaggagaagagagaggaggacagaaatgtttctgttggccaattgttggagaaatttttggcaggggaaaagcagcaaaaacagcagaaaaaggacaacgctcagcagagattggatggaaaatgttctgtggtggacaaaaacaatgtcgcgggaacttca

SEQ ID NO: 93032 - DNA, 475 bp, Heterodera glycines
  SCN-specific regions: Sequence locations=1-475
gtccatttaagccaaaaccatattttttgtcttccatataatttcatttctatggtttgtttgtcgcgtcctcttcaaattgttgtgaaaaaaggcggtgaaacggtttggaaggaagtttccttcaacaaattgccaaaagaccaacaaaatgcgaatctgagcagaatgcccatttatttcctcgttttgcccttttgtgcggcatcttttggttattatgcgatggctcagtaccaattcaatcccgagtcttgggttgcaatccaaatcggcaaagtcactgacattctattcccgtcacaatcgaccaaaagtccgaatccgataatttcattgaagaacaatgcactgacgaattataaggaattcattgaaacagaaagggccatgcgaagaccgacggaagaagtgcaaatggagacgaaaacggaggaacaaatgagaaaggaagcggaggaattgtgggaacagc

SEQ ID NO: 93033 - DNA, 616 bp, Heterodera glycines
  misc_feature (201)..(201): n is a, c, g, or t
  SCN-specific regions: Sequence locations=1-101,123-288,310-616
caggaactcgtggccacggtattacacaccagtccttcgggaatgctgccggcaactaattcgccgcgtggtcgtactccgattgatgctgaacgacgtcactgctgaaatgccacacggagcaacacttctctgcggaaagaaacggaccaagcggaatgcggaccgctgataccagaataaagaacttgtgtgcgaatnataaacgcacaatggcaaacgtgaccgctcgtcagaaggtgactcgactttgaccaaagggccacagcaacggaaccgccaaaggcggcaggaaaacgctttctctctgcccttttgccgggaaagaaaaaggtacgacttggcctttcaatttcggagcctccactaaattttgacatcgaaccgtccaagaatgactttgaacccacggaaatcaaaaggggagaaaatgccaaaggaggacaaattgcggaccatcaacagaattttggggagaggaaccgattatgcgatggcatttcggacggaagtcgcaaaagtcggccgaattttgcaggggcacttcaaaatgtccgtgaaaaattgaacgttcgtccgtcgtccaattcccaccgctcctccgccttttctcctc

SEQ ID NO: 93034 - DNA, 256 bp, Heterodera glycines
  SCN-specific regions: Sequence locations=1-231
cacgtgtcgctgatctgagcagcaagcagcagcagcagcagcgagtggacgaatttagtgctgggcaaaacagtggaatggcacaaaacgatggaaataatgccaacgaattaatggacaatttaaagctagcagccaatgtatttaaaaaagtgccgattatatttatccgtatttattttttgactgttatgccattgtatatatatgtatgatcataaagtttaaagcaaaaaaaaaaaaaaaaaaaaaaaaa

SEQ ID NO: 93035 - DNA, 626 bp, Heterodera glycines
  SCN-specific regions: Sequence locations=1-57,79-626
gaaagttcgtcgacaatgaatattcctccgaaatcgttcaatttggctccgattgctgagcaggaagggtgtgatctcgaccggtccgtgtcctcgtcgtctttcactaatcatcaacagattgggcaagcgcgaagatcccatcccaggggtatgccaaggatgattcggctgagacggaagcggcgggatgatcctttcggcacgctaattcaatcgaccaagaaaatgcgacttaacgaccagtggaattcttcggaggggcaagcctctggcgtagaagggactacgacaattgcgaaaaactttgcaatgattggggagagagcgccgagtggaagccataacattagcaaaatggatggtgtgctgttcacggaagacgaggaagacgaattgttgttttattatggcggacaggacgaggaggacgactcagacgcggacggatacgacgacgaatcggactcaaacgcggaagaatactacaaaaatgactacccggacgaagagaacggcaaatttatcagtttcgcggacggagtgcgcaccaacgaatatgaaaacgactcgacaagtggggacgacaatttcgatcattacggtgacgaagcaacaaaatatgg

SEQ ID NO: 93036 - DNA, 480 bp, Heterodera glycines
  SCN-specific regions: Sequence locations=1-7,30-480
tccaattaagaaaatccataagcaaaaaattctataattaacaacttccgacagtaaaacaattgatcgcaattgcaatttctaaatggcttcgaaagccgatattactcagctgcctacgacatcgtccactgtccaatcgcctgctgcgcttccctccgccgagggtagtgtcaatccacgtcatgcttcgccttcctcacaaacgagattcgccgccaggaacaccaacaaattaaataaatccaataatggcgccaattcatcgcggcgacctcatcaacttgaaaatcaaaacacatccgagtcactggcattgtccgcgttcgtacagtcatcgtcatgttctgcgaatgaccaagataacaatttggatggtaggaacagcctgcatgaaaattacgacaactacgactctccatcagttggagcacctggaaatcgaatactaagcgaaaccaatctgtacattagaggact

SEQ ID NO: 93037 - DNA, 351 bp, Heterodera glycines
  SCN-specific regions: Sequence locations=1-73,98-351
ggagaaaccatccgaaaaagcccccgagtgatttgccatatattcgagtcggaagagtcggcattcattgcgcagtccattggccaagcatttcaagtggcatacgtggaatttttgagggccaacggaatcgaagacccaaattatttgcgagacattgactatcaggaagtgctaaactcacaagaattactgggcgaagaattggaaatgttggccaggaaagagacgcaaaaagatgtggtggtgtcgaaaaagtcgggggagacgctgggaattgtcgtggtcgaatcgggctgggggtcgatgctgccgaccgtggttatcgccaacatgtcgccaggggggagc

SEQ ID NO: 93038 - DNA, 614 bp, Heterodera glycines
  SCN-specific regions: Sequence locations=1-614
gtccaaataagaaacaaaaaaacaattaattaccgccaattgcccattggaagaaatgttcagctcttccaatttgtctgctctctttttggcctcctccgttttggccgtgcttataattggcattaaaatggacggaccgacggaggcaaaaggcgccgcccctccaaacgccgcggggccaatgggacttttgcttttattgaatggcaaacaatcggcggctaatgaaaagggaaaagcgccctctggcgaaagtaagccaaatccggggcagaagccgagcggagaacggcgaaagagggacgttttggggcacgccggcggatacgtcggaggatgggaccatcccattgactcgacacttgattgggcaaagagtcagtggaatgatgccaattggctcgccgatgttgtcaacagaaacggatgggaaaacaccggcactccaaccggcggacgatgaatcagtgaattgtgccgaccaaggaatgaaagacggcatttttgtttgggaatttaattgactttcgggatcaaacacactttcctttttagttgcctatttattctaaattagcgttttttctgttcattttctacgcataaatttg

SEQ ID NO: 93039 - DNA, 340 bp, Heterodera glycines
  SCN-specific regions: Sequence locations=1-340
gtcattgcataaccgattgaaagacattcacatcaaattggacagaactcgacgaggcgaagacaggtatctccatctgctcacagaataacacgcggcaatcacaagtgagagggaattgctttcctcctttgaacaattggaagccaatgaacgcgatgcctttaatttgctctcgagtaaagatgacattaaccacgaacgctaaagggaacgagatgaacgtacgaagtactggacggtgaccggctctatggtcggcgctttcctcggtatcttcggcacgacaattgccaacgaactgaggatgagacgcgttctggaaatgattcctagtggc

SEQ ID NO: 93040 - DNA, 627 bp, Heterodera glycines
  SCN-specific regions: Sequence locations=1-222,244-627
gaacaaagtgatggcaaaacgaaagaggttttgtacatcgccggaggcaccaccggccacgtttataacatggacatttggcgcctcgagcggccacttgggcaaccgcgaatcccatggatttgcaccccactgcacagagatgggcttgaaattggtcgttatcggctggagatggctgcacatggccaaaagctgtacactttcggtggcggagcacccgaattttgtgctgaatttgacgaaattctcgctttcgacctcagcaccaatcgtttcggaaagattcgagctcttcccgacccgaagtacggagttcccatcggccggaaatgccatgcgttggtgcaaaaggggaatttggcgtatttaattgggggatgtcgcgacgcagaaacacaacaaaatcaaaatcgaagccatcagctgatagccgacgtttggaagttcgacatgaacaccgcccaatgggtccgaatgcgcaacaacttggcgaaggcggtgtttttccattcggctgcccttacctccgacgactgtttgtttgtgtttggcggttgcaccgacgaactctccgaacgccgctgcaattccctgcagcaaatgtggctccaaccgccctctctc

SEQ ID NO: 93041 - DNA, 187 bp, Heterodera glycines
  SCN-specific regions: Sequence locations=1-187
gtcagataaaacaagcgaaaatgtccaaatttgttccactatttttgtttctgttctcggcacttttgctcatttttctgtgcccgccgacctcggcccagggccgtcccccgccgagtaagtcaggccggccaactcagcacggacgagtgacaacggacggggaagataaagacggcactgccga

SEQ ID NO: 93042 - DNA, 589 bp, Heterodera glycines
  SCN-specific regions: Sequence locations=1-356,378-589
ttggaggagagtttgggcgaagcgaagttggaccaattggaaagatgcaaatcgtgcaactttgccatcattatcgaggtctctgctgaagagcaccgcgtcttcgcctgtctgaagtgccatgccgaacattgccgtctctgtgggaaaccgtgggacgaatttcacttgggaaagccgtgcaacgaagtggagacggagaaggagcaaatgaagcgctattttgaaaacagactttccgaggcggtcatccaccggtgtcggcgttgttcacttcccttcgtcaaacaaatgggttgtaatcggatgtactgccgttgcggggccacccaatgctacgtttgccgggcacacaacatccaatacaaccatttttgccagcattatcggaacccgggccaagtaaagtgcaaacagtgcactttgccatgtttgctgtgggagagggaaagccacgcgacgaaacgggcgattgacggagtgttgcgcgaggccgagcaaatgggcattgcccttgaccctttggagtgaattccttttgctgatgcattggcttttgccttttctgcctgatcaaaccggttgtttt

SEQ ID NO: 93043 - DNA, 453 bp, Heterodera glycines
  misc_feature (432)..(435): n is a, c, g, or t
  SCN-specific regions: Sequence locations=1-291,313-404,430-453
tacaaggaagagatgcttatatttcaagatatggtcatcgacgtgccttacaccgagttgaaccactcggccttttgggtggaattcatcgttcgtcaccaggaagttccccacgcccgctcgggtgcggacgacctgaatattttccagtacttcctcgttgatgtgatccttttcctagtcggcctctcactgctcgtcctttaccttttcattcttttgctcaaattattcttccgtctgatcatctttttgatcaaatggcctttttccgccggttggggcgctaacaaagagaaaaaagggacaaaacacgcaatggctaagaagagagactgatcgacataagcaaattcacttaaaaccgagctgctgactgatttaactggccgtttttgctgagccaatttttaaataaatttttagtttccnnnnaaaaaaaaaaaaaaaaaa

SEQ ID NO: 93044 - DNA, 329 bp, Heterodera glycines
  SCN-specific regions: Sequence locations=1-177,200-270,299-306
gaacagcgcgagtacatctgcgacaaatatgccgattatgtgctgccacttgaggaggccgactggtacgggttggagctgaacacggcgtgccgaaaactgcaggacctcgaggacaacacgagggcacagccgatgaaatacgcatttgagaaggaattgatggcacaattgcaaagggaggcggcggcggacggcaccgaaaagcaaagacagcccaccaaacttgttggatgaggacaattaagaattacgccctgcaattgtgtgtatttttttaaattgaaattaaatttttgtttggttaaaaaaaaaaaaaaaaaaaaaaa

SEQ ID NO: 93045 - DNA, 494 bp, Heterodera glycines
  SCN-specific regions: Sequence locations=1-423,466-494
ctgaaatttaatctatcatttgccatttgctgtaaaaaattgaatttttacaaaaaaagcgatggcagaagtgaaaaaggagcccatttttacggaagtgaagaaggagccaatttttgcagcggagacgccagcagccgagccgagaagggacagcgccgtgtcaacaatgccacccgactttgacgacgtcaccgcagtgattgagggcgttttgcgcgagacgcgggaccgtttccaggcgatggccgaccaaatcattcaccgcattgacgagatgacccagcgggtggacagcctggagaagaacatcaccgaaatgatggcctccgactcggcgctcgtggcgagcaccagcggaacagtggacgaggacaaccaatgatggacgacggagacaaaaaaaaaatggaacatttacaacagcaacaacacaaccaaaaatgatttgtatatgttatgtgtgttgagagagaagattttaaaagtggaaa

SEQ ID NO: 93046 - DNA, 181 bp, Heterodera glycines
  SCN-specific regions: Sequence locations=1-181
ctgtttttgaactgccccaagagtaccaattcaaggaggaaatggtcccacgataaatccatcacatttttggcatttaatacaatttttttacgtaataaccaaatcctttggtttctatcgaaattttctgtaaatgtgtaaaaaaatggcataaaaatacatagggaaaaaaaaaaaa

SEQ ID NO: 93047 - DNA, 482 bp, Heterodera glycines
  SCN-specific regions: Sequence locations=1-111,133-459,481-482
attcattttgtttcttggaacaccttatttttcaatcaatcgccttaaatgatctcctgtcgtcgttcggtcagcaaatgtttgctgccacaaattacgaatcggttgacttccaattttggccatcttcagccgtgctgctcatcccaaaaggtgccaatgtgtgcgtccgcttccaatcgttcttccgtgcgtctttcagccattttcccacgaatgctttcgtcttccgttggtgacaaatcacatgagcggccccaaatgtaccaacttgaacacattcagaaacggttggaatatacggtcccgctgatgttcaacgcacgtctcgactacactttctacaccaaagatgtctttgtggacaatcaaattctcgggagtcaactcagaagcttggaagggtttatgcatcacatttctctgatcactgtcgccgctcaattttgttgcacgcatatcgaaacgcaaattttgaacat

SEQ ID NO: 93048 - DNA, 289 bp, Heterodera glycines
  SCN-specific regions: Sequence locations=1-289
actctcgcctcgacatgaccgcgcggctccatgaccaccaccactgaaaaaggaacgaactccggaaccacagccacgccaactttgtgttcgagatctaacatgaaatatcaccgaagcgcgcttgaaggaaatcttcgctctgtttggggctctaatctcctgtgaattgccaatgtaccgtgtgcatgtgcatctgctccggctatactgctatgagtagtatgaacaggctgaagatgccgataaagctctgaaacatatgcacggaggacaaattgacggactg

SEQ ID NO: 93049 - DNA, 634 bp, Heterodera glycines
  SCN-specific regions: Sequence locations=1-586,608-634
agatgtttcgttttttattgcaattttttgcctttttaagcgtaacaattgcacaaaattttgagactggtgataattcgactgttcacggctgctcaaatcattgctcgtacggcgaccgcgacttgggatgttggaataggagtctgttgttctttgagaaaatactccttggacagatgagaaattacgttgctgttcaaatgaatgtcgatcagtggcgccgtcgcaatgtgcggccatacaaagaggaatttgaggaagccaaacgtcattcaatccacacaatgattgcccaaaagcatattggcgatgatgtggtgaacaaccgaactattgaaactgtggtcggtgcactcgtcgacttggccgccttgcaaagcaaccattccctggtcaaatggatgccccatttccaatgtcccatcccttgtgaacaccgctacaccgtttggcgaaatttattcattttgtcatctgtgctcaatgtgtgcctttttattgccattttgccgttagttaaacgtatgcacaacagcgattccacggagtctctaatccaacgcggatgaattgatttctttttattcacttccaatttgtataaaccttggccatagctgaagtgtgaaat

SEQ ID NO: 93050 - DNA, 535 bp, Heterodera glycines
  SCN-specific regions: Sequence locations=31-399,430-435,458-535
cctcgtgccgaattcggcacgagggctccgttcccgaaatgttatgtctgttccggcaaaggagaggtgattgtacacgtcaatttaaatgaaatgttgctcacaactttccgtcaaaatgttttggtcggtgctttgaacatgttgaagcctgacgtgatggatctctgccaaaaccaccgaattttgctctccagtgaagaaggcgaaaccgactccattttggaccgttctcttggcttattgggagttttgaacggcacgcaattggagtgcgatgactatgcccagcaattgaacttcaagctgatccttttcaacgacaacacactgacgggcgaacagttcaaaaaagtcgaagatcaggcgacgaaaggggcgaaaagcatttctgacgacaaacagaaaagagaaaacgaaatagacgaggaggaaggagtgccagtgaaaaaggcgaagattctctgcgaaacctgaatgggctttacatttcttgaaatgtccatcgctattattattattgttttattattat

SEQ ID NO: 93051 - DNA, 481 bp, Heterodera glycines
  SCN-specific regions: Sequence locations=1-43,66-481
gttcgcgtccgctttgccccctcgcccacgggcagcctccacctcggcggcctgcgcaccgccctctacaactacctgctgtctcgctcccagctcgcgcaaggcagcggcaagttcatcctgcgcatcgaggacacggaccaatcgcgcctcgtcccaggtgcctcccagcagctcgtccgcgacctcgaatgggcccgtctcccctttgacgaaggccccggcaaacctagccccgtcggtccctttgtccagtcgcaccgcctccaactgtatcgcaagtatgcgcatcagctcgtcgccgatggtcatgcgtacaagtgttactgctcgccgcgcaaaccgccatcctctcttgccgctacacccaatgcaacgggctacgacggcacctgccgcgacctgtcgcaaaagcagctcgaatggcatgccggccagccgtttgtgatccgcttccggtcacctcgctcgggcctcaaca

SEQ ID NO: 93052 - DNA, 537 bp, Heterodera glycines
  SCN-specific regions: Sequence locations=1-146,172-344,367-537
taatggacgtggtaagtagtgaaagtgatttggtggccacgtggcaagtgccaatgagtgacaaaatgcacaaaattgaattcgaacacggcacaacgacgggaaaacgaattttgcgggtggacggaaaggaaatcctacgacacgaatggatgttcaaattggtgggcagggaaatgttcgaattgaacggcgttcgctgtgcgattaacatcgatgccgcgggaatattcgcctacgaatattcgctgaccgttggcggaaaagcattcgaaaaattccgggaacaacagaaaaaagcactacaggtttggcacgtgcgaatgggcgagagggaaatcagagtttgtttggagaaagacaccatggacgtgtgggtgaacggctccaaagtgaacacgacgggcgaatttgcagacgaaggcaccaaaacgcacttagaattggccacggggagttcggcatacattttgtcggagagcagcggtaaccgccacatcggaatggtccaccgtttgttcgtcaacgacagtttgg

SEQ ID NO: 93053 - DNA, 556 bp, Heterodera glycines
  SCN-specific regions: Sequence locations=1-556
ctcagcttcccaaatcccgccgttccatttcagtccgtccttcaattacaaaatgcctttctgtgccgagttcgcccctttcctttggcactttttttgccggtgccctcttcaccaaattgtcctttctgcccttttcgtcctttgccacttttctttcgcttcttcttctttccacatttcgccttccaaaatggcaccccttccggcagaattcttcggaccgatgggtcgacgaccgtccaaacattcgtttcgacgccatcaccgaatgaaagtgtcaagagattattggctttttgatgacaatttaaagcgacgcgaaatatgcgaaggtcgacgactcagtccgttggtacaaaatgcgctggtggggcttttgctgggcgaagaggcggctgaaatgccaaatgattctgtcgatttattgcgaacgacggcacttcccctacgaatggcacagaatgatccgctcaatgctgctgactaaccaacgaataatcagtgccacggggcgaacgaaagcgaaatgagcggatattttggcgaaataatg

SEQ ID NO: 93054 - DNA, 542 bp, Heterodera glycines
  SCN-specific regions: Sequence locations=1-101,142-158,183-542
atgaaatggttgtccaccaatcgttgtccgtcaccccaacactttccgccgacggcaccgttttggtgccattggatcagcaacaaacgcagcggcatttggctttccaccaccaccgccattttggccccacttctccgtcttccgccatggcaccgtcttcctcctctgccgccgccgccatgacaccactcggcgtcattttggtgtccaaggacgagtcggccgagcgcgtgctgttcatgtacccatttgagcgccgtgtgtcgccgcactctgcccatattaacaacagggaaaagtgctatgagcacaaggacacagtggtgccaatgattggcaaagaagtgccaaagttgggcggcggtggtatggcggacgacgtgcggtgccaatcagctgcaattgacaggggtgatcagcaacaacaacatctcggcgacagcattgcgttggatggcacttcgattggtttttccgtcaaaatgttggcccctttgctcgtcgccaaaggctccaatggaaatgggacgccttttgag

SEQ ID NO: 93055 - DNA, 271 bp, Heterodera glycines
  SCN-specific regions: Sequence locations=1-271
gcctcgtccaaatttcctacgcaattggagtggccgagcccctttcggtgatggtcacccatttcggcacttcccccttcaaggacaacgaccttctcaaaatcgtcgagacaaacttcgaccttcgccctggggcaataattagacaacttggcttaacgcgtccgatttaccaaaggacggcggagaatggacactttggcaacgacgaattcccatgggaaaagccaaaaacattggcccttccgaagaatctgcacgaaactctgag

SEQ ID NO: 93056 - DNA, 448 bp, Heterodera glycines
  SCN-specific regions: Sequence locations=1-393,416-448
cttttttgcactcgacgaaggactgcctactcttctcaaagggcttttcactttcctctaccagcaaatcaaagaaagtcgtgtgatcgccccgcgggacgggcgaatgtttggactggacgaatttaagagtctttacgtggacgaagacaagagaattgagaagaaatggcgcttttctctggtcaacattcaggacccattagaactttcgcataatgtcgcggctaatgttggcaagcaaagtttggcgtcactccgatggaaagtcatgtatggaattgcaatgttaaagcgttcgcccaatgattttcgtccgcttttccgtttgaacgaccctgaacaactgaaagaggagagacgggcggaaaaggcacaaaaccaagcgatcagacagcagcaaaaccatggaggacgcccgggccgaagaaagggggaaaaaatggag

SEQ ID NO: 93057 - DNA, 337 bp, Heterodera glycines
  SCN-specific regions: Sequence locations=1-182,204-337
caacatgaatgacgaactcatccttccgctcaacgattccattgctatcacaattgatcacctgaccgccaccacacacatcacaattgcgcccgatgtgaacacggactctgagacattcaactaagtcggcattgacatcaccggcatgtcgcggtttcgaaacatttttcagcaaattcgtgaatactccaacaaaaagcaacaactgaagggcgaccatgcttcaaatggttgccacaccaacattgactcaagcacaaattttccgaactcagagagactcacttcatccgccacctattttgccgccattgcgtttggacttggcaaaatt

SEQ ID NO: 93058 - DNA, 374 bp, Heterodera glycines
  SCN-specific regions: Sequence locations=1-353
agaaaatgctctttttcccaattgccactgttttgctcggtgtcttcgttggctcccttcaggggaaacccaccgaacaaaatgccgaaattaagccggcagcacccctcgaggcaactcgcaacgaaatcaaagacacgccgcaacgcacagagaacaaagaaatttcgcgcagcgaaatcaacgaaatcaaagagattccgcgcaacgaattcaaaacggcgccaatcactgagagccgtgaaagaccgttcattaaaagcgaaatcatccgcgacatcagctccgcaatgaacttcttgaacgagcaaatccgggagtactcggaacgaaccaaggacagacaggaggaattcaagggcatcattgaggcc

SEQ ID NO: 93059 - DNA, 226 bp, Heterodera glycines
  SCN-specific regions: Sequence locations=1-62,84-226
attctccatcattgaagactcgcagcgcatgggcgattggatccgccacattcacgaacgtactggcctcactgaatggcagctgatgcgcgttctgaatgcgcttgatcagctaatattggcgcgaatcattaacgaggtcgtgtccacaaagaatacgtacattcagtccagattggagggcgacgacacactgacaggtggcactttttactcagatcctcac

SEQ ID NO: 93060 - DNA, 580 bp, Heterodera glycines
  SCN-specific regions: Sequence locations=1-580
atacagcgtctaaccagtcaccctcggcattttgatcgctacggctattgactatacatccacatatcgacaccgtcacccgtcaccactggttccaaacgccacactcgcgccttggtgctgctctccagttcccgaccctctttgacccttctggcccgcgtgctcttcgccgacctcattcatcctccccccagcgcgtttttgtcgtaccggccaacaagaaagcccaaaaaaccacttactgcgcacacctctttgccaactatctcctcaacttttgttgtccaacatggcatcccaaggtttgtctccggacgtcctcgccgcggaaagtcgcaaggcgcaagccaaatatggcaatatcacccccaagaaaggcctcctcgcgaagagcctcaaaggtcaggaacgcaagtactttgattccggcgactatgccatgtccaaagctggaaaagctggccccgatacaacggttggatctgctcatcccacccccgaaatgattccgcattctcatcccccgaccgtctctgcgtcaacatctcccgcaaaggaaagctccctgctcaaaaag

SEQ ID NO: 93061 - DNA, 531 bp, Heterodera glycines
  SCN-specific regions: Sequence locations=1-531
cttcgcccgtttcttcacggattcctgtcaatgtttcgtcgctcactgcgcgttcagcgcgtcaccgccaattcagtacccttcaaaaaagtgacatcgaagccattcagcaacaacagaagaagcaatcgctgcgaccggtgctgtcatcgtcaaagtcaacggcggggcacaggcacaaaattatgcaaaacagcgaacggaaagtcggcgcaatgagacggaagagcatcgttggggagcaaaaggacgaggagagcgcaggctcaagcaaaggaagcggaaggaaaaagggacgattcagcaatttggcccgtaagctcaacattcggaggaagccaagcattggccttcactccaaacgcctctctccggcgctcgcgccacagccaacgcctcgcgcattgcaaagcaaagttaacgaattggtcgagcagaacaaattgctgacaggcatcaacgaagcgcatgtgctgactttccaagaattggccgcaaaaattaagcaattggagatggaaatgtctgatc

SEQ ID NO: 93062 - DNA, 542 bp, Heterodera glycines
  SCN-specific regions: Sequence locations=1-542
gaaatgaacgaactttccacgctcgcttggtacccggctgccgaatttttggaatttgaacgaatcaacaaagcgtattcgttcaacgtcccagccttttctgtggacacttcgacaacggatgggccgaagtacacacaaattatgaacgcactgtcggaacaattgcaacagcacgtggccaaggcgaatttgctgatttctctcaacgagaaaatcccgcaattcgatgttgaagttgaggaaatgatgcgcattgcaattggccgtacgcaattgctgctgaacaaacggatgaagcaatttcgggaacatttgagccgtcatttgaaaccaattcctggccaaaaagtgaccaaattgaacgatttgcacgctctttgggtgcttatcgacatgcaattggatgacatccgatccattttcaactccatcgagcagttccgtcttcgctgttgggctgtcgctgaaccaaaggccgccgcgactgccgcttctggcaattaattaatcctcagtctttcatcatcatcgcatatttt

SEQ ID NO: 93063 - DNA, 557 bp, Heterodera glycines
  SCN-specific regions: Sequence locations=1-557
atttgcttggcattcgcttctcccgttttcgtgtctttttggctgttctttttttcgccggaatggccattccgggatggacaaatatacgggaacaacttgaaatccagggggagtacaacaatcctgagcaggagagactgtttcattggatagacaaaaacaccagaaaagatgcggtgtttgctggaacaatggcattgatggctaatgtgaagctgtccaccctccgccccatcttcaaccaccctcattatgaaagtgaagaagtccggaatagaactttgctggtttattcgctttacagtaggaaatccctcaccgaagtgtaccattcgctgcgttcttcgaacattcatttttacgtgtttcagccgcaacaatgcatagagaaacacccaaaaaacggatgttcgtatttggaaatgtgggatgagcatgacgcgtccaacaaaggtcgaccatcattatgccatcacatttggaaggcgggaaagaatggtcaacaaatggcaccgtttcggcctgtctattggtcgtcaacttacgttgtgttg

SEQ ID NO: 93064 - DNA, 230 bp, Heterodera glycines
  SCN-specific regions: Sequence locations=1-230
gaagcagcagaagattgacaaaaaggcagcgccaacgaagacgaaggcggccaagcaggtgaaagcgccgaaacaattcgtgggcggaaagcgctgattttgtgacgaaaagatgggatgtgcttgtgtgaattcggggcgggaattttgtttttgttcgagttctttgtcctcctcatttttgttgttgaaaattaaaaaaaccacccaaaaaaaacaaaaaaaaaaaa

SEQ ID NO: 93065 - DNA, 266 bp, Heterodera glycines
  SCN-specific regions: Sequence locations=1-4,26-266
gtccatttaagggttctgttcaccgacgtcatgcaaaattcaatacgagatttgagtgaaattgaccccgcttggttgcagcacattgccccgcattattacgaatttggatcaaatttgcccgatgggagcagaagaaaagcagcggaagaggagagcaattttgcggagggacgattagcaaatctcaattaatttatcaatttgtataaatgcattttgagaaaatataaattatctgataaaaaaacaaaaagaaaaaagaa

SEQ ID NO: 93066 - DNA, 421 bp, Heterodera glycines
  SCN-specific regions: Sequence locations=22-421
agctttttcccattttcctcaaaatgttccgtttgcaatcttttcaaactgttggcaaacactttcgacaggcaatggcaatgcaacaaattgcgaaacgctcaatttccgcttccgccgtgcgtcagtccgctttgcgtgaccctttcttccgcgaccccatcgacctttggctgtacgaccccttgcgtcccatgcgtcggatgctccgccgtgcgtccgatcccttcgcgatgctcgaccatttcttcgacgaccggtgggtccctcatgtccgcgacaacgcggccaaattgggcatcgatgagaagggcaatttcacgtactctgtggacacttccggatatcgcccggaggagctgaacgtcagcatcgaaggggacgaagttgtgatccaaggggagcacaaggagacggtgga

SEQ ID NO: 93067 - DNA, 310 bp, Heterodera glycines
  SCN-specific regions: Sequence locations=1-310
caaaagctttggggaaatgcccaatttgcagcgccttcctcttaatatacaatacgactttttcaatgcggacaacaatgtgtaagaatttgactacacacaactacgcagtgctgccgatcgctctgaagaaacggcttttctgtctaatgccgatgccaatgatacggtcgccgtttgttccgccaaccaaggttcggcccatccgcgggtgatcgatctgccgaagacggaccagggactcggcttcaacgtcatgggcggcaaggatcaaaactcgcccatttacgtttctccgattatccccggg

SEQ ID NO: 93068 - DNA, 579 bp, Heterodera glycines
  SCN-specific regions: Sequence locations=1-411,433-579
atcgaaccggacatgaacgcccgaaaacttccattgccaccaattcgagagggccaacgaatcattgccaatttgtggcacaacaaactgaacaacttctacttggtgcacagttacgtgcttgcggagaagttcaagcagccaggggaacgcgatgaccactaccagttgcccgttcgactccaactcggcacttcgtccgcaagtgccactccgagcacgtcatctgcaagcgaaacgaccagccagtttctcgtcaaagtgaacaattccatcttcaaggacttctattcgtgtgaacaacttggctttgctcttatttctgatccgagacgactgcttcgcaatgcgacgcatctcgaacatctcgatgggtttcccgtttggatttcagccgtgccggatgaatttcgtctcgctcgcttcgccatcatggcactggcctatccaaccaagaactattctcgactcgaaagatccggacggcatccggatattcatggccatggcattttgattgtgtcgtccactgggattgtcttcagcaaggaccacccgcaaactcgcatccgccttctg

SEQ ID NO: 93069 - DNA, 334 bp, Heterodera glycines
  SCN-specific regions: Sequence locations=1-334
ccgctcttggtgagtatgtgttcttcgtgttcaccacagtgtccgttctgtgcattgtatttgcggtgaaattcatgccggaaacaaagaacaaaagcctggaggacattcaagcggaaattgatcgacgccgaggcatcaccaattagccaaagcaatgccaaacggaacggtgacttagaatgttgcacccaataaaacgtgaaatagggatttaattatttatgtgtataccaataagacgtactgcgatttaattatttaagtgtacaccaacaaaacgtgaaattgtgatttaattatttatgtgtacaccaataaacggtgaaactgc

SEQ ID NO: 93070 - DNA, 481 bp, Heterodera glycines
  SCN-specific regions: Sequence locations=1-481
caagtttgagatcattcttccggcactgaccttgacgttcagttccccccacacattgccaaaggcagtgaattcattttccgtttgactgtcgtcgaattgctcaacgttcccaaggagtacacggacgtgttttgtcagttcaattttctccatcggcacgacgaagcattttcaacagagccagtcaaagggattgcgaagggcgaacatcgcacgttaccgtacaattatgtacaggtggcataattagcaaacgcattgccctatcaatggaccatttgcaatgattgcctaattgttccaattgcccttttgaggagttcaaagcggtggtcaactcggcattcatccattacctgcagcactttcccatcattttcaatgttcacatactttataccattttcttttgtttcttttcgcgattttctccaaaattatttttcactatcataataaaataaacgattaattaata

SEQ ID NO: 93071 - DNA, 462 bp, Heterodera glycines
  SCN-specific regions: Sequence locations=1-11,33-430,452-462
taaaattcaccaaaaatgcagcttttcctaagaaatctcgtcgggaaaacaattgtcgtcgagactgatcagcagttcggcactgtccgatcgatcaaagaacaaatcgagcaaattgaaggcatcccaacggatgatcagattttgatttttgctggacacattctgcacgatgaccagcagttggccagcaattgttcttcttcttctgctggcgatttgtcctctggcagttccattcatttgtctcttcggcttaatggcggcggttcgtacgatcgatgcgacccaaaattggtgcaattggccaaaagttttcgatgggataagctgatttgcagaaattgttatgctcgacttcccctgcgtgcgtcaaattgccgaaaatgtggttcatccgatcttcgaaaacggaaaacaatgttgtcaaagcctttataaatggaaattttttattgttga

SEQ ID NO: 93072 - DNA, 91 bp, Heterodera glycines
  SCN-specific regions: Sequence locations=1-91
attattttgtcttcgaaaatttaattgcccaaaatatgactgctatgaaagtgtccatcattctgctcattcttggcattgtgctcctttc

SEQ ID NO: 93073 - DNA, 422 bp, Heterodera glycines
  SCN-specific regions: Sequence locations=1-10,33-422
ttgagctttgtcgcttttccctcgcctcctcttaagccatttttgaagcggaaggtccccggcgtaatggaccatctcatcaccacgccggcccatcaccacgtttcgccattggtccgttctcgttctcgctctgagactcgtgccggcacttttgtcggttaccgtcggacacgatccgcctctttcacttcgaatagtgcgggcggtttcaccctgcccagttacggctatggcggcggatttatggcccgatcgttgagcagatcaaattcgtccttgtcactgttcggccgtggtctccattcgtccgccctcgacagaacgccgccctttcacaacatcgccgtccaacggccgacgccccattacacggacaaatatccttttgtccgctacagttacggcaacattgagacggg

SEQ ID NO: 93074 - DNA, 479 bp, Heterodera glycines
  SCN-specific regions: Sequence locations=1-57,79-317,341-479
caagtttgaggaattattcaattttgaaaatgattgcccttccattgtttgctgttgtcctctgtcttggcctcccattccaatcgatcgccctgttgagttgcaaagtcggcatgtacaccacttatgctgctcatattgacaaacaagagtgctcttctgcggatgaacaatattgcattgcgtacggctgtaagaaagaccaatacgatgtttccatcgtgtggaaatgctcggtgaatgccaattgcgatcagttcaatgccggcggcaaagccgacggtggcggcgccattaacgcctccgtgtgcgaatgcaaaattggggaaaagggtgccaattttgacaatgcaaaattcacatttccgattgcggaggcgaaaacaatggaaattccgtccggccgcagcagccgtgaaaatgcgggcattttttgggcaatgatggcaattgcattggcgtttttgtgccttatttga

SEQ ID NO: 93075 - DNA, 294 bp, Heterodera glycines
  SCN-specific regions: Sequence locations=1-256,278-294
gctaaatcagccgaatttattgctcacggttggttgcgttgcgacattcaaagagacactgtaaccggaagtgaacaagttttgtatcactgggggcctcgatcagaaacggtcgtcagcaaaaaaagaatgctcgaatctttctgtgacatctacggaacaaatccgaacaattttccaaaccatgcgaaagttgcaggacttcgagggaaatgaactcgaatacatgaattgaagaatgatctctttggttattaaatttattgaaattttctttggctattaatttactga

SEQ ID NO: 93076 - DNA, 585 bp, Heterodera glycines
  SCN-specific regions: Sequence locations=1-206,228-585
gacaacgggaaaaaactgtcgggtttggtcgaattaggctatcggaagagagtgctgcagcggttgggttacgcgactgaggaggacaccatcacggaaaagggccgtgttgcgtgtgaattgagttcggccgacgaattgctgctcacagaaatgattttcactggcgctttcactgatctttcgccggccgatgccgcggctttgctttcgtgtttcgtttttcaagagagagcaccgattggcaaactaagcgattcactaagtgaacatttgcgcactatgcagggcatggcaaagaaaatagcaaaaatctcgattgagtgcaaattggaactggacgaggaaaagtacgtggagtcgttctgtcccgcgatgatgaccgttgtctccaagtggtgttcgggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgtt

SEQ ID NO: 93077 - DNA, 247 bp, Heterodera glycines
  SCN-specific regions: Sequence locations=1-247
atcgatgcattttgggatcaagggacgagaaatcaacgtccaatgtttcttcagcattggctattaccagtgatcacggcatatgatagctgacagattccgggtacgctcaacaatgaccgcctatgcacttactctccagacaataaacggccgtaaaaagggtggagacattccattcagcaatgaggagcttgacggactcatcgcacacggcacagctttttgtttgccagaccgattgtta

SEQ ID NO: 93078 - DNA, 593 bp, Heterodera glycines
  SCN-specific regions: Sequence locations=1-439,461-593
acgaggatttaatacaggttaagctttcgactcacgttcatttaatgacaatggattaccttgccgagctgatccaagaaaaaggcaccgttgctgcctttcacaattacttcaaacatgttgaccgcctcatcgatcttgagatagctcgtgtccgtgcacaactcttccatttcaacacagacgaagatttgcccaagatgcccgagcttgatcaggaagacatcgtcacgctgcatgagaaggtttacgtgccgaaaaaggagcatcccgagttcaacttcgtcggccgtattctcggacctcgtggcatgaccgctaggcagttggaacacgagactggttgcaagataatggatcgtggtcgtggatcattgcgtgatgctgctaaggaggaaatgaatcgtggaaagccgagtggggagcacttggaagacgatcttcatattctatcccatgtgaggacaatgaaaaaagtgcgcgctccaactcgaacaaccgtggataaagtgaagaaatgctcgtcccatcgcgtggacggatcaatagtttaagggcaaccactggtggaactgaacatcttaacgggaact

SEQ ID NO: 93079 - DNA, 136 bp, Heterodera glycines
  SCN-specific regions: Sequence locations=1-74,112-136
cacaaatttaaattatttgctgaatctaccgaatggtaaaaaaagagcgaagaaagattaaactctttttttcgttttttttaaatatttttaattttatgtttttttttactctaaaaatttccataaaattcgc

SEQ ID NO: 93080 - DNA, 396 bp, Heterodera glycines
  SCN-specific regions: Sequence locations=1-230,252-279,301-396
gccaactcacagcactgaaagggatcggcgaaatgggaggtcagagagtggaactgaacacgggagacgacagcgaggaacaagagcaacgagcgatactccggcgattgtacagcaaatacgggtcgaacgcgagggatttgcttcaacgagtggagaatttgctgttgttagccgaagatggaatatcggcaaaaaagacggtgaacgaacccaatgatagcggaaaaagccaaaaaatgaagagaaggcaagcggaggaggacaaagggctgatcagaaaatatttggagcaactcatggacagcgagacgggaagaaataaaaccaaataaaagacaataatgtacataattatagattgtatgaaaatatctatttataaatttagagtta

SEQ ID NO: 93081 - DNA, 425 bp, Heterodera glycines
  SCN-specific regions: Sequence locations=1-425
acgaggtaagtagcaaaaaatgtcatatttttccgctgacgctgatgcatctgagcttattactgcccaacgacgggacgatgagcaaattcagtgggtctatgacagaatgtccgattgcgtattgcgactttttggggagcggatttggatcggttaccatcgttggcttccatcgctggccgctttcatttatctgtcggcgaccaatttgcgtgagaagcagtccgttggtgaggaatacgtcggactcgtccaaattggctccgatcgtcgctttccttcgcttttaaaccgactccttttcgtctttttcgaagtcatttctcgtgctccgttgctcagttttctgttgcttcaacaacatccgcttatcctccaaatgcattcactttttcatcccgtcggaatcgaccaaattcatt

SEQ ID NO: 93082 - DNA, 452 bp, Heterodera glycines
  SCN-specific regions: Sequence locations=1-339,362-452
gtagtaggatgattctgcccgcgttttattcctttacctttggccttacttcatgcacttcggctacatttcgcgatgaggacgattcgtggaattggatcgcagcaagtgccatttgcggactcgcccatgccactataagaaataacataccgcaaggatttgctttggctgctatcggctctttgttgggcgtctcctttcaagctgttcgaatcagtcacaacggctttggaatggtccacaaccgaatgactcaaggctttcttccgtttactggcccattggactggaagcatattccaacggatgccgttgatgtgttcttcgaatttggcgcagaatcattcacttttaggcattttttgcccaaagcttaaaaagaccaagtcaagttcattgactgtatttgtatggatttaggaaatggtacaataaagtttaatgtattt

SEQ ID NO: 93083 - DNA, 576 bp, Heterodera glycines
  SCN-specific regions: Sequence locations=1-482,508-576
gtattgatcgcggcatccattttcaccaaatcgggcaaagcacttgtgacacgccaatatgtggcagacatgaccagagcacggttggaaggacttttgaacgcttttcccaagcttatcacttcggataaagctcagcgccaacatactttcgttgagacaaattctgtacgatatgtctatcagccgatggacaacatttacatggttttgatcaccacgaaagcatctaatattttggaggacctggagacgcttcgtctgttttcccgagtgatacccgagtattgccgttccaatgatgagtccgaaatcactgacaaggcattcgatttgattttcgcttttgacgaaattgtcgtgcttggttatcgcgaaagtgtcaacttggcacaaatacgaactttcactgagatggactcgcatgaggagcgtgtgttcaatcaaattcaaattgctcaacaacgcgcagcccatacactgatgaaagagaaggagaaggagataaagcggcaggaaaaactgaagaagcatttgaagggcggaattggaggtacggctgcatccgccacgggg

SEQ ID NO: 93084 - DNA, 524 bp, Heterodera glycines
  SCN-specific regions: Sequence locations=1-524
gtcaggtaaaaatggtgcaagtgataataggcaacaaataattttaaatagctgattttaggctttgtttcgaccggacaattatcttaaccggcttaacatggccgagaaaaatcgctcagaaatggtggacatcatggctgcaattgctttttgcaaccatatgtcaacggatgcctttctattggctgctcggttgtgcgatgtgtttatgacaaaaaaaacacagacaatgacaaggaagaaggcacacaaattgtcggttgcggctattaacatagggagcaaattcgatgtgagtttcatggacactttctattactataaatggagaaaatgttaaaaagcaaataattttaggaccgctattctccatcattggagtcaacctttacaaaaatatggcggacgaaattggaaaaatttacgcaaatggaattgtatgagatggagtttgaaatattggaaacgctggggtatgacacatatgccccaagtgcaaatcattttcttgtccatttctt

SEQ ID NO: 93085 - DNA, 417 bp, Heterodera glycines
  SCN-specific regions: Sequence locations=1-417
aaaatacaggttctgaaaagtctgccattgtacggtgctttccatacaaaaatgatggaaaaagcggcctcaaaagttgccgaatgtttgggaagcattgaactgcgcgagccacgcgtgaatgtctactcaaatttcaccggcaaatgccacacacgtcgtttgacacaaatgcgcacggacattgctcggcaggtgaacaaccccgtcaagtgggagcagatcatgcagattctgttcaacaaacgcaaagacgaagaattcccttcgtattttgaggttggccccggccgcgaattgggcacaattttgcaccaaattggcaaaaaagcttcaagaacatatgtgaactatcccgcctaatttgttatttttctgttgttacattggctatttgagaaaataaaaatgaaaatt

SEQ ID NO: 93086 - DNA, 377 bp, Heterodera glycines
  SCN-specific regions: Sequence locations=1-43,65-101,142-269,291 -328,350-377
acgaggcttttatttatttcaaattgtattcattaccattcaaattttactttttacataaaaattttgtatcccttttcttttcgatagaattttctaacttttaaatcccataaaatatttgttcaacagaatatttatatatgtatcacaaaataaactaccagaatgaacagctgtgtttttggcttttacatttgattacattaattaccgttaattacgtcattgtatcataaaactgtcattggccttgccaccgttgtcctaattgagggcaactctgtgtttgatgagttttacttatgtacaattttgatttctcgtctaaatttgaattacttattttaatgatcagcacttttttcccataaatt

SEQ ID NO: 93087 - DNA, 476 bp, Heterodera glycines
  SCN-specific regions: Sequence locations=1-300,322-476
tggaggagtcgccgctcgaagctcaaaagcgtgaggaaatcctccgcatgtaccaatcgtgcaaggaggcgctgcgcatcatcagcgacgtgaacatggccacgatggccaccgatttgccccctccggtggtgtcaccggcgaacgatttccgcaacaattcctcgccagtgccacggcccgccccggcgcctcctggccaaattccgacaaatcggccagctcctcagcctccgatgggtgcccgtccgattggcatggtggccggggcacagccaataatgccaatccaaaaccgaccgctccccgggccgccgggacaagcgccaatgcctccgatacatgccaacgatttgaacaaaccgcgaattccggagagaccgcaaataccaagcagacccttttgactgtgctgaagggaattcactaatttctaactaatgagtgtgttttctgttttaatgccaatttcggaa

SEQ ID NO: 93088 - DNA, 241 bp, Heterodera glycines
  SCN-specific regions: Sequence locations=1-241
atttcgagtgcccaacgcgattgccttaatccgtttgcctgcgcctggaaagacttatatttcacacaaactttgccgttatctgaattggattggcatcaaaactatggcattcaatgtgggggagtaccgtctccactcatgccatttcttccagccatgagcatctgaattctttaacccaaataatcaaattgggacaccgatcacagaccattgcgcaaaattggccatggaggac

SEQ ID NO: 93089 - DNA, 596 bp, Heterodera glycines
  SCN-specific regions: Sequence locations=1-457,479-596
tcagatctgaggacattttgccgaggaaaaaaagaccattgtccgccacttctcattttgacgatgcgccagcgccaaaacggcagacactgcaagcaagtgaacccgacaataaaatgacgcggacggatcaaaagcagacagggaaagggccgcaaaatgtcatcaaactcagactggccaaacagaacttccgattgctgcaacaaaatcgagagcaagacaaaaaggcggatcagagagacaatatggacagcagcacatcttccggcatgagcgaaagtgccaatacgccgagggcaccgtcgtcaaatttggcggaagagccaactcaacattcagatggaaagctgtcttcgggtcaaagtgccgtcgccacttttgctccccgttttgaaaacggaaaaaatttgtccgtggatcattttgcaagccgcgctcgtgaacttaaaaaaagtggaaataatgagagggataaggtgcatcagattctgctttacttcgaatccgtcgctttttacataatgacagcgtcttcactcaactcaaagcccgaaaaaatgcactcatcattgactgacgtagtcaatttttta

SEQ ID NO: 93090 - DNA, 210 bp, Heterodera glycines
  SCN-specific regions: Sequence locations=1-143,202-210
cgaaacgacctagcaccgccatatgcgcaccgtgttgctgatgtgctctaagcgcgccttgttctcctcatattgacgatcaaagtcacgtttgtgctcgttgagcaactgttctgcactgagtcgatcagattcggattggcttaattttaagaaaaaaataaataaaataatattattaataaaaaattaaaattatttggaaatgca

SEQ ID NO: 93091 - DNA, 588 bp, Heterodera glycines
  SCN-specific regions: Sequence locations=1-201,223-517,539-588
tgcccattgggcatcgaagaggtgaagccgcgttctctgcgctttacttggtcaatgaagacgacttcgtcacttgcaccggacgaaataatgaaagaaatacgaaaagtactcgacagcaatggatgcgaatatgagcaaagggagaggtatttgttactttgtgcacacggcgacccaagcaaagactcattgatacaatgggagatggaggtttgcaaattgccaagactttccctcaatggagtgaggtttaaacggatttctggctcttcgatcgggttcaagaacattgcttctaaaatcgctcaggagcttaacctctgacggttttgtgaaatcggatgctgcctccaaaccatttattgaactttgtcttcgatgttgtggattctgtttctcaaataactaattattgctaacattttcttctgcatgcttttgctctgttcgtgcttctctctctattcgtttgttttatcttttgccactatcgcttttttggtcggtcggtaaccaattttcttcagtttctcagcgacaatattcttattgttcgtgagtatttaaagataatttaactttcat

SEQ ID NO: 93092 - DNA, 454 bp, Heterodera glycines
  SCN-specific regions: Sequence locations=1-384,417-454
cctatttaactgaactaaaccgcatcacaatgtctgaagtctacggttttctcgacaggttcacaaaaagaataacgcgacgcagaggcaccactcccgcagcttcgggatttggagcggacagttcgatggatggtggcggtgtttcgaaggtgtgcatcggcctgtgcctctgcattctgattctcgtgattctgttcgctattctccttttggttgttgcgcttacgcctgaaagtttccaaggcgttgctgtgctgggaggcctcgcgagtatattcggaaattaaatcgaaatgcgatgttcttcaatctctatgttgttgtcccataaggcataagcctaattacttaattctcgagttccctctattgaataccgtacatttgcttttgtttttattttgttgttaatttcactccgattgtgagtaataaatgcggttcccggtga

SEQ ID NO: 93093 - DNA, 56 bp, Heterodera glycines
  SCN-specific regions: Sequence locations=1-56
attcattaggaggagcattagcagccatcgcagcagccaaatgtgtcgcacttgga

SEQ ID NO: 93094 - DNA, 175 bp, Heterodera glycines
  SCN-specific regions: Sequence locations=1-132,154-175
aatgaataatcataattgtaatgctgttggaggagtaaaggcggaagaaccgccggtgcaacaactacaccaacagctttttgcctcgagttcacatgacatgcaaatggcagcctcaacatcaacagttggtgaagaagcagcagcagagaatgtgcaccacaccaatcagaaa

SEQ ID NO: 93095 - DNA, 163 bp, Heterodera glycines
  SCN-specific regions: Sequence locations=1-163
ttttatgcgtggtactatgccgctccgacggactttttattatcttggccggggaaaaatacatttgcctgaggaagtgaaggtctttccaattgctttccacaatttcccaaacgtggcccacgaaagggccaaagaattcccattttggcactgggcccaa

SEQ ID NO: 93096 - DNA, 337 bp, Heterodera glycines
  SCN-specific regions: Sequence locations=1-67,89-337
ttatgtgcatttggatattatggacggccatttcgtgccgaatttgacggtcggacctccgctcattgaatgtctgaggaataaattgggaaatgacgcggagttggacgtgcacatgatggtgtccaacccctccgaatggctcgaccctctgcacatagcaggcatccatcacttcactttccgttgggaggcactcggagacgacgaagctgtggacacactcatcgtccgagtccaatcctggggaatacgatgtggactgtccatcataccaatgacgccgctggacaaactgatgaaattctgcgaatttatcgacacatcactcctaatg

SEQ ID NO: 93097 - DNA, 351 bp, Heterodera glycines
  SCN-specific regions: Sequence locations=1-351
gttctcctctgcccatccgtcagtgtccccagctgatcgcttggcctcccgttccgatcgccaatcattcttcccgttcggctggtgaccaattccaaattcatccgcagtcgtccgctttggagtcaacgcgtgaagcaacaacagcagcgactacaatcgcctcagcgatcgcttgtccctccggcgtgggacaacaaaaagtgccgttgtgccttttaccccacgggcatttgctgtcctttcctttggcatcacttcaaagtaccgccaggcatttgcttttttcacaacggacgcacttccgacgccaatcactgcccaaaggcgcgacgattagcgactgcagca

SEQ ID NO: 93098 - DNA, 506 bp, Heterodera glycines
  SCN-specific regions: Sequence locations=1-394,417-506
ggtgttcatagcaaccagcaatacgttgtgagccgactgcgcacgctttgccaaaacattgcacttgaagaattcaaatgggacggtggaggcgaacagacagtgcgcgatgagagcgactcatttgaccgcttcatcacttggggtccgcaattaccgaccgacactgagctcatttggcatttgttttgcacttatttggactttcacatttcgccttcctccgatggcgtctctgaactcagcaaaccattttccaatgtgtttttcgttaattcgtctgatggaaagttcccattggctctgatgcatgccaccattcaaccgacaaaacagcaaattgtgccggatgaattggctgatgagaaatatttcattcgtttggcttccgctcgtccgccaactttcgaaattgtcgttgatggcggagaaaccgttattttaccttgtaaaaatcagccgcaaaatttttggtatgtgctcattttgttccttgcccatgttac

SEQ ID NO: 93099 - DNA, 267 bp, Heterodera glycines
  misc_feature (200)..(200): n is a, c, g, or t
  SCN-specific regions: Sequence locations=1-267
atggcatccgagaaggatctgtttccgttgccaaattggatcgcgcgtcctccaaagggttcccatttggacgtgctcaaaggggaaaagctgattcagaaattgctggttgatgagaaggggttttattacttcggacggaatccgtcggactgcgattttctctctgaacacgcctcctgttctcgggtccatgctanttctcctctacccaaaccagtgaaacgctttgccctcgtctatttgcaaagcaaccatgggactttt

SEQ ID NO: 93100 - DNA, 532 bp, Heterodera glycines
  SCN-specific regions: Sequence locations=1-440,462-475,497-532
aaattccattcccttccattagctttgcttttgcttttccttcttcaaaatgccttctctcgacgaacgtttcaatgctgcggttgaaattgtgcagaaattgccaaaagaaggcccccttcaaacatcgaatgaccaaaaactgaaattctattcactgttcaaacaggcgacaatcggcaacgtgaacaccagcagaccgggcatgttcagtctggtggaaaaagcaaaatgggatgcatggaaatcggtggagggaatgagcgctgaggaggccaaggagaaatacattgagacacttttggaaaaatttgacgatgctgggactcaggtggacatttcggattggctgtccaaaattgacccgtcaatcagaaccaatttggcgctgctcggcaaaaacctttgagccgaaaaatcattggacgaatgtgtggcaccacaaacagagaatggcgttgtctttaagacaaaacgatcaaatgttgtcaaaattaattaattattcaagaaatatttcatgtgtaaaaaa

SEQ ID NO: 93101 - DNA, 324 bp, Heterodera glycines
  SCN-specific regions: Sequence locations=1-255,280-324
ttgctggccgaatttcagaacacccgtttcattgcggcagcgattttgggggcaacgaatgccgaaaaaacaaaggacggcgggcgggagaaggaaggagtggtcagttttgagaggtccaagcacagtgttccgcgcaacatgtggtacaaaaagttggccaaacgtacaaaagccaaacaccaacaataagaaataattgattattgcgattcaatgggagtgctgttgcgacttttaaattgtcattttgtactgttgtttttgttgtttgttcataaaatgccaagaaagaaaaaaaaaaaaatcaataaagctaatttt

SEQ ID NO: 93102 - DNA, 581 bp, Heterodera glycines
  SCN-specific regions: Sequence locations=1-237,259-581
gaagaacatcatgttatgtttggtgccaaaccaaaccaacattggttggttagagttgcacttttggacgccgtcacatttcttgcacccgccattcatgacgacgacttggaaagatttgtccaaattgacattgacgatgtgttcattggtgccattggcagtcgaatggttgcggatgacgtggactatttgtccattttgcagggcaaactgcgcgaacacattgccgactttcatttcacgcttggcttttctggcaatttttttcgtcatggtgacccggcagaaattcaaggagacgaaatccttgcaatgcgaacaaattccactgattcccgcacatgtggcgtcacaaccatccgccagaattttctgcggattatctgcttgcattgatgacacaaaatcgtgtgtttgctgagaatgttggcatttctgccaatctgagctatgccgtttcgccacaacattctggggtttatccgatctatcagcctctgtacgatgcctggtccaaaatttggtcgatccaagtcacttctaccgaagaatacccacatctgaagccagcaagcgga

SEQ ID NO: 93103 - DNA, 537 bp, Heterodera glycines
  SCN-specific regions: Sequence locations=1-13,103-124,146-537
aaattctctccgttccttctccgtcgtcctcagttcctcctcctcctctcctcccaatttctccccttcttttccctcatcatccgttttctgctgcttctcatattccctggcgtcgcgcagtgcgcgcgtggccgccgcctgcgcgtccaacgcgagcgcgtcttggagaaaagtgcacagctgcgggaggaagggcagcagcagaccgagcgaagtggcgaccacctcgcgcaacgtttccgcaatggccctcagccgacgctcatccgccggctgcgcattgagaacggatttgatctgttcctgttggaaaatgatagaggaaacgagctgcttgctccgcacagagattgccaattaacgccatttctgtgtgctgccccaacgaccaaccaaatattcgttgtttacgcggtcgccaatgaacgtgcgcagcgtgtgcagtgcttggtttgtgttcagcgattgcatgtggcaatggtaggcgcgagtggcgagtgccaattgtcgcttcagctcaatgtcttctgacta

SEQ ID NO: 93104 - DNA, 148 bp, Heterodera glycines
  misc_feature (8)..(8): n is a, c, g, or t
  misc_feature (29)..(29): n is a, c, g, or t
  misc_feature (55)..(55): n is a, c, g, or t
  misc_feature (71)..(71): n is a, c, g, or t
  misc_feature (136)..(136): n is a, c, g, or t
  SCN-specific regions: Sequence locations=1-101,130-148
ggcgccgncgaagccccgggacaaccccngcaacgccaccagccgcgccaaacgncaaccgcccggacacngccagcgcgcgggccccaaacagccaagcaggcccccggggccgcccggcccggccggaccgccnggacagcccgga

SEQ ID NO: 93105 - DNA, 562 bp, Heterodera glycines
  SCN-specific regions: Sequence locations=1-38,67-270,292-562
acaaactatgttctcccgcctcctcacctcgacatcctctgccgccgtcgccgccgccgctcggccatccatcggcaccctgctcccgctgcctggctccgctgttgttgccccccccatcctctcgctgtcgcaaaagcgctgggccaccaaacgctctggaggatccaccaaaaatggccgcgactcgcactccaagcgcctgggcctgaaaaattactgcggccaatccgtgatcccaggcaacatcctcgtgcgccagcgcggcaccgaattccacgcgggccccaatgtcggcatgggccgcgaccacacactgtacgccctgacgcccggccatgtccactttttcaaggcgtacaaggtgaaagtgcttgctggcgggaagcgcacgctggccaaggagtaccagtatgtgcaggtgattaacagggacacgcacgctgcggcatttgataaggagtcgggcaagttggatttggccaaggcggtgttggagtcggatagtgtgcgcaagtcgctcgagcgtgcgagggacatcaagttgccgccggtccccgcc

SEQ ID NO: 93106 - DNA, 460 bp, Heterodera glycines
  SCN-specific regions: Sequence locations=1-355,378-460
taaacctccccgagaaatgattttttcagaccgacaggctggacaaacacatggagaccatgctttcccgcataaaactgccacactctattcccagcccaatggaaccgaaataaacagaaaaatcgccggagagtcggatcccaattcgcgcaaaccatactcccactgcgagaagaactcacctgccattcataacatcaatcaaactgacccccttgtccttaaaagaaaaaagacacacggagaaactcaacatcacagtgtatcgcaattgctcacgttgatccatggactgcaccatcacccgaaggtcaatgtcattggtgcaacaaatcgtcccaattcctttgacccggctcttcgtccctttgggcgtttcgatcgcgagattgacattggtattcctgacgcaattgggcgtttggacattcaacgcattcacactacgaacatgaaa

SEQ ID NO: 93107 - DNA, 91 bp, Heterodera glycines; identical to SEQ ID NO: 65787
  SCN-specific regions: Sequence locations=1-91

SEQ ID NO: 93108 - DNA, 487 bp, Heterodera glycines
  SCN-specific regions: Sequence locations=1-239,261-464
gccccctttcaaaggcgacgacgggcccgaaccgatgggcgacagaattccgcccgcaaacggtgcagataaagagccggtgacaagtcgggcgtccgaagtcgaagcgcacgcgaaccaactgcgcgcggtggcggagcaagagcagaaacggcaagcggatcaacaggcgacaaattccgccatcgccgcccctgcggaacgcgacgcggcgaccgcgtcagcgactgccgcgcagtcgccggacgccgccgcctccaccgctcagcagtcgcagaaggagcggcggacgcggcgctccaaactttgtacagtaatgtgatcggtggttagtcaccgccggggccggcgagcgacggtgcgcacggttacggtattggtgcaacagcgacgcggcccgataccgtaaccttgaaagtgatttgtatagatcataccgtgtatatttttgttacgtgtgtttgttatataaaatatattttttaaa

SEQ ID NO: 93109 - DNA, 634 bp, Heterodera glycines
  SCN-specific regions: Sequence locations=1-344,366-521,543-634
gtttgagatgtttttattgcataaatttttgccaaatttgttaacaaaatgccactatcaacaatttgcttcgtatcatttttcaaaatctttgttcaaattggtccaatttaatttgtccgacattggtgaagggattgcggaggtgcaagtcaaagaatggcacgtgaaagaaggcgattcgattgctgaatttgatgagctttgttcagttcagagtgacaaagcgtcagttacaatcaccagccgatacaatggaaaaatcaaaaaaatgtattaccaacccgacgaaattgccaaagttggccttccattggttgacattgaaattgccgaactttcttcagaagaagaaaaggaagcaccaacaaatgttttgccaactgtaaaaactgacgctccgtcttcgcttttgtctcaatctccaaaagtaatcgcatcgccggccgttcgtcgcctcatccgcgagtatggcataaatacggtcggactgaccgggtcgggcagagacggacggattctgaaggaggacattctgaagttggcatacgtaccgccgcccacctcttttggaaagtcacccgactccgtcaccgcttttcattcgcgcgataagccgtccggtgtcgaaatt

SEQ ID NO: 93110 - DNA, 540 bp, Heterodera glycines
  SCN-specific regions: Sequence locations=1-78,100-540
aagccagccatgcttagcaactttttttgcggcgaaattaaaaagttacctgttccgactgccgccagtctgattctgctccttgtccttctttccgtcattgcattagttgtcatcgtcacactgggagtgcttttctacaaaaaatataaacagacgcgccgcacaaaggctgtctcttcaaacaaaagtgaaactccggaagtgccttcggacttggctgacgaagcggcggagtcttcggactctgatgaaggccgtggtggagtttcgacggcccctcccgacatggaatcagtagtggctgacgaagcggcggagtttttggactttgatgagggccgtggtggagtttcgacggcccctcccgacttggaatcaggacgcaaataatgccataatggaatttaggcagtcaatattgtattgttgtatatatcaagtggaagtggaaactatctataactgtctgtgactgttcatagcatcataattctgactgtatcgcccgaataaaatgctttttcattctaaaaaaaa

SEQ ID NO: 93111 - DNA, 630 bp, Heterodera glycines
  SCN-specific regions: Sequence locations=1-288,310-588,610-630
gtccaattaagttgttgtttaaaacaattgtctgcaattttttgtgcgtaaaatggacactgccaattcgccgtcagtcagtgatcaacagctgaaaagcattggggagcaaaagcgcattgcacagcttgaacacaaaattgcgtccgtcagcaaacagttggacgagaagggcacaaagctcaaggaaacgttggagcagaacgcgtcgttgaaagacagaattggcacactcgagcaagaaaaattggaagtctcgcttctcattgaaacattgacaaagagtcgggacagactgcttcaggaaaagacggacctccgaaatgagctgcttggcctcgagaagcgcaaagatcagctcgaattgcaagtggccaagttgaacagcgaaaaacaccgccatttggaagacatcagtgaactgcgccaaaagtgtgacgaattgtggggtgaacggaccgagttgcagagccaaattgacgacttccaaagtgacaaggcactaattgtgtatgacaaagagcagtggaaacgcgagaaggacattctgttggccagcaagcaatggtacattgacgaaattgcggaccgggagaagaaaatcaacgaactcatccaggcgaagtccga

SEQ ID NO: 93112 - DNA, 476 bp, Heterodera glycines
  SCN-specific regions: Sequence locations=1-476
gcggtgctccttttcctcaatttcaaagtgttcggctgtccatgcctccgcttctcttcccctccccgagtcgtccttttcttttcgttcatcggtcactttctccatctttgcggcggaatttctgttttttgcttacttcaaatattggaaagccttgcattaattgtccttctgatgttcagtcgcgtcacttttcgctggatattcggcgaatgtctgccaaatctgagaagggattgtgggccaaatttgaggagaaaaagaggcgaaaatacgctgaaacgggttccatgaaaaagcaaaagggctcaaaaccgacggtgaacattttcgatggaatgaatttgagacatttggccatcgcattggactgcgatttcgacgcactttgtctccgattgctggacattgtatccgatttcaaattggacagcattctttccgatccaaatgcgccactcgaccgtcttttg

SEQ ID NO: 93113 - DNA, 511 bp, Heterodera glycines
  SCN-specific regions: Sequence locations=1-511
cggagaaggagccgtacttgcgcgatgatcttatcaaaaggccactccaattattgacggtagacgagttggtggatgttttgcgagaccaacgtgccagaaacatcacagtcattcagttgagtgatgatgagagcaacaactcaaaaccgtttgttatcatttgttcgccgtttaacgcccggcatggcaaagcgttgatgatcattttacgtgcatttttgaagcgcaattttatcattaaaaatcttcaagttgaggtgcccgaacgccatgccgtcccaccgcgttggaacgtgctcaacatggccggcaccattgtgcatattttggatgaggaactgaggctgaggtacgatctcgagtcgttgttcttggggttggactgtgacgaggagggcaattccagtgccgcgtcgtggcaagttgaattccgattgccggcctcaaagctgatcaaaatgccttcacaacttggcctactctcatgagcatcactttccttctaaaa

SEQ ID NO: 93114 - DNA, 349 bp, Heterodera glycines
  SCN-specific regions: Sequence locations=1-324
ggaaaattttggaaatagcggacaaagagaaaatttcaggccttttgcgcattgtcgagtcttttatcattgattccgaatgcatccacccaattaggaagcttgaatatgcagcagaatatcggatgagccgactcgctgacacagtgcttcgattatttcctactcaaattgaccggctcgattcattattcttatatttagcagaaaatggagagacattggccgatgttcacttggatgtacttaaaatgcttgacattcatgattcatacattgttatgtaaaacaaattcttgctcttgacaagattttatctcttataaaaaaaaaaaaaaaaaaaaaaaaa

SEQ ID NO: 93115 - DNA, 429 bp, Heterodera glycines
  SCN-specific regions: Sequence locations=1-8,32-252,274-370,396-429
ggacgcgtctgcccccgacggcggcacctcaaaaagtggaactgttgaacatcgaggactacaagaaggaccggacaatgataaccgccattctctacgaggaggaccacacagttggcaatgccctcaaacacatcatttgccaaatgcccgacgtcgagttttgcggttacaacgtgccccatccgttggaggacaaaatcctcgtccgtatccatactgtcttaaggggtggccgcgggggatgtgctgctgcgtgggctggaagatttggcacgcatttttgacaccatcgagcgcaaattcaaagcggcacatcgtgcggcccatttcggtgtcagtgatcgaatggaggaggacagaaacgaatacgaggaagaggaggaggagatgaccatttgaacatgggcaaacgacgcaaatgccatc

SEQ ID NO: 93116 - DNA, 498 bp, Heterodera glycines
  SCN-specific regions: Sequence locations=1-498
gaaaaaatgtgcaaagagagtgaagagcccttcaaatttattcccgtctgctgctacgaagatgcgcaggcgattcgtgcagttgcattccatcccagtggggggtatttcgctataggcactaactcgagaaatttgttaatatgccgatatcagtcttacgaacgtcgaacatcgcttaatgatgatttcctccatggatttgttcctcctccaactattctaatgagcagaagcaaacatcaccgcgggtctgtgtattgtgcagcatttaatcagactggcaatttgctcgcgactggctcaaatgacaaaaccattaaactgatggccatgcagattgacccaaacggatgtcgaattggcgttgaaatggacctgcaacaagtgcatgatggcaccgtaagagacctccttttcatggaagatcggacttctgcctgtaatagttcttcctgcagcacgctcatttcgggtggggccggaggttgtcgtctt

SEQ ID NO: 93117 - DNA, 196 bp, Heterodera glycines
  SCN-specific regions: Sequence locations=1-196
tgacaatcgcgccggacctgacccacacaattacgcgcttcccgccggcctgatcacgagaaggactgaactcacgaactgaaccgaaggatggttgaactgcctgaacgatgcgcgttgagaaatcggatcatctgattttttgtatgtaaaccccatttcacatgatgaactctctcaaactgtaaaaaaaaaa

SEQ ID NO: 93118 - DNA, 599 bp, Heterodera glycines
  SCN-specific regions: Sequence locations=1-202,224-274,296-599
ctttattattctgctttgttaaggaaaaacgtcgcatgagccctatgatgccaaatttacttcgatgaagtacttcatttcaaggaaacttgtttttcctctagttcatcagtggacttccgcatatttaatcacgcttcattctactttttctgaaaattaaaaaaaaaaaaaccaacaaaaaattgacaactttccttaaaaatgaatgtagcagaggagaagttttggcagcgttcggatgttcatgcggctgttagtcctaattctgtaattttgtaaattttgtgtagataattatagttatttttccccgtctctgggtttcatgccaaacatctccatcgccgcaacgtttccagccttttctcccatctcctcacgtgtgcttcaaccggagtttcaaccgactttcatatcatctattcgttgaacgtttatcctagcgaagcaactggattgaattacagcaaccggaatcgcatgaatatacccacgaacaagtgctgttgaatttttgccacatcgattttgcctaaaaatagactgtcaaatgaaaaaaatatgatacctaaacgtcaataaacgtatcctgaaga

SEQ ID NO: 93119 - DNA, 307 bp, Heterodera glycines
  SCN-specific regions: Sequence locations=1-55,77-160,183-284
gagaaggagtcaagacagaacgaaacgggaatgttggtagttttcgagcagatgaaagtgatcacagcgatgatgaggcgacgtggaacggaaattcgactcagcagttgtgaattctgtgacggtgttgttattgagagatcaaagacaggatgataaatatgatatttatttttgttacagaaacgcgggctctagtgcactttatgagtccaatcaattgaaaatactcggtttttatacaataactttgtacatgttcgaacaaaccctatctttttggtaaaaaaaaaaaaaaaaaaaaaaa

SEQ ID NO: 93120 - DNA, 147 bp, Heterodera glycines
  SCN-specific regions: Sequence locations=1-69,91-147
ctgtgagccagcttttggccgataatttggtgcagggattggctgcaatgcttgatgtttctgctttccagtaaatgaattgtgttgatgaccagagactgtttaattgtatctgtttatgcattatatgattcataaaatgtgtcc

SEQ ID NO: 93121 - DNA, 540 bp, Heterodera glycines
  SCN-specific regions: Sequence locations=1-147,170-316,340-540
caattgtctttttggtctgttgcaatgcaatgccaaatttcccgtgctgcccgggaagtcagcaagtggttgctgtgatgtccaattacattggcactttcactagtgaggacaaatctacagtatgctcaaccgcaaaaaatactgtggatggaataaaaagtgaactgtcctctcgcggcggatgcccaagcggaggagaagcacaaattgtgaacgaaatcgaccgacagctgactaacattgcgaaaatgaagatcaattatgaggacgggtgcccgtacaatttgggctttgctcgtgccatgttcgacttggccgctgctgctgctggccatgcgggcaacggcacagaatggcaaacaatgaaaggacaatttgagcaggaaagccaagcaatcaaagcaattggccaagaaatgaacattgaagttactgatgtgcattttggacatccaagcaaaggattttccgcgcaccaaaatgtgccaagtccaagccatgtgattgccaaccctggccaacagagttcggttggcc

SEQ ID NO: 93122 - DNA, 645 bp, Heterodera glycines
  SCN-specific regions: Sequence locations=1-159,181-645
cctcgagccgcattcccactttttgaaatggttgactccaacagtgaggaagctgctaacaaaccgtcgttgcaaaagcatctctttgcttcgcatggtcaatacgtcaaattgaatgtcggaggctctcttttccttaccacggttgacacgttgacaaagtacaactccatgttgaaagcgatgttttccgggcgaatggaggttcgtcgtgacacggacggctatgtgctgatcgaccgatgtggcaaacattttgggctcattttgaactttttgcgcgaggggacgctgccgttgcccgactgtcggacggaagtgctcgaaattctcattgaggccaaatactatctgctgcaggaattggtggacctttgctattcgtcccttaaagcccttcatcatgaccaactcgtgtccacgcttggcatttgccgtgtccctgtagttgtgtccaaaaagcaagttgaacaaattgtgcagagttgtgctggaaagccggtcatcgagctgttgatgaaccgtcaaaacaacaaatactcctacaatgcgtcgtccgacgaaaacttcttgcgcaaccaggaactgttcgacaaactgatccttcgcttcaacaaccgcgggctcttcatcaaaaatattggc

SEQ ID NO: 93123 - DNA, 181 bp, Heterodera glycines
  SCN-specific regions: Sequence locations=1-181
atttttgaatttttatgatggccaaactggtggttgaacaggcaattgatgcgagcgagaagtttttgatccggaatgtatcaatatctttttagaagaaatttggtgaaaaaatatttaggttgtcactggaaaaagtgtcgaactttgaattcaatgaacccattctgaaaaaattgcg

SEQ ID NO: 93124 - DNA, 568 bp, Heterodera glycines
  SCN-specific regions: Sequence locations=1-544,566-568
aacaaatggaagaagcatttgcgaaggcgcggtcagaggagaaacagtgcggcatttgtatggagcaaattgtggagaagggactgcgctttggcattctgcagaactgcacgcactgcttctgcttggattgcatccgaaagtggcgccgccaaacggatgaggaaatcaaaacgaaaacagtgcggtcgtgtcccgaatgtcgtgtccattccgattacgtcatcccgtccaaagtttggattgacctcaagtcagacaaggacaaattggtttcagtcttcaagcgtaacacgaaaaagattgcttgcaaatacgtcgtcaatggcgacgtggacaaatgcccattcggtaacaaatgcttctacaaacaccaactgcccgacggttccatcgtcgaaggcaaatcgccgacgcaattgcgcaagaaccgtcgcaacgatgccatcatgttcagtctgtacgactttttgccctccgattcggattgggaggacgactttttcaacgataacagcgatttgttcgattgattcgcctgctttttgtgttatttaaataatttgat

SEQ ID NO: 93125 - DNA, 397 bp, Heterodera glycines
  SCN-specific regions: Sequence locations=1-363
cgcatttggcatatgcttttgttcccccatcgccacccgcgcttccgtgagaattggcgctccttcctcggcctccagcgcaacagtcgccgctctctttggcgtcacattttactgccctcctcccacgccacgccctattcactgaacgcggcctcggcctttgacgaggagcagcagcgactggtgacagttaaaactgacattggaaacggacacagcacaacacagcaacaggaagggacgccgctgattgccgactctccccaaagttcgaccgaaacgaataattccgccgatgacaacattttaatgatttgatgattattacccttgtcctttcctcatcgattccttcattttaaaaaaaaaaaaaaaaaaaaaaaaaaaaaaaaaa

SEQ ID NO: 93126 - DNA, 505 bp, Heterodera glycines
  SCN-specific regions: Sequence locations=1-505
gcccgatcaaagaaagcgaaatgatcaaaaaaagtgccgtcattccttcccttttgctatgcgccattttggtcgcccaatttattgagcaggccaatgcttactgttgcaaagtgtccgattggccaattggccatccgccgaactgcaacatttttggctgcaactgccactgtctccattgtgtgaacgtgattgagaagggttgttgcattgcgcaaaagacggggctgaccgatggctgctcagaaacgcgcctcaaacgccacgcgctgccgcaacagccgaagcgggcggaggccaaagaggtgtttcagcaagcggacactgacggagacggggcactgagcatggacgaagcggtcaactttttggtgtctaaatggaacatgacggaaggtgagctgaccaaccccgacaaacgccattggttcaccgaaattgacgtgaaccgaaacgaaaaattggagcccgaagagatagacgaagcaatgacaaagtgaga

SEQ ID NO: 93127 - DNA, 184 bp, Heterodera glycines
  misc_feature (158)..(158): n is a, c, g, or t
  SCN-specific regions: Sequence locations=1-160
gtttcgtctgtcctttctccttatgttgtccattttcctcacttccgtgcattgtattaagccttggctcgggcgtatatatttatttggatgagtcgacgccattccgccaaacttccctttgatgcttttttgtgaaatcggtaaaggtcgcttcngtaaaaaaaaaaaaaaaaaaaaaaaa

SEQ ID NO: 93128 - DNA, 654 bp, Heterodera glycines
  SCN-specific regions: Sequence locations=1-244,271-654
ctcgtgtttgagtgtgacacctgtataaaggctctgaatttcacggattttaacgaggccgaagaatttaaagttgcaatggaaaaaaggagagaatccaatcaaaaaagtcagcaaggaaggcggggttctgcaggaacggcagttatacaaaaccaacggaaatctccagctcacccaagccataaaaaaacaactgcaccttgctttccgccgtcacaccttcaagatggcattcagtccagtcattatcatcatcaacatcccgtcggtggcatcacaagcatgggggtcatgccgcacttcggtctccatcatttatccacaaagaaaacgaccaaaaaagacagagatggcaaaaagcgaaaggttaccaaggaggacattggaatccctacagattttgtacataaagcacacattgggtgggacgggaacacatattccgcctcatctgtcggagacgcaatggatgaaaaatttttgaatatgtgccagaagatcaacgaagatcccagcaaaatggaccgagaagaacttgggtttgcgctggaattttatgcgaagaatgaaagcaaatacccaaacgaaaatattggaggcttttcacaaaacacaccgttttttgcacaaaatccaacattggctactcgg

SEQ ID NO: 93129 - DNA, 561 bp, Heterodera glycines
  SCN-specific regions: Sequence locations=1-290,312-413,435-561
ataatgctctctttaaaaaaatcacaatttctcattttattgctcttcaattgttttgtgttaagagtctttgcttatgatggcgtagaagatcaaatttttatcagactcaataacaccgatgtccaatgtgttcgaatgttgaatggtacacattcaattggatgtcagtcgagtcgcaatgggaatgttggcgtcctgactgaaattgtccatgcaaaagacgtacaaaatgcgattggcattttaccattggggctatccaacataatcgctgttattcaactcacaaatattaatgatgctttaatcggaatccttcgttcacacgcgcaagttgttgggattctgttgatacatcgtgggaaagataagcctaaagagttttctgaggatggctcatgtccaaatcgtcagttcacattttattccaatgagaaaactatcgaaagttgccatggatggaaccaaaagaacgcgattcactcggatgggcttaagtttatcgacttcaacaaacctcttcgtcttgtcaccagcaacgaagagatcgacttaatc

SEQ ID NO: 93130 - DNA, 448 bp, Heterodera glycines
  SCN-specific regions: Sequence locations=1-159,183-292,314-448
tttctcacatgatggagacaacatcgacattttggtcttcaaccacttaaatatgcgtggacactcccatgtcattttcattgagataaataccagtcgccactgccctccgttcctgcttggcttccccttctaccacgagccgatgcgcttccaattctccaaggaggactctgatgtgatctccagagcgacagggacttttgtctaccgtcccattaagaacatcaccgtgtcgaatgataagacaacacttgccgagggtccgaacatggaaatcaaaacgtccggtctatatggacaacttcgttcgaccgcaccgaccatcagtattttggtcatcaccaatttacctccggaatgtacggaggaaatgttacgcgttgttttccaacctttgcccggccttcgcgacattctccaagtgtccaaccgtacagacattgcc

SEQ ID NO: 93131 - DNA, 610 bp, Heterodera glycines
  SCN-specific regions: Sequence locations=1-610
ccattaacaacagcagatggcaattgggtgcccaacgaaggcaatgttagccgtctcagcagtcaaatgagttttagcgccgatggcttaatgacaccgcttggcacgttggacacgcaagagaccggcgaggccacgctggacaccgcccgttccatggtcgtcacgcctggcggcacttcggacaattactgctcctcggcagcggagttggagcagtacgcggaagacggcggcgatgactgtggcgatggggacaacgatggcggggacagtgttattgtgcatcgacggtgcagcagtgggctgagcactgaaattgtcaacgacgcaatggcaaatgccattcggaatgtttcgcgcgccagcaaagcttcggctacaacagcagaaggacaacaaccggcgactggagatgaacagccgaaaatgcggcacgggcgcgaatttcaattggaattggacaaacgcgtgtcagcgcatcggctttcttctggctcctcctcgtccgcgtcgggtgcagcagcgggacgcgacgtgcacgtgcggacgccactgaacgacccgcggtcaccgtttaagccattggcttacacatcttttgagccgg

SEQ ID NO: 93132 - DNA, 639 bp, Heterodera glycines
  SCN-specific regions: Sequence locations=1-639
gtttttagaccagtctcagagtcagtaactgaatattaaaaatgaaagtggaaaagattaagacaaggagaggcaagaaatttcttgaggacagagcaccgaaattggtcgaaaatgacaaagtgacactttttgtgaagggaaagaaatgttcagtgatgctcaacaaaatacttggcgaactttaccaactgaagaagccattggccaatcgactgcaacggttaaattggcccttttttaatgattttctcacaaatttgacgcttctttatttgtcttcgggtccagcacaaagaaacggccgaattcattgctttttggcagaatgtacgaccatcaaatgttggatatggtcgaattgcaagtggagaattttgtctctagcgacgaatttaaacaagtcaaaagcgtaactttggggtcgaagccatgcatcattttgcaaggtcacctttttgagtctaacggaatacttcaacggattggcaatttaatggtggatttgtttcgtggccccaaagtggagtacttacggcttcaaggcaccgaattgataatttcattgacagcagtttccgaagagcggattaaattcagagtttacagagcatccctaaagaaggacatggaatctgc

SEQ ID NO: 93133 - DNA, 629 bp, Heterodera glycines
  SCN-specific regions: Sequence locations=1-5,27-629
gggaaagggaggaaaaggacaaggaaaagcggatggaagtggaagtcgaagtttcgaccgacggaatgtttgtgcgtgccaaaaacgcggtccgttacccaatcccaaactcaatggacagccccgagctgagagtgtattttgtcggaaatgaccaaagcaacggcaaattatgtcagttgaagtcgcagattgaattcagagggaccagcaaattcgctgttcctcccaccactccgatcactcccatcgaccgatcatcgcaaatccttcccccaattattcggatcgaccacaaatggccgtacagtcgaaaacgacccaaaatcccgcgtcgcagcacaatggcggcccaacgccttctcacgcccgcccattacgcctctcccagcaactccgcccaaccgttcattcagcggaagtcgcaactgctaaaccccgtccatttcggagaaaagagcccagcagaatccatggagacgagcacaacggcgacttacattgacataattagagaccgacaactttacgaggaagtgcaacggtcgaaaaccaacgaactgaactcgcgctggtccaccaccttcttcgtatttatgctgttggtcgcctttctgatcgcaacttcc

SEQ ID NO: 93134 - DNA, 649 bp, Heterodera glycines
  SCN-specific regions: Sequence locations=1-34,62-156,178-369,392-649
attaataattgctaatccaaattagctaattaatttgttgttttccttcccttttaaaatgccacccccaattggctcaattatttccaaatggactttctctgaggccctttcggtgttttcactccctttccccgaactcatttttcgtgcccaaaatgtccatcagcagcatcacaatccaagccgagttcaaatcagtacgttgttgagcataaaaacgggcgcgtgtccggagaactgttcttactgtccgcagtcgggctaccataagacggggctgaagaaggagccgttgatggaagtggaacaggtgttggaagccgctaaaagagcaaaggccagcggcgcgacacgattttgtatgggggcggcatggaggggcccgaaggaccgcgacttggacaaagtgtgcgaaatggtggccaaagtcaaacaattgggtggccttgaaacatgcgcgactttgggactgctcaaaaacgagggacaggcgcaaagactgaagaaagcgggattggacttttacaaccacaacatcgactgctccaaggacttttaccacaaaatcattacaacgcgccgctttgatgaccgaatttcgaccattgagaaaattcgttcggccggcatcaaagtttgctgcgga

SEQ ID NO: 93135 - DNA, 537 bp, Heterodera glycines
  SCN-specific regions: Sequence locations=1-493,530-537
aataattataattaccgcctctcccttcacaatttttcagctctttaaaagcaattattttcgttttgccatgcgcactaattattctttattgtgtgacggttattgctctcgcccagcgacgcctttccccccaaattttgtcctttcgaccgctcttttcgtcctcgtttttgtccttgtgattacaaatataatcactctctttttgcttctgacaaaacgtcatcttcgaattggcttcaatgggcacttttcatttgcccccaccgacgacgaaaacggcgaaggattcgaaactatcggcggaggggccaacgacgcacagaacccttttttgaaggaaaaccgatgacagacgaacaatcaatggggaggaaacaaacgaccgttaaaatggtgtccttatataaaattgttaaactaaaaaacagaaaatctcacgagtcgtttaaaatattcctactgattagcaaattatgcggagagatggtttaaaaatattatttatttcaatgaataaaataatggaaaatt

SEQ ID NO: 93136 - DNA, 397 bp, Heterodera glycines
  SCN-specific regions: Sequence locations=1-397
cgaattaatcgaatcccggtggatcaatgggtatcacaaaattatcgaacataacagcgcccagataaagtgccgaatgcgaattggggattatttaccggacagtctgccggaaagcaaattgccagtgctcttttatctttctgggttgaaatgcaccgaggaaaattttgtcgtcggaagcgccatgcagcgattcgcatccggtcgagaaatcattgtggtcaatcccgacacgagcccccgaggcgttgtcactggagacggtgaggaccccagttttggtgctgcagcaggattttatttggacgcgacggaaacataatgggcacggaattatcgaatgtattcctacatggtggaagaactcgtaccactcgtgctcacgactttttca

SEQ ID NO: 93137 - DNA, 223 bp, Heterodera glycines
  SCN-specific regions: Sequence locations=1-223
cgaatgtttctccgtttgggagccgctgcgacttcgccaggaagggactatcatcaactttgtcaacggattggatttggctactcccggcctttgtatgccaacctttaacttccgtgatgacttcctgtccgaaatttactggctactgtgccattacccgggtgggattcgcgaggagaacagtgggaatgtgtcgctgttcctctcaatgtcggcgacg

SEQ ID NO: 93138 - DNA, 480 bp, Heterodera glycines
  SCN-specific regions: Sequence locations=1-271,293-450,472-480
gacaaattgagagagcgccgtttggcgcccatttctgtggcgcagggccatcaaatggcaagggaaatcaaagcgaccaaatatttggagtgttccgcactcacacagatcggccttaagcaggttttcgacgaagcaatccgtgccgttttgtgcccagtccaagtcaagccaaagaagtcttgcgccattctctgaacagttcgcgtccaacctaaagcgaggaacgagagtctccagtcaacaccaactaaacgacgtcatcaacgcatttaatctttaattattttctaattgcacccatcgcttaattaacacatccaatcccttaatgttgcccccttctgatcgttcactgttttggtgctttccatcgatcccttctgtggtttttgtcatcgattgattgttttttttgtgcttaattttcattttgccactaaatccgtctacttcatcctctcccatttccaaatttgc

SEQ ID NO: 93139 - DNA, 501 bp, Heterodera glycines
  SCN-specific regions: Sequence locations=1-4,35-501
cccgaatattttttttaattaaaaattttaaatactatttgtgttcgcttgtatgccaaattctgcttcaacaccgatggaagagtttgaggaaatggtcgctgttcttcagcttgatggcgtccttgactttgacgcggtgcgaagagcagtcagttctggtgcaatccgagtgcgcgaatgtgacgcggaaacgcccatggttcagattggatctcatttgtattctggacaatggtcacaaacgttaggcactgatatgcttttatgtccttcttcaatgtcggattaccatcaccatgaaggccatcagaggttggaattggtcgctgtgtcagacactcgtctctgtgcgcaaaaagttcttttagcaactgacgaaagtccgactaatggcaatggcactcggaatgaacaaagcacttcaaatagttcaaaggcataaagacaaagcatttgagcacttccagtttttttaaataaatattcacatatttggta

SEQ ID NO: 93140 - DNA, 287 bp, Heterodera glycines
  SCN-specific regions: Sequence locations=1-209,236-257
caaacagcagcagcgacgcacctgctgcatttggccgtgcattcgcgctttgctggagggccaacaccaacagcaaaaacagccaaacccgcaactgcaggtcctaccgatgggaatgcagcaaatccaaggaagtggaggaatgtgatccttcagcagatggaagaaattcatccctatttgctttacacattgtaaaacagatcagctatttattattttataataatttaaaccgaataaaacgaaaatccgcgaaaaaaaaaaaaaaaaaaaaaaaaaaaaaa

SEQ ID NO: 93141 - DNA, 481 bp, Heterodera glycines
  SCN-specific regions: Sequence locations=1-53,75-460
cttaaatatgtcagaggcaagcagcagcaacgccccccataatgccaatgccaacaacagcagcaatgccaccaacggcggaagcagagatcggatgaaccaatcgcaaatttggaagtgcttcgagaaaatgcccgactatgaggcggcaaagtgtcgcttgtgcacttcgatgctttcctttaaaagggcgtcgacgaaaggactttgggaccatttgaagtgcaaacaccggtcggaatacgacatgctgaagcaaaactttgaattgctcactccgtcgaattcggacgcatttaaagcgccaaaaataaagaaaagaaaaatggagccgaaaagcgatgtctgtgtggacagcgacaattcgttggtctcgggaatgggcacgcctcagacggaagtgatccgagtgggcggactcgcgaacgaaggccgaacggaggcgcaactgaacggcgccggagggggcggcggcgcaaat

SEQ ID NO: 93142 - DNA, 560 bp, Heterodera glycines
  SCN-specific regions: Sequence locations=1-560
ccactaattaactctccaaattgaccaatttccaaatgcgttgggtgctcaatctcgacggagggccgcgacgggtgaaccatgcggcgttggcaattggcgacaaaatttattcgttcggcggttacgccgccagcgatcctttggacagccaaagcgatttcatcgacattcacatgctcaacaccttttcctatcgttgggagcatttgccggtgttcgcccctttggcattttcccgtgaaacgacggcgaaattcccgtcaaaaccgcgcagtgcgaccatttcggcgcccggcatcagtgactttgtggagagtgttccgtccaccagtgccgccggcgaccgcgactttccaccggccgacgtccgacggcgtcgtgcccgatcactcacggaaatgcatccgttggcacttattcgttcggctaaccctccgctggaggacgaccagcagcagcagctgatggccaacaacatcgtgcacagacggcgcagcacaccgaaccgatgcgaagcgttgcgcttccgttcgtcccgcgttcggccggcaattgac

SEQ ID NO: 93143 - DNA, 550 bp, Heterodera glycines
  SCN-specific regions: Sequence locations=1-121,143-550
cacacatcagatgaactccaatttgatatcaacaagttcagtgatgcaaaaaagcatttctcacgccccacgagagccatcaataaaggaggagccgatgggcggtgactcggcaaaggatgacgacaacggcagcgacaaattctggtcgatggcaacgaagacgacgtcgcaacatggggaagcgccagcaattccaacgatgaccaaaaaaagaacgtccattgaattgtgcgaagcaacacaaattggacacagggaagaacttggccaattggtttctccaaaaccagcgaccgatcgtacagcaccgaccgccgatttcatcagaatgggcctccatcaaagtccatcgatgccgccaatggtgatgaaggcactagcggcaaacgacaatgatttcacaatttcttcaactgcttctgatgaggcagcaacaacaacggaaggcaaactgacaaagtccgcaaccggtgcacacatttccgccgacccaacactctctcatatcgtcgacattggcgcacaaacgtcaacagccgtacaaaat

SEQ ID NO: 93144 - DNA, 638 bp, Heterodera glycines
  SCN-specific regions: Sequence locations=1-262,284-638
caattggaggagagagaaatgcacacggaagggacagaaggacgaataacaattgggacgaagcgaaaaccatcgaaaacgacgctaatgggcacgacggataacagcgaatggttgggtggcaatcacatcgaagagggaagcgaagaagcgatgtcaaggacatcacaacgggggagaatgagcacaaaagcaccaccaccgacagcagcaacgccaagttggagcagtacacgatggaaaagcggaggggaaacaaacgacgcaaaagagaacaaaaaagcacatgagacaagccgaactgcagcgacagaacggacggaaggcaatgttaacttccgactgctcgcaatcgccggaatcattgcggtgttgtttattatggttggaattggaagcatttgtacgggacggtacgtgcgaaagagtcgtcaactccacggcaaatacaggcccgccgcgtacgaattgcagaccactcgccccccgcctttgaccagctcttccatgactttcgcgccttccaatcgcatggccaattccaatgaattgcagcagaatcggcatttcgagtttggccaaatccatcaaataccgccgccagttcattgtcctcatcagctcacaatgaatgggaa

SEQ ID NO: 93145 - DNA, 143 bp, Heterodera glycines
  SCN-specific regions: Sequence locations=1-143
ctgaattgttttttttttattaattcattgtttttcgtttcggcactttctgcccatttgaccaatgatttctgcccttccttttcctcactaatttgtccttttcgcctttcctcacatggcaattcgattaaattttggtg

SEQ ID NO: 93146 - DNA, 171 bp, Heterodera glycines
  SCN-specific regions: Sequence locations=1-171
aacaaatgtctcatcgcaattctcggaacatttaacacatttttgagtagaatttgctgaagaactttgccataatggcgaatgaccaaaaagcgtaaatttttcagtcgcgaaagagacaaaaaggcagccaaaatgtcaatattataagcggaatatccgaggtcttga

SEQ ID NO: 93147 - DNA, 462 bp, Heterodera glycines
  SCN-specific regions: Sequence locations=1-234,256-462
caaaaaatactgcaacggcggaggaccaacagcagatcaaccgatttgcacgtcttcataaagcttactcggcagccaaagaaaaacttatatcgttggacaacgatgtcaacaatttgaatgacgcttccgatgaaattctgctgatggacgacgaggcggcggccgattcgattccctttctcgtcgggtcggtgttcgtccatttcgaccaggacacagtgaacggtcggttggaactgctgaaagtttccactcaggcggagatggacgcattgcgttcacaagtcggaaccatggagagggagttgggcgaactgcgggcagtgctttacgcaaaattcggcgacaacattcacctggagacagaggaggacgaggagagcggcgatgcgacgagaaggaacgggagatagtgcatgaaagaggaagggcagagagagagagaaaggaaaagaaaaa

SEQ ID NO: 93148 - DNA, 635 bp, Heterodera glycines
  SCN-specific regions: Sequence locations=1-76,98-324,346-635
gtctattcttcaccatttgttcgaatttaaaaatgtcaaacaacgaaaatgaaaatgtgatgaatggagaagccgtgggaggggtggaaatcaaagtggaagccaatgaagaagtgaacacggaatcgcaggaggacggagaggaggcgaaaattccccagttcagcaaagagcaaatggaacgttcggtgatgtgctgcacaaacgaaggcgaaattgtcaatgcgccttggcatttgatggcacagtcaaagacattcatgcaaatgtgggaaagtctcgacatggaagaaaaaacgcaagaagattttacggatttcgtttttccgctcaatgacatcaccagcgactgttttcagcagattctcgcttggatgcgcgaacatcacaaccttcccgagccaattgtcaaggaggacccggtgacgcaggaacgcatttggttcaaattcaccgattgggagcgccaattcttcgacgtcgactttgaaagggtcaaggagtactttttggcttccaactttttggacattcgttcattgtacctctactgtgcccaggaatgcgctcgttgcataatggacaaatcggcagaagaaattcgggagatgctttgtctggaggatgatttgacc

SEQ ID NO: 93149 - DNA, 437 bp, Heterodera glycines
  SCN-specific regions: Sequence locations=1-25,47-91,114-437
tacgtcgactgcgttcgaatatttcacaatttcattttctccaaatcctgtgaaaattgcattaccatgtggaagttcggcaatctctccgagggcatttcggggaagggcactctcggctgtgccgaaacatacgctgcgcacaccgccgtaatggagatgccgcgcacggaaatgtggttcatcaaaatggccgtggatccgtcccgcagatttctcgtctgcggcagcgaggagtgttgaattgcgcatttggcgattggacacagagaaactaccgaaccgaaagagtgatttttgtttggtcgcgccgaccaaagaattgaggaaatgcattcggcaggtggcgttcagtccggacggaagggttatgctctctgttggcgatggtggcgttgtgtcgcggtacaatttacaggaaaaggaggagacggatt

SEQ ID NO: 93150 - DNA, 533 bp, Heterodera glycines
  SCN-specific regions: Sequence locations=1-533
ggttattaatattcaaaatggctatggccgcaagaggtggacgagggggaaaattgcctcccgaggtcaatcgcattttattcattaaaaatctgccttataaaatcacggctgaagaaatgtacgatatttttggcaaatttggtgcaatacggcaaatacgaattgggaatacgcctgagtcacgtggtaccgcatttgttgtttacgaggacgtttttgatgcgaagaatgcctgtgatcacctcagtgggtttaacgtgtcgaaccgatatttggttgttctctactaccaagcgacgaaggcatggaaacggatggacacggacaaggctcgcgtaaaattggaggaagtgaaggaccgctacggattgggcggagacattgagaaggaaaaggagaaaatgggcatttacacgcccaaacacacgcccggagtgagcacgccgcgacacaaacactgacaataaggcgtggacaccgaatttttattttttttaaaagttaacatgaattataccaaaaaaatacca

SEQ ID NO: 93151 - DNA, 579 bp, Heterodera glycines
  SCN-specific regions: Sequence locations=1-304,326-579
ccatttcgctgttcctcgcctcgcccactccgatgctaaacgcactgacaaacgcaacagccggttttgtccgagaccatcccgatttgccggtgtctaacacaacagaaactcttaccgccattgtttacatctgtcggcatatgttggaacgcaaggaattttacgaccgtctttcgggtgacgaacgcaactttttccttcgtgtgatggtcagtgcgttgattcttttcgaccacatcgactcggccggggcattttgtcgccattcacaagtcgacgtgcggggagttgtcgaagtggtcaagcagaagggcacggagcaacaggctaatcagctaatggatgttttacgttatacctcaaaacatttgaacgatttggagacaccgaagtcaatgcgtgcgttgtttaacgaaagggtggagagaaacatctgaccaaacggaatgagaaaagtaagcaaaattctgtgaggagccgaataatcagtgatttttttttatacctataagccctcctttctaccttcgtttacctaacaaataagaagaatcaattctttcataataattatac

SEQ ID NO: 93152 - DNA, 616 bp, Heterodera glycines
  SCN-specific regions: Sequence locations=1-319,341-363,386-616
ccaagtttgagcatttttatccacgatgatcagtagcagcaaattttgcacaaactttgatcagctttttaaccatttgcgtttattgtgttcaaatgacgccggtgcagcgcattacggcaccgaactgatgccaattatcaaagaaaatccctttttcggtgctttatgttcagtgatggcggaagagaagcaaaaaataagggcaatgacagccgaaatttcgtgtgcagcaatggcattggcattttcgttagactcgccaacggacgatgcgaaggacaaaaattgtgcggttgaccaaacattgagcgaatgcaaaaaatattatttggaggaaaacgaattggatggagaaacaaaggacaaaatgaagcagactttggaagaacatgaacaatttgggcaactgattgagcagaactccgtcgcctgtctccacacttcacgccgtctgttcgctgtccatgcccaacttcgtcccgtcacccttggcgatgtgcaacagtttggcattgtgctcaaactgagcacaaagaaatggcaaaacgaactgaaagatgcggtgtgcagccaattgttgctgatcaaatcacgcgcagggcaaaaaaaaaag

SEQ ID NO: 93153 - DNA, 538 bp, Heterodera glycines
  SCN-specific regions: Sequence locations=1-179,217-538
attaaataaatgtcttctgaaatcgaaaacatcgtccccaatggcgcaatagatgaccatcagaaagaaatgaacaaattttcatggacattgaacgatttcgaaattgggaagccattgggaaagggcaaattcggcactgtttatttggcgcgggagcgagaaacgaaatatttaacggcactgaaagtgctgttcaagaaggacatggacaagcacggagtatcacatcagatgaagcgcgagatcgaaatccaataccatttgagacaccctaacattcttcgtctttacggctatttctacgatgaagaccgcgtttacctttcgctcgaattcgcctcgcgtggctccgtctttcaacttcttcgcaagagcaatgcttttcggtgccttactccgcccgtttgatttatcagcttgcggacgcattaatttactgccattcgaggaatgttattcatcgggacattaagccggaaaatctgctgattaatactaacggagacctgaaaatcgcagactttggctggtcagt

SEQ ID NO: 93154 - DNA, 582 bp, Heterodera glycines
  SCN-specific regions: Sequence locations=1-582
ttactctccgtgtcgtcccaaatgtcctccggccaatccttatctctgctggtgttctctgttttcctcgccatcctttgctcattttgctcctcttttcccctccaacaaatgccctcccaaagtcggccaatgtttggaaaaattggcacttcggcacaaattgtggctaatgtgctgcccgaactgcaaatggtcgaaccttttccatttgatcaaatcagtgacaattcgcaacaattgaaaagcgaatgggacggaaacggaaggggcggagaagtccaaacgcagcgattgcaattctcatcctttccgcactttcttttcccagtggaagtgaaaagacaaatggacgacacaaaacggggaagcctcggcccacgtccgttgagtttcggaagacggtgaacgaagcgaaaagtggagaaaggagaagcgaatgcatgaggaaagacgacgaacgggcaaatggcaacaaaagagccaatttggcacttgcaaatgaatgtcatttcgaatggtccactgttattaatatttttgtacaatcaaatcggactaaatgaatgtgttttgttggaa

SEQ ID NO: 93155 - DNA, 633 bp, Heterodera glycines
  SCN-specific regions: Sequence locations=1-143,166-331,383-579
atattattgtcagagaaaattttttaattagagggcaataaagaataattttattaaaagtaacttaaaagttaattgaacaaaatttttggttaattatatttaagaaaatatcgacaaagttgcaacaaatttttccagggttttgaatggatttttaaatttcaaaaaacaaaacaaaaaatagtggaaaatttttgaatttttccattcttagaaggtgtatttaaaaaaaatattcgacaaatccttcggtggtggatttttggttttgtagaattttgtgatgaattttcgaaaagtgcgaaaaaatgctaaaacttctgatatgtttatataaatattttaaaaagaggcccaaaatattttttattttttaaatcatgccaaaattcttttctcaattcgtcgtcattgaccatcaatgagtcagggcctgaatgtcgaagcaagggatctctgaaatgattttttgagtgctaaaatttcaattttaaattccgtttgaatttacttccaactgctgtacatatataagtcaacatcaaaagtctaaatttttaattaggtattaaatggaatataaaaatttaaatgatttttaatttaaattgtttttaattgaatttttaa

SEQ ID NO: 93156 - DNA, 364 bp, Heterodera glycines
  SCN-specific regions: Sequence locations=1-208,230-364
caagtttgagaaaatttattttgttgaagcatttgatcatgcagcagcacacgtacacggaacagcctcaacgccagaattaccaatactacccaaatccgcctcccccggtggtgtacgaacgtcgttacgtggaaagggacagcggcccgcgctgtgtgccgtgctgctgctgcattccgtgcattccgatccctttgtgcttcgactgcggctgctgaacaccggcggagaagcaaaacgaatgttttgggaaatgcgcgaaaatggaaacgcttttattacaactcatcactcaattaattacataattaattgtcattaatgcaaatttacatttgcgaataaattttttcggatccaa

SEQ ID NO: 93157 - DNA, 450 bp, Heterodera glycines
  misc_feature (424)..(424): n is a, c, g, or t
  misc_feature (427)..(430): n is a, c, g, or t
  misc_feature (433)..(440): n is a, c, g, or t
  misc_feature (446)..(446): n is a, c, g, or t
  SCN-specific regions: Sequence locations=42-42,213-273,296-322,344 -353,399-450
attacataataactaatagcttcataagaaataacaaattgatttacaaaattcaatcacttggaatgaaaaggtttgttggcatttcttccgccgtttttctctgtcacttctttttgccgtacgattgttggatcagtagtgggaaaaagacgggtcgcattatgccaatgccttgtggctactgtaatgcttgctggcacctaccgtttccactttgtacgcgtcgtgtttggcgatgatcgcatcgaaaccgctgaaaaggtcgttcagaaaagcgaccacttggatgggcgttgaagtggaggaaatgcgcgtgaaactgaacaaaaaggggtgggggattatttgggatttaaaacattaaaaaataattattttttaaattttaaatttaagatttgagtataaaatacccccttanaannnnaannnnnnnnaaaaanaaaa

SEQ ID NO: 93158 - DNA, 387 bp, Heterodera glycines
  SCN-specific regions: Sequence locations=1-207,232-245,267-387
cttttttttgcgtttttttcacaaaaaattccattaaaaatgcaacaaaatcgtgaaaatatactcgtggatgagagaatcaaatcttacgtagcatatgaattcctacgtattatcatcgtgccctgcatgtgagctacgcaggaattctgattctctgacccaagaaatagaaaagtcactgctctgaattgttaagggagcagatgcacattttatataaattttattacctaccataataaaaaatttattttagattacttagtttgcgaaatgtcaatttttgggtgtgttggtgaaatgtccgaatttggattagccggcgaaatgtccatacacacctttctcattgtaatttttttgccatactgttaaacgaaaaaa

SEQ ID NO: 93159 - DNA, 277 bp, Heterodera glycines
  SCN-specific regions: Sequence locations=1-104,126-255
actcaacgggttctgctgttgttgctgctaggacgggttgctaaacaaattcggggtcgattcgcctcctcttttagagtcctcgcctcgctttgttccatcggttgctccttctcccctattccgtccccgggcaaaaatcgcccttttatcagctccaaattgcttctgtagaattcagtcacgaattgcgacatgtgtacagtgccctcaatttgtattggcgtaatttgcggagtatcgccgggctaatataaaaaaaaaaaaaaaaaaaaaa

SEQ ID NO: 93160 - DNA, 565 bp, Heterodera glycines
  SCN-specific regions: Sequence locations=1-136,158-228,269-541,563-565
acctaatgcgtttatttgttctgccgctgttcaccgagacaattctgcgtcaccgatcagcgattgattatccgctgaatttggattttacccttctataaaatccaatcaatcgcttcgttttcccaaccaccaaatctcatatttttggtttaaatcaattcagctgataattccattttttacacttttttgtttttattttccaatgacgattattaaaacgtttctgtctgtttgtgcgctgttgtgtttcttcaaatgtaattcttatgctgacgaaaatgaagtgagacaaatgtcagcagtaaatgaccaattccaactcggtccaagggctatgaatatacagtttactccctcaccatttgctaatgggatcatattcattcgtaattaatctattgacgtctcgccaattttggcctgcatagcaaattgccgaaagcgacacttgctagtgccgagtcgagacttctgctaccggaaagtgtgccggacaataactgcagcttatgaggacgcgtcagggcaccagcattaaaaacggagaaaaagaaatgct

SEQ ID NO: 93161 - DNA, 605 bp, Heterodera glycines
  misc_feature (487)..(487): n is a, c, g, or t
  SCN-specific regions: Sequence locations=1-605
ctcgttttcagcacgtggccgggactcggtgtcctacagattttgcggaagtgccctccaatttgatggagtgtttcttcaacgacccacgagtactccaaaaaatttggcgagattcgtcgggccgggcgccaaccgatgaaaagacggagcttttggaaggcattgccaactcgcggagagtgttcgacgccctgcacacgacgcgacaagccctttatgcgctgttcgacttggaattgcacggcgaacgcgcggcagagatagcggagggacggatgagcacgacggaactgttcggccatctccaaagcaaggcgttgcccgggctgaaaaacggggaccaaatcgcataccatcacagaatcgcccatttgttcacttatggcgccaaatattattcctatttggtcgctcgggcgggcgcttctctgatttatgagcgacttttcgccgacgatcccctttcgggacgcaatggtctcanatgggcaaaggtgcaatcccacggcggtgagcacccgtccgatgtgctgatggccatggcattggactcgccggaagggaaggcgccgaccgccgccgaattggtcgccgcattggac

SEQ ID NO: 93162 - DNA, 597 bp, Heterodera glycines
  SCN-specific regions: Sequence locations=1-37,60-597
atgaattccaactttgttagtgatatgtctaccaactacaacaacagcaaccaacaacagtcagtttcaatccgttcatatcagaaccaaatgcagtccgttcctgtgcctattcaacattccgaggaaagccaatttaatgggtcgcaaggaccgcagacaattgaacccaatggcaatataaaaaatggttttctccaagagaatgatgtgaccttacagagacagcaacagcaaatggccgtcagttctccctctgtgagttcaactgtagattgtaatgctggattgggcaatggacaaaatggcatgcggtacggtttttttgctggctcgcaacagtcggatccgtcaagttttcttttgcaacagacaacagtcgaagaaggtgttagcaacggcgacatttgccataatgcgcagcgacatcagctgcaattttctacgatgaacggccaaaatggcggaatgtgttttccatcgaatttgccatcagcaatgtcgatgttagcaaatgctcctcaaagacgaacatttttattcaattcggacatggcaaacaccgctgctaaatctatgcagcagcatttaaccgaa

SEQ ID NO: 93163 - DNA, 549 bp, Heterodera glycines
  misc_feature (453)..(453): n is a, c, g, or t
  SCN-specific regions: Sequence locations=1-549
atttgtcccttccaataaaaatggtcttccgttgcccggtcaaaaatgccatcgacgatggcccatcgtccgccgttgtccgtctgttccgccaacggtttgacaactgcgacccgcaatggctgatcagatgcccgggccgagtgaatctgatcggcgagcacatcgactacagcgactactccgtgctgccgatggctattgagcacagcacatgggtcgctgttggaccatcgccggaacggacggtgcaattggtcaacgaagaagaagaaaaataccctcccttcactttggccatttccgattcgttttccggcgcttcctccaatggcgccgtgcccaaatggcaccactattttttggcgggttggcgcggcattttggagagtttagcccaacgggagggtgtcaacacagagacagaagccttacaaagagccaaaggaatgncgtgcggtggtggccagtcgaattccgccaagtgccggactgagcagctcttcggcattggtctgtgccgcggcattggccacgctttgtgtgcaa

SEQ ID NO: 93164 - DNA, 133 bp, Heterodera glycines
  SCN-specific regions: Sequence locations=1-88,110-133
aattgaaccattaattagccccaccatatcacatactgatctgtcagatttcgctaatgagtgccccaaacttatggccgctggtgcggattatttgcatttgcatattatggacggccattttcggccgaat

SEQ ID NO: 93165 - DNA, 241 bp, Heterodera glycines
  misc_feature (219)..(219): n is a, c, g, or t
  SCN-specific regions: Sequence locations=1-20,42-191,214-219
aattgtcgaaccggaagagcaaaattcaccgcaaaagaaggagtacatctcgagacttcgcatgccaacaatcttcactcgccgcaacacgcgaaaggacaccgaaaagaaatgaacgtcttccacagacaacgcgctcatcgcatttttgtacgaagaagcgatgaagaattctaacatttaactcatcttacacaaacatataaatatatacacacnaaaaaaaaaaaaaaaaaaaaaa

SEQ ID NO: 93166 - DNA, 640 bp, Heterodera glycines
  SCN-specific regions: Sequence locations=1-323,345-501,523-640
actccgtactgaatcggcatgggccaaccaaagtcccagccccccctcttacattccggtgccagggaccggattgactgatgacctcagtttctgggaacgcacttacaatttggtggcccatcttcgccagctgtacatccatcagcacattattctccgaagggtcgacaaactctttcagaagcatttccctggaaaattgcctgattcgtttaccctggagcggaatgcctccatcaactttgtgaataacccgcccattttcgatttcgcccgtccatacatgccacgggtaaattttgtcggcggattgcactgcaaaaaccaaaccaaatggacaatggacagaaaattgctacaatttgtcaatgcttcttccgatcagaaaggctttattttaattagtggtggattttctgcccaatggtcacacgccccagcggaagtgatcgagaatttggatggtgccattcgcgagttgccagacattctctttgtctggcagttcaatggaccaccgttaagggacactccgaataacctttttgcggctgaatggcttccccagcaggaattgctcgctcatcctaaatgccgcgcccatttgtcccacgggggagtgaacagtgtcatcgaa

SEQ ID NO: 93167 - DNA, 586 bp, Heterodera glycines
  SCN-specific regions: Sequence locations=1-72,94-400,422-586
atattagatactttttatccattttcacataaatactctcttacttcaaaatgtggaaaaatccgaaaaaagccaagaaggaatggaaagaaatctctctctgcggcgactgttggctgtcagtgttccaatttatcggcccctatgaactcgggttgaaatttgcgttgctcagtgatcgatttgaccatttggtggacgagcatttcaagacgaaaaagtgggcgatgggtttcctggaaattcgtctctcctcaaggggaaaacgcgcggtgattgtcaacaattttggcgacggacagcgcagtttttatccaattccacaaaagccattgcccagcaatatcgtcggatttgaaagcattcgtataagttacgtcgaccaacacgtcgtccaatttctccaccgcattcgccgccttttcgactccgtcccgacaaacctttacattgcgaccgccgctttggccgaaactgtctaccgcctgaagcacttcgtccgcagttgcgaggcgattcgccaacacattttgccgctgctccgtgccaatgtccgcgccctgtttttgtcctctcccattttcga

SEQ ID NO: 93168 - DNA, 65 bp, Heterodera glycines; identical to SEQ ID NO: 57115
  SCN-specific regions: Sequence locations=1-20,56-65

SEQ ID NO: 93169 - DNA, 451 bp, Heterodera glycines
  SCN-specific regions: Sequence locations=1-395,417-451
ctgtgcgaatgtcgcgggagagtatatcgtcttcaccgaacaacatgatcgcagtctgcacctggcaaatactaatggattgcatcgcctagagtgcacgacttggcatttacaacagtatatcctcctcatgtacgcacaggatatgaacagcgtactgattgaaagcatgtgggacgaatctaattgtggtgattgccttcccatcgatcggaattgggaacgtggtaattccacctttgacttcgacgctagaacgtcgcaatttgaacagtgcttgcggcaatggccagatcgcgttgttcgacataatgaaagctcgatttgtcaaggctgccgataaccatacgacacacttctcgtatgttattgcgacatattttccgatgcccacactgtgtactgtatagacgtggacagcgagatgaatgacacgatgaaattgtggcaa

SEQ ID NO: 93170 - DNA, 78 bp, Heterodera glycines
  SCN-specific regions: Sequence locations=1-78
gtcacaccctatatctttctctacatagtgatcgtattaactcatagggctatgttctatttggcgaaaaaaaaaaaa

SEQ ID NO: 93171 - DNA, 143 bp, Heterodera glycines
  SCN-specific regions: Sequence locations=1-143
ctcaagccctcagtttaacacgccatgcctccgtttctctcgtcgctcgccatcgtggtatcgacgattgccttggctatagggactgctcaagcagctcctgccgacgagcctaccgcccgcgcgtccccacttctcacaac

SEQ ID NO: 93172 - DNA, 430 bp, Heterodera glycines
  SCN-specific regions: Sequence locations=1-117,140-430
ggcaaaatcctcccccactgacatccgaggccaacttggcctgctccgccggatccacttttgtttcggaaaacccggtcctaactgtacacaatgccttccataatgatggctcccttttcaactggcaatgactattagcggtctcgcggccttgcgcactggaaaacatcccgttgctgtctactttggcaatccactgcttggccataagaatacgttgcccttgtttttccaaagggaccaatttttgcacatcctccgcttccaatttttctgctccctataaatacacccgaggggttggatagttgagaaaaacacatttgtaaaaggccttccccttcggaaactccgcttcacccgcaccgattttcagctgtttcaacgactgcaccccaactgcttgaatttcttcccgtgcactcat

SEQ ID NO: 93173 - DNA, 250 bp, Heterodera glycines
  SCN-specific regions: Sequence locations=1-250
cggcacttcgtacagtaggacatgccgacgaaactaccggatgctttgcccatcaaattcacactgagatggccatgatgatgccaaattggatgttcgaaattgcatcaaagctgcaaatcaaaagcattgaaaagaaaaatagaggaaattcctgagaaaacatttccataaaaacattatttttttatggctgtcgcatgtgctgaataaatcgctgtgttttacaaaaaaaaagaaaaacaataac

SEQ ID NO: 93174 - DNA, 397 bp, Heterodera glycines
  SCN-specific regions: Sequence locations=1-9,31-33,55-58,80-234,258 -397
ggaattttaaagaaaataaaaagcgaaaattaatggccaccaccagcggagaaggagcttgccaagaatgcccgtgcagtgcttaccgcgaggatggcattgcggacgaaaatgaccgatgctggtactgttggtgtggccatctgttgcaagtccacggcgaagccggataaacactttccctgacattttgccaaacagcacatgaacacctgtggagaaaagggccacaaattaatatttatttgttattaattagcatttattttattgggacattccattgattattgaatatttttttgtttcttgaattttattttttgcattttatttaatgaaagcgttggtttttaaataaattatttttcatctatagagccgaaagaaacaaaaa

SEQ ID NO: 93175 - DNA, 624 bp, Heterodera glycines
  SCN-specific regions: Sequence locations=1-624
gaggcatcaccagcagaagcggtcgcaccaacaagcggccgccgtcactttggcggacattcgctggatggaaccgatggccgcgactgaaagtgccgctacttcttcaacaccggcaaagcggctgttgacacgactcggcacaaccagagtgggccgctacgttcaacagttggccatcgattacgcagcttccttccgcgacatcgtcgttggaatgcgtcagcgaccgctgcgagccgtcgcttgcggcgccgccttggcttcgcttgtgttcactttaaaatccaatccggacgaaattgcgctgcgcgcgcgtttggctcagttgcgtcagcaaatggtgctcatcccggcgtccattcacagcactcgtgccgacgaacggctcgagcagtacaccgtcctgttgaatgggaatcggcttgaactcgtcgactttttgctcttctctgtgctcgttgagcgtccgtttgacaaaaagaatgaattttacgctgcccacgacaaaacattgcgtggatggccgtggaccgagctgtggcggaacgcgtgggacatcggcgcgctcggccgtttctgggccttggagcggtcctttgacaattgcgacgttcgccacga

SEQ ID NO: 93176 - DNA, 630 bp, Heterodera glycines
  SCN-specific regions: Sequence locations=1-436,459-630
gtcggctgctgtccctggcgaagtttactcattggatcaatttgtgcccgaattgagcgaagttcatttgcgcgagcttcaagaggaagcgatgcaatttttccgtcaaaacgaaagtgtgcaaaaattggtcaatttgggcatatcttccgtcgttgccaaacgccttggaaatcctttgcgctatggaaatccgtcccgccgttgttttttgtcccttaaaatcgttgcacttgccaaactgacgcagaccattcacaaagtcaatgttaaagaaattcggaagctttcggtgaaggaagtcgaatcattaagttttataccaccgaaaatgctttgtcatatccgcgaggaatttttatcaattccgcaaaaccaaaaaggaagggttttctacgaactttcagcagagaaaaggagtcgcattttggccgaattgctttgtcttttgctgcttttcgacgatcccgaattcactttgccaatttctccgattgtacaggatttttatgtgtcggaaaatgtgttgaaaaatctgctcgttgcgatgggatgcgtagtgagcgtcgccagtgaaacgcaggcactttcccttaacacgattcggatcgctcgtcttgttggtcctcc

SEQ ID NO: 93177 - DNA, 539 bp, Heterodera glycines
  SCN-specific regions: Sequence locations=1-539
cgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgcctcgtcatgaacgcgcggctccatcaccaccaccagtgaaaagggaacgtactccggaaccaccgccacgccgactttgtgttcgaaatctaagcagaaatatcacaaaagcgcacatggaggaaatcttcgctctgtttggggctctaaagtcctgtgagttgccaatggaccgtgtgcatgtgcatttgccccggggatacggctatgtggagtatgaaaaggcggaggatgcggagaaggctctgaaacatatggacggaggtcaaattgacggactggaaattcagtgcgaaatgact

SEQ ID NO: 93178 - DNA, 599 bp, Heterodera glycines
  SCN-specific regions: Sequence locations=1-599
gtttcactgccgatccctcaaaacggcctaaaccgacggagttgctgaaccattcgttcatgcgaaacaaatgcaacgaaacgaaagcgagaataaacattggagttgagccaaaaggcgaagtccaatggaattccaaacggagaagcctccgacttgacatgatggcagtgcacagttactacggacagctgaaggagcgcgatttgatgtttgccattctgaacgcgatcaaattggtccgagagggcaccattccgccgattttcatcgaaaaactctctgccgttgtccatgacaaatttgtggcggtcgacgcttcgttggcgttccaacagagcgaagaatggagccgcgacgtgctgaacatttcgaatgccagcccatccccggaggggacaaaacgacttacactcagggaacacaaaacaccgcactgttcaggggaacagatcaacacgggccacaacaacagcagattcccacgggaagaaagggaataccaacgttgtgagatggtgttcttcgtcaaccgaaattggtcaagggaacaccgacaacttttcgttgcttaccaattcgcccgttggttttcccgc

SEQ ID NO: 93179 - DNA, 567 bp, Heterodera glycines
  SCN-specific regions: Sequence locations=1-567
gaaaaaggtgcaacagaacgccacatggatgagtcaacagatggatttgacgaagacgagcaacaacggagagaccatattgaaaagctacgcaagcagcgagaggaacacgcgatcaaattagacgcggtactgaaccgatcgggacttagcacgaaaatgcaggaactgatgggcaaatttgtactcgtcgaacaattttatatgacgcaatctgtgaggaaagccattgacatggacagcatcgaggagggcgcgctgaccagcactctgttggacgacgtctttttcattgtccgcaaaagtattcgccgttctatcagttcgtcgtcggttgactgtgtctgtgcaatgcttaataatggcgcaacgcttttggagacggatttcctcaaatacattagtgcgcctattaagtccggctatccgtccacgggttggagtgccgaaagtgcttatcaaacagcacaaaatgtgatgcaaggaaaaggcgaagttgtcgggggtttggaaaagcaacggagtgctttcataacagcactgaacaacttgcgatcatcaattgat

SEQ ID NO: 93180 - DNA, 436 bp, Heterodera glycines
  SCN-specific regions: Sequence locations=1-396,418-436
cataaacacaagtctgttgatgtcaagttctactgtctgtgccggttccagccaggcgacgccttcaacatgtattggactaccaatccagaccgccggtttggcccatcttcccaaaaggctcaaaaatggtctgatgtgctcggcccattccgttgtccgcacgacgaccatctgacaaacatcattaatgatgacgacctctggtaaccgatgccaccaggcaatgtccctgagtgagtgcaccagaactagggcacggagcccgttgtcttggaacgtccgtccaattggttccacttcgtcatccccgacgaatgcgatgggagcgttaataataacccttttttctccaacgccatcccaggggcgcctttcctcaacaggaatttgtgaaatgccctttctctcatccttcgattcttcctccttgtgt

SEQ ID NO: 93181 - DNA, 628 bp, Heterodera glycines
  SCN-specific regions: Sequence locations=1-628
cgagcttcccattcatttgacggatgaagctcactggtgggtgtctactaatataccgcctcgcaaatactacttctcaatgcctcttcaaattgtcatcattgcagagctgctcgtcctttctggtctcttctcgggtctcaaccttgggctgatgtcacttactccacaaaagttgactctcatcaaaaattccggttcaccaaaagagcggaagaatgctcagaccatcctgccaatgcgcaagtccggcaaccggttgctgtgctcgttgctcatcagaaatgtttgcatcaactctgccatctcaattctcttcgacgatttgaccagtggcaccgctgcattgatcatttcatcgaccggcattgttgttttcggcgaaatcatcccgcaggcgctgtgtgtgaagaagggcttggctgcgggtgcctgtaccatatgggtcactcggttctgcatgatgctcactcttattggatcctacccgatcagcctcattttggacaagctgttgggtgaacaagtcgagtcatatgatcgcaagcgcctcatcgagctcatcaaactgaacacgaagaatgcggcgcaagcggatgagctgaagattgcgattgacgccttcgag

SEQ ID NO: 93182 - DNA, 405 bp, Heterodera glycines
  misc_feature (377)..(378): n is a, c, g, or t
  SCN-specific regions: Sequence locations=1-318,340-375
cattgttcccgtaccatagccgttcattgttcccataccgtagccgttcattgttcccataccgtagccgttcattgttcccataccgtagccgttcattccgtagggcattgttcccgtaccatagccgttcattgttcccataccgtagccgttcattgttcccataccgtagccgttcattgttcccataccgtagccgttctttttgtagggcattgttcccataccatatccgttcattccggtgccgataccgtatccgttcggtatgttcccgtaaggcgatgttcctcccgtaccgtaacctccatacggatttgtgttgctgctgctgctcccttgctgacctttttaaaaaaatatttttgcattannaacaaaaaaaaaaaaaaaaaaaaaaaa

SEQ ID NO: 93183 - DNA, 530 bp, Heterodera glycines
  SCN-specific regions: Sequence locations=1-453,478-530
gaccttctttgcagtccagtgaatagctcatcaaaagctgaggtctcgcgcgcatccaactcgtccagcgtttgtagcatttcctttttaatcaggtcgaatttcacttcacgcatccctattttggacgcagtgcgctcaaaatcgactgcggcattcaaagacctttccgcctttcccgtgacttttagttgtaacgcttttaatttttctgcgttggtccagccttcggtgccaatttcgaattttcgaaagaatgctcgaattcggtccgagccctctcttccgttgatgtcgggcagcttatccaagataagaattgcttcgagtcgattatagtcgaatgggaagcgctttgttgcatttcggtggcttccctttggttttggcattggttgggtggtgctttttcagcgttgaaccatggcggtggcatccatgggtaggacccataccaaggaggaggaggggggtaagcccttgagtccccttcaaaattcggtctctgtctgaactgttgttctctatgg

SEQ ID NO: 93184 - DNA, 565 bp, Heterodera glycines
  SCN-specific regions: Sequence locations=1-60,82-497,530-565
gtccaataaaggtccattttatgccgtcgtcccttaattactgtccattgtccttcccatttttgtgtgcttttatttgttgtttttttctctgctgttgttccaccgccgatgggcaacaacaacaacaacaaccgcacatggcactgttggtggaaaacaatggcacaacgccaaactcattggcaacgacgccatttcaagacacaaacaaaaacaatctatccgaagttgccaatcctgcgcttggctggctcttttttctgagcagtttcgccgcttcaccacctgcggttgtcgagaatggcacttcggcacgcatcctttcgtcaaatgccgttgcatcggcaaacaaaaacagcgtaaagccaccgccgttagatttttcgctgatcaaactgcgtaaggctggcattttggacccacccaccggtttggagctgtacttgctggcaatgctgttggttgcactttgctccatcctcttcactttggcattgttgtgctgctgctgttgttgctgctgtggacggcacaaaccgaagtgccgtcaatgctatcagca

SEQ ID NO: 93185 - DNA, 589 bp, Heterodera glycines
  SCN-specific regions: Sequence locations=1-589
ctaattgagcctaatgatgatcgaaacactcatttccatggtgcgctatttgtcagcgcgaaaggacgatgatttttctgatcggatgaattatttgtacacaccgaacatccttttggcattttcggtgctgatcagtttcaaacaatttgggggcaggcccctcgagtgtatgttccccaacaaatttcccggcagttgggaacagtacgcagaaaatttctgttggtctgaagacacttattatttaccacccgaagttcacgtggcacaaattcaagaatcagagaggtattcgtccggccgtaagctttcttattaccaatgggtgccctttttcctcctttttcaagctgcttgtttccgtttcccaagtttgctttggaaggcaataaatctgagttccgggctccgagtgcacgacgtggtcaccaaggcattggactcgcagaacatggaagagagcaaccgccaacggacccttcagattttggccaatcatttggccagagcactcagtttccaaactcaaattttgagacggcatctgatcgtacaccaaacattccgttttctgaatgtgacttgc

SEQ ID NO: 93186 - DNA, 416 bp, Heterodera glycines
  misc_feature (410)..(411): n is a, c, g, or t
  SCN-specific regions: Sequence locations=1-368,391-416
ctcagtcggaggcgcggcagcgaatcgccaacaaaggcaaaaagtgtaaatgaaaaagaatattcccgaataataaataatgcaggacagttttggaggagtgttaccaaagtgtcaggacaaagtgtcgacaaagggacaaatggacgaaagacaaagcgcagaaagggattggtcgagaggccgaattggacctgccgaaagtcggtcttcgagcgcaagtcacctgcccacggcaatcggacagaacgccaaaaaagtcgctgaaaatgtcccttcggccgctaaaaaagcgggcatttcgtggctgggccgtctccgtcggaaggagggacaaaagacaaacgaatgactcaaatggccccgcttttgtctttttattgaaatgagagaataaaatgcaaatgttnnaaaaa

SEQ ID NO: 93187 - DNA, 600 bp, Heterodera glycines
  SCN-specific regions: Sequence locations=1-600
gtccacaaccctttcctggaccattctcgtcgctcctccgccttcgcccacttccgtcccctccctacgcccagcgctggcttcaaattatacgacatcgacggaaggggcgaaggcgtcgttctgccgcaggcggcggagcgtattttgatgcatagcgcagttcaacggcgtgtcgcggggcacagcgaaatgttcaggagagagtgcgaatgggaaaggcacttccgcaagaggaagtgccggctgatcaactgcacggaggacgtgttcgaacaggtccagcagatgaacatcgactcggtggaaaggtctgcacagcaaaaggtcgaaccaatggacccgcgtttggccgcaaagtccgttttggagagcatcgcgcgtccgttgcggaagtatctccgcttcatcggccaagaggcgttcttccgccacgacgattcgcttgcgcatttgcagcggtgtttggccttcggcttctccgcacgcacctttctccagcgctttttctcctcctcaacgcctcttcaagaagtcctttccgagtccaaatggtccgttctgtgcgactcgcgcgtgtccggccccctgcggcacggc

SEQ ID NO: 93188 - DNA, 569 bp, Heterodera glycines
  SCN-specific regions: Sequence locations=1-228,250-255,277-569
tttaaaaatgtgcagttcgtccggctgctcgctcagtgacacttccgggtccaaataggagctgatctcggcttgtcctccgctgatcacttgcagacagcagtctccgctctgcaaatgcaaaatctgtgcgcggtttgctctgtcctgtcagcggacgtgtcgcttcttccgttcggccatccctgagttcttgcacccgaacataagtctcctctcggcaaatctccacctctttgctcccatcaatgctttgctcctcttcgatctgttccaattcttccatgttcatctcttctccgtccaattcttcgaccgtcgcgtgtccttccaacatttgttctgactcttccgccatttggacaaacattggagaaggacttttctttgcaatgggagaagtctcttccgtcgcaacgggcttttcctcatcctccacgatggctttcagctccgtctcttccgccggcttctgctgctcttcttcgctacacacactttcggcactttctccggacgaagaagtcgatgaaacggaccgactacgatgagagggcgaaactgcgcga

SEQ ID NO: 93189 - DNA, 304 bp, Heterodera glycines
  SCN-specific regions: Sequence locations=1-230,252-304
acaatagttgatgtacgatccgttgttgaacactgcacgtcatttgggtggtcagggggcggaccaacaacaacaagagctcacccaatacctttcatacacgtcgggccacctgaagtattattttgcggtggacaaccattatgtgcgaccaaagttgggcatcattctgttccccctctttcatcggcatggggccaacaaatgagagggggatgcgcccgtgttgccctgtcatgatgtgaatgctcgggacctgtacatttcgatgatggagtatattgcctatgtgctggtgactggt

SEQ ID NO: 93190 - DNA, 355 bp, Heterodera glycines
  SCN-specific regions: Sequence locations=1-1,23-355
ccctgctctccaacggacgaattcccctctttgctggcgttctgatcaccatggtggacacgttcacttttctgctgatcgatcgctacggctttcgcaaattggagttcattttcgccgttctgatcagcacaatggccatcacttttggctttgaatttgtcgtcgtcaaaccggacggatgggatttgatggccggcactctgttgccctattgtccgggctgtggacgtcaagaattcctgcttgtgtttgagtggggttcactacgttccccatccctgatgatctatttactgtttttttcaaaaaattttccaagaaaatcatgaaaatttaaaaaaaacaaacagca

SEQ ID NO: 93191 - DNA, 606 bp, Heterodera glycines
  SCN-specific regions: Sequence locations=1-606
gcacatcatgaatcatgatgagccgccagacggcggccgggatgcctggctggttgtacttgcttcgttcttggctcatttcgtcgtctttggtattcaatactcgtttggtgtctatcaaagcttctttgtcaacaacgacttcaaatcctcgtctcccgcatccgtttcgctcatcggaaccgtcggatttgccgccatcttttgcgtcggcatcgtctctggcaagctcgccgaagcatacggctacaggcgcacaatctttgccggaaccatcctcatcacctctgggctcgtcctcgcctccttttcgtcgacgctatggcagctcattctcactcagggcctcatggtcgggcttggaagttcgctcgtatattacccaagcgtcagcgttccctcgcagtggtggaaacgtcggcggtcgtttgcgaccggtatcgctgtcgctggatccgggctcgggtcgctcaccattacggccgtcacggatgccatgttgcggacagccggattgaggtggacgctgcttgcgacggcgctcatgagtgcgacgctgctgctaattgcgctcgtctttctcaagacacggattccacggccccc

SEQ ID NO: 93192 - DNA, 370 bp, Heterodera glycines
  SCN-specific regions: Sequence locations=1-370
gctgattggcgagtctgatcaggcccgtggctatttcatcatcaacggaatgaatgcccaagggctgtcctttggcggcggattgggcgatttgttggcccaatgggtgctccagggtcggccgccggtcaccacacaatcagtggtggacacgctggacgagtctcgctttttgccgttgcatgcccacccacagtatgtgtttctacggatgcccgaggtggccagtaacatttataagaattttactgcttcccatcaatgccacagcgtccgaaatttgcgcacattcgccatccatcgccaccttcaagaagcgggcgctgtctttgcatataatatgggctatgaacgaacaattcggtacgat

SEQ ID NO: 93193 - DNA, 343 bp, Heterodera glycines
  SCN-specific regions: Sequence locations=1-343
ctctaccactgatgacgacactgctgcttttgcttggctatctgagaaaatatttacgacggcacgtggatgggactattacggacccgagggggcgtacggagcattggctgggcatgacgcaactcgtgggctgggcacgatggatgtccagccaatcaaagaccaatttgatgaccacggcggaattgacccatccgatttggaagaaacgacagagtggcaacagagcttgtcattgtaatacccgttcccccgtcgacttttggctccaggagagcaaaacaccgagtatgacactgttgcagacaaccgtgagggatatttgacagcgggtgactcg

SEQ ID NO: 93194 - DNA, 351 bp, Heterodera glycines
  misc_feature (346)..(346): n is a, c, g, or t
  SCN-specific regions: Sequence locations=1-275,297-351
aacagatcagccttctgtcaatgcatttcggcgctgagcaggtgaacagacgcatctacggcttcaaggccgactttttcgcaaccattgccaattcgttggcgactgaatgcgtctttttggacggtgcgtcgcattcgcaacggatgccatcgaagcgtgggccgaactcgtggaaatgatgttcagcagtgtccgcgatggctattacgcggaggtgcgtcgaaggcgccggtgcagcggcggcgcctccggagagaccaaaagtggccaaaatgaaaagatcataaaatgaaacacatttttttcactttgttgttgattaagagaaaacgaaatttttcanaaaaa

SEQ ID NO: 93195 - DNA, 577 bp, Heterodera glycines
  SCN-specific regions: Sequence locations=1-226,259-422,444-577
caagctcaccaacgacgaaatcctgcgctacggccgccaactcatcctgcccagcctcggcatccacggccaaacctccctcaagaactcgagcgccctcattgtgggcacgggcggtttgggcgcaccctcgtccatgtaccttgccgccgccggcatcagtactctgggcctggttgacttggacgtggtcgacaccaccaacttgcaccgacaagtggttcacgctgaagaggcccaggacttgcccaaggtcacgagcgcgcggtagtcgctgcaacggctcaattcgcacgtcaagtacgtcgagcacaattgcttgatctcggccgcgaatgcgttggaaattgtcgccccgtacgatattgtgttggattgctcggataatgtggccacgaggtacttgctcaacgatgcatgcgtgctgctgggaaagccactggtttccggatctgcgttgaggctcgagggtcagctgactatttacaaccacgccaacggtccatgctaccggtgcctatttccaacgcccccaccggacgaaaccgtcaccaattgctcggacggaggtgtcatg

SEQ ID NO: 93196 - DNA, 503 bp, Heterodera glycines
  SCN-specific regions: Sequence locations=1-275,297-366,389-503
gtccaattaagattataaagcaatggaaaacgaggaggagcctcagcttcatattgacgtgttgcttaacgttgcagaaaagctaattttctcgcctgacaatgactttcgtcttgatttgagagacccaaacgccgacatcgtcaattttatgttcgctgggcccgcctgtcgttggtcctttttctcgcagtttcggaagctcacccaagtcagtgtcaactcggccgaactccaactgtacgcgccgaagccgattcagggcattcgcggcactctttccaacaacaaagagttcttccaagggcccttcgtcgtcaccgatcagttcttttacacccttttctgtcgtggcattctccgacccaccgtcgtggacactttcttcatcttcggcaatgacgtcgtcaccttcgacagcgttccgtcttcttcggcctccataatgatgaacgattggagggaacaattggaggacggagaagaaacggaagagggagaga

SEQ ID NO: 93197 - DNA, 605 bp, Heterodera glycines
  SCN-specific regions: Sequence locations=1-215,237-469,492-526,550-605
gttgccagtccgcaggagcgcaattggcgtggcattgcaacagcgcttctcgtcatcgtcgcaatgtgttccatcattgcacttgccgtgcttgtgcttacgccccctcttttggacgctgaccaaccgcagaagcgcgtcactttggccgatgtgctgactcatcgctttctgaactcggtggagtcgttggaatggttggacagtcggcgactgctcgtcaaagaggcggagagtgtccgcgtgttggaactgaacgaaggggcggagaacggaggcccaattgggtggacatggaaaacgttgcctggcgatttgtttcgctttggtaagcccagttccgtgtccctttcgcccgggggccgtttcatcattttgaactacgcgccaagcaaacggtcgccaaagagcacctatcgtatctacgacaccgagaaacagattttcgaaaatgttgggcctaaacagagtggggatgagaatgtgcgcgttttggcgtggagtcccaacggcgaccatttcgcttatgtgcatgagaatgacgtgttcttccagcggagtccgtccgcttcgctgagcgttcagttgaccaatgaatcgagtgc

SEQ ID NO: 93198 - DNA, 524 bp, Heterodera glycines
  SCN-specific regions: Sequence locations=1-524
ggtcgcgcactaatgccgccattgggcactcgctcatccataaactcttgagcgaaaggttgaaaattgggacttcactgtgttctctgcgtgtccggatggattgaggaccgggaggacagcgcatttcggcaccatttggccacctatgagcaaggagcgagcagtacacgggagaacaaatacttggaggaattgggccgcagcattcattgactttttcgtctcctttgttttttcctacgccattcaacgttcgctgatggaaacaatgttggccagcctcgtgtccgccatcgcatggcctttggtgctgcttggttcctcctgtgtcattgacaacccgtaaaatatttgcactcgacgtgctcgtcaggtgggtgaacatctcgctgaagtattgctaactcgacagcactgtcgacgtccgattcactctgatcgatttttccgaagtgttcaaatgatcacctctgatcggcttttggcttggcgcccgcgtgttttaatttttataattctta

SEQ ID NO: 93199 - DNA, 285 bp, Heterodera glycines
  SCN-specific regions: Sequence locations=1-146,168-285
gttcttctcgcttggaaattgtcgtggattattttttccaattttatggcgaagcttttcagttgtgggctgtcgtcatgctcagtcacattgcttatgtcctcaccaatgattatttttgtggaattgaaaatgaagaattgtgagaaaaacaaagcaaaacattagaaatttataaataatcaccgatatgattttggtctattaaaaattttcatttttttgtctaattattaattgtttaaagataaattaggacttccgaaaaaagaaaaaataaaaaaa

SEQ ID NO: 93200 - DNA, 449 bp, Heterodera glycines
  SCN-specific regions: Sequence locations=1-423
agattatgaaaagtgatttatattcacaaattgatagaaaatttgaagaatcttctacttcgaatgaagggtcagataatgagctcgtagctgatgataatgcttctcttaattctatgtatatgaagcttgatttcctggaccgggttaaagccgagatcatcttcaattcactttctgtcgacaaagagccaaaacgaagtacaacgagacgattgatgagtttggatggcacaattatcactgcaaaattttcttccgatgatcagaaatcattgatacgaagcgccaataattttttcgacatgtgccaactgagcaaaagttgcatcgatatggcgcgaaattatgcctacaaatctcccaaaatgaagacagttcaaattccgacgaaaaagaaacataacaaataaaatttttatgaaaaaaaaaaaaaaaaaaaaaaaaaa

SEQ ID NO: 93201 - DNA, 319 bp, Heterodera glycines
  SCN-specific regions: Sequence locations=1-319
gaacactgcgctgccgtcacagggaacgatagtcactgcaggggatgatcgaattacaacaacctttgcaacatgtgcgattatctgtgcataggacacacccctctccttcgagtattgctccactttgcgctaggaggacattcacgacgattagcgctattttgccgaactgcacccatgtgttcaacctgtggacatccttttggctcgcgttttgggctatggcgacgcgcacacttcttatttgctcacgatcgctgaagctgaattgggagtagtgattggccggagccaaaaccgcgagcggcttctaccg

SEQ ID NO: 93202 - DNA, 596 bp, Heterodera glycines
  SCN-specific regions: Sequence locations=1-236,258-596
cagaaggcacaaattgaaattcgctgccacacttgaaagaatattttagacattaattgaaaattacaaaatactcacccctctcctttgaaaacaatccgatactcctgctccttctcgaacacgacaagccgaatttgtccaacaccgtgctcattgatgatcaaacgctgcagatgaccaacgtcctccaacgtgtacaagtccttgtccaccgcaattccagcacgtgtcagcagaaccacagcttctggcccatgttggtgttgtcgtgcggcatacgcatcgaaagcgtcgcgtccaccaccgttcggctgtctcgtctcacggtcacggagccccaggaggacggcacgcgccagacaatggcggtcatttggattgactacgcgcactagggactgcacggtgttagaaacactgtgctcagtgtcaaagtcacaagcacctaaattcattagaaaaatcaatattaaatgcagagtacaacctccacgctgagcatcagcacgaacggattcaaggggccatacagcaagaactttggttactgtagttccggcaagaagttcgattccagctgccgactgttcgtt

SEQ ID NO: 93203 - DNA, 554 bp, Heterodera glycines
  SCN-specific regions: Sequence locations=1-142,166-554
aaagttgctcgtccaacgccaacttcgctctcccacgaggcgtacgaaccgcaactgatggcctgagtggacatttaccggaccaaatgcaatgccaggcatggcgcaacggcaaaatcggcggtgccgacggttgacgaactgttcagggcacagcttggtcatttctacgctcagattgatggcattgtgtttgaagattttgtcaggtccgccgtcctcggtcagcttttacgcctccatctgtcttctgctcgttggccatgcgttgcatgggcaccgactggcccttctccgccgtttgggccccgcttggctaggccgagtccgcgaacagttggccgactgccgagccatggacgaggcggacaaagcggcacaatagcagcagaaacagggccaaaaaaggcacaaaaacgggacggacatgccgaggacgacgatgggatgagtgcggaattgagacgacaaatgacttaatcggtggagcaacaacagctgttccgaatgaacatgttcgccttccaacttgacgaggcggccgatgtgttcag

SEQ ID NO: 93204 - DNA, 239 bp, Heterodera glycines
  misc_feature (214)..(214): n is a, c, g, or t
  SCN-specific regions: Sequence locations=1-214
gatgaattgatcggagaagtgctcaacttaattcacgcagaaagcccggaacagtgaccgtcttgatgcttttaaatgcacttacgagaaaaaaaacaattccgcattttggtctcacttattatgctcattttatcctctcaccaacatatgacactgtccaatgcttcttttttttgcatttataaacggtgagttggatcagaccgggtcnaaaaaaaaaaaaaaaaaaaaaaaaa

SEQ ID NO: 93205 - DNA, 499 bp, Heterodera glycines
  SCN-specific regions: Sequence locations=1-499
ctgtaatcctaactaaatacatcaaatatatttggtcaaaaatgtacgcgacggcgcatttagcgccccaattactcattcgccttttgtcattttgtctttgcgcaacggtggcttctgcctttgtgtacggtagtagaggtggtggcgcatatggtgacggactaagaggatacggtggtgccgtatacggtagcggtggacactacggcgactgggatgaggacggtccctaccgaccgcccgtctaccgtagaccgatgtacaaaccagtgcccggcccgctgtacggctacaataagcgtcccccagtatatggcggtggcagtggcaacaattactactacccggcacccgcaccaaaaccgccaactccgtgcccaccggcggaaaagccaagtacggtagtaccaacatcatcgctagcaccaccatcgacgcaacaaagcacccaaactgcaactcatacgagcacgacggcacaaacatctccgaagac

SEQ ID NO: 93206 - DNA, 540 bp, Heterodera glycines
  SCN-specific regions: Sequence locations=1-1,24-229,254-306,329 -421,443-540
tgttccctgtgctgttccttctgtcccacttctaagaattcgacctccactcgtgtgatgtacgctttgatgttgttggtcggcactctcacctcctgcgtgatgctctccgaatgggtccaaaaaatgttggccaagggcggatggttctgttcggcgacgggcagtgcgggcattcccgtgtgtgacatggtcacggggtaccaagcagtttaccgcatttgcatgggcatgacctccttcttcctcctgttcatgttgctaatgctcggtgtcaagtcgagtcgtgacggccgtgccccgattcaaaatggcttttggtttttcaaatatttgcttctcggattgctcattttcggctttttctatctgagggacggcggatgggcgactccgatgatgtggattggaatgcttggcgctttcatattcattctcatccaactggttattatcgtcgattttgcgcatggattggccgaaaattgggtgagcacttacgaggagaatgagtcgcgctggtgctttgccggaatgatc

SEQ ID NO: 93207 - DNA, 292 bp, Heterodera glycines
  SCN-specific regions: Sequence locations=1-292
cacaatctttgtactgttggccatatctatctgcaaaaaagatccctggatcaacatcacctatctttgccaccccatcatgaatacctatctctgcttgtgacgatccatggaaagagagtgaagcatgaaacttaagacccactttcttaacaatctcagctactgccaagtagccaaaccattcatatgtccccgcagcttctttctcgacaactccccaaaagataggtaactcagtgacttctacaccaggtagcgttcaagctttaagcccagctgtaatagcttt

SEQ ID NO: 93208 - DNA, 401 bp, Heterodera glycines
  SCN-specific regions: Sequence locations=1-401
ggtctcgtcatcatctttctccctgcctactgccctttctttaacccgatcgaattcttgtttggcatgatcaaggatcgcatgaagcgccaactcagcggcactcagatgaccaacaagaacctcctcaagcacgttgccaccgtcatggaccccttccgcaagtacgacttccggccgctgtttacgaaatgcgggtacggcattccaggggcatttgaccctggttgtggcttccccgattcgctgctcgaaaaacatgccgagaccatggtggcgagggatgatgatggtacggatagtcaaggcgagggcgtcgatttcgaggtggaggagtaggtgcatgtaattgtgtacacgggcatacgtttctttgcacatactcgatttgtagattgaaa

SEQ ID NO: 93209 - DNA, 588 bp, Heterodera glycines
  SCN-specific regions: Sequence locations=1-588
tacttgaacgccggcgcgggcgtcgcacacatgcccaaggttggccagccgcagctcttggacacgtatgccgagcaccggttctggcgattcatgctgacggcgcccatggccacgcaccagtcgctcaaggtcgagtacatggtggatgggtgcgggtcggcgacattcaatgtgccgagcaagaatgagcagttcaagtgggcctttatgacctgcaacggcttctcgtccgacgtcaaaccccgtgtccaagctcaacactcgggcattgaccccatgtggaccgacattttgcgtgagcacgcgcaaaaggaattccacggaatggtggtcggtggcgatacggtttacatggacgacatctggaccgtgcccgccgtcaaggaatggctcgacatgcggggcgacaaggcgaccaaagtgtcggccccctggacggccaagatgaactcacagacccacaagttctactttgaccgctacatggcgcatttcacgctcaacgggtttgcgcaaggattggcggcgatgccgtacttgtgcgtgtgggatgaccacgacatctttgacggtttccgctcgtac

SEQ ID NO: 93210 - DNA, 409 bp, Heterodera glycines
  SCN-specific regions: Sequence locations=1-1,23-409
gcgccgccgccgctgccgcgacaccgccgtcgtttcaacgacgacattccgcagcagaaactgttcagcgattttggccataccgcggccgccttcgttcgtcgccgagtgcagcagcaaaaaatggtggtggagacgcaggaacagctgaatattgaccaccatccatccgcgtttcaccgtgtcggctcggccactgttgcgccacaaccgcccgctgctgtggtggagactaacgtcgttgccggaacgatgccgacagctcatatgaatcagcacaaccaacttggcacgggcactgcggcacaacagcaccagtacattttggccatgctccaacaggtgatgatttttctatggttattaactaaatttacttttgtttatttgttattttttatttttggaa

SEQ ID NO: 93211 - DNA, 552 bp, Heterodera glycines
  SCN-specific regions: Sequence locations=1-50,72-552
ccaagtttgagatggccgttttgactgtctgataatcgacgcgtgcggcgccaaaagcccccctccgggccaaaaataccctttaatttgtccctttgagggcttcgtcaatcccgaaacgattgtggacaaaatgtacaaaatgcttcgagcggacggaactctgatcatcaacactttcgttgtgccaaacggcgaaaatgaatccaaagtttccgaagtgcggcaatttctgttggaattgtttagacaccattttggggggcactgttattacatcggacttcattttagtaataagcttttggtctgtaatttggcactgtcctccgccgaaccgatgacggagaaactcttcgaccatcggatgaacaaattgcccaaatggcttcagggggaattaaggacagaaatgagcattgaaaatgaagtgtggagaaggcccaagtccgaaatttgagttcgaatttattttttcgagattcaattccataaatttcttctcgtgtctttaatatccaatctttttgttgtaaaaaatatacaaatccg

SEQ ID NO: 93212 - DNA, 349 bp, Heterodera glycines
  SCN-specific regions: Sequence locations=1-349
cgaagctgcgtgcgagaatgaaccaaagcatgagtgggcaaagctttttgtcccgctcgtcctccctgcaccactccgtccaacagcagcttaacagtgcccaaaatgccaatgccatcgccactcgtccgtccgcttcttcttcctcctcaaatttcacctccatttgggaagaacggagttcgccagcccaatgtcttcaaacaccgggaaacgagaaaagaataaaaaagaaacgaaaggacaaaacgacggcacttcggctgggggcgaagaaatcggcggacaacgatgcccgaggggacggagaagggatgggcgtggcggaaagcatcgtcctttgctgaga

SEQ ID NO: 93213 - DNA, 257 bp, Heterodera glycines
  SCN-specific regions: Sequence locations=1-257
gttttacgaaccgcccctccaaccgccttcacaatttctttcaacgaatcttcgcccgcgactgttttgccgcccccctccgaccctttgtgtgaatctattgatgattcacgtgaattttccctgcaagaagcggcccgtcaggcacccaccgtttttcttcttatggcaacgcgtcggagtgtgccgccacgtccaatgccggagaaaggcgagcggataggtgccaccgactcggggtcggaagccggcgaccc

SEQ ID NO: 93214 - DNA, 567 bp, Heterodera glycines
  SCN-specific regions: Sequence locations=1-567
gcagcctctgcgtaaagcgtagcgcctctgccacttgcaccaccgacccaacactttaccaaaccaagcatgacctcctactccgacaagggccccaagccggacgttggcaagtaccacggctttgaccacgttaccctgtgggtcggcaacgcaaagcaggctgccatgtggtacaccttgaccatgggcttcgaacccattgcctaccgcggcctcgaaacgggccaccgcgacgttgtctcacacgttgtccgccaagacaagatcaccctggtcctgcagtcgccactcaacccgaacggcgtcaaggcaatgaacgagcacatggcgcaccacggcgacggcgtcaaggacattgccttcgacgtggacgatgtgcgcgccatcttcaaggcggccgttgcccgcggcgccaaggtggtgcgcgagccctgggaggagacggacgccaacggcactgtggtcatggccaccatccaggcctacaacgataccgagcacacgtttgtcgagcgcaagaactacaaggggagtgttttttgccgcattttcgctgcccccgca

SEQ ID NO: 93215 - DNA, 243 bp, Heterodera glycines
  SCN-specific regions: Sequence locations=1-243
gcatgtgcttaaaaggagccgccgaaggaagcgatcaccgattccaacgaagagtcacccaaaaaagagaccaagtccactgattgatattgagacaaattaatactcattcatattggaagacgattaatgtttagaccaaattattttggagttgattgatattgggacagtttttcattgttggccaattggtgttggaacaattctttgtaatgggtctaatccatgttaaatattgac

SEQ ID NO: 93216 - DNA, 226 bp, Heterodera glycines
  SCN-specific regions: Sequence locations=1-49,71-226
gtgccgaacaattcttcaatgggtcggtccttaccatcgcgccttcttttgtgacgacgactccatcagattgccttacaaaagcagcaccgttcccgattggctgcttctggtctatgctttgggtgtgccaccattcgttttcgcttttggagagttcatttgtttgtccaaaccgcccgctttggccattcgtcaacgtctaaatgactttgagtttggggag

SEQ ID NO: 93217 - DNA, 368 bp, Heterodera glycines
  SCN-specific regions: Sequence locations=1-14,73-125,152-368
gaactagtctcgagttttttttttttttttttttttttttttttgccattaattattattattattcaaattgaaatttgagtgattgcaaatggaaatattaattacattgagatgggatggacaataaataatttaaaaataatttaaagtcattcagtcaatcgaatggtcaatttggctttggttgttctccttctcctccgcgtctgtttttatgccgcgggcgcggcggaagggcggtctttttaaggaacggtcatttggtgcgcgagacggacgagggcgtccacatttcgcgctttgcgcgcggacgacgcgagtttgttggcgcggtcggcgttacggtactgattggtgccaaggtc

SEQ ID NO: 93218 - DNA, 488 bp, Heterodera glycines
  SCN-specific regions: Sequence locations=1-234,256-319,342-488
gcttaagaacaaaatacagtaaaatgaataatgaaaatgtcaataatgccatggttaatgacacccgcgtaaatgtaaatgacaactgtcagaatccaaatgatacccgtgtccatgtcaatgacactcggtcggtttttgcctcaattaacccgttgaagcgtcgcgttagcttccgcgacattccgaacattcgtgagtttgagcagccttcttcttcctctactgcaccttctcctttgccttctttgtttttggacacaactcataccatttttaaatcgttgatggtggcgcaaacaccgaccaaactgctgaaggttgatgaggtggccaagtatgggtcgctggacgaacaactggacgtaactcatgtcatacaacacactccgtttcataatcggcaccaaagcccgttgctgcttgatgacctgacgaagcaacatgcctcatcacttttgtttggctctcaggataattacggactt

SEQ ID NO: 93219 - DNA, 378 bp, Heterodera glycines
  SCN-specific regions: Sequence locations=1-378
cccgggctgcggttcccagacgagggggacgacccggcgacggacttccgtggcatgggtatgctcgtcctccaccaattggtattcttcgcccagttcgatttggacaattgtcagcgcgtcctttcgttgtccaaccacccgatcattggatttccatttgcaatttgtggcattaccatcacagcgttgtgcaaggaattacttttcgacgatttgctcaaaaaccatttttacaatgccttggaccaaccgtccctaagggaggatttgtgctttcaagtctactgccgcgcgttttctcttttctccgacttttgggtgttcctgcgggcgtcatccgtcatggaattcaatgtggccaaacaacgttttgat

SEQ ID NO: 93220 - DNA, 484 bp, Heterodera glycines
  SCN-specific regions: Sequence locations=1-323,363-484
gtccatttaagatttttcttttgattgacatgtcgccttctctctatctgtccccaataattgaagtcattcgttgccaaatctgcgcccattcccaattcgttcacagggatgctcaattggtccctcgtgaccaattgttggcgcatatcgctgcgcacattaactacggaccatcttctgagaagaatgaacgtcttaaacaaatatgccaacgggagtacgaacattgcatttgcattgactttgctgaacgacttggccatttgtctggcgaggacggccatcggcaccatgaacaacagcaggcgaacatgacgttccctgctgcccctcctcctcctcactttgcgtcttccatccccaatctccgttctctctcgtccaattcgtcgtcctgtctccctccgtcttcctttgccgatgctttgccttctctcgcctcgtcttcgtcgtcttccaaatctgtgtcctcttcatccat

SEQ ID NO: 93221 - DNA, 502 bp, Heterodera glycines
  SCN-specific regions: Sequence locations=1-502
gtttgtaatggtgaaagtagcagttccgacgacgaatattacaacaatttttccaaatacaaagcgaaggcagcattggcattacgaagaaatgattgcaaaagtggcaaagagattactaaaaatgggaaaagcacaacgaagaaagtctcttcagaaccatcggatgttgaggttttcacatcttgtccattatctgaacaattaatttcgcgggctgaagtcgatcctgagatttgtgtagttcaatttgcggacacttccgtaaactctgttgttgatcatttagtgactgagacttactcaacgacggaatgcgcctcacctttgcgaaccaatccaacgtttttgaccaatgtttgcagaataaacatttcatccaaaggacaacaaaagattttcttctgtgatttgaatgagcctttgctcaatgtaatcaatgaattcgctgaaaggacgaatgtcgacccgaaacgcgtgaatttgtacacaaaacaataca

SEQ ID NO: 93222 - DNA, 552 bp, Heterodera glycines
  SCN-specific regions: Sequence locations=1-361,383-552
aaagttcagaatggaaggcattgccaacgcaacagaactgatccaaagattgaattccatggaagagggcgacgaaatgaaagcggaaattgcgaaactgctccaatcccatgaccaactcacaaaggcacgagcgaaacgggaggcattcggcgaatttaccgaagcagaaattggattcaagccgacttatcggacattggtccgttctggtgcctacgactcactccgtgtcccttcctggtgcgaccgaattctgtgcgaaggtgacatggacgcacttcgcatcacaaaatactcgtcctgtccttccataactttgtctgaccattttcccgtgtcggctcaatttgaattgcactttcaaaaagaaaagcggcaccagctaagcgaaacaatcttcgccttggctcatccgagttgagcacattccaacttgggaggaattcataccgctcgtgtgccgaattgcgattccaaatgacatctgggcagatttgtgttcttatcgtgattggatcggcatttaccacaactcgttgaattcgatta

SEQ ID NO: 93223 - DNA, 184 bp, Heterodera glycines
  SCN-specific regions: Sequence locations=1-34,56-184
gcgcaagccgatcgacagggacgaggtgcccatccacccggcgcccttccaattggccatcggcactccgctgcaccgagttcacacgcttctcgcgatgctcggcctcaaccacgcttatgccaccaacagaggccggcgcgtttgctattttgcaaggcgcgagcgccgagccgccctcgct

SEQ ID NO: 93224 - DNA, 249 bp, Heterodera glycines
  SCN-specific regions: Sequence locations=1-249
aggattcttagggctatcgaataatactaataatgtttaatttggatgcttcttgaaaaagttatggtgcactaaatttgcaaaaaaaaaaaattatggtcgtgtgagctgcaatagagccatagttttatggcaatgaaagcattcttttccttttcacagttacattgatcattccgtcatcgcttttcttcgttcaaatcaccaaattttcgacaaaagagacaccaatttatatttgtggatttt

SEQ ID NO: 93225 - DNA, 578 bp, Heterodera glycines
  SCN-specific regions: Sequence locations=1-59,81-578
atgtgacttcgtccgctgatttactactcaaaatggaccaaaatcgtcaacagaatcttttcaaaatgcccacgctgcttccaccgaatttgaatcagggcgcactgctcggcctgtcacagggattgctcctccaacagtccgcggtcggagcctcaccactcggtcactctgcgctgaatctctctgtgcccagtgcaattcattctgttttgccaacgactccaccgaatttgccaattatttcgccttcttgctcaattgtttcaaggatgacgccggcaaatccttcatatcccatcgacaaatacaaccggggaccggacgggtgcaatttgttcatctaccatttgccacaagactttgccgacacagatttatattcactttttgctcattttggacaaattctctcgggcaaagtgttcgtcgacaaacaaaccaatttgagcaaatgcttcggctttggtaaatagtccgaagaatcttccgctcaaaatgcaatttctgcaaataatggttccaaattggccccccacggctggaaagtcagggtcaacaaatcggaatccgatccg

SEQ ID NO: 93226 - DNA, 355 bp, Heterodera glycines
  SCN-specific regions: Sequence locations=1-328,350-355
atgctaagaatgtggccaacctttgtcttgtcgctgacacttatttcgctgcactgctcaaaaaggcctgcaccaaattcatctcttccaaccacaaatctgtgctgcgaagtcccgaatggaaggagttgaagacgcaccggggatcactcgcgaacgaactgcttgagtctgttctggatcatgcggacggagagagcattttggagatgggaagttcattcgatggtggcaattcggacgcgattgtttcaagcagttcgtttgggaacaacaatttcggctatctcttcccgcgaaacaactcttccacggccatttcggctaacctctcctctctgcctgtgtccacctc

SEQ ID NO: 93227 - DNA, 346 bp, Heterodera glycines
  SCN-specific regions: Sequence locations=1-346
gtttgagagctaaaacatttaaatatgttccgacaacatttcttattgaccacaatgcttttatgtgcacttttgtacccgattattattggagttggcccgccagcatatttggccatttgccaatggaaggattgtgtggatgaaaagccggcccccggtggctctcacacgatgatttgtttgcccgcgactcgcccggcccaatgtccagaagaagcttggaaccaactgaccgaattgaacgagctggagccttgttaaatttccaatttagcatgccatggaaaaatcgcttttttgaaaatgattaatgatatattccgccatttcaacgaataaactc

SEQ ID NO: 93228 - DNA, 502 bp, Heterodera glycines
  SCN-specific regions: Sequence locations=1-502
ggagcaattcaccgcctattcccttctcatggccggaaggcatctcgggtcacgacggtacagcgaatttctgcagctgaacaaattgctcaaggaagaattccccgactttccgtttccgaaattgccacggaaatggccatttcgtcactcggagcagcagttggacagcagaagacgcatgttggagcagtacttggagaaagtgtgcgcagggatagtgattgccgagagtgacactgtgcaggagtttctgatggaggattccggcggtgctttgtcagctccgttcgtcgacatttcattgcgcgtcattgtctgtggcaacactcttgcgttgaacatcaaaaggcacagcgacacgcgcgaagtgttcggcagagtgtgcgaggagctgaaactggggactgacgcggggcatttttgcacattgtttgaagtgatcgaggattcattctcacgtaaattgcaccaccacgagagaccgcaaatacttatagta

SEQ ID NO: 93229 - DNA, 477 bp, Heterodera glycines
  SCN-specific regions: Sequence locations=1-477
attcgtccgtttttgctttttcttccatttttgcttttttctccttccgctgcgttcgttgatgaccccaatttgtgccttcgtctcacatcggcggcccatgacgaaatccaagagttgcccggactcagctttcggccaaacttcaaacattactcgggctttttgaaaacaacgtcaaaaaatctattccattattggtttgtgacctcggagaataagccttgttttgacccattgcttttttggttcaatgggggccccggctgttcatcattgggcggtctgctggacgaattgggcccatatttgatcaacgccgacgggaaaacattacgcaaaagcccatacccttggaacaaaaatgcctccattgtttacatcgagtcgcccgctggcgtcggcttttcccactcagtcgacggattgcctgccccgtcaagcgatgactcagcggctgcagaaaattacgaagcg

SEQ ID NO: 93230 - DNA, 119 bp, Heterodera glycines
  SCN-specific regions: Sequence locations=1-119
aattggcgtcctccgtggggcggactcagtccgactcgtcgaagagttcgctgaggacggtcaattcttcactgctgtccaacagggcggagggaattctcgggaaattaatcggagga

SEQ ID NO: 93231 - DNA, 245 bp, Heterodera glycines
  SCN-specific regions: Sequence locations=1-245
tcaaatctgccaaaatcctacaaaaatgtcttctccttcttcggccgcctctctactcgccatcgtcacaattttctgtttgctgtgcaaatgttgcgtttcggcaccgcatgagtgtgcccacagcctcggcttcgtccgtgccatgttcgtcattgccgcctccgcttcttcccatgtcagcaacaacagcgaatggcaggcattgagtgcccagtttggtcagcaaatcagtgaaattgact

SEQ ID NO: 93232 - DNA, 384 bp, Heterodera glycines
  SCN-specific regions: Sequence locations=1-384
taaaatattcggaggaacggccgggcaattgaaggatttgggaaggaagccaaaggaagacggtggcgagaaaatgaagcaggaaaaagggacgactgaacggacaaatttaaacggaagcaaaacgaagggggcgaaaatggcggacgattttttgaaagtgatgggggacagagacgcggagatgcgattcacttacctaccgctgaaggataaatacgatggtacttttgcccgcgagttgcaactcggggagtttgtcgttttggaggatgattgccccagaacagaaccttcgcttgcccatcagatcgatgtcttttgcgatttttgaatgaaaacattcacctaagtaatgctcgacgaattccgatcattttctga

SEQ ID NO: 93233 - DNA, 248 bp, Heterodera glycines
  SCN-specific regions: Sequence locations=1-139,162-248
caccccccagtgaagaaagaggcaatggaaaacgaaatgaggaaatttatgatgaggtggataaaagaaaacgatgctttttcggctttggtctttaattttaatgagctaattaattaagcaatgctttggaattatactataaaatcatctaaatatttgtcccttattccttcgctcctcatttactcattcagtgtaattagtccatttggaattgcatacattctgcatgatgggcttttttc

SEQ ID NO: 93234 - DNA, 397 bp, Heterodera glycines
  SCN-specific regions: Sequence locations=1-40,62-397
gcccgggaatttgtcgactttgtgctcaacgagctgaacgtgacgcgactgttggcccagctgaacggggggttttttggcatggacgaacacttttggcagtcgttgagcggcagcgaatcgctggacgcgcccgggggctttccgcacgaatgttttgtgaagggaaatgagtccttcagcaagtacaagtacatcaccagatttgccaaatggtccgattcgtcccctggcaaatgtctgagtgttttttggcgccactccgtctgtgtgttcggcttggaggatttgctgggccccggcagcgaaatggaccgacttccccatctgttcgtgaacaaactcatgccgggcttcgacttctacgctgttctttgctggcaccagcgaatgcggc

SEQ ID NO: 93235 - DNA, 426 bp, Heterodera glycines
  misc_feature (415)..(415): n is a, c, g, or t
  SCN-specific regions: Sequence locations=1-426
tggcaattttgatcattggcatattgctgaggacgacgaatgtgccgatgctccatcgcctacagcccgtaaatattgtgaacagctgcagagaaaagccaaactgcaaagagcctccgccgcacaacagcatgagggacacacggagcatcacgcaaactttggcatcgcaatcggatgcccaagtgaattggccatttcactgatcgcattggcaccggcattttttctgcgccaatttcaatgagaagcaaacagaaaaatggtggtgacggaatgtgctgagaaagcgcgggaaaaacaaacaatgactaatttacctaattatggtgttaattaccgactaccaattgttgcctattaccctatcaattaattaatggtaattgacagaaaaaactaccacatagggggnaagaaattaaa

SEQ ID NO: 93236 - DNA, 361 bp, Heterodera glycines
  SCN-specific regions: Sequence locations=1-361
cgtcggatagaccaaagggagtctttcggtttaaaatgcgcgaaatgtgagtgtgcaattgaggagccaatggtctctcaggcttgtttgcaccgcttttgcgctttttgtgcccggggtgccaattgttgtccattttgtggtgtcagcacgcatttcaaaatcgacttaaattttgctttgatcatttctaaagtgaaggctcggggcaaatttttcgtgaaacggagaatcgtctatgttttgtatggcgatggtgctaacatttcgtcttttggcaacggacgactttcgcggatgagcgcaacccaagaaaaggagcgggaacggacagcccatccgagcagtactcgacttgttc

SEQ ID NO: 93237 - DNA, 237 bp, Heterodera glycines
  SCN-specific regions: Sequence locations=1-181,203-237
ctgctcttataaccgccgtttcgaacctggcccatcagcaccgccaaaccatcgcgacgcaagcccagacaatcgccagccaacagcagatgatcatggaaaaggaccgttacatcgcgcaatcttttacttggaaggttatatccgccgatttggtgttccattgcccgcgccggcagaacagcagcaggacggcggcggccaatgagagagagaggcctctgacagagtccgact

SEQ ID NO: 93238 - DNA, 410 bp, Heterodera glycines
  SCN-specific regions: Sequence locations=1-410
acgttatgcaatgcacgaagttgggatgaccatcagcggacaaaggtcgcaagacgacgacaaaactctcagtcagtgcaaattcgaagttggcgactttatcgatgttgtgattagtcctcctgaagcaggcggacgcggaaacggcgggccaatgggcggttcctacggagggctgggccgtcgaatgggcggcggtgaccgcggcatgggcatggagcgagaacgcgtctcttcagccgtttgttccggtggtggacgttttagcggcggatttatgcgctgagggacaattgaaaatgatcttttgcaattggatttgtcattgttgagaagcaagcacaaaacgctgttttcatgttcttgaatatctcacgccttctctattatttatgaaaataatgaatttc

SEQ ID NO: 93239 - DNA, 235 bp, Heterodera glycines
  SCN-specific regions: Sequence locations=1-235
ggtgcaccaatatttgagcaaattgcgccaaaaatgctagtgctcgcctaattctaagcctctgccacgcgatcagcatcaaataagcatcatcgacaccgagggcaagcaccaaaaagggcgtaacacaaagcagtgacccttttaattgggaaaatttaaaaaaaaacgacaagattaaaattaccgaaacgaaagccgagccaaaacattccgccaagggctgtgcctgttt

SEQ ID NO: 93240 - DNA, 323 bp, Heterodera glycines
  SCN-specific regions: Sequence locations=1-323
gattccattaacaacaacaatggcactaataatgcctatgctcacaatctttcggggaatgaaccatgtcattctgataaggacaaagcgatgtcgagcagtatgtctcatcctttgactttgtccgaatttgccaggactgtcaataaaaacagaagtgcatatgcacaatgccaggacgaaagtgagccaaaacagacaaaaaaccgacgcggctcattgtttcaacggattgttcaaactgttcggtcgggggtcgactcacaaggaaaagggcgacggcttctgcagggagacggcaggtgccgcacgaacacagcaac

SEQ ID NO: 93241 - DNA, 591 bp, Heterodera glycines
  SCN-specific regions: Sequence locations=1-192,218-591
cgaccgggacggatgcgatgttttggtcgccacccccggccgactagaggaatttctcctgaagaatcggatcgaattggattgtctgcagtttttggtgatcgacgagatggacaaattcttttcggactttgaatttctgcgattgtttcacgaattgaacgaaaacaatagacaatgcaaaagcaccgtttggccctttcctacttttttgttcagtgccacttccgattccctcgacggcgacgttccgttccttcgccccgatttcttccgtgtcatcgctgggccggtcaaccaaagtgttgcgcacgtgcgacaacgcatcatttcgactaacattttcatgcgaatccatccacttgagcttatcttgcaaagagaagaaataaacggtgcctgcagaaaaacggtcatttttgtgaacgaatgtcgccgctgtgatcgacttgccattttgctctcctattacggctacaaggagattagcattaacggaaaccgctcacttgggcaacggacgaaggctatggcacaattcgatgacggcacttacgatattttggtgcgcacagatgtgatctctcgtgg

SEQ ID NO: 93242 - DNA, 537 bp, Heterodera glycines
  SCN-specific regions: Sequence locations=1-475,520-537
ccaacggcaaaatcggcggtgccaacggtcggcgaactgttcagggcacagcttggccatttctacgctcaaattggtgacattaagtttgaagatccgccgtcttcggtcaatttttacgcctccatctgtctgctgctcgtcggccatgttttacaagggcaccggccgacccttctccgccgggtgggccccgcttggctgggccgagtccgcgaacagttggccgactggcgagctatggacgaggcggacaaagcggcacaacagcagaaacaaagccataaaaatccgcaaaaacgggatgaacacgtcgatgacgacgatggaatgagtgcggaattgagacgacgaatggctcaatcggtggagcaacaacagctgttccgaatgaacatgtttaccttccaacttgacgaggcggaacgacgtgttcaggaggcgttggatggaagcagcgaggaataaaacaacaaatatttctaaaaatgtattttgctttatcagagcaataacaaaatttgtgcataaaccgag

SEQ ID NO: 93243 - DNA, 463 bp, Heterodera glycines
  SCN-specific regions: Sequence locations=1-463
gtcttcgcaaaacatccgatttcgttggacaattcgaccgacattttttactttgaaattactgtcctacaaaagattggagattccatcttaggattcgccgtaaaaccggcacgaacatggattgaatttacttcttctccaatacgcacttatgcatatgaaaacgatggctgtttaaaggctacttttgtaaatggaacttttacttttccacagagaataaatgccaaatattcctacggtgtttgtgatactgtaggaattggcgttatttgtgccaatcgacagatcgttttcaccaaaaatggacaacgtttggattcttccgattttattgttgctccatcgtttgttggccaattgtttccattcgtttctttggttcactccggtgccgaaattgaggcgaattttgggcctaattttcaattcgatttgaccactctttaaataaatattt

SEQ ID NO: 93244 - DNA, 567 bp, Heterodera glycines
  SCN-specific regions: Sequence locations=1-3,26-382,407-567
gtttgagcaaatttcaaattatgcccgtcgtttttgactcggaatcttcagatgaagaaggcattgatccttttgatgccgcagtcaaatggatgatgcagaatgccaaaaatttatctgctaaggaatttactcaaattgatcagggattggctgacaaaagtgcccggcaacaaaacagctgcgaaaattcgccgaaacggcatggcacaaatggcaccgacaaaacgtctccggctccatggttcgaagcagcgttcaaacgtccttcttggtcagcgattgaagaacaagccgaggcagaagctcttgcggacggcgtccaattgtggtctgatgacctcgatctttggcgcgaactggatctgttgttcgccgaaacggagaaggaggagccggaggaggctgacgacaacattttgcacaaaagcgaggcaaagtgactttggccatcgatgttacagtgaaagaagcaaaaacggaggacaaatcataaacaattaaggagattgaagaaagaaaaactctacctattttgaagtttcaaataaaggttttttctttttc

SEQ ID NO: 93245 - DNA, 216 bp, Heterodera glycines
  SCN-specific regions: Sequence locations=1-16,62-216
atttgaaataaagagcaattaaataacatttaataaaatattaaaataaataaaaataaatgcaacgtccaaattgttaaatgattcgagtgagaaaaagacacgattcaagaacctaatacatgcttaaacaaaaaaccactttaggataactttgtgaattgttttataaaatacaaaaaaccaaaaaatttaagaattaaattaagcccaata

SEQ ID NO: 93246 - DNA, 578 bp, Heterodera glycines
  SCN-specific regions: Sequence locations=1-578
catgtcttcctctgcaatgcaaatcgatcccaacccgcgcgccttcctggcctctgcccgccaatcggcccaggcggccggccacgctcaagtcgtggacgcgatcaatcggtttgacgagctgtacgaccgcaagctgtggcaccagctctcggtcgaaatggacaagttcattgccctccagcaggcccaggaatacttgaccaatttttactttcagtttgtgcgcgactttgagtctaagctcaacaagctgtcgctcgttgctggtgttggccaggccgtcgccaagcatttgcccgacaatacctcgcgcatcacctacctgctcgccctcgccgaccgcgtgaaaccaacgccacccaaatcgggcgaagagcacctgcacgtcctcgacatggaatccacgtcggcgcacctgcttgccaccacgcaagctgcctactaccagctgctcgacggccagtatgacacggtcctggcacacatctcggcctcggaaaagcgcctcgacgctcttgatggcgtcgacacgcgcgtgtcatcggctttctaccgcgtggccgccgactactaca

SEQ ID NO: 93247 - DNA, 107 bp, Heterodera glycines
  SCN-specific regions: Sequence locations=1-107
gtcacttcggcaacatcttcacatattttgaatgttatttagcctatctcaatttaggaagcagccatttttaaggaaaacaacgttttttggccaataaatttttt

SEQ ID NO: 93248 - DNA, 569 bp, Heterodera glycines
  SCN-specific regions: Sequence locations=1-36,58-569
gtgctaatgatgctgatcaaatttgctttgccgctcctctttgtgcttctccatcccttcgtttgttcggctgccgaggaaaatgccggcgctgccgaaatccctcaacaattttatggcgccttcaaattggaccacagcgacaattgggacgattatttgattgccaaagggtacagtgaccctgagatgcgcaagaaagtggagctgcccaggttcacacgcattttgtaccgtttcccgaacggcacttatcggatgatggtcggcacggggctcgagggcagcaaatgggtgaaggggtccaagaagaacgccgattggcagttcaagcctaacgagccgttcattggcaattattgggacggctccaaacacgaaatcactttcacgtacgacccgaaagagagtcggctgacggaacggcacgtcaaagtggacggcaccggcacgccggaggagttcaactacaaaattgaccaggacaacaacttggaattttacgtgttcttcaaagatgtgaagcttgttcaccattaccatcgtactgattaacaaacagcagcaga

SEQ ID NO: 93249 - DNA, 605 bp, Heterodera glycines
  SCN-specific regions: Sequence locations=1-133,316-450,490-605
tgagttccatttttaggtcagaaaatgaattcccaattgctttgcatctttctgctggtcatttgcaccgtttccattggcacactgacacaagcaaagccaattccggaagaagctgcggcaaccgaaaccaaagcggacgaaggcaaaaaagaggagccgaaaaaggaagaagccgaagcgaaaaaggaagaagcgacgaaggaggagccgaaaaaggaagaaacaaagaaaggagagggcaaaacggaagaagctaagaaagatgaagccaaaaaggaggagccgaaaacgaagaggccaaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagaacaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaacactttctgaggacagcaaaaag

SEQ ID NO: 93250 - DNA, 338 bp, Heterodera glycines
  SCN-specific regions: Sequence locations=1-316
acaataatgaaccatgaccagctgcagttggtgaacagggaaggctgggccaagctcgctttctacctcgtctcattcttcatctacctgtacggcatgatctacacaatggtgaccacttaactgtgaagagccggacgattttcgcgcccttctcaaacaattttcatttattgcccctaaaaatgtgccagattaataattaatcacaaaacatgttttgttttcgtgtgccagtattttcacctaatatgcatttttttcattaacttttgctgtaatatgacaaaatattggcattaaaaaatttttgattaaaaaaaaaaaaaaaaaaaaaa

SEQ ID NO: 93251 - DNA, 549 bp, Heterodera glycines
  SCN-specific regions: Sequence locations=1-13,51-70,160-256,278-549
ttttttcagcttcattaatttttcttcataagaatatttaaattatatttttgatcattaataggcagagaataaaatagttattttcatatttaaaattttttccaaagaattctaaaaaataaattctataaaaatcatttaatataataattttttgttgttttatttggcttttccacaagtatccgatcaatcttatctgaaaatagatcaatgtgtcctgattattcttatttgtcctgaaacatagatattcaaactcaaaaaacagaaaagccttaattttcaaattgctttgggtttacctttaatatttttccccatcttttctttgtagtcacatttggagtttatttttcacgaatggtcctcctcctcgtgcctggggcattataattttttttcactcattatcggcctctccttcctctgatattgtcacctcattttcctcattaaattccggaagtccttcttcttctgctcttcatgtctcttgtattaattgtggctactaattccttttccatttttgcaatgtccgta

SEQ ID NO: 93252 - DNA, 631 bp, Heterodera glycines
  SCN-specific regions: Sequence locations=1-185,207-469,493-631
catgttttcatattctccactaagtgctcctttcttcagtaaatcgtttagcagcccttctacaaatgaacaacgcaaaatcgacctcaaatttacggatttatgcgaatattttttcatatcgcatccattttctggacgaaaagaaggaagcgaacataggagggtcatgtattttcatcctgcaaaggaaagcatttctaagcaaattgaatttactggaatgtctgaggctgtcgttaattttaccgatgggttcagcaagtcagactgtgaaagcaacatttcggctcaacacgattttgattatcgatacgtaacttccacaaataccaaagaagttgttttggttgtggagggtggagagtttcttatcggtgcttcgttcaacaaaaagaattgtacggcgaaagattactttttgcatttgcccaccataaattccctgcttttcaatgcttacaatgcctataaacttcattatggatatttttcatatcgtttccgtgcagaatcgaatgaatttaaagaaatattggacagattttttactccttttttgcatttgaatcgagttaataagattccccttgtcgatctcttcaatggaggggatttcctttccattggg

SEQ ID NO: 93253 - DNA, 492 bp, Heterodera glycines
  SCN-specific regions: Sequence locations=1-114,136-222,245-329,351-492
tggggctgtgaaattgccaaaattgagaaaatgatggacccaaagaatgacttttacgacgaaaacgcggacgtggtgactttcaaagcggaagtcagcgcggaagcgccgaagggaatgccctctgttcaaagtgggcacactttggtggtcaacggaaaaacgatttgcgtgaacaaatacattttggctgcccattccgttttcttccgcaaattgttttttggaaagaacgcagagaaaaccccgcgaattcagttggaagggaatgcgaaggccgtgccgaatttcgagcgactgatcgccacgatggcaccaatgaatttggagttggatgatggctgtgtggagagtgtccttctgttggcccaccgttttcagctggactccgttttgaatcgctgcgccgactttttgctgaaaaagagcaaaaagacggccatttgcaaattccgtttggcccaccaatgcgaaatggttgccatgaagaaa

SEQ ID NO: 93254 - DNA, 247 bp, Heterodera glycines
  SCN-specific regions: Sequence locations=1-99,121-247
gactcaccgcggagtgatggacgcaattgacatgcgatcggttcgtcgctgttatggggggtccgagcccctgtgtgccccatgccgatccttataattcttccgtgaccaccattttgccaacaatttcctgacacagcatgaggcgaacacagatgatgccgatggactgatccccgacttggacgataatggtgtgtaaatactacgtcccgggctgttcccctacacattgcctggcccctac

SEQ ID NO: 93255 - DNA, 615 bp, Heterodera glycines
  SCN-specific regions: Sequence locations=1-615
gtttgagaaaatatttttttttaaatgtgctacaaaaatgttttattatttattgtaactacagtagcaatttttgagacgtcatttggagctgaaaacaatgcaacacaaccacaaaaaaagcaggaattgacttttgaaaagacgatggaggaaatgatcatctcggcaaaaacgggcaaatttgtgcggcaatgttcttgcgatgaacaggagccatgtctgaaggacattttgacggattttcaagcctgtttcgagacatgctgggaacagaaaaactcgggaaaaattgcccctaagccagaggtgttaaagcaatgctttgagagccgtttgggcctggtcaaccagttcatctcgtgcattaacactaccgcaaaaacctgtttcccgaccaaatcaggcccgcaaattgagtacgtgtctgtacaacgaattgttgccgctggggaacaacgcatggcggcacaagcaagcggctttgagcgcgcaatgggcccagcaaataaaccggtggttcaggctgccgaagaactcgccagctgtatgaaggattgtttcttagacaaggacgctggccaaaaatgtttcggcaaatctgggtgtcaacca

SEQ ID NO: 93256 - DNA, 620 bp, Heterodera glycines
  SCN-specific regions: Sequence locations=1-56,78-449,473-620
tggacaaagagttgctgaagacagttcgcgagtcccccatccaaggctttcaatgggccaccagagaagggcccctctgtgaagaaccgattcgcaatgtcaagttcaaaatgttggatgctcagatagccaaggagccgctctacagaggcgggggacaaattatcccaacttcccgccgttgcgcatattccgcctttttgatggcaacgcctcgtctgatggagccgtattatttcgtggaagtgatcgcccccgccgattgtgtgacagccatttacactgtgctgtcaaaacgacgtggtcacgtcacgaccgatgcgccgatccccggctcaccgctgtacacaatcaaagcgttcattccggtgatcgattcgttcggtttcgagacggacttgcggacgcacacccaaggacaggcattttgcatgtgtgtgttcagccattggcagattgtgcccggtgatccgctcgacaaaagcattgccattcgtccactcgaattgcaaccggccccccatttggcacgcgagtttatgatcaaaacaaggcgaagaaagggcctctccgaggacgtctctgtgaaccaattcttcgatgacccaatgttggtcgaa

SEQ ID NO: 93257 - DNA, 623 bp, Heterodera glycines
  SCN-specific regions: Sequence locations=1-623
ggaagaaatatgtgttccaaaaatgattcatcagtgcgcatcgacttgaagcggtgtccatgcattcactcattggctcagttggtggatgtgacattgcaatcgctgctttaccaacgacaaatgatccccgagccggcctcaacacttttgcacggctgcacaccggtggcggaccagttcagggacacctaccaaaaagtccaacaaattctgcgcggcactttccgctccgccaatggggacggacgcattcgcgaatttgtgattttggttggtgcgacgccgttttcgcccaaggaaatctaccgggtgcgcgtgccgccgacaatttgccgaccatcggctgcggatcagcagaaaagtgccgaaaaagcggtgccgacatcgccggagagtggccggcggatgatggcaaaagcgttggccaacgaagccgatgatgatgacaatgattacaggcacaaaaatgggagagaggaggacggtgccgaaaatggtggtggcagaggaggcggtactgacttggccagcgcaaaatgtcgctgcggcggcgcgacggtgtgcgacgcgttgaacgcaaaagagaggcgattggttttttcggcggtggcactcagcaa

SEQ ID NO: 93258 - DNA, 600 bp, Heterodera glycines
  SCN-specific regions: Sequence locations=1-416,448-600
ttcctccaaatttgttttcgtttgaaatggccccggggagtattccgagctgttgcctcacctccgagcaaaaagacgcactgatcgacgcggtgcgacagcgaccggtcatttgggactgttcattggacgcgtaccaagaagtacagaacagacggacagcgtttgtggaggtggcggaactgttgtcagatgagaagagcaaatacacagggcccgaaatgcaagtcgaatggaagaaactgcgcgacattttcaatcggactctgaaaaaagtggtcgcctcggggggctccgacgcggaggtcacttggcgctattggacaaagctccaattcatcgctgaccatgaacgttcgcatataaccaggaccagaaaatggccaaaaaaggaagagctgtcccctccgcccgtatcttctccgtcctcctcctcctcttcttcggtcgcacgggcgcgaaaacgaatgccaaagcatcgccgttggacggaactttggacaattcgccactttcactggtccaacaactgacggaagccgcacaaagtgcacgggaactgatcaaatccgaagacaacgccaaagaatcggcgccacc

SEQ ID NO: 93259 - DNA, 500 bp, Heterodera glycines
  SCN-specific regions: Sequence locations=1-52,74-424,446-500
atgaaccgacgtgctgcaataaataatccagaagaagcgcgccagcgaatgaccgatgtgaaaagcacaagtcaaattctgcaagaagctatcagaattctccagcagggcattgaaaatgagacacttccaattgtgccgccaaatcaggcgacgatgttggagccattcgccgaccgaactgtcctcctccacacgactctgaacggcgttaagaatttcgcacggttgtcccattgctttggcaaccgaactgtgatggtcgcttggaaaaccctgttgaatgtgttcgagaaatgcgaggaaacgctgggcgaaagtctgtacgaagtcggaccaatggacggcacttcgaagctcaatgaaatacaagttggcttacaaaagccaattggataaaggaaaaggaagaaaagcgaatggaatcagaaaaatacacattttcacattgtccaactgatatgttttttttgtccttttagaatacaaacaatatttga

SEQ ID NO: 93260 - DNA, 355 bp, Heterodera glycines
  SCN-specific regions: Sequence locations=1-166,190-214,237-317,339-355
ctgacctgacccaccattcaccatcattgatcacggatgattttgagaccaaatttggcattttgatcatcattgacctttttttatttatgtttttgtccgttccatgagccagcaattgttgatcatggatttagcccaatgtatgtgactagtatgactgcttgcatttacataaaatttaaagttatgcagctaattatttactctcacttcccccattaatgaaatgatgtaattaaactataccaggcttgatcaacctgctgatttaaattggtatggatttgaaactttgcattaaacgtcactctgacacatttacattttaggaaaacaagaagaaaaaaaaaaa

SEQ ID NO: 93261 - DNA, 575 bp, Heterodera glycines
  SCN-specific regions: Sequence locations=1-137,160-198,220-538,560-575
gttggccgcccgtctgcaagccgaactgtccatcaacgaaacggcgacgatgacgccgcacacaatggatattgacggcaaaaccggtgccaacgatgaggacggcacttttgctggtgaagcagctgaacaaccatcgttggcggcaccaacaacagcgacaaaagacgcagtttctgctgaccatggcactgccatggctgctgctgtgacaaaaccgaaaaagcacgcactgttgcgcaacataatggtggacaaacggttcgaaagtctgttcatggacccggacatgcaaattgacgaggacagcgaccagtacaaacacttggagccgttgatgaaaaagatggaggcgaagaggcaacgaacaacaacaacaacaaacaacagaaggggaaagaatcggaatcggacggacaaatgaccaaccaatacggacaattggccaatcagtacggacaattggcaaccaaatgataatggaataacaaacaatgaccataaattcaaatgttgaagattattatgattttatgactatgaatttgtcaatttaatgcatggatttctcaaaa

SEQ ID NO: 93262 - DNA, 277 bp, Heterodera glycines
  SCN-specific regions: Sequence locations=1-277
accgatggtggaccacagtgacttggcttttggaatgatgttgcgcaaacattccccacgcctttgataccctccgaagatccactgccatttgtttggtactgacccagcgtaccgcaaagcgaacttcacaactttggacactgatcggccactgattgtgcaattttgagccaatgatccccaaactttgctgatcgcgcgccgattggtggagggatagtgacgcggtgttgacctgagcttgacgtgccctcagctgatcgcactacagggc

SEQ ID NO: 93263 - DNA, 402 bp, Heterodera glycines
  misc_feature (398)..(398): n is a, c, g, or t
  SCN-specific regions: Sequence locations=1-150,189-333
ccttcgttcaacgcttcctgctccgcttcttcattgttcccgcccacgctggtgaccaccaacaccacgggcggcaacaacaacaataaccggccgtccacctcggcctccacatcgcccacttcgtcctgctcgtccccgttggtgttgttgaacaacagcaacaacaccggtggcgctgccgggggatgccttttgtccgccgggggtggcccacttcattaccaacaacaacagcaccagaaccaacagtatcatcaacagcaacattacttcccgccgtccttgatgctcaacgccaacactttcagtggcagcggcggtggaaacaccggcggtggagttggaggaggtggttgtggctgttgtggttgtacaggtggtggtggtggtgttgntggt

SEQ ID NO: 93264 - DNA, 66 bp, Heterodera glycines
  SCN-specific regions: Sequence locations=1-66
taattttaagtataattgtaatattcaaaaatattcttaggagtaaatcgggcactgataaagcat

SEQ ID NO: 93265 - DNA, 161 bp, Heterodera glycines
  SCN-specific regions: Sequence locations=1-137
ctacaaatccatcccgatcagtcaaatgacggcctcatccgcaggatcaggacagcgtggactccgtctgagcaatttttaattagctgtttcatttcaacctttttaccattcagaaatttgtaatagtatattgcttaaataaagtattttttaaatta

SEQ ID NO: 93266 - DNA, 238 bp, Heterodera glycines
  SCN-specific regions: Sequence locations=1-238
cacccaaacttcggtggaagtggattgtccatcgcgaaagaaccgaatgaacaattgttaggttgatcatgacgattgttattcaaagcaatggggacaaaccaactgcgacaacgttttttgtgattgcttagaaagagcaactaaaagatcatcacgctgcgaaacttatgacggaccacgcttgtgtcatcttgtacacacgtatggcgcgtcggactaccgcgcgtccgtcccc

SEQ ID NO: 93267 - DNA, 566 bp, Heterodera glycines
  SCN-specific regions: Sequence locations=1-169,191-203,225-566
cttccctcccctacggggacagtccgttgttgaaaagccccgccatttcgccaagcaaatcggccgatgacattgcgagtttacaaaagcaattccatttgccaaaccgacgtttggatggcgcatcaatctttggctccctaaaatccgacaaaactccgccagcgaagcaattggatgttacaaagaattcgacagcggatttgaatgcttcctttttggaccaaagcctcacttataagcctttggttctgctgccatccgtaggctttggcgctgcgttgggacttcaccaatcgccaaaacttaaatcaaaccgaagcgattcaatgctgcgatcgattgcatcagaagacgagaaaaatgttaaatccctcgacatttcagtggtatacgaaagcgttcaacagtcgagattaaacgaaatcgatgactcacatttgtcaagtgatattcaaaatcccccctcgcgactcgagtttcagcgtacccccgaaaagtcgacgcgtagcgaaccttcggcgacttcggcagaaattagcactcacaatcagagccctttatcc

SEQ ID NO: 93268 - DNA, 485 bp, Heterodera glycines
  SCN-specific regions: Sequence locations=1-485
ggcactgtcaagtgcaatttttttgctcagcgtcgcaaaaatcagtgatgaagacagtgaggacagtaacgaagctggttctgccgataatcagcttgcaactgaaattgtggcagagttccttgccaaatttggaacgctggctgcatcaacggcagacgtcggtgcatacatggaacgggtgtctctaagtgcgcatgtctttcttaagttggcttttcctatcggctcaatcattgccagctctctgcaaatttcaacaaaaaaacaatcagatgagtacaaagcattggtaaatctgcgcgactcaatgcaaaaaaatcatgaaagcatcatgaaagcaatttcctttgctcaagaaatgattggaatggaaagcaaattggacgactataccaataatgttcgtattccgattaaaaatctttttgtacacatgcgaaaattttgggacccgtcaactgacaaatcgccagaagctgttg

SEQ ID NO: 93269 - DNA, 544 bp, Heterodera glycines
  SCN-specific regions: Sequence locations=1-140,164-544
attttgaatttttgactttgtcggggctggatcagctgattgttttgactggccaaattcgcttttttccctttgatcaatttttttgttttcgaaggtggcgcggagattacacaggcgaaaccgttcaatttgtgttcgtttctcttttaattattattttcatttctgttccttgctaatttcagtgccaccgttgtgcaaaatctcaagagattttgggtgaggtccatcgtttccgtgccaattccgtcctgttcaatgcgttcgtcgttcggcgtttggaacaaagagatgccgacggtgccgccgccaacggacactttcaaaaaggagactttcgagttgtttaaccccggctcggctgctcagctgatcagtgaaatcagtgccttaccatccgaagggcgcccccggaatttcttccctcagcagcccactccacagccccaaccaaatccgaccttctttcgagctaccgaaccgacgccttttgttgttgccacgacgccttccttcttccgacccaatcagcaattccagc

SEQ ID NO: 93270 - DNA, 250 bp, Heterodera glycines
  misc_feature (232)..(232): n is a, c, g, or t
  SCN-specific regions: Sequence locations=1-197
cggatacggtggaagggacggatatgagcagagcggatacggcggatatgcgcaacgcggatacggtgaaaaggacggatacgagaagagtggatacggtggaaaggatggataccagaacgagtaccatgattattacaaaaacaatcgctgatcaatgacttatttatcttccgatctttgcagtgattaaagtgtatttttaaataattaataaataatctttatctcnaaaaaaaaaaaaaaatat

SEQ ID NO: 93271 - DNA, 412 bp, Heterodera glycines
  SCN-specific regions: Sequence locations=1-412
gacgcaacttatctttcggaccgcaaactccattttgatgaccgattgcattctccacggcgatttggctaacatactaatgggccaatattgcctctttgggaagggatcgatcattcgaccaccctacaaatatttcaacctaagctttgccgatcttcccgtccattgtggagactacatattcattgacaggggctgtggggaccgtgccccctacttctgtgcattggccgccatgggccataacaccatcgatgtacataactggggggtcaaggacagcagctgtattccgactgacaaagtgctaatgcgctagaccgtctcccccacctcttccctcatcggccgcagcccagacctcgtagcggactattggcctaccacgagtcaatctctgatggccgac

SEQ ID NO: 93272 - DNA, 404 bp, Heterodera glycines
  misc_feature (384)..(384): n is a, c, g, or t
  SCN-specific regions: Sequence locations=1-382
tcctcggcgaagcgatcatttcgctgcatccgttgacaaatgctctgatcactctgttccttcttcggccttatcgcgaggcgttgaaacgaatccgtccgccgttcgcccagcgaattccgctgctgctctgttccaactcccagcggagtacgacaacggccaaccgaagcgtatacgacagcacaggaccaacgaccatcgacgacttggctatttttggaggagtggccaattgcgacgacactccgccagtttcattgtgacaaggaaacgctatgccttgccagaaatacgaacaaaagtgccatcatttgttcacatcatttcattaatttgtaaatatgtatattcctttcatcgaaaaaaacaagtttattttanaaaaaaaaaaaaaaaaaaaa

SEQ ID NO: 93273 - DNA, 235 bp, Heterodera glycines
  SCN-specific regions: Sequence locations=1-210,232-235
cgatgtgtcactcttcgacctcgacaaaactttctgtattacccacggggagagggaggcccgtcatgggccctatggcagtagaaggtaccttggccccatattgtgcacggtcacctaattgatgccgatcaaaggtaatccgtccggcgctgtagccgcttcgccgtggggttcaagcaccattttgaccatcacttgcgaatccatcagactgatgggggccgtggggtta

SEQ ID NO: 93274 - DNA, 625 bp, Heterodera glycines
  SCN-specific regions: Sequence locations=1-625
caagtttgaggttgttattcgtttgtaacgtggttgttgtacttataattaggaaagaagtctcacaataatgcttcagtatgttccgtggagacaaatcacattcacgggccggctgttcgacgttggtgaaggcagagcgaccacattgctattcttgctcaaatgcttaatttatatggctttggacattgtcatttgggttgcattgacatttgtgagctacaaactgttggtttggactttcttcactccctttgaacgaggtttttattgcaatgatcaaagcatcagagagcccttagtccccaacactgtttcaacgtcccttcttatcgcaatcactttgggcacaccgttcttcttcatttttcttgccgatttgatgcgtactacgaggcctcgcaggaggaatataactcaggtcatcaaccgttccactctcgagtatttgaactactgcatcgctttctggctgatgactttggccattgacgcttttaaatgcttgatcggtcgcattcggcccaactttttgtcaatgtgcaaaccacgggaatggagcgaagtgtgcactgtcacccctgatgcctatgtgaagctcgcccattgtaccgttggatgg

SEQ ID NO: 93275 - DNA, 626 bp, Heterodera glycines
  SCN-specific regions: Sequence locations=1-626
cacagacacaccctcatgcacatgctgctgatctgaagcttacgaccccatccaatcttctcttcacttcaacgcagcacaccaccatgccgtctccctccgccgccttttccgtcgaggacctctcgctgcacgtcctggccgtgctcaacgccagcccgacgggtgccctcgagtccaccgccacgctcacctacccgggcacctccaccgtgatcgactctacggcgctccacggcatccttctgtcgctcgaatccaaggaaatggtcaccttcacggccgtcgagcacgaccgctggacgctgaccgccgagggcgccgaaatcgctgcgtcgggatcccacgaggccaaggtgtttgccgccgtgcctgcgggcgacgagggcatttccattgccgagctcagtgccaaggtcggcgacgccgtggcaaagattggccagggtaaggcgttcaagaacaagtggatcggcaaggcaaagagcggaaacttggtcaagttggtcaagagtattcaggataccacgcaggaggagctcaaggtggtgcaggagactgccgggcataaggatcccaaggtgctcgttgagttgaagaaacgcaagttgtgcgacaaggagaag

SEQ ID NO: 93276 - DNA, 259 bp, Heterodera glycines
  SCN-specific regions: Sequence locations=1-14,36-259
tttgatggtcccactaaagcatttttctgttgaggatgaaatcaacccgtggatgaagcggggtactgtagtggactaacggaaagcgatggaccaatggacgcaactcaaaaaggccattgagggggaggagagtcgacaatgctgacggctggaccaagggagcggactgccggacatggtcttctcctgcaacagcggccttttctaccgcaatgagctttacctttcccactttcgccgcgctcaacgactcgga

SEQ ID NO: 93277 - DNA, 430 bp, Heterodera glycines
  SCN-specific regions: Sequence locations=1-402,424-430
cggcactgggctcaaggacccacacataatggagcgcagcggcgaagtgcgcgtccaaacgccgtacggacgcccttccgacgcactcattgagggaaatgtggcgggtgttcctggtgtgctgctgtcacgccatggtcgacgtcatcatgacgctcccaccgacataaattatcgggccaacatttgggcgctgaaaaatgccggcgtcaatgacatcgccgccgcgtgcgcttgcggctctctgcaggaagaattggaacccggtgaattgaagctgatcgactcgctcatcgaccggacgacgaagcgcgagcagaccttttacgatggactgccgggtcatccgccgggcatttgccatatgccaatgcatgccgcactcgacgaacgcctgcgacgggcgctgctcgccacggcgacgcgtttg

SEQ ID NO: 93278 - DNA, 592 bp, Heterodera glycines
  SCN-specific regions: Sequence locations=1-335,358-592
caaaaatggtcaacgaatattatgaaaaatatgatggactaaatggatttgctgaatttatccggaattgggcctttacctttttctgtttacatgcctttgatgatgacgacacatctgatgaagactaatttcgttaatatttattgtatgctcttggttacaaaccgataaacaaagccatcagggttatttgaacgatttaaaatttgcataacattttcgaaacccaatctcttatagacataaaataaacgaaagtaattacatagtgaccacaaacattggacaacaccgattgaaaccgcgtcttattatagtaaatgtttttaaaattatcggataaatattttttgatcaatctgataggcatctctccatatgagtcaaagaagtaggcaacagcaggagactgtgcccatatcgcacaccaatgagttcccggcatacctgcagggtcctgaatggaaatacgatgagcaaatgaagcaaaaattaagcgtaccaggttaacaatcagactgcacggaaattttgaacaccttggcaacccatctgcgggatatgtgccgctgaagtaccttttcgtcgc

SEQ ID NO: 93279 - DNA, 488 bp, Heterodera glycines
  SCN-specific regions: Sequence locations=1-325,347-488
tgcaaaagttctgtgacaacgctcataaagcgcatcaaacaaattccgatgggattgcccggtcctccggttgatggtgtgccacaaagtgccgcccgattttattctgaaaacgcttacattgaactgtcatgcttcattaacaatcagcccaatttgccgcgtgcgactgattttaacgaactcggcctcaactccaatgctgaaaattatgtgccgactcttctccagcgaattaatgccatggttttgaattgcactaaatcgcctgaagcaaccgccgaagtgcttgggcaattgggaattttcctcagcgttaaaaacgaaggagtgaaccgcagtttcaaaatccgttcttcttctgctgccggtggcgaatgatcgaggacaatgcggctcgacgctcggaaattgggataaaatgagcttaatgttgctgatttggaaaatttaaaccaattaatttttggatcaaatttttaactctt

SEQ ID NO: 93280 - DNA, 280 bp, Heterodera glycines
  misc_feature (230)..(230): n is a, c, g, or t
  misc_feature (245)..(247): n is a, c, g, or t
  misc_feature (255)..(255): n is a, c, g, or t
  SCN-specific regions: Sequence locations=1-280
ttccttctctctccggactcacaattgtggtgagcttcgtttgtctgatgtcggcagccgagcgaaactcttcggatggatggccgccaaacggatgaacaaattcgtcctcctccgcgactcctatggttcagtgcaaacagtgttctcatttgcgctcttttcgtcgctcaaaaataccaactttttatctgccctttgccttgagggagtggtggcggacagaggcnacgaagggaacgacnnnatgcccancggcgacatacaagtggccggcgac

SEQ ID NO: 93281 - DNA, 457 bp, Heterodera glycines
  SCN-specific regions: Sequence locations=1-5,27-251,274-457
atccccccacccaccaaccaaccaacgcatcaccagcaaacatgtcttccttcgataaggttgttgtcatcgacggcaagggtcacctcctcggccgcctcgcatccatcgttgccaagcaggccctcaacggccaaaagattgtcattgttcgctgcgaggagctcaacattgccggccccttcttccgcaacaagctccgctaccacgctcaccttccaagcgttgcgttgtcaaccccgcccgtggcgccttccacttccgcgccccctcacgcatcttctacaaggccctccgcggtatgatcccccacaagactgctcgtggtgccgccgctttggcccgcgtcaaggtcttcgagggtgtccccgccccctgggatcgcgtcaagcgcatggttgtgcccgctgccctgcgtgtcctccgcctcaagcccggccgcaagttcacccgcgtc

SEQ ID NO: 93282 - DNA, 337 bp, Heterodera glycines
  SCN-specific regions: Sequence locations=1-337
accctacactactcggaggatgcccgagatttcccccggccaaacactgaacattcatggcaatgtgaacgcgaatgcacaccgatacaaggccaatttgttgagctagtgcaaccaaatggaggcccacatgggctccgcgacgctgcacgttacaggtccgatttttttaggaaaaggcgcgctcaactcatttgctgccggagaatgggggaaggaagagcggcggtcgagggctgtcgccgcgggacagcccttcaacccgcgatagcaaagccaggaagatcgcatccaaagagtgtcccaagagaacaaaatcggggagggcgggcatcga

SEQ ID NO: 93283 - DNA, 469 bp, Heterodera glycines
  SCN-specific regions: Sequence locations=1-371,393-469
gtttccaagaacgaggaatttgtccgcgattgatgatatggagtttcgctaggtgcacgtcagagggtattaccttttcgaccgccaatttgtcattcggtggcgctgtcggttggaccccgcaaataccggcacttcgaattcggaaaaatatggggcgtatgtgatcactccgatgagactggagggcacaaacgttacaattatggttaaccgaggatgggttccaaacgagaacgtcgaatccgaactgaagaagggcttgtaaatgcgggagtccaaactaaaggatttgaacgcagtcgtcagaactgctgagaagggctctcctttcgtcgaggacgacccagaagaaggaatttcggccttcgaggatttggaaaaagtggcaaggcaaagcgacgcccgcccaattattggggggatgccgattacgaatccgactgacaaagaatcaccaatcgagggg

SEQ ID NO: 93284 - DNA, 263 bp, Heterodera glycines
  SCN-specific regions: Sequence locations=1-66,88-241
cccgggcggcagctcctcagcgggactgccaaagtcattcggtcagtcatccaaatacaaattttgtttttgaagtaataattaatattgaaaagtaaggaaattaaaataaattattaagtgtactgtacataataatttgtcgaccttatcattatatgcatcatttaattaattaatcaccaggggctcctgtatggtttatcacgagaaaagaacggaaggaaatgacaccaccgacaagagggagcagagaaagcacc

SEQ ID NO: 93285 - DNA, 345 bp, Heterodera glycines
  SCN-specific regions: Sequence locations=1-147,169-345
cgattggtggcgtcaaaaaaaggacggattgtgattggtctctttggtgaagtcgtgcccaaaacggccaaaaactttttggaattggccaaaggcacccatggctacggttacaaagactcaaaattccatcgcgtaatccggaacttcatgatccaaggtggtgattttatgcgtggtgacgggactggtgggaagaccatttttgagggttaatcatctcacgaccacaatttcaaactgcatcactatggcgccggatggcttaatatggaccaatacagtccctgatacaacggatcccagtttttaatcaaccacaccaatacagccaggctcgatgca

SEQ ID NO: 93286 - DNA, 584 bp, Heterodera glycines
  SCN-specific regions: Sequence locations=1-5,82-83,142-311,342 -479,501-554
tgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccttttttcaactgcccggacactgccagtgcgctggcctccaactgccaagctgtccccctgggccggccggcccgtccggaccgcctggacaggccggacagcctggaggcggagggaggggcggggaggggtggggaagacgtgggcgaaggcgctcgtccgtggcggcgccagaaggtggcagggcaaaggagaccatgctggccctccacggcgcgccggaaggacagagagagcggcggacagaagaagaagaaccgagaccaggccggggaaccgccgatccagggaggcggaagcatggagggagcgtggcgacggaagggggacggccggaagagcggggcgcaggaagggcgtgcggggaggcggggcgggagggg

SEQ ID NO: 93287 - DNA, 643 bp, Heterodera glycines
  SCN-specific regions: Sequence locations=1-401,423-504,528-643
ctagcaacaaaatggctgtgctcccagtgcgccattgcgtaagcgtcgccacgccaacacaaaatgatgtgccatacaatccgtcgcccaccaccgcgcaaactttggacaccttaggcattggcacgacggtgcagccaccggagccaaaatggcaaaaggccggactccgaattgagctaaactgtgccgacgagcaaatcttcaagagcattgtccaagagatcgtcgatcggttcggctgtttaaactccgcctatgactacgccatgtggcgaaaagcgtttgggcccaacaatttcggcatgttcttcgccctggacgaagaccgagtgccgatggcgtccacaagcatggcggtgtacccaaaaattgcacattggagcatgtattacgtgaaggaacgctaccggggacaccaattgggccgtgcgctcactcgacgagccatggaaatggctggggacagactcattttcgggtacggaggtgctggaatgtgcgccaaagaggccgaggaacaccgcccgggccatttcccgaaccggaactttcgccaaacggtggcccaaatgccgatcgggctatctagagcctcgggaactcaagtgcaggcggagggtgggagaacggcaaccccccg

SEQ ID NO: 93288 - DNA, 177 bp, Heterodera glycines
  SCN-specific regions: Sequence locations=1-128,151-177
gttcgaaacaattctggcaataatttggcttctccgccaaacggaaccgcaacagcctctaagaatttgttggcataaacactgatgcattttgatgaaatgatttgataataatgattttattccattaaaaagaaattgcagataaaaagcaaaattatgtaaaaaaaaaaaaaa

SEQ ID NO: 93289 - DNA, 363 bp, Heterodera glycines
  misc_feature (334)..(334): n is a, c, g, or t
  SCN-specific regions: Sequence locations=1-87,121-174,198-201,238-363
caatacaacgacatccaagcgaccgagattgagtccaactgggacgaggttgtcgactcgttcgatgacatgaacctccgccaggagcttctccgcggcatctacgcctacggtttcgagcgcccctcggccattcaggctcgtgccatcatgcccgtcatcaagggccacgacgtcattgcccaggcccagtccggtaccggcaagacggccacgtttgccatttccatcctgcaaaagattttttttgcagctcaagcaaactcaggccctcatcctggccccgacccgcgagttggcccagcagattcaaaaggttgtgctcgctttgggngatgtcatgggcattgactgccacgcgtg

SEQ ID NO: 93290 - DNA, 243 bp, Heterodera glycines
  SCN-specific regions: Sequence locations=1-111,134-243
taaagtataaatggtgcaaatcagccaatcccaaatcaaaaaaccctccgtctttcaccatgctttcccaacaattcacctttggctttgtcccctccctcttaattggcctttccctttgcattttcttccccgccggaggcaatggcaaatgcatcgccagtgacggcaactcgccaaatatttcttcggcacaaccattggaactcggaggttgcgtgaactttcgctgtcccgacaatt

SEQ ID NO: 93291 - DNA, 362 bp, Heterodera glycines
  SCN-specific regions: Sequence locations=1-154,176-362
aaagtccattcagcagaatggtggtcccaaccgtgtcacattcattctgcgaaaaggtgcaattttcttcactgggatggttgttggaacagtcgttgtttttaaggcatttaagccaacgcgtcccttcgacgaagcggcagaacgtggcaaaagggagctgttggagaaatacacggaggagtacaacgcgttgcaggaagagctgaggcaggcggaagagcagcatttttttttgagggatgtcgaagaggcggaagcgagaaaggcttattctatgacaataataatgatcaatttgggtggaagggttgtaaatcctctgaagtaggatcacattgctaattaaacattttgaattt

SEQ ID NO: 93292 - DNA, 485 bp, Heterodera glycines
  SCN-specific regions: Sequence locations=1-103,125-211,284-485
catatttttttgctggcaatgagcaggaacttcgccgctcttctccgtgtaacgtgtgaccggaagatggcacgtcgggccaacaaacagctgaaaagggtgtgcaagaaggcgcatgcgcaacacaaaaatatcgaaacggtcatccaacagcagttcgatgatcaggcaaaattggaaaagcgacgggagaagcggcgaagacagcgcaaacggaagcgaatggaacaacaggaaaaggaaggggactacaaaaaggaaggaaatggaagagaagaggaggagcaaacagaggacgaagcggacccatttgacgatgagaattacaccgtcaaacagtttgaggaggaggctgaacggatgcgcaaaaagcggatgggaaccgaattggatgaggacgagcgcgaaattacgcatttggaagcaaaactgaggaagaaagggcgcaagaagggcaagaaagagttggaggaggacggagatga

SEQ ID NO: 93293 - DNA, 214 bp, Heterodera glycines
  misc_feature (180)..(180): n is a, c, g, or t
  SCN-specific regions: Sequence locations=1-189,211-214
cgttcttgcgttcgtcttactaaagatgaattgcgttatgcggtttatcgtctgatcgggtccaacgagcgtttgagagccgacactgaacggatggagcgtacaaacgcacttctttttcaaatatatgcacgcctttcagctggaccgcccaatttggaaccgcagaatcttctttantttggtgctaatcagccgaatcttcctgttgctg

SEQ ID NO: 93294 - DNA, 544 bp, Heterodera glycines
  SCN-specific regions: Sequence locations=1-544
ggcagttcagcagatggaagaactgaggacgaaaaacaccaaagccactcgtgcccactttgccgacaccaatgcccttcggagtaaaatccaagaattggaacactcgctgaaaattgccatgaatgaacttagtgccagatcaacccaagcgaatgtccagcagcagaatgacatggaacgatcatttcgctcggggatgaacagaacgcagtcaatgagcgtcacattcgtttcgcgtcctggttctgcgatgtctcaccaggaaactttgtccaatttggactctgccggaatgaacgacgatgaaaggctgaaagaattgcgcgagcggaaccggcgttatcctccgcacatgcgctcgtattatttgccggagtctgctcatctgaagaacagcgagacggatttgaatgttatgccgtgagagggaataattggcaaaatctttatcaatggaatgacccaattcgcttttttgaactcattattttttctgtgatctgaatattgatttgattgctttaattagaattatcatctc

SEQ ID NO: 93295 - DNA, 209 bp, Heterodera glycines
  SCN-specific regions: Sequence locations=1-209
ggacggtcaattttgtatcgctggacgtccaaaacaaagaccggatgggctttttgttgagattagcggacaatgcaaatgggtttaatctcgcaaatgttgaagatttccggaaagttgtaatgaatgattttagttgaaattgtttgctcttaaagataaaattatttttaactcgaaaaaagcagagagaaacaaatttatatttt

SEQ ID NO: 93296 - DNA, 176 bp, Heterodera glycines
  SCN-specific regions: Sequence locations=1-176
acgaaacgaaatgaaacgaaacatctgtttgccccagcccctctcaacggatgccaatgcaaaaaaatgccaattttccgttccttctgctcctcctccgccattctcttaactgttctcgatgtttttctgttcactgcacaattcgccaattcgtcggcaccggcggacgattc

SEQ ID NO: 93297 - DNA, 402 bp, Heterodera glycines
  SCN-specific regions: Sequence locations=1-402
aatgtgatcatttggggcaatcactcgagcactctgttccccgatattcgacatgccaaaattgccaaaggtggttccgaaactttggcctatgatgcggtcaaagacaccgcgtggattcaggaccaattcatcaagaccgtacaaaagcgtggcgctgtgatcatcgaaaagcgcaaattgtccagcgcaatgtccgcatcaaaagccgcgtgtgaccacatgcgcgattggttttttgtcactccgtccgacggtcgttgggtgtccatggctgtgtttttttacggctctcacggcatccccgagggattggtgttttccttcccccgcaccatcgatgcacaaaaaaagtggagagttggggaggggctctacctcgacgactttgccaaggggagg

SEQ ID NO: 93298 - DNA, 117 bp, Heterodera glycines
  SCN-specific regions: Sequence locations=1-90,116-117
cgctgtccctggaggagttgaagcgtgtgcctgaacagttaatgcgtgccgctggcatcaaaccgctgcctgaatgatcaaaaaaaagcctaaattttaatgtttaattttaaaaaa

SEQ ID NO: 93299 - DNA, 395 bp, Heterodera glycines
  SCN-specific regions: Sequence locations=1-103,125-395
atttcttatcacaaataatttatcactttaaaaattcactgctaatcgatttctaatcaatgctaaactctctgatcaagtaatcactgatttctacccaaagaaatgctgatttttctaattggcaaaaaaagtcggtatgtgttcggcatgccatttcggcacccacaagcatacgaccaaaaagagttggacatggtgcaggcattttcggcaaaaatcatggacttttggggacgttttgcgcgcactggtgaacccatcgagttctggcccaagtacaacaggatcacgcgaaagtcgctggtgctcagcgatgagattgcgcgcgggaacagtcatcgcatttatgtggacgtgcacggcaaactgtgccgtctgttggaagaggcgca

SEQ ID NO: 93300 - DNA, 387 bp, Heterodera glycines
  SCN-specific regions: Sequence locations=1-40,64-220,242-387
gttgtccactggaaaaacggccattcctcatcatctgaagacggaaaaacacaagaaagcagcgaaagctgcaaattccgcaaggcaattacggcattcatgccaagcaaatcggcaccaacgaatttggaccgtcaaacagcagcagcggaaggtgcttgggcatatcacattctttgtgccatgcgcaaagctttaaatcggccgattgtgtctcagatttgttgtcaaaaatttttcctgattcaaaaattgcggcaaattacggatcaaaacaaaataaatgcgcagcaattattacaagagtacttgctccgcattctgtctccattacgttgcacgaaatgactgggcttccattttcactttcgattgactcctcaaatc

SEQ ID NO: 93301 - DNA, 527 bp, Heterodera glycines
  SCN-specific regions: Sequence locations=1-188,212-527
atttgcaacaacaaagaaaagctttcattattctcatcagcaaaaaatgagtcagcagccaaacgcaccccctccctacgacgacgctcagaaatacccggcctatcccaacccaaatgttccaactgaacaaggtgccgcctatcagccaaacatgaacaacccccagcatgccccgccacaaccgtcgccgggcgccgcgccggccggcaacaccaccaccacttacgtgtacatggcggacgggggacagccccactgggggcctcggccgcaaaatgtcttttgctcgaactgtcgccaacaggtgctgaccaaagtcaaatactccgccggtctgctcacttggctgttgttcggcggttgtcttctgttcggctgttggttgggctgctgtttgcttccgttttgcatggacgactgtcaggactgtgagcattactgcaccaactgcaaggcgtacatgggccaatacaaacgtctctgataaatggttttgactcgtcgttcgtcctgacaacttccac

SEQ ID NO: 93302 - DNA, 653 bp, Heterodera glycines
  SCN-specific regions: Sequence locations=1-204,228-653
aagaacgaggatttattggaatgattgggggcgaagaccttttcacaaattcagacgaggagctcgatgaacaaaaatcgccagaaacgaaggaatgcgaacaatctcggcttgttatttcgccggcttccgattcatttagcactgccgccgaattttccaacaacgaaccgtctcataatcagtttcccgaggctccgttgactccttcctcttcccaatctcctcatcagcatttagacaaattgtcatctattctcattgatggctctattcaaatttttatccgagcctatgaaaagcgaggcgaaggcatcaatgcttacattgtctacaagattgagacaatggcatcaaaaattccgggttacataaaaaatcgttttgaagtatggcgacgtttcagcgattttttgggccttcgtgcaaagttggccgagaaataccaacagttgggcgtcattgtgccatacgcacccgaaaaaagcattacatcgcttactaaaacgaagctgaatgccggtgaagaacacagtgacttggctaacaaacgttctcgtctcttggaacggtttctgcgccgtttggctgctcatccgcgtttgggttccgattgcgaagtgcgggactttctcctcttgtaaggggacttg

SEQ ID NO: 93303 - DNA, 283 bp, Heterodera glycines
  SCN-specific regions: Sequence locations=1-283
ctatctctcaaaacatgcttctgagtttatggatggtcctttgatccacaaggcgtatattattccgttcactttcgacataaaacaggcttcttttggagccatcaaaaaaggaaattacgttggaatggcacttccaatcaggaaatacattaactggaagtctgtttttttgtttctgccatgggttgttcagataaaactgttggaagaagtccaaacgaatggcggagactgggaacacgcactcaagaatttggtgccagagagaggtttggagaac

SEQ ID NO: 93304 - DNA, 268 bp, Heterodera glycines
  SCN-specific regions: Sequence locations=1-268
caaatgagttcggacggtcggccgtccaaaagttcgcgaatggcacaggcacaagaggcggtggcacgcgtaaaagctccggacggcgaattgcagcccagcactgagatagacctgttcatttcaaccgagaagataatggtgttgaacaccgaccttcagagaatctcctattatttacgttcgccaggacattctcatggaccattccctacgctccatctcttacatcgccgacattggcgatttggttgttctgatggcccgt

SEQ ID NO: 93305 - DNA, 236 bp, Heterodera glycines
  SCN-specific regions: Sequence locations=1-236
ttacccaaaaacgaggccgtgaccatggaccacaccaccagcactctccgcatttcacacccaagccagccaagatgccccaagtgatcaacctcaagaacttgccgccggacgagctgtccatctacaacaagctctacccctgcaaggtcgcgctgctcaccctgaaaaagggccagtccttctcgctcccggaactggccgatatctcagacaaggtctcttcacttgccgag

SEQ ID NO: 93306 - DNA, 526 bp, Heterodera glycines
  SCN-specific regions: Sequence locations=1-198,220-526
attatttattccctcctggatatggcatagatttctggatgagcgcgcccaacttcagtccttcgaggatttcttctacaggaacaaacggaattcggataacacgacggaggagcagcgctcgtgttaattggctgaccgaactcaccacgcgcgattctgctgcagttacaagcacccaaacttcagaggatttttctgaaatcagcaaacatttaggcgctcgttgaggacgaagacaatattatattgattcaagcaaaacgagaaaaagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattcagaatggcaatggt

SEQ ID NO: 93307 - DNA, 380 bp, Heterodera glycines
  SCN-specific regions: Sequence locations=1-380
cttcttccgctcgtggcaatgggtcggcgtttaatttgcaaaaagacactgtgataattagcagtcttgcacaaattttgcgttttccgttggaattcgagaggcactcattggagaagggagaacatcccgaaatccgagagggaattgcccatgcgcgacaatggttcgatcgtcgattagaacaaattcgaattgtggagacggaggaaaagggcatcatttgcagggagtacgaggaattttttgcccaactcgagcaggaacatgtcaagaagctgaaatagttggaggaatcgttcttcaaagagttggatgaacagaatcggtctctcgacagtgaagtcaatgcgttggacattgccattccgccgcttggc

SEQ ID NO: 93308 - DNA, 198 bp, Heterodera glycines
  SCN-specific regions: Sequence locations=1-198
caccagcagcaagtttgaagaacaccttcgattaattatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcgg

SEQ ID NO: 93309 - DNA, 322 bp, Heterodera glycines
  SCN-specific regions: Sequence locations=1-64,87-322
cactcaagacaatgaaggttcacccgtgacagttcagggcgaaatcagtggtcttgagcctggtcttcacggcttccatgtccatgcctacggcgatttgtccaaccggtgcacttcccccggcccgcatttcaatccaacaaacttttttctcggcggaccgcaggatcaaatcctacatgtcggtgatttgcgcaatgtccatgctgggtcggacggaattgccaagctgacattttctgaccatttgattacagctgtgcgtgccgagcaccttgtgcggcatcccctggtcttggcgcagtcgcaggagcatttgggg

SEQ ID NO: 93310 - DNA, 431 bp, Heterodera glycines
  SCN-specific regions: Sequence locations=1-209,231-431
gcaacagcaacaacagcaggatcgctgaagcggacaatggcagcagtttcgacatggacaccgacggggcgcgccaatgggacgaaaatgaggacgacgacatggacgacgatgagctgatccggaggcaggacatgctgctggacaccgagcccgtcaaccaccacgaggtccattgtccctactttccgggcgacaaattcgagtggtggtacttgtttttgttggagcgcaaaacacgccgactggtcaccatggtgcaaccgtgcaagacgcttgaccaggagaagacgcacctccgttgagacctcagcacactgaacacaactgcgcaccatttcttcagccttggtcatcacatattccggctgaaaaaagcgcaaatttcaatcaaaaaaaaaagtgtaaattaaaatttttattacatttaa

SEQ ID NO: 93311 - DNA, 459 bp, Heterodera glycines
  misc_feature (440)..(441): n is a, c, g, or t
  misc_feature (444)..(444): n is a, c, g, or t
  SCN-specific regions: Sequence locations=1-459
taagttttttatccttcctttgaaaattatgttttgcaatttctacagaatttaattgtgtcctcatttggcgtacaatgacaacaggtggcgcaaatgaaccgagattccatgtgctggcccaattggaacatcttcagtcaaaatacacaggcacgggccatgccgacagttctcgctgggattggatcaccaaccagcatcgtgacactttcgcttcaatcattggccatcccgaccatttgagtatgatggccatttgtgagaatgagacgcgtgctcgaacgaagtacaacatgctctgtcggatggttcagccgtgtggtccgcccccggaaaaatcagctttagacgatctttgacagctcacaatcggtcgcgaaaggatcatcatcttttatttgttcaactataaaatgttttcatcgactctttcaaannaanaaaagaaaaaaaaaa

SEQ ID NO: 93312 - DNA, 546 bp, Heterodera glycines
  SCN-specific regions: Sequence locations=1-181,208-468,491-546
cttaagatggatgattatgcttatctgttcaaagttgtgctggtcggaaatgctggggttgggaagacgtgtttggtcaaaaaatttactcaaggaatttttccgccggggcaaaatgcgaccattggagtggattttatggtcaaaaacgtgaaagtggacggggagaaagtcaaattgcaaatttgggacaccgccggacaggagcgcttccgttccatcactcagtcctattaccgttctgcgcatgccatcgtgctcgtctacgacctctcctcccaaccgaccttcgattgcatcagcgaatggctgctcgaaattgagcaatatgcaaacaaaagggcgttgagaatgttggtagggaacaaattggacagagaagaggagagggaaatcccgacggatgtcgcgcaaagtttcgcctcggccaacgcttttcattttttcgtggagacgagcgcagcaaacgatgccaatgtgaacattctgttccaggaggtggccgagcagttggtcagcaacgagaagaagcaaaatgcaaacgga

SEQ ID NO: 93313 - DNA, 430 bp, Heterodera glycines
  SCN-specific regions: Sequence locations=1-31,62-202,226-430
gaattcattccgccatttgagcaagagggccatgacagagaggaggaggaggagaacagcaaacggaggagggcactgaaaatctgtttcgatttgccgtccggcgcctacgccactgtggctctgcgcgagttgatgcgcaccgactttggcaaaaaggcgcaaaagcaattggaggaagaaatgatgaggaagagaaggcggaggacggaggaagcagaaggcgaatagggaagaagcgaaaacgagcaaaagaaagacgacaaaacggaaatgtgccaaattaaaacttaaaacatttttttgttgttttgattgtttcctttttcaccacttttacttgttaattttatgttggtattcccgatatgtgtgattgaaagaataagaaaaaaaagttgaaactgcaaaccgagaccaaaatgacaac

SEQ ID NO: 93314 - DNA, 387 bp, Heterodera glycines
  SCN-specific regions: Sequence locations=1-46,69-128,150-387
ggccatgtcatctttgctcccttctcgtggcaatttcacttttctggttcctttcccttttagctatttctcctcccctgacaatggcactttcgcttttcccacggcaaaatgtgccgaaaatgttacattctccgtttctccaacaacatgacaataataataataataatgtcagaggaccattgggttacagtgatcagcttgaactgttggcacattcgggaagaatggcaaagaaatgtcggcacgactgttcaatcagtgacccaactgccgaaaaatgctggaacgaaactttggcattttatgagcaaacgcttttcggagtgttaagacgtgtcattttggttgaaaccaaccgaattttatggatgaccggccaaa

SEQ ID NO: 93315 - DNA, 581 bp, Heterodera glycines
  SCN-specific regions: Sequence locations=90-90,135-135,163-581
cacaactgaacacactatcccagcagaagcaagtcacactgaatgtgcaagtgccgaaaacaccgacgcgtctcttctctttgcacactttgccaatgactttcgttggcacagagaatgttcaaaatgctcgtcctcagcagcggtcagcttttcttcatttcggcgagcagtgcaaagccgtgcagaatcagcagctgctctccatggccatggcattcgacaaacactccgacacggaacagtccctcctccaactccctttccatgtcagaggcattctgcacagaccgcgacgaatggacaaactgaaggaatgggtcaaggtgcttctctcgacagaaaatcacttccaactgtctctcgtgtcaacatcaagcctttccccgcacgaaatcgctttttccatcggctgggatttgtcccgcccccaaccgaccattagcgaggctttatcccatatcggattcaaagaatggccaaaggcattcacttctaccgcttcggacattgagcggaaagacaatgaaaacgaagagactgaagaggacgacggacagtgggggactgaagcgacggcg

SEQ ID NO: 93316 - DNA, 321 bp, Heterodera glycines
  misc_feature (49)..(49): n is a, c, g, or t
  SCN-specific regions: Sequence locations=1-89,135-183,206-222,249-321
aaaagccaaaatttgtgcggaggcacggcactcaaaatggcggcagacnggaaaaaaacatcaaaaagttgggcacaaaacagcaccaactgcagctgctcactgctgcccgatggaggaggaggagcaacagcaatccatggacaaggagcagcaacaattcgaggcgtcctccaccgcgcactgttctttttcgtcttcgtccagcggcggtcaatccggcgccgccgccgcctccgtgctgctcgtcgacctgtccaatccgatgctgcagcaattctatgtgcagcaacggttgttcttccgacaaatttatgccca

SEQ ID NO: 93317 - DNA, 449 bp, Heterodera glycines
  SCN-specific regions: Sequence locations=1-170,193-408,430-449
aaaaactattaaatattttacgaagtaataaaatgaattccgctggctttgttctactgctgtggaacattgtcaatttgcttattgtttgtgaaggaaatgtgctaaaagagaaagttgacaagtcttttgcaagtgccgatcttttggttgcgcatgtgaatggacagcagagttcgtggaaggccaaattaaatgccaaatttgccaaaatgacgccggaggagcagcagcaattgatggggtcacgtcggccatttcttgaaccaatcacaaaaagcacaaagcaacaaaacggaaagccacgccttaataaagcggacattccgttgaattttgatgcccgacaacacttttacaaatgtgccgatataattggcaaaatccaagatcagtccgcctgtggcagttgttgggccgtttctgtcccctcagcgatcactgaccga

SEQ ID NO: 93318 - DNA, 655 bp, Heterodera glycines
  SCN-specific regions: Sequence locations=1-655
aaggtttttaataaattccatgtcgacgatttcttccgatcagttggacaaattggaaaatgtatttgaaatccgaaaacatttgaatgcttctgaacaaggacgtttgggcaaggcaattggcctaacagaagagcaagtcaacgaatggttcgaacagcggcgcaatcggtggagagaagaattttcttgtgactatcaagaacagtcgccacaaaatgttaacaaaacggaggcagctgaacaaaaagttgtggcacagaagcaacaaatgttgtcggccgatcagtttgcggtgcagagtgaatgtgccaccgtttgggagccgttgaaccttcgtcaggaatggacaatcagcaactttgccaaagcgttggaattggccactcccggcatttgcatgcgaggcaagaagctctgggacacgtcgatgccctacatttgctggcagttgtgcctttacccgggcggcaagcgcgaggcaaacagtggcaatgtgtcattgttcctcaaaatgtcaacgacacatccagcgcacgagttaaccaccgttcgtgccgagtaccatttcttttttgtggatgagcagggcactgtaaaattcagcaacacgaacaccgccgacttcaatgtgaagccgtccaaaagctcttgg

SEQ ID NO: 93319 - DNA, 475 bp, Heterodera glycines
  SCN-specific regions: Sequence locations=1-475
gatttgcataatcaacaatggaaagaacagcaggaggactatcccttgcatttgattgtcagtcggatgatgtttgtatacggcgattccgacgagcctttgaacatttgccaggaatttatgctcgatttgctttgcaaacaactgaaaatgctcctcgacaaggcccataaactttcgattgaacgacacagcccttctgtcggctttcctgagtttatgttcgcattcaggcgccatccgttgctgatccgaaaactgattggatacatgcggctggttgaccttatgccagcgatgtttcgtgaagaagaacaaaaaattgatgattcagaagacattctgccgttgtcaagttcatcgtctctcaacatccaaaattcattggacgacttaatgaaattgaaaaacacttccaaagtgatcgttgcagtgcgtctcattgatgtgatggaccatcttttggctgacatcg

SEQ ID NO: 93320 - DNA, 91 bp, Heterodera glycines
  SCN-specific regions: Sequence locations=1-70
gacgaacactcatcactagtcatgcccaaaaattgtgtgcataaactgacaattaaaaaaagagaattgtaaaaaaaaaaaaaaaaaaaaa

SEQ ID NO: 93321 - DNA, 562 bp, Heterodera glycines
  misc_feature (556)..(556): n is a, c, g, or t
  SCN-specific regions: Sequence locations=1-169,192-409,433-520,556-562
gtcactccataaccaagacgtactaccctgcgcaaaacgacgtaattcacgttttcaacctgtccctttgttcctcattgtcttcgaccttggcctcataccaacttgcatcgcccgtctccaaccaccgcgagggaaccttgtctccatcggcaccaggcctgcccgtaccgccctggccaagccccaccactctgattcagcgatgacaaacatgtcagacaatgcgccagagcccaatgtggactcgatcattgagcggctgcttgaagttaggagtagtaggccaggcaagcaggtcgcgattcccgagcacgaggtcaggtggttgtgcatgaaatcgcgagacatttttgtctcccagcctatcctcttggaactcgaagcacctctcaaaatctgcggcgatatccacggccagtactacgacctactccgccttttcgaatacggcggcttcccaccggaggccaactacttgttcctgggcgactacgttgaccgcggcaagcaatcgctcgaaaccatctgtctgctgctcgcctacaagatcaangtaccc

SEQ ID NO: 93322 - DNA, 430 bp, Heterodera glycines
  SCN-specific regions: Sequence locations=1-63,91-180,205-304,326-430
ggcactgtctctgccgccccgtcttcgtcggcacgcattctctgcttcgaccatatccgtttttgggttggcaatgccaaacaggcggcccattggtattgcgtcaacttcggcttcatccctttcgcctacaggggcctcgagacgggaagtcgaaaaacggtggcatatgcagtgaaacaggacaaaatcttttttgtgttcgagtcggcactgctgcctaacaacggggaaatgagcgcacatttggccaaacatggcgatggtgtcaaggtcagttctccgccgttttctccgtcttcggcttttccccttcccttccactgattaccgcccccccccccaatcaaaggatgttgcgttcgaagtggacaatttggactgggttttggacactgcgcgccgtgcgggcgccgttgtggcggaagaa

SEQ ID NO: 93323 - DNA, 424 bp, Heterodera glycines
  SCN-specific regions: Sequence locations=1-222,244-259,281-424
gtcgtgccaaccgttggccactgtccgccctcccgggacggccattcggcggtggtcaacggcgactttatgttcattttcggcggatttgaggagagggaacaccgcttcagccaggagacgtacgccttccatttcccgacaagagtgtggaagaaattgaaaacggagggcgaatcgccgcagtacagagacttccacgcggcgtgcgttttgggtatgtaaaatgtatgtttttggcggtcgttctgatgagatgggccagctgcacacttcccacgacgtttactgtgacaaattgcattatttggacctcaaaacgttccaatggcatcgccccgaggtgaaagagccgacgacagcgccgtgcggacggcggtcactgacaatgtggacttatcgggatgcgatttacatttttggc

SEQ ID NO: 93324 - DNA, 526 bp, Heterodera glycines
  SCN-specific regions: Sequence locations=1-269,292-526
gaatgttgatgattcttacattatcaacccatgggaattactcaggaaagcaattcaagaaattcagcgaaagaacaattctggtctaagttttgaagaactttaccgaaatgcctatacaatggtattgcataagcacggagacaaattatacgagggactcaaagaagtggttcgagaacaccttcaaacgaaggtccgagagatcgttgttgaggcaataaatggtcgctttctggaagtgctgaaccgcgtttgggctgaccacacaacctcaatggtgatgatcagggacattctgatgtatttggaccgtgtttacgtcgcccaagcagctgttgaacctgttcacccgcttgggttgcggattttccgtgaagaaattgtcgattatccggccataaatgagcatttgaaggcgactctccttgggatgatttcgctagaacgtcagaaggaaatcatcgaatggattgaccttaaaaatgtgtgccaaatgttaattgcgttggggttggacaatcgg

SEQ ID NO: 93325 - DNA, 94 bp, Heterodera glycines; identical to SEQ ID NO: 79778
  SCN-specific regions: Sequence locations=1-94

SEQ ID NO: 93326 - DNA, 473 bp, Heterodera glycines
  SCN-specific regions: Sequence locations=1-157,194-207,229-230,252 -265,289-473
aaaaaggatgagatcgaagttgagatgaagaagaagcggaccgttcgcccttcacaaacggcaactcgtcgaagacagctggacgagccgacaagacgaaggacaagtgcatcaccgagcaaaattcgagcgtccaatgccaacattgaacgtgcaaagaaggcagcagcagcagcagagtcccgcttctccactccggcaaagatgacaccagcagaaaagtcgcaactacaacgcgagcagcagcagcaaaaaaggaataaagaagccgagaagcagatggaggcgaagctggccattgtgcaacaacatctgcaaaggcaaattgaacgtgagaagaatttggcagtgcgcaacactctgtggaacagagaggccaaaatggaacaacgaatcatacaacggttccgtgcctaccgcgccatggtggacaaagagtttcgcgcagctgtccaccaaggagcaacaattga

SEQ ID NO: 93327 - DNA, 530 bp, Heterodera glycines
  SCN-specific regions: Sequence locations=1-424,446-530
atttaaactgggttgtaagccattattttctgatggatttgcctggcatttctggagagcagcaggaaaaaggacagcggttaagcagcagcgcagcaaatgacttcggaaaaacagtcggaggattggaccacacaaaagcagtaatcaccgcacaaccgaagacaaacgaaactccgagcggagaattgaaagagaattcgccaacgaaagggggcgatctcagcgggtgttctgactgtttcctttgctgcgctttctgcgacccgtccgatctgatggaatgttttgcctatttgtgctgctgcggtgcgtttgccgaaaattgttgacgaacagggaatggacagccaatgtccaaaagtggcataataaaaccggtgaaaagcaaaaagacggcaaaggaccaattttctttcgacactttaaatttatttttatatttcacagcctttttccttttttgtaagcaaattccaattgtcaaatatgttcaaattgttttatattaaaggctttaatttttaaaa

SEQ ID NO: 93328 - DNA, 543 bp, Heterodera glycines
  SCN-specific regions: Sequence locations=1-193,215-338,376-493,515-543
aattaattgagtaaatcgatgccaatcttttgactgccttttttcacatgtcccaccatcagcagcattttcctcccgccatgtttaaatccgaccggcgtttgctcagtgcgccgtaccaaagtcgaaatgccgaacgaatgcagcggagaattggccacggaatgggcgaacactcgcgcaaattcacttccaatgggaattccttctgcacttttgaagggttaatggaagtcgccgtggaaatcgaagtgaaagaaacgacggaaaacgaagggacagatgaagcgaatggcacggcaaattcaaagccgaaaatggcacaggaaaagccgaaacggcagcaggggggaggaggaagaccttttgttggtgccatctctctctgccggcgaatttggccaccaccaaaagcatttcgccgcttctccgattaaaacggatgagctgcgccctctcccccaatttcggcactcttttcgccacaattcgccctcctcctcttccgccgccgtcggttctctccgccaattgcttcgcttc

SEQ ID NO: 93329 - DNA, 241 bp, Heterodera glycines
  SCN-specific regions: Sequence locations=1-241
aaaagaaaccggagagaaccgggtgtacactgtgctgttcgccattaccgtgattttctttctgtgaacgatcccctcgcccccggggaccattttcatctccgatcggcatagccaatcgctgccatttcaaatattccgttccgcctcgaatttgttggaaatcaccaaattcgctcttaatttttacttatattgtctcataaacccagacattcggagggtttgcctcagagtgtta

SEQ ID NO: 93330 - DNA, 518 bp, Heterodera glycines
  SCN-specific regions: Sequence locations=1-157,180-278,301-411,433-518
gagaataatggccaaccgtcgggtcgaagaacaaaggcagacgcttacaaaggagcccaaaaaaaaggttttcgagagagactttctgcgaatggcgactctgaccaacgatgtgatgtttctccgtcgcactttggagcgcgacgatctctctgaactgttgttgtgtttgtttgggtcattcacttgcgaaaaagcgtttgagacggccgaacatttggaggcattcgtcgcgaaacattgtccatccattcgcattgaaacggtcggattgggcgctgatgtgaaaaagtttttccattgggatccggcgggtgaccagcctcagaagaatgggttggacagaatggcgaatgggacggcaatcaacgaaacattcgaagaggaaaatgaaagcgaaaactgaacagccgacaagaaagaaacacaaaatcacgatgatcaaaaacttccgatttttgatactgaccttttgtaaatttattgtttttttttgttgatttgaataaaattttcgc

SEQ ID NO: 93331 - DNA, 616 bp, Heterodera glycines
  SCN-specific regions: Sequence locations=1-54,77-477,499-616
caagtttgaggtaattcttaaatttactttaaaaatcccttttcacttttacatcgttttattttgtttggattttacgatggctgccattcgaaaaacactaaattttgtgagtggaaataaacagaagttgcttgagcttcgtcttctgctcggagacgaatttgagattgctccgttggacattgaccttcccgaactgcaaggtgaccctgcggacataaccaaggcaaagtgtgccaaagcggtggacgccaccggtggcactttgaaagtaatcgttgaggacacggcactctgtttcaacgcattggacggactgccgggcccatacgtcaaatggtttctcgcgaagttaaagccggagggattgcatcggttgttggctggctacaacgacaagtcagcttattctctgtgcactgtggcctattcagagggaaaagacaagcccatccatctttttactgggacaacaaatggacaaattgttgagccgcgagggccgcgcgagttcggatgggacccatgcttccaacccgatggatttccaaaaacatttgcagaaatgaccaaggaagaaaagaatcaaatatcgcacagagcgatcgcatta

SEQ ID NO: 93332 - DNA, 408 bp, Heterodera glycines
  SCN-specific regions: Sequence locations=1-408
actcagcgaaagatcaaaggaattggcgaacatttggccacaatgggcgtttcgtttgagagtcgtccgctttcggttggcgactatctttgggtgttgcagcggacaaattgggagggcaaaagacaggaattggtgttggattatgtggtggagaggaaaaccctcgacgacctccggaggagcatcaaagaaacgcgctatttggagcagaaacagcggctgaaatagtgtgggctaagaaatgttgtttttgtgctggagggagggacgacggccaacgaccggcagttggagcaggcgatggtgtcgagcggcgtggagagcggtttcctcgtccatcggacgccgaatgtgcaggggacggccaaatttctgcaaaatttgacccgatggctcagagaacgt

SEQ ID NO: 93333 - DNA, 577 bp, Heterodera glycines
  SCN-specific regions: Sequence locations=1-284,306-577
gagttgcaatgccagtaaaaattttaattttttcaattcttttctgtgtgtgtttgcaaacggtggaacttggttttaatggacaattaaatcaagactcgcaaaataatggccaattaacaagcacggttcaagaagcacaaggaggaacatttggcaaccaaaaccaagctactaataatggtcaatttaaaaatggacaattaattaatggccaatcaacaatcacttcttcgaataatgtgcaattaattagccctgtatcgcaagtgcagcaaggaaccgggtctcttaaaaatgttggcgaagggacaggactatctgttaataggcaacaattaatcagcactggtgcgcaagtgcagcaaggagccggatttcctaattatagccaatttaatgcaggccaagggtctcttaacaatgctggacaagcaacaaagtcttcaattaatgggcaattaattaaccctgctgggcaagttcagcaaagaatcggatcatcaaatgattatcaaccgaataatggtcaactgattaataactctgaccaaggaaaaattaacgggcaagtggg

SEQ ID NO: 93334 - DNA, 452 bp, Heterodera glycines
  SCN-specific regions: Sequence locations=1-387,418-422
ggaatgctaccgtaactttctgttaagcgttaccgttacccaccaaacattcaccaaacgacggcgactgcgtccgctttcccaactccgcccgtcagtggcgcagcaatgcctgtgccgggctccggactgagtctacaggtgtccgtgctggccggacaacactcagccgcacatttgcacaatctgagcaccaacgaatggggcggcacttcgacggtggaccatccaagtcagtattggccccaatgaccgaacgaagggacaaatagcgaacggagaaagcgaaccgaccgatccatggacaaatcacaaatcaacagttgtttaccaaagattttcaaaaggtcatcgattcattcacaagcgtattgtgcttttcatatcaataaaatttgaaaatatattaatttaaatgtgttaaaaaaaaaaaaaaaaaaaaaaaaaaaaaa

SEQ ID NO: 93335 - DNA, 653 bp, Heterodera glycines
  SCN-specific regions: Sequence locations=1-653
gtttgagctgtgctgacaaaattaaacaagcaatgaaatacacacatgcgatcactattcgaatgccttcttctttaaaattcgacgacaaaaaggcaaagtccaaaattgattttccgcttgcacttagacaacaccaggacttgacagagactctcactgaggcgggcattgaagtgattgagctcgcaactgctgaaactgaaccgacaattccatcgctttttgcggatgatttggctattgtgataaatggcaccgctcttttgactcgacctaaaagtaacaacaacaaaaagacgcccgttgtcagcagaaccaatgaatttgtctctgtgcttaattctttgacctggcaagtcgtagaagcgcctttgcaaattcacggccgttctgtggtgctcgaagggtctgatgttgtttttaccgaaaaggaaatttttgttggaattcgcaaaaacggaacaaatacagaaggggcattgattgtcgcgaaaacgttcgccgattattccgtaattccaatttcaatcgctggcactttgccgttaaaggcgcatatttccgtggcaacaaatgaaattctttcggttggaagagataaagattcgcaagccatattgagtgcattgaaagggatgccacgttccgct

SEQ ID NO: 93336 - DNA, 334 bp, Heterodera glycines
  SCN-specific regions: Sequence locations=1-334
gtgccgaagagcactctaatcgtgcatggactggctagtggcgatcgacacgtgggagtaccgagggcacaccaaatgcatcacggaggaccaaaagtacttatgcgcgagacatgtgccaaaagtgaacaagggtgaactaaagcaggacgcctgggtgtcgcaagtgcgtgccgccatccgtcaggtggaccagccgcggctgaagaatttgttgcgctccgtccaatgccacaccaatctcccgcgcaaggaggcccaatatgtcgtctttttgcaaaattcgatgcgcattcgggaccgcgcgttgtggggggacgcgtggaatggagtc

SEQ ID NO: 93337 - DNA, 627 bp, Heterodera glycines
  SCN-specific regions: Sequence locations=1-147,174-177,205-205,228 -261,294-297,361-627
cttctgtccactctgacttggcgcatttgacctgctccacccctccaacgccactcaaccgcagcacccgcccactcactactcgccatcatgggtttgtccatctccaagctcctgtcttctctctttgggaagcaggaaatgcgtattctcatggttggtctcgatgccgccggtaagaccaccatcttgtacaagctcaagttgggcgaaatcgtgaccaccatccctaccattggtttcaacgttgaaaccgtcgagtacaagaacatttccttcactgtgtgggatgtcggaggtcaggacaagattcgtcccttgtggcgccactacttccaaaacacccaaggtatcatcttcgtggtcgactcgaatgatcgtgagcgtgtcaacgaggcccgcgacgaactgcaacgcatgctcaacgaggacgagttgcgtaacgccatcctgctcgtgtttgccaacaagcaagatttgcccaatgccatgcaagccgccgagatcaccgagaagttgggtctgcaatccattcgccagcgtgagtggtacatttaagcgacctgcgccacgtccggtgatgggttgtacgagggtctcgaatggctgtcgaacacgctcaagaag

SEQ ID NO: 93338 - DNA, 469 bp, Heterodera glycines
  SCN-specific regions: Sequence locations=1-413,435-469
gcgcgtggccattctcgactttggggcgcagtacggaaagctcatcgaccgtcgtgtccgcgagtgcaatgtgtgcagtgatttgctcccattcagcacaacaatgaatgaactggtccacaacggatacagtgccgtaatttttatcggaggaccaaattcagtttatgtggacaatgcgcccgtgtacgacccggaactgctcggtggtcgtcttccgctgctcggcatttgctacgggttccaactaatcaacaaacacttcggtggctccgtcagtttgcagccgcggcgggaggatgggcgaactcagatccaagtcagcccaaagtcggaccttttccactcgttgaagccggaccaatttgtgctgctcacccacggggacggagtgacaccgggaaacgtcagccaaaaatgggtttcaaccaattggcttcaccggggaatttgtggcggccatcgaaaa

SEQ ID NO: 93339 - DNA, 545 bp, Heterodera glycines
  SCN-specific regions: Sequence locations=1-545
aaacaacagtactccaagccacaaaaatgcctgcccaaaattttgtcacgaatcagcaacgaaaaaatgattacgcagctgaccaccaaacaatgctgaacacgctgaacccaccgccaaaaacaattaaactgtccgcccgtacattggatgccatcgcgttggcacaccaggaagtaaatgtgccgaaatacagtcgtgcttcattgtcggccggcattgttcacttcggagtcggcaatttccaccgggcgcatcaggctgtttatctcaatgaattgttcaacatgggccaagacttggactgggccatcattggagtggggatgacttcgtcggcaagtgcaaattccaagaagaaatgtatgctggaacatgactttttgacaactgttgtggaacaggatggcatggcacaatcagcacatgtgactggttgcatgattgactatgtcccggccggcaatcccgagctggttgtggccaaactcccgcatccggccctccgaattgtgtcaatgacgatcacggaaagcggcctattt

SEQ ID NO: 93340 - DNA, 546 bp, Heterodera glycines
  SCN-specific regions: Sequence locations=1-18,50-57,103-126,191 -196,244-276,300-546
gcgttcggtgatggttcgctgtttgtcgagaaattcgtggaaagacctcggcatatcgaagtgcaaataattggggaccattacggaaatttggtgcatttgtacgagagggactgttctgtgcagcgacggcatcagaaggtcgttgaactggcaccggcacctgttttggatccggcaatacgtcagcgaatgttggacgatgctttgaaattgacacgccatgttgggtaccaaaacgttggaactgtcgagtttttgctggacactaaggggaatcattacttcatggaagtgaatgcacgtcttcaggtggagcacaccgtcacggaagagatcaccggcgtagatttggtccaatctcaaattcgcattgctgagggaaagtctctcgaggacatcaatcttcgtcaggactcgattcatgtcaatggggcggcaattcagtgccgggttacgacggaggacccgggcacggcgggtttcaccccgacagtgggaggatccgagcgtttccccgtgtcccaagggggggggcagtcgctg

SEQ ID NO: 93341 - DNA, 135 bp, Heterodera glycines
  SCN-specific regions: Sequence locations=1-56,79-113
attaactttgaattcgattctttctccattgtcaggctcatttttcctctattcattaaatatttatgttgctttttaagtttggtactaaatatgtgagataaatattgacgaaaaaaaaaaaaaaaaaaaaaa

SEQ ID NO: 93342 - DNA, 137 bp, Heterodera glycines
  SCN-specific regions: Sequence locations=1-98,120-137
cccacttctattggatcccactctgcctctttgtctaccaaacattcccttcgcttaaacttaagaagccaaatccgcttatccttattatctatatgtatattgcttctcttccccatgccaaaaaaaaaaaaaaa

SEQ ID NO: 93343 - DNA, 474 bp, Heterodera glycines
  SCN-specific regions: Sequence locations=1-474
gtttctctttgatggatgtcaacgaatttggtcttgctgcaagttcttctctgcttacatgcgaagagattgccgaagtttttctccatcttacggtccgtcctcgtccccaatgtcgtttttcggcacgcggtttccgtgccaattcgcgctcaaaacatattgtgcagcgcttttccgccctctcctccaagcgatgcacgcgccgtgagaacaaaatttgctttaccgccgatcgggacgttctgatcagcggagtggcgatttatggcgccaatcagtcgggcagtcggatgatcaccgacgatagcacggcaaagacaaattgggaacataaaatagccataaagcttgaactcgtggccgatttgtacggctctccgctagaacaattggcatctaacgaactgttgatgagcggcaaattcggcgacccgactccgctggtggcccaattcgctgagccggtgccat

SEQ ID NO: 93344 - DNA, 511 bp, Heterodera glycines
  SCN-specific regions: Sequence locations=1-249,272-511
tgagcgcgccactaagactggcttagcggctgaggcccaacaaaaaattcacagcaaatttgacttggaattatcgaaacaaatatttggatggatttctcaagtcactggagaatcttttactgtcagtggcgaagtggaagaatatttgacgaccctcaaagatgggactggtttatgccagctcgaaaatgatctgtcgcccaattcgataaaaaaaataaacaccacgaattatccattcaaacagatggaaaacatttcattctttttgggttttgctgaaaaatatgtgaacaaaagtgaactgttccaaaccgttgatttattcgaaggacaagacccgaattctgtgctcatttgtctggttgcacttgctcaaaaatcggataaatcatttggaaagggggggcttggtcccatagaatgggagggatcgaacaacgaatggacgtgggaggcactgcgtgcccggtactctatccatctgcttgcaaatgggctcaacaaa

SEQ ID NO: 93345 - DNA, 434 bp, Heterodera glycines
  SCN-specific regions: Sequence locations=1-180,202-243,295-349,371 -396,421-434
tttttggtcaaaagtcggtcgaacacgacgtaccgtactgtgacagtaacaccgccgatgctggaggagtgggaacagaagaacatcgtgcgagcggcggaaagcattcgcgaaaaaatggggggcaaaggatatgccaaattggatgaggaattcatctgaacaaacggaggagaacagacacaccacagacacagtaaaacagaagctagtcaccactgaccgacaattatgtaattggtcaaataataattaattattcgttaatatttaaattatgtatatttttattttggttcatcgctattttaatcttaacatttgcttcattccttcttcctccattaattaatattttgctaaataatttctaattctgacaaacaaatgataaacaaacaattataaaaataaaaagggcgaggaacaaaccc

SEQ ID NO: 93346 - DNA, 282 bp, Heterodera glycines
  misc_feature (247)..(247): n is a, c, g, or t
  SCN-specific regions: Sequence locations=1-282
ttgtgttgcttgacgctgcacactctggtgaaaatccgcgcgtcgcgcattttctccgtttcgcagaccaacctttactggcaaaagtcgggctcttatttggcagcgcacactgaacgctaccacaaaatggtgaagaacaaagagggggaggtgaaatatacgggtaataattcgtacttggaaatattcgactgtacagacaaggaatatgcggtacagtccatccaattgcccgaacctttcntcaatttggcatgggagccaaaaggcaacaaattt

SEQ ID NO: 93347 - DNA, 330 bp, Heterodera glycines
  SCN-specific regions: Sequence locations=1-220,243-330
gatttatctaaaattttaatgtgtcggccgcccattgaaaatatttctgcaggtcgtcgttattccaaagtgatttggcgaagtttaaaacgacagaggccgtcggccgtgtgttttgacatggactcgacactaattaaagaagaaacattggatgcgtatagcagctttttcggcttggatttgggcggaagtgccatcactgaaaaagccatgggcggacaaattggctttagaaaagcactggcccttcgcttggaaatgcttaaggccaccaaagcccattccgaccattttttgaacaatttccccccacatttagcgattggg

SEQ ID NO: 93348 - DNA, 335 bp, Heterodera glycines
  SCN-specific regions: Sequence locations=1-80,102-335
tgaaaatgcaactctctgagctttctgttgcattcgtggccctgttcttgacttctgcgctaattgagatcaccgaagcgaatgcgccaaagcagaacagcggtaccgacaccaacgcggaaaaggaggaaaacgtttgccttttgaaaaaacacgaggggagcggcaatggacacatcagacgatggtggcatgacaaagcggacggcgaatgcaaggcattcttttacaaaggaagaggcgggaacggaaaccgtttcgtttctaaggctctttgcgagagaagatgcaataaatgagcaaaaggaagtgatgaggagcaacacagagaagag

SEQ ID NO: 93349 - DNA, 500 bp, Heterodera glycines
  SCN-specific regions: Sequence locations=1-270,292-500
ctgatgctgacaatgatgcggtcaatgaagaaggggaacttatggaatcattggagaacccgcaaggactctcttttttggctcaatcgccgcagttccaacagctccgagacatcgtacgtactgatccatcgatgctgccgcaaatcatccaacaaattgccgccgccaatccgcagttgatggaggcaatcagaaacaaccaaggcgcgtttttgcaaatgctcaacgagggacaaccattgggcggtgggaccgacgctggagccggtggagaagcggcggccggcgttcagcaggaagcggcgcaaagaagggtcagcattccagtgaatgcccaggacagattggcaatcacccggctcgtttcaatgggatttccggaagcgttggtggttgaagcttatttcgcctgcgacaaaaacgaggatttggctgtcaattacatcttggagaggatggatgagtctcagaatgaacgggcgggtgccgggcagcag

SEQ ID NO: 93350 - DNA, 187 bp, Heterodera glycines
  SCN-specific regions: Sequence locations=1-33,57-102,125-187
ataatccagatttgtttgtcgtgaattttgttaaaaaactgataaaaactatttaaggaatttttcattaactcatttataaaaatggaccgtttagacacaataatttcttctcttctgaactgtcccgcacgtaacttgtgcgaccgcttaaatcacccggatgagatacaaaaaaaaaaaaaaa

SEQ ID NO: 93351 - DNA, 408 bp, Heterodera glycines
  SCN-specific regions: Sequence locations=1-277,314-408
gctgcgaccttttcgcggtgaatgtgaacatttgctcgggcagttgctggtcactttctttcgtcgacccgcgccaatcgaagggcgccgaaagtgaagcgaatgccaacggaaatgaaccagcggtggccgtgttcgcccaatgctgccgaatggtcgaagcacaaatgctcaatgttagcattccatgcgaggatgggtcgaaaactgtgcagattccgtccgccacaaattgcagctgtttcgactgttcccgcaagcgccggaggcgataattagaaaaagaggagagaaagaaaggaatgcccagcagaaaaaggccaaatgcttctccttttcgtctgtttgtgtacaatcgtaaaaatggccaaacgatggccataaaatgataaataatgtatatttctc

SEQ ID NO: 93352 - DNA, 519 bp, Heterodera glycines
  SCN-specific regions: Sequence locations=1-519
cttgccaacacaaattaaaaagcatcatgttcaaagctgggctcaaattggcctttttgctcttcgcggcgcttttcccgtcagttcctgcattgagatgcgtgtccagcattgcacttacgtacatcaacaacatgaccggcggagtgatgatcgttgacctgagcaagccggttgaatgtgcgttcggttgtgcacgaggaacctgcagcatgaacttcggcggtgaattgaacagccattttgggcttggaattgtgcgcactctgggcgacgacggcgattacaaattgtggaactcgccgcttgcggttgtgagcggatgtgcggcggcaccgaaaaatgggacgacggcaccgaatgggacggcggcaccgaaaaatgggacgacggcaccgaatgggacggcggcaccgaaaaatgggacgacggcaccgaatgggacggcggcaccgaaaaatgggacggcgacggcattggggggcagcaacattttttttgggaacgcggcgacgatcg

SEQ ID NO: 93353 - DNA, 480 bp, Heterodera glycines
  SCN-specific regions: Sequence locations=1-373,397-480
ccgaaatgttctcagcttcgatgactactcacaatatcgcattattaccgtgcttctgcatcgtccgcagggaattaatgagggcgccgttggcttattattgcgcacgatggcagagagatcaaagccagcaaatgcgccgttttcaattttggttcatcaagtaacgggtgggtccattgcgagtaaaaatggccatttgatgcaaggtgaccgggtgttcttcatccaacatcagtcgacagtgaatatgtctgtcgccgaagcacgttctctggtaaaaagcccgtcgccagtaattcatttggtcgtcggtcgcggacgctttttgtgaattaatttgatgattttgaaaacactaattgtcgagaaagaaatctccacacttgcacatttattcttttctctttgattgtatttgttaaattctcatccatttatcttcattgttgatccttacaaatgataagaataacacat

SEQ ID NO: 93354 - DNA, 59 bp, Heterodera glycines; identical to SEQ ID NO: 52422
  SCN-specific regions: Sequence locations=1-59

SEQ ID NO: 93355 - DNA, 298 bp, Heterodera glycines
  SCN-specific regions: Sequence locations=1-298
gactacccatattgtggatatgcttacaatttctgaactttctgaacgttatcccgaccacaaattcatcggagaataaaatgtcttggcaggaaatacttacgaattgactgatgcaccgacatggattattgatccaattgatggtacgacaaattttgcacatcgcatcccattcctcggaatttgtgttggtcttgctatcaacaaatctctctgagctgggatcggtttcgtccaatcactgatgagctatacaccgcaattggagggaaacggcccttcaaaaatggctttc

SEQ ID NO: 93356 - DNA, 345 bp, Heterodera glycines
  SCN-specific regions: Sequence locations=1-20,48-345
aaagaacttggtgttgacacaaataaaaaaaaattaaataaattattcgccgcgaatttttctcatcggaattttaatttcgtcgacgcatttcaacagccaaccaattgtctgactctctccgttcccttcgcttcttctcccaatgtcccttttgctgttgtcggccacggccgagcatctgctggtgctgtccgccttcttcttcccgcccgctctgctcattgtgcttttggtcgtcgttttggccacttttggcaaatcgttgggcctccgcgagcgctatgtcagcattttgatccgaatttttgagtggggtgccggtgaaattcagagcaggcgcaa

SEQ ID NO: 93357 - DNA, 451 bp, Heterodera glycines
  SCN-specific regions: Sequence locations=1-451
gtggcctctgtctgggcaaaggtcagtgctttttcgttatgccaacgtgcccttcttctgagtttgtgcctttggcatgacttcgacgcttcgcggattctgcctttcccccgctgatcagcagacgaatcttttctcattttgcagtgaaatggcgacgaacgcatcacagaaaaggaaggagatctatcggtacaaagcgtcgttcaatgtttatgcgatgggatggtcaaccaaattgttttttttcctcaaatttcgcttggccatcggcagcttcatcgatgaataccaccacaaagtgtccattgggcacctgcaccaagaccaaggccaatttggccgtctcgggactttcgaccatgctaacacctcgacaaagcgctgagaagcccccaaccagaagacggctcttcaccactatatagctaccatcggcgactctatgcgc

SEQ ID NO: 93358 - DNA, 360 bp, Heterodera glycines
  misc_feature (29)..(29): n is a, c, g, or t
  misc_feature (54)..(54): n is a, c, g, or t
  misc_feature (67)..(67): n is a, c, g, or t
  misc_feature (108)..(108): n is a, c, g, or t
  misc_feature (126)..(127): n is a, c, g, or t
  misc_feature (138)..(138): n is a, c, g, or t
  misc_feature (145)..(145): n is a, c, g, or t
  misc_feature (164)..(166): n is a, c, g, or t
  misc_feature (168)..(171): n is a, c, g, or t
  misc_feature (174)..(174): n is a, c, g, or t
  misc_feature (176)..(188): n is a, c, g, or t
  misc_feature (214)..(215): n is a, c, g, or t
  misc_feature (220)..(220): n is a, c, g, or t
  misc_feature (224)..(226): n is a, c, g, or t
  misc_feature (229)..(235): n is a, c, g, or t
  misc_feature (237)..(238): n is a, c, g, or t
  misc_feature (240)..(243): n is a, c, g, or t
  misc_feature (249)..(249): n is a, c, g, or t
  misc_feature (254)..(255): n is a, c, g, or t
  misc_feature (261)..(263): n is a, c, g, or t
  misc_feature (265)..(265): n is a, c, g, or t
  misc_feature (267)..(282): n is a, c, g, or t
  misc_feature (291)..(294): n is a, c, g, or t
  misc_feature (301)..(302): n is a, c, g, or t
  misc_feature (306)..(309): n is a, c, g, or t
  misc_feature (313)..(315): n is a, c, g, or t
  misc_feature (324)..(325): n is a, c, g, or t
  misc_feature (328)..(332): n is a, c, g, or t
  misc_feature (336)..(336): n is a, c, g, or t
  misc_feature (338)..(340): n is a, c, g, or t
  misc_feature (344)..(345): n is a, c, g, or t
  SCN-specific regions: Sequence locations=1-86,108-117,164-196
atggtcgtggcgttaataatcctcgtccncactttggctaggcatcactttgcncgttgtttacccnacatttaactataattcaaattttgtttggttttttccccntactttcccttttttttnntttcccttttnttttccnttttctttttttttttttnnnannnnccncnnnnnnnnnnnnnctttttttcccccccccccccccccnnccccntccnnnctnnnnnnncnntnnnncccttntcccnntttttnnncncnnnnnnnnnnnnnnnnccccccccnnnnccccccnncccnnnncccnnnccccccccnncannnnncccncnnntccnnccccccccccccccc

SEQ ID NO: 93359 - DNA, 319 bp, Heterodera glycines
  misc_feature (145)..(145): n is a, c, g, or t
  SCN-specific regions: Sequence locations=1-37,112-115,145-319
cattgttctcgggattgcctcggtgcgctctctgttggctatcatcgccacagtcgtcactctgccatctctgtactcggagatgagccaaatgaacagcaaagtgcgcgatggagttgaggccttccgcgtcaacaccgactcngcctgaactgacttgatggacgcgcaagtggtcttgaccacgccgtccaacccccgtgataaccccctcgactccttttttttttgccaagcgtcaactgtccgcacactgccaacgcgtctttccaccaccctccaccatcatcccccacggtccctctctccccacaccccc

SEQ ID NO: 93360 - DNA, 512 bp, Heterodera glycines
  SCN-specific regions: Sequence locations=1-337,365-512
aaatggcttccactcatgaaaaacggacagattctcggcttgtttttgtgccattcgtcaccttcgccgaccctcttttttggaatgagattaaccgactgaaagtggaccattggaaattggacgagtcacttaagccaatttatgccacaacaacttttcagggtgcccagccttctgatgggctcctctccttcgaccaattttccatcgctgccgaaagtggccaaactttgccgcttcaatctgtccaaccgtttgtctctccattccatggcacttttcttttgctaaacacaaaaaaagcattttccgatggttttgatcgaaagaaatttttggaacagtcagctgattcgttatggaaagtcatcgaatcaaagaaatggttgacggaagcgcaactgctcaactcatttctgttaaccgcttgagctgacgtgaagaatttcacatattgtttttggaattgcgtgcccgcacggcttttgccggacaagcttcgtgagaat

SEQ ID NO: 93361 - DNA, 553 bp, Heterodera glycines
  SCN-specific regions: Sequence locations=1-78,100-286,308-364,400 -500,545-553
gtccaattaagtaaattaaaacaagaatagccaattagtcttaaaatggaactacaaaagaagcgcaatgtctgataatgaggacgaattaacggggattcagcggagacggcgactaacagagggaacggacgagaaaagccgattcagaccccctttaactccgtccaattcgcttttgcttcgctctccgcccgtcattatgatcaccagcccatcgcttcccaacagcagggaagaacatttggcagagcagcaggtgccgtcttccaatgggaacggaacttcctcttccgcctcgtcctctgccggcaccacacgtgtcaatcatccgccgcaaccgttccccgtgccattgcagcggcgccgctcctcctgctcctcctccgtcagctctccgctgggcagtgccgcctttcatccgcgctattccaccccgcggctgtccatcacttcgcttggctctgttgccaaaactttccgcaacattgctgcttttattgtgcctgaggaggagggtgagcgcgagagggcacgcgatcggctgcgtaag

SEQ ID NO: 93362 - DNA, 411 bp, Heterodera glycines
  SCN-specific regions: Sequence locations=1-411
gccaaatgtttgttgcacggtcccagtgttgtgcgcctgttaccacacagtctaaagattagtcgctcttttgcggtcccttggaggcaatttttcgacaaattaaaagcggacagaatcaatgcgcaagtgaagcataagccgttggacgatgaccacaagcggtacgcggacgacgaatggcattggatgccgacgggcgaaagcgacattcaaaaccaagcaaccgtcacatttctctcgcgtatattgaagaaagagaaattggttgccatcaaaacgatcagcaaattcggctttcgtacccatgaaaatgcctatttgcttggtccaattgcggtctttccgaggaccgttctgtcctggcgtgtgccaatgccggccgacataacgcccgagtcgctggagttg

SEQ ID NO: 93363 - DNA, 593 bp, Heterodera glycines
  SCN-specific regions: Sequence locations=1-13,35-56,131-134,193-593
ctaaaatgcaagagactcacattgttctcgggattgcctcggtgtgctctctgttggctatcatcgccacagtcgtcactctgccatctctgtactcggagatgagccaaatgaacagcaaagtgcgcgatggagttgaggccttccgcgtcaacaccgactcggcctggactgacttgatggacgtgcaagtggtcgtgacgccgccgtcgaagccccgtgataaccccttcaactccatctttttttttaaacgtcacctgcccggacactgccagtgcgctgtgttccaacaaccaaccagtgcccccggggccgcacccaaacaacccgaataacctggacacccctaaacccccccacccacacgaccgaccccccccatgccctctccgaccccccggagtgcccggcacgctcgcgcgcggtctaactccacctccaagcacatcccccaactgtacccgccacacagacgcgtagcgtccgccccctctgtagcgccagaccaacccccccccccgcgcggtaatggttatactcgtatcccaccacctctgccccctcgcgtatcgcccgcggcgcgagcggca

SEQ ID NO: 93364 - DNA, 280 bp, Heterodera glycines
  SCN-specific regions: Sequence locations=1-56,79-226,249-280
tcgttggaacaaagtgaaacaatggcttttgtgctgaagcgactgatcggttatctggccatttggctgatctgcttcatcaatctcttctctttgcaaaaaatcgccgcccgtttccaagtgattttaacggtgcttaaactgctggtaattgcgctgattattttgacgggactttatcagaacagatcatctttcgcggcagaacggagaatttccgcgacacttttgtttttacaaagacagaagcgtgcgaaattgtgctggcattgtttgccag

SEQ ID NO: 93365 - DNA, 487 bp, Heterodera glycines
  SCN-specific regions: Sequence locations=42-338,365-434,456-462,485 -487
gccatctctgtactcggagatgagccaaatgaacagcaaagcgcgcgaccgacttgagggcttccgagaccacagcgactatgactggactgacttgatggacgggcaaccgggaccaacgccgcccgcaaacccccatgatagccccgcccgctgttttttttttgccaaacgccaactgaccgcacgccgacactgccttctcgcccacccagcaaggtgacgccccggagcgcccggccagtggtcatcttaatttcccccgtccccccggtgggatatccgccccccccacccgacgacacacccacccggtcgaagcgccccagacggcccggacaacacccacaccaccacccccgctacgccgcgccacaagagcgaccccgccagttggacccgcgcctgagcaccacgccggccgagaagaaaaaacccacaggcccccaaccccgcccacctggggcgccccgcgagcgccgcccgg

SEQ ID NO: 93366 - DNA, 365 bp, Heterodera glycines
  SCN-specific regions: Sequence locations=1-365
atgagcagccatctccgagtcgccactcaataattgtcctgtaaaagtgctgccgagttttactagcacatttctgcctgatttatcaaatgcgcaagtgttgaagccaaagcccaccaatgttgatcgtcttcctttatcaaatgaagaatttataactccaactcagccaaaaaagcagcaaagtcgtcctttttccccagcaaatggcgtatccaaattgatacttccgagaagccgagtcgcttcaatacgtcgtgagtcggattgcaattcagagaaaggatttggtgaggcggaagcggcacaccaaaaaatggtaaaatcggcacagcaagtcgcgatgggttttgaggatttttgcc

SEQ ID NO: 93367 - DNA, 528 bp, Heterodera glycines
  SCN-specific regions: Sequence locations=1-394,416-528
gaagaccaaaagtgaaaaggaccgacacgagcatcgcacaacggaggaacagttgcgaacgcgactgctcaattcggacggacagtgcacggaattgcgccacaaattgcgcgctgtggaacaacaaaatgacaatttggagcggagagaaagaattcacacgcaacagttgatcgatctgagtgaacgctatgaccactgtttggagcgctgtgccatgctcgaggcggggatggccgtgccgcaggcgctgcccttggcggtgaatggcggaggcatcaacggcgtgatggttcagcaaattgactgtgccgacaatcagccaatggacttcgcgtcctccagcgtcaacaatatcgtggacaatccgtcatcgacgacagacacatcgcccgaggggccggcgatgcgcgagagagtgcgacagacactgaacgggagaccgacgcaacgactgatcgagcaaatgctgcgcaaagtggaggctgccgaagctcatttgaacatcagcagcttttcctcttcctc

SEQ ID NO: 93368 - DNA, 524 bp, Heterodera glycines
  misc_feature (447)..(447): n is a, c, g, or t
  SCN-specific regions: Sequence locations=1-524
caagtttgagcaaaaagggaaattgtttttttgctttgtttaccaattgttctgatgacaacgcttgatgcgaagatgagcagttcgagctccgttttgcaagacttgctcagagatcacagttccgaaattggcaattggagtgaaattgtcaacaaccatcaggatgagagttcgaaacctgagccatttaccaacattgaccacaacggaccattctacatttttgtgcccaatttaacgcttgactatgccgtggacagtgtgaacatggaagtctacaaaatgtttggtggacataaaaatcttttcgctgtctacgcctatcggttggcgaagaaagtgtcgcaatcattcatgctgatggcacgggacttcgaaagctgtgttcaagtgttgaagatggaggagaagattgtcaatagcagcagcaaagaggttgtccgncttgagtacgtgttgccgtccgtcgccccgccaaaaacgtttcattacaccactgaacaggtggacaaccaattgca

SEQ ID NO: 93369 - DNA, 479 bp, Heterodera glycines
  SCN-specific regions: Sequence locations=1-313,335-479
taagatcagagatggcagcggttgatcaacaccagcaacaactcgttgaacgcattaaacagcttgacaccctttcaacaacggcggatgaacaatttgacaattctttaaatgtgccaattggcgatttgtgtcgtttgctgttggccgcgctggcgggcgacgaattggccgcgggggaggcaaaaaaaatctgtcctccctcgtccccttttgccaatgccatcggttcgcttgccgttggctgtctccgggacggcattggcccggacggattggccatggaaattcagcaattaaattccgcctcgactgggaaaggcaatgaaatgcgcaatgcatttttggaggcttataggtccaattttgatcaattgaaaatggcattggccaaatcgaccggtacatttgcctccggtggcagtgcttatccaaaagtggttggcatggactggagcattttgagcgtcattgaatcg

SEQ ID NO: 93370 - DNA, 205 bp, Heterodera glycines
  SCN-specific regions: Sequence locations=1-205
agtcgccgatttgggagagattgaggacgatgcggcgcttaaatcgtcctcaatcgcggctgagcacatcgatcacggtattttcggcaatgtcatccaatcgtcgaaggacgcggcttatttggcccgtcacatcggcctccgagttggcgttcccgaccatgtgcctgccgctactgctaacaagatttgcggctcgggtttt

SEQ ID NO: 93371 - DNA, 430 bp, Heterodera glycines
  SCN-specific regions: Sequence locations=1-8,31-298,321-430
gcaggggttttttggattttcaaaacaaaaagccccgccccccattctcgttgaggcaataacaattattgttgctcggggaaattctgtcaaaaaaaaaataaaaaattgggagggtgattgggaaaatttgcgtgtccccctcaaaaagatgaaagagggcccagcaaaaaatttggccccgaaaagggttttcaaatttatgaagcaaaaaggtttttttgaaaatcaaggcaaccacctccccgcgcattctttaattatggagcaaacaattttcgaatttgggggtatgaaaaacccccaggggcccgcccccaaaagaaaagaggttctcacttcgatgacgcgggaacacaaaagtgcggattttgcgaggaccgatcctctcgaggatgaaatgaaaaaattgctccagatgatttctcaa

SEQ ID NO: 93372 - DNA, 479 bp, Heterodera glycines
  SCN-specific regions: Sequence locations=1-113,135-171,194-479
acttgatctcgtcgctggtttccggattattgaccattggtgaccgttttggcggtgctttggacggggccgcgaagagtttcagtgaagcaatggacacgggactgagtgccatgcaatttgtgaatgagcagaagcggctgggcaaactcattccggggattgggcacagagtaaaatcgataaacaacccggacaaaagagtggaaatactgaaagagatagcgaagaacaagaccttcttctagcaggagacgcctctttttgactacgcactcaaagtggagcaaatcacaacttcgaaaaagcccaacttaattttgaacgtcgatggggcaattgcgacaattttcgtggacattcttcgccattcgggaatgttcacgccgcaagaggcgcgggagaccattgagattgggtctctgaatggactgttcgtgctcggccgcagtgtgggattcatcggccattatttggac

SEQ ID NO: 93373 - DNA, 355 bp, Heterodera glycines
  SCN-specific regions: Sequence locations=1-216,252-333
gccttgccggacaccgtttcaacgcgttcaaaattacgccgaggaacaggcggagctcaacgacggagtagcgcgcctcacgaatggtggaccgattttgggaggagttgtagttgatctggttttcagtgatctgcgaagatggagaagcgttgcgattgatcggaagggccaacaaatgggtctgaaaggccaaaatatattattctttggaagaaatttttatatatttataaaattaatataaaaaactttgatttgatggaatttcaaaaaaagaacccataaaaagccatggaaataatgatgtttcaacctgagaagagaagtgccgagtgccaacatgaagactgta

SEQ ID NO: 93374 - DNA, 578 bp, Heterodera glycines
  SCN-specific regions: Sequence locations=1-22,44-65,142-143,202-578
gtttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcatcctttcttccgtgccaaacgtcaactgcccggacactgtcattgcgctggcctccaacaggcaagctgtccccctgcgcccccccgggccgtcagtattgccgggactgtcctcgaccccccgaaacccccccacacttatccgccgtccggccccccctcgccatcccccccccgcttccccctttccggtggtaccccccggtctgtcccccccgcgtacgcgccacccacaccctatatgtaacgacccgcccccgaccgacgacctccgcgggtcccccgttttgtgtcaggccgccccgccatagcccccccgcgtacaaccccccccc

SEQ ID NO: 93375 - DNA, 280 bp, Heterodera glycines
  SCN-specific regions: Sequence locations=1-280
ttggtattttcattttcctccatttttctccatgccaaccacagcctcttctactcttgacaaacaactaaaagcttgcggaagacttttgctcgattattgccaagcaaatcttatttacaccactgatttggacgaaatttcaaagtcggatttattcaacaatcgtcgactgaatagacatttggatctgtcttgttttccgggagtgttctactttctcgaacttcacaaacacgttgagtgcaacgataaggacaagacccgctgcgacatttat

SEQ ID NO: 93376 - DNA, 283 bp, Heterodera glycines
  SCN-specific regions: Sequence locations=1-149,171-232,279-283
gttttgaagacaaatatcattcataagacggtttctcgcatggtcaaagtccgtttgtatttggccttcaaatctccgcacaacttgagaggcttggcattcatcacggacccggacgcctattggattgagattttcaatccaaacaacatgtgaaaaacgaacccaaaagattgagaattggattttcccattggcgaagcaatcaatttcgaaaaatcacaatagagcctttttattatttatttttttatttttataatcgaataaatatttatgactt

SEQ ID NO: 93377 - DNA, 279 bp, Heterodera glycines
  SCN-specific regions: Sequence locations=1-279
gagtaaatttaaaatctatgttcatcgctgtacatgccggtgccggctttttcgccgaatctgctgaaaaaaattgctcagaagcgctgaagcatgccgtcgacatcaacaatcgcccaaccgacaatgggaagcaatcggaaattggccttggcggtgacggcattacttactctggggctgctggtgattgtccccttgttgctgctgtcatgtttctggagcgttgcccggcgctcaactgcggtctcggctcaaatctgaccgttgccggctcgg

SEQ ID NO: 93378 - DNA, 91 bp, Heterodera glycines
  SCN-specific regions: Sequence locations=1-91
tcaaaatgcaccataataatcgcatttataagtttataatgaatatcttcaatgtttagtatcacttatcgttgtcctaaactttgactga

SEQ ID NO: 93379 - DNA, 289 bp, Heterodera glycines
  SCN-specific regions: Sequence locations=1-31,56-84,108-132,154-289
ctcctcaacaaatttatcctaaagacataaatattgtataacacaaaacaaataaaagttgatcattacaataatatgggctcaaattcgttctccaactccgcaattcaattagatcgatcagttctcaacaattgattcattcattcacttctgctgttgatcacttgggccgggaatttcgtcgagaagcccatcgtttttgtcatccacaaaaataggacaaatgctaattcgattccattgaccataactagggagtccaattatatgcacatgcatatttttt

SEQ ID NO: 93380 - DNA, 253 bp, Heterodera glycines
  SCN-specific regions: Sequence locations=1-38,65-179,209-253
atttaaatttcaataatggaccaacttatcagtgggcttctcggaggtggcggcggaggaggagcaaattctggtgataatcagccgcagcagggcggcggaggcagtggcaatcagttggcagatatggccggggaattaatcggaggatttcttggcggtggcgggggaggaagcggcgccttgggaggaggcgcaggcggcggggacattctgtccacgctggtcaacgcggccaaaggctttttttttt

SEQ ID NO: 93381 - DNA, 475 bp, Heterodera glycines
  SCN-specific regions: Sequence locations=1-475
cggatttcaaaatgcaagcgccagattggggcaactacgacaccaacggaaccgactacgactacatctacaacaactcggacgaacgggacaactggaacagcgagcaggccggcgtgttcagacatttagtgacccagctcggcaccactcagactctgcagaatttggcgctgcccaccttcgtgctggaacgacgctctctcctcgaaatgtacgccgacttcttcgctcatcctgatgaactgatcgccggcgcctacgagaatacggctgagaaacgattccttgccgtcctcaaatactacttgaactccttctatcctgcacgcaaaaccgacgccgcgaagaagccgtacaatccgatcctgggcgaagtgttccgttgccgttggaccctgcctgacgtgccgttgtccgcaagccgaaccgccggtggaccgttcccgggctcagcaaccaaccagatgacgtt

SEQ ID NO: 93382 - DNA, 238 bp, Heterodera glycines
  SCN-specific regions: Sequence locations=1-238
gttcaaaatgccaaagtattctctgccctttccttgccgtcatgaatgaactgctcgccatcgtgctcattgtgctgttgtgctgcgcgatgtttttcgcgtggcttttcgccttggcaacttgcccagatcgtttggtcaacctgatcagtggaacaaagtccagttcgtcgcccatttcccgcgccagcgaagacaacggcactcgcaagggctcctcccggtggcgcttcggagg

SEQ ID NO: 93383 - DNA, 254 bp, Heterodera glycines
  SCN-specific regions: Sequence locations=1-254
cacaattttaaatccatggcaacatcggctaaccatcggccaatcttcgaatttattgtcgaattgggcattcgtctccaggccgattcgctgaccgtcgcctttgcctcggtgtattgccatcgcgtgttgcgccaaaaggcttttccgggcgaccaaatttgtccctttacaatggcttccgcctgtgttttggtggccggcaaagtgacgaacgacgcgcgcattaacacgcgcgacgtgatgaacatggc

SEQ ID NO: 93384 - DNA, 471 bp, Heterodera glycines
  SCN-specific regions: Sequence locations=1-471
ccgtgttgagctacgagcccgagctcgccgtgttggccgcgtcggcgtacttgtcggacgtgatttacgcgattcgcgcaagcgaggccgccctcatgaagaagcgcaagggccccgcggtcacaagcaaggccgccaccattttggtggccacaacgtatccggcatggcaagaggagctgcttgacgtgattcgccaagtgtacaaggggacgggcaacgattggaagggtaaagatctcgcggcgctcaaggccgccgggttgctcaagaacaagaaggccatgccgtttgtcaacgagatcaagaagcagttggccatcgtgggtgaggaggcgttcaaccggaccttggcgtttgatgaggagcaggtcgtcagggagaacttgttggtgattcaaaggagggtgggctttgacttgattcgtggtcgagttgacgaccgagccaggggtggagtgatgaggaggg

SEQ ID NO: 93385 - DNA, 651 bp, Heterodera glycines
  SCN-specific regions: Sequence locations=1-651
atttggacggacactctgcaggccggattcatctacggagggttagccgttatcattgtgcgcggcacggcacaagctggcggattgacaaatgttttggcgattaatcagcggacggggcgactttggtccgcatttcgtgtgcacccgtcactgctgcagtacaacaacctgtgggtggcaatgtttggtggcattttgcaatggacgtgcatttacgggctcaatcagatggccatgcaaaggtactgctccatgccgtcccttcgccatgcccgcgtcgtcctctctctgaccatgccggccaacttgctgatccaattgatgatcggctacatcggcctgctaatggccgcttactttgaccagtgcaatccgcttgcgctgggcgaagttgaaacggtggaccaagtgaccattctgatggcttcgcgcattttcgaaggagtgcccgggttgccaggactgtttttggccaccattttcagcgcgactttgtccaccgcaagttccggcatcaattcccttacagctattttatgggaagactttctcaaagtgccgttaaaagatctgtcggatgcccacaaaagttgcgcaatgaaaggcatttcggtctttttcggggctttggccacagtgatggctttt

SEQ ID NO: 93386 - DNA, 605 bp, Heterodera glycines
  SCN-specific regions: Sequence locations=1-605
tgtacgcgcgcgacatctctcccgtccatgtggagtgggcgtacgaaagcggcaccgacgctttgcgaggcgacaccgcaatgttggaacgcgtgaaccgcttgcagatgacgacgccccacaacagccaacaaagccgtgcctcgccgacgcgcacttcgtcggcacagagtgtcaacggcggcgtcgctccctcccgcccatcttcgcccgttgctgctgaaaaaacagtggcgccaaagcgaaagaagcgacggaaggcacagtcaccgaaaattcagctggtcagctacgcgacgagcggaaccagcagcgatgaggacgaagcggagacgagcagcagcaacggaggaggacggagaaacggaggccgaaacggatgagacggacgcggaagaaaggcggaaggggaaggaaatgcagagccaacccatgaccattttctatgtgtatgaagaattgataatgcattttttaattgtccaaaatgtatgcgatctcttgtcctccattgttgatttttttaaagtttagacattgcattttaatcggcatttgattgttgttactgttgagaatttatgcattaaattttttttattgtt

SEQ ID NO: 93387 - DNA, 526 bp, Heterodera glycines
  SCN-specific regions: Sequence locations=1-526
cgcagcgaaaaatttgtttgattcccatctccgcccatggcacaaatcccgccactgcgcacatgtccaatttccgagtggtcccagtggagtcggacaaacacgggaacatcaattacaaggacctctcagcaaagtgtgaaaagcacggggcggagttggcatgtgcgatgatcacttatccgtcaactcatggagtgttcgagtccaacattttggatgtgtgccagaaagtgcatgagtttggaggtcaaatttacttggacggtgccaatttcaatgcccaagtcggcctttgtcggcctggcgattacggaagcgatgtgtcgcacttcaacctccacaaaactttctgcattccccacggggggaggtgggcccggcatgggcccaatcggagtaaaagctcacttggccccctttctgcccggccacccaattgtgccgatcaaaggcaatcgttccggcgctgtggccgcttcgccgtggggttcaagcagcattttgtccatcacttggacataca

SEQ ID NO: 93388 - DNA, 661 bp, Heterodera glycines
  SCN-specific regions: Sequence locations=1-251,273-521,543-661
ggtacttcttcatcacttcgacatggaacatattcgcactaattgagacgtagctaattatctgtactgctgactccattaagatgccagatgcgctcgaattatgctgatacttgcagacaccgattcattcttccgcgatgcgaatcttctcgatcctacaacgcataccaaaatcgagggaaaggttgattactgcacagatattgctacacatttaagactacgctgagtgcgattgctgtggcaccatttgttttgccgtcagtgctggtccaattacttgtcgtgcaagattctcggcgagggtcgaccttatgtcacttgtcctgaacttcgatgtactattgttgcggatgatgaatttgtgctcaaaaatgtcgacaataaacaagcgttgcgttcctatcacaaattggtcctcaactcttttgtggagtgtaacaccttgattaaatggtgccccgctcccgaatgtggtcgtgctgtcaaagtacctcattcagaaccgcgcaaaattctttgcaaatgtgggtgccttttttgcttcagctgcagccagcaatggcacgagccaataaattgtgaccttctcaagaagtggcagaagaaatgcatcgacgacagtgaaacatcgaattggttgagtgccaacaccaag

SEQ ID NO: 93389 - DNA, 574 bp, Heterodera glycines
  SCN-specific regions: Sequence locations=1-541,563-574
caaaaatctcaaataactttcgcgcccgtttcctcttacactcttcggaaacaaaaaagacccatcagtcgttcaactgaagagccgccacccgttcttacaaagggttcagaaaccgaatttgacaactgtgaggagccaccgccgccgttgttggaggcagaaacagcaacagacggagatggatcggagcatgactttgtccagaatggttcgattaaatcagtaagagatctctccgtgattatgacatcagctgcagaaattggtagggcagcggaagacagtgccgccggctgtgaccctccagcggaaccctttattttggagagcaggcatttgccttcatggttccgaaattgccctggatgtcatcccgatcaaaattccgaacttctgtttcgtggacgaatcgctggtgggcctcagtctggccctattgtctcaatcgaatgcgcattttgtggttcccgatttataacagcgattgtcactgggaacggcgaccgacgagggctgaaagtgtagaaaagaagagcacaaaaggctcacaatcagcctgtgatttgactga

SEQ ID NO: 93390 - DNA, 641 bp, Heterodera glycines
  SCN-specific regions: Sequence locations=1-641
cctcgtgccgcggtcaccatgtccaaccgccagcacaccaacgttttggagctgttctttcgccgaccccaccaccttcggcttatccgtccgctggtgtcgtcatctcttccaaagtcccgccattctttcgcagtgttccgcccgcttccccctttgtttgtcccgcacctccttcggttgttctctctcaaccgcccccgatgggctctccactgccccaacgggcgcagctgagccgtgcgcagttgctgagcaggcacagccgagacgtggaggcacgcaaattcgcggtcaaactgtaccacttgcagcggacaatcaaagcacttgtctataaaaatggtgcattagcggacgaattggcacgactcaatcagcgtattaacacagtgacaacggagcgaaagatgttggccaagcgcttgcagcaccacgaaagaaaccgaattcgacgcattcaatcgcagtatcggaaggcaattgcggcagctaacaataagcagcagtcgaatgctgtagaagcgctgttggacgaattcggcggtgaggggagaaatgtcgcacaaccgaagaaaagttgacattataagtaatcggaggatcgagaaaacgcgtgctttcatattcctttttcttaa

SEQ ID NO: 93391 - DNA, 549 bp, Heterodera glycines
  SCN-specific regions: Sequence locations=1-367,389-549
tcacatttctcctactatgtcctccactgtccttcaaaatgctctccgcctgttgttcattactctgatcgttttcaactgttgccatggtgcgccgcgcgttaagctcaggaaaccaaccgaggagaagacttcgacaaatgaaattgctggcctcagtgtcaagttatggatcatcattggtgtctcagttttgctcgccctcgttgttgtgtgtgccattgttgtgatttgctgtttgtgccgtttaacgccgtttcggccacgacaacgatgagctttcgacagcagtgtcaagcagttactacaaatcgcggcagggaccaacggattcgagggactggccgccgacctcagcttctgggcatggccatggtcgtggaggacgaagcggtggtggtgcgatcacggcggtgccaagcggaatgatgtccaagatgccaacaatgaagacgaagcagccgttctcatttcgaatgctgatgccgaaaagcttacgctcaattggaccatcacgaccagcgccatcaacagcaacaatggaacgag

SEQ ID NO: 93392 - DNA, 630 bp, Heterodera glycines
  SCN-specific regions: Sequence locations=1-67,96-135,158-523,547-630
agacgttccgtttgctgtacgatgtgaagggacggtttgtcatccaccgaatccaaagtcgtgaaggccagtacaaactgtgcaaggtgaagaagcaggcggtcggtgacaagcaagtggcgtacgacgcgcgcaccattcgctacccgacccacacatcaaggcggacgacaccgtggtgattgacattggcactggcaaagtgacggactacgtgaagtttgatgctggcaacatttgcatgatctgtggtggacacaacattggccgtgtgggcattgtcggacatcgcgagcgtcacccgggttcctttgacattgtgcacatcaaagactctgctggccatggccattcatttgccacacggtgtggaattatttcaccgatctgttcgactattttccgctgactgcgttggtggacggccaaattttctgtcttcacggcggtctgtcgccgtccatcgactcgttggaccacattcgatcattggaacgtcttcgggaagtgccacaatggaggcccaatgtgcgatttgctgtggtccgacccggacgatcgtggcggttggggcatttcgccgcgtggtgccggttacattctgttgaaagggctggatttggtgcgtga

SEQ ID NO: 93393 - DNA, 601 bp, Heterodera glycines
  SCN-specific regions: Sequence locations=1-294,316-601
attaattcctgcgtattattgcggctgctgttctctgtccgtgccatcatcaaatcaaatcaacgaaagctgagccatcggaagtgtgcacaaatcgactaccaaacgaaactgggcaccacaaatcaacaaaatcatcatcagcagtaaaagtggtgcagaaggaaacgcatggaccaaatcggcggcactttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcgtcggattcaacggcacattcaacatttggtatttggacgcagaagtgatcaatttcctgcaacgatttcggcgcctcttcaacacgtacatctcgctgaagttcaccattccgataacagaatttcgcgcttggcaagccgtggcacgtcacattt

SEQ ID NO: 93394 - DNA, 324 bp, Heterodera glycines
  SCN-specific regions: Sequence locations=1-69,97-300,322-324
cttttctgtgttcattgcatggttttaatacacacatatttgtagaattcatttcctaatgaccaaaagttgttgtgtctgtctgtccttttctttcttctgactcacggaatttaactgtgacattggtttatatgcttggattgcactttctttttccgtcttaattaatgttaagaattccattttcttttattgtccgttttcttaatttaaaagcttaagcatcttctgacagtgagcactttttgaagtttaagcaatgtctggtcgttaatttaattttcactttctgtccgcttcaataaataaaacaaaatttgc

SEQ ID NO: 93395 - DNA, 477 bp, Heterodera glycines
  SCN-specific regions: Sequence locations=1-107,129-134,159-385,407-477
ccatttttcattgatgttctcctttcacccgatgacaacttcagcagggcatctgagtgaccccgcgggcgctgtcccccgtcgtaaaatggtgccgtctttgggtgccgttgtgccccctcccccggagggttctccctcctcctcctcgtccccgtcgtttgcccatccgaatcagttaatgcaacgcacagacggcacttctcccgtaggaggcgatatgtccacgggcaccttttcccaccttcaacctttttttgccgcgttggcccgaaatttggccaatgtttcgccacaacagcagcagacgaaccaaagccaacggtgtcaagcgccgaactcagtgccatcaaattcaaataataacgtggcactttctccgtcgccttttccctttgcttttcccggcacatttttggcacgacagcaaaatgcgaaggagcagcaaaaacagcagcaaaattcgccaccaattgg

SEQ ID NO: 93396 - DNA, 645 bp, Heterodera glycines
  SCN-specific regions: Sequence locations=1-645
attttattaacatttatgttattttaataccattattgtttgccccagtcattttaaaaaaccatcctcatttagcactcctctcgcaatgtgttcgcctattttgtctcttccgacacctctcagcctgccattttcttccgggaccctcacgttgaggacgatcttcgctacaacggaccattggacaacttggactctgtcaaaaaatggctcactgacaaatgcgtgccattggtgcgcgagatcacttttgataatgcggaggagctcaccgaggagggcattcctttcctcattttatttcgaattccgggcgatttgcaagcggagcgaacattcactgacattgtcacaaccgaattggaagaccaaaaaaatgctgtcaattttctgatggctgatggaaaaaaattcgcccatccgttgcatcatttgggcaaatccgagcgcgacttgccactcatagccatcgactccttccgtcatatgtatttgttccctgacatgaaacagttcggcgtcaaaggtcatcttcgtcagtttgttcttgacatgcattcgggaaaactccatcgtgagttccaccagtggcccgaccccacggaacagcccgcaccgaccaccacccaaccgccggcctca

SEQ ID NO: 93397 - DNA, 458 bp, Heterodera glycines
  SCN-specific regions: Sequence locations=1-10,32-458
gccgtagaaaaggaggaggaggagtacggtagcaaacagctgatcccttgtgctccgtacgctcgtctgttgctcttcggcacgccctctgccattcaaagtgcgcaattggctcagctccgtgcgctcgtccccggcgcgcaactggccgtggccaactgtcggcctggcctggacacggacgaagcggtggaggaggaaattgttgccctgggggctagccatctggtatttgtccatggggcagacggagaaacgcgcgacgcgtgggaagcgggcggaccggcgaatttgcgggagaatgtgcgcgtcaacctgttcagcccgtggcttctctccaacatttgtgaccgttttggcattgtgttcatcgaatttgatggggagggcaaaaactgttgcaattcgaatgggaaagtgccgacaaatgctgacgctttacaaatgagtcgctacac

SEQ ID NO: 93398 - DNA, 616 bp, Heterodera glycines
  SCN-specific regions: Sequence locations=1-492,514-616
attattattttcggaatggcacccgtcaaaaaaaggaaaaaactttcctcaaccgaccagcgccccatttctgcaactgttacaaatcaacagaaaccgttgggctcatttgtgacatttggaaaacggcgaagtctccgcgtggccatgaaaacgaagagtcgacgttggctgtgcaacgacatttggatggacattttgccactttttcgtcgtcctcaactcggccgcaaattggcacttctttcgccacgtttcaacgcgttggtcgacaaacatttcgacagcaaaaacgaactgacaattttgaaacaaatcagaattgccaggaatggaacaaaacttctgtctgtggttacgaagagcaatccgttgcccaacaaaatccgctttgacaaccttcgaattgagtacattgaccactccgtcatcgaatttcttcgttcaaacaagcaaatttttgcgaaaggcaccaacatggatttatatttggattttgatgatgtgtatgacaacaacggcattgtccagccaatttggagtgtttttgcacgcgaattttggcccatttttgcgccaaacattcgccatttgactgttcccattggccatcaac

SEQ ID NO: 93399 - DNA, 645 bp, Heterodera glycines
  SCN-specific regions: Sequence locations=1-201,223-231,269-331,353 -545,567-645
attgtcctttcttaccaaagctcgctttctcatgctctgttgccgaagtgaagggcgaacaaggcgaaaggacggtaattgccattaattaccatttaattgtgcccattttttgggtttttgttttacagcgtgaactgggcgaacttcgcgagattggacaacagttggaacaattagccaacattttgcactcacccgaagttcttcctctgggattttatctctgatcattccattcattcattgtctttcttccctctttttcaggacattttgctttccctcgaggcgctgttaagactttgtcagactccggtggttgctgctggcattttgcactatttaaagacgcttttgcttagggaggaccttttggctgagccgagttccctccactttgcgctcattgaccaaattgcgcgtgttcaccccaatttgcactcgagagtgttcaatttgctttgcgatctctacgatcaccagtcgaaccgcaacgaagtggccgaagtagtcatggaaaggcaacggcacgtcgtggagagatttgtgcatttgctgtgctgtgggatggcaatttccgttgtggagaaaatcatcgccatgttcaaagcgggacacatcgacatttcgttggtcaggtat

SEQ ID NO: 93400 - DNA, 586 bp, Heterodera glycines
  SCN-specific regions: Sequence locations=1-250,274-388,410-586
attttgagcggattggtttatgacggggattcactgctgcgcattggcaatggcatttgtgccagcactttcccaatcgagcggaaaccttcgggaggacacgcggctgacaattccacggtctctgcttttgttacggtggcatttcaccgcgacgacgacattaagcgaagttcggccgaatgtccgctgctttggtttggccacagattggccaccatcgcccaagggcatgcccaattccattccctttggcactttccccttttctcggctcacccaaatcccagcgaatccctgcgggaaacattggacacaatcaatcgactgggccaaaacgaaccacaaaaaagcgacaagacaaagccgagaagcgatcagcaacttttgtcaattgaagaagtactgcaaaaagtggacgcaaaaaaactgagggaaatgcgcgaaaaattcattaaaatgccaatggaagagaaagaaagcggaaaaccatcaaaatgatctgtgtacttaaaacaccggaaaatccaaaacattacgaaaactttaagagtgtacactatcaaagagctatttgtaagagaaa

SEQ ID NO: 93401 - DNA, 447 bp, Heterodera glycines
  SCN-specific regions: Sequence locations=1-375,397-447
atttattttaagattcaaaataaaatggtcatcgacggactgcgcgactgtctcctgcaagtactccgcgattatgcgcttcgcgtcggactgttggagcattcgaattccgtcgcttcgtctgacacttttgcgctgtttcagcgacggctgaggccggagcctttcgttgctggcacccatggaatggtcaccgagctgagatgcgagatttgcttcgatccattagtcagtccttccgcctctgccccggtcggagatgttcgtttgttggtcaacggaagtgcggtccacgagaaatgccatggacaaaagcaaatgccaaacgcaaaagcactttacgaggaaaggagaaatgagtgaggcaaagactggagaaaaaagaaaagcgaagaaaacaaatcaaacgggtttattatcagtcatcaccaaacatatcacttatat

SEQ ID NO: 93402 - DNA, 653 bp, Heterodera glycines
  SCN-specific regions: Sequence locations=1-653
aagcgattgaaccaaaagcgattggttggagcacaacaaaaattgggccattgcccgcatcaatcggaaagcggtgcccgaaaatgcatgtgatccgaagacgcaacgtgaacggttggaggaagcaaaacatacggccgagctgaacattgcgtcgttgaagcgttttgaggacatggaattggagcggcggaagcgccatcagaaaccgacaaagcgactcgcgttggacgggccgcgtgtgcgcgagctgtggacacgggacggaaagcatttcatcacatttgtgcccgaaccaccgccagccgagcaatgctttccaaagctgaagccaagggagttccgcgtgtgcgcaatcagtggacagcgcgcgcgttacattgacccggtgacgcggctgccgtacgcggacatggacgcgttccgtgtgttgcgcgagaagtaccgccaattcttggagacggaccatgaccatattcaacagagacagcagcaacaacagcggaagaagtcggcggcaaatgattaaattggtcattatttgatttttttatttaaagaaatgtaccatctttttttattcgattgtcttcgtcgtccattcatttcatttgtttgaattattaaaacattcaatttgaaaaaaaaaaaaa

SEQ ID NO: 93403 - DNA, 611 bp, Heterodera glycines
  SCN-specific regions: Sequence locations=1-84,106-316,338-611
actttcaacgtccgttggaacttggcgctgatgttgtgatgcattcgttgaccaagtacatcaacgggcacaccgatgtgctgatgggtgctatggtgaccaacaatgaccaacttgatcagcatcttaaatcacagcaaattactgctggtgccgccccgtcaccgtttgacgtctatttggtgatccgtggcatcaaaacgctccatttgcgaatgcgacagcacatggaaaatgcattggcagttgcacgatggcttgaaaaggacccacgagtggaaaaagtgctttatcccgagctcgagtcgcacccgcagcacaaaatccataagaaacagagcagcggaatgtccggcatggtctctttttacatgcgcgccgatgccgacagggcacgcaaattcctcgccaatttgaagctgttcacactcgccgagtcgcttggcggtttcgaatcattggccgagttgccggccgtcatgacgcacgcgtcggtgccagagcaaatgcgcaatctgatcggcatcagcgacaacctgatcagactgtcggtcgggtgcgaggacaagacggacctgatcaatgacttggacatggcattgaacttggca

SEQ ID NO: 93404 - DNA, 238 bp, Heterodera glycines
  SCN-specific regions: Sequence locations=1-93,116-238
tcctgcgtgcccacctggagaggttggagcacctggcattcccggccatcctggagcccctggacagcccggtacggacggacagtcctgcccgaagggacctcccggaggccctggacagcctggcaatggcggaaccccaggacatgccggccaacccggacagtctggaaaccctcggatagcaacggaatgtgtcccttatactgtgcacgggaccgaggatggctctttgagg

SEQ ID NO: 93405 - DNA, 651 bp, Heterodera glycines
  SCN-specific regions: Sequence locations=1-651
gtccacttttcgccgcctgccaaattaattttgccatcgacgatacccttacgatctttaacagcactttggagccgattttgcgcaacatttggccaatgatcgcgacaaacgtttgtgccatccaattgtccgccgaagttttccgccgtttgcgacatttcgagccgtcaattctcaacgactgtccatcgcttcgcgttttcaatgcgtattactttggtttcttcacccaatttccatgcgatgacagtgccgcggcatcggatggacaaacggtggccaaatggcttttcactcctcgtccggacgatgtgccaaaggtgttcaaatgctggttgcaatgggatgatgggcatttggcgtcgagcattgaagacttcaaaagggaatttaccaatgcttcatctcccgtcaatttcatcgctgtcattcgctttccgccgacttttgctgactccgttttgctcttcgatctgaccaatggatttacgcatgaacaattgacgttgacatggatgaacgatatcggccgttttctgctgatccgtcgtccaattgtgcgcgacacgaacaaatgggcaaaatgggaaaaggaagcgattggctggcaattttatgatcaatggaatcgaatcgacattcgttctt

SEQ ID NO: 93406 - DNA, 454 bp, Heterodera glycines
  SCN-specific regions: Sequence locations=1-373,395-427,449-454
cactcatagtgctctcgagagtgcctctgtgcgctctgtggtgtatattatccacacaggccactctgtgatatctgtgcactcagataagacccatgagaacaacaaagcgcgacacagattagaggtcttccgcgtacacacacactcggtgtacagtgactatatagacgcgcaaggggtcgagacccccgcctaaaacccccgagataaccccttaatctatattttctgtgccaaaccaactgtgcccagactgtgacagcgctgtggtctcacacacaaaatgtgtccctgtggctccccgggcccgtggagaccgtgtagacaccccagacactgtaggcaaacgactcctccttgaccgtgcccaaacatcccctgcccactcctgctctgctggcccacaaggtcgcctggcgagactgggatggtggggacagcagggagcccc

SEQ ID NO: 93407 - DNA, 544 bp, Heterodera glycines
  SCN-specific regions: Sequence locations=1-77,99-544
taattcggtttccaacggagaatatgccgattgtgatgagatggaattggacgagccgttctctgaatctgaaggggaagactttccacaagcgaagggcgttgagaagccgtgtttggtcatcccccgtggacgcatccgctcgctttccggtacaattccccccgtgggctttgcgccccattggggcgggccgacgatgtgtttgagttgcttccaatttttccaattgcctgagatgatttgcgagttttccactcatctcctcactgagcatcaaatctttatcgatgggatggatataatcgtggacttgaaacgttacattgagtattggcgccagcaattcgccaagcgaaacattgcagagattttcccaaaaatttgtcctaagcccgaagatgatgtattcggtaaagtgggtttctactttttgatggacgaaagtgtgaaagaagattacggattacgccaacgtttggccatgcgtcgtctcgaggaggctttggcatgccaacagcgcgagagagaagactccgtcttc

SEQ ID NO: 93408 - DNA, 500 bp, Heterodera glycines
  SCN-specific regions: Sequence locations=1-214,237-317,339-500
caagtttgagcttgtaatttgatgtcgttggatggatgcagtttttctggagaaattatccgagggtggccttttgaatggtgagcagttgaacgaactggatactgacgaagtgcgcaaattggtcgaaattcaattccgaaaagacggcgcaactctccgcggtgttgagcatctgatcataagggtggaggcaaaagtgagtcggaacgaactccgtctgctgtttgtcttctatttggaattgcttcgtcaatgtgtcgttcaaaacagcgaaatggacgacttttgttccgatcaaacgacccgccaatttttgcttcagtttcaatttattttgacggaggaaagggcggacgaccggcagcagaattgggtgcagctgctactaggagaaatgatctgcaaaatgttcgtggagatgggcagaacagcggcggcgagcagtgcgtcacccttttgctatgaaattgctaagcagcacatttccgcccttttgg

SEQ ID NO: 93409 - DNA, 615 bp, Heterodera glycines
  SCN-specific regions: Sequence locations=1-3,25-170,204-615
gattacattcacagagttgggagaacggcacggatgaaccgaaaaggagaagcgatgcttatgcttacgccgtcccaagaaccttttgttgctttgctcaggcaaaggaatgtccccgtcacaaaagtgacagtcgactccaacaaagtgtttgatgttcgtaataaaatcaccaatttgatggttcctttcccatcagtgaagcaatttgctcagcagagtttaatcgcttatgcaaaagctctctatttttcggaattgaaggaagtgtttgatgtgcaaagcattgatttcgatgcactttccaggtcttatgggttggtagttacgcctcggatcagatttctcagaaaaaaaggaattatgacaagaaaatatgtcgaatttgagaagggaacttcgccagaaatggcaaccaaaactgaagaaattttgcttggcaatccgagcggaagcggcggaaaaaatccatttgatattcaatgccaaaacgaaatggaggaggaagaaccatttttgaaggtgtcgcgaagggacgtgttcaattccatcactgaagtcgatatgaaggaagaaattttgtcgagaatttcttcaaagaaaccaatttcgaag

SEQ ID NO: 93410 - DNA, 588 bp, Heterodera glycines
  SCN-specific regions: Sequence locations=1-141,163-445,490-588
gcgaaattctcacagtgggcgacggggcgacacacggcatgcaagactcatcgtcaaagctcagccattctcgatcagtgcttatcaaattgactacagccgatgtgtaatggccactgttcaaacgaccgctgtgattctaaaggggtttttaaacaaattagtgtaattaggaggataattttagtcatcaccgttattgcatagagactgaatgctgcgttaaaaagcggagacttctcatgtacatatggcgacaaatccaactcattcacatcgaatgtgactgcagcctaatttaaaatttaattaaccacgtacaaaagcggtgaccggcggaaaaccgacctcattttttacgaaggaccctccaaatttttgtgctccgtgtcgccggctgtttgcttttgcacttcggacaatcccaaggtgcttcgagattctgaaacaagaaaacagaaaggcaaaataatcaacctacaaaattcaactgctcactgttaatgaaaaatgcgccccgagacagtccttcagtttcaggcagccaatatttgtcggcaactcgacgctaaattcaaattcaataag

SEQ ID NO: 93411 - DNA, 584 bp, Heterodera glycines
  SCN-specific regions: Sequence locations=1-315,337-584
caacagcaacatcaccgtttttctggtgatatttgctttgactggcatttgcaaatttggcactatcgcttcacctgttcacaatgaagaagatgaaataaaaaatgctcagccacgctttgaaattggtgaatcatcaagcaaaatgagtgatgaatcgaaaaacaacagacacagcaaaacccaaaagctgagactgcatcgaccaaattgccactggattatgacttgcagcgtgtggctgcaaaagcggctggcaatgtgtacgcgtggcttccggccgacaaacagcccaaaaagcttgcggacatcaaaccggcggcaccggcggcaccattgccgccagccgattatgacgtggagcgggtggcagaaaaagcggcggaaagcgtttacagttggttgccaaaggagctacagcccgaaatgatgactgaggatgaacgtgttgaatttacagctgaagttttccaggacatttgaaggtcatcgaatcattttttgttcttcaaatgattcagtttagcgaaggatgacattttattttttattcatttttgtaattgttcaacaattttataaga

SEQ ID NO: 93412 - DNA, 612 bp, Heterodera glycines
  SCN-specific regions: Sequence locations=1-445,467-573,602-612
gtgaagatttccaagtgggcgaagccaaatgaatgttggcgttgttgaaccctttcctcattgaattattgaaattatgttattagtttgcgagttgtccatgaccgattaatcaattgaaacgcattcttccccctcccccaagggcaagtttatttcggatgggctcctccaaagagaacgatggactttccgttgccggccgtgcaaaagcggccaatcgcctcgaagtaactgatgcggccaccagacaaaaactgaaacggcacaatctgagatacactgatctccagctcacccggtcgcttttggttgtcaccacagtgttcattgtcctcaaccttcctaattatgtctatcgcatttccatccaatttttcgttatcagtgaacagatcaacttgagttttgccgcccacgtgctgttgtacacacaccacgccatccttttttacatttacattttcaacagcccacaaatgcgcaaaaggcttattccgacggcacttaaactgttggagtgttactgtttgaagccgcggcacctcaacgatttttcggacaatttgttccaatgaatatttatttatttattttggtccattcatttgt

SEQ ID NO: 93413 - DNA, 646 bp, Heterodera glycines
  SCN-specific regions: Sequence locations=1-285,307-646
ctccactcatttttcctccgtcggattgatcaccactgaccgatcagtgccaacgatggaaaatgaaagtcaaggtgcgcatttaatggaccaattggacagtgtcatcccttcgctggtcaatccttccgagtgccaaagtgagaaggatttggcattgtttcggcaacttttccgccaatttttggaggatccgcacaaagtgaattggcaggaaatacaaccaatggcaaaggaaaagcaaatgccatacgaacatttgccgaaggtggagggatcggaggagagaagggcaattttggaacgaattgcggtgataaaactgaacggaggattgggcactacaatgggctgttccgggcccaaatcgctggtccaactgcgtgacggactcacctttttggacttcgccctgcagcagcaccgcattctgttgaactgcgccgacttgcgctcccccgttccgcttctgttgatgaactctttcaacaccgatgcgcaaaccaaagccttcctctgggcacaaaatgccaattctgtcgctgctgtcaaatgcttttgccagtcgaagtgtccccgaatatttgccgattctcttcgtccggtgcccaactcgtgggatgaccgtgccgaagaaggttggtac

SEQ ID NO: 93414 - DNA, 566 bp, Heterodera glycines
  SCN-specific regions: Sequence locations=1-391,413-566
aaattgtgcaggaacgcgtattgggaatcatccaatcgtgggcggacgcttttcgcgatgacccggcgctgtcgggcgttgtcgaattgtacgacgaattccgggccaaaggcgtcgaatttccagccaccaacattgacgcaatggcaccaatcgtcacacccaaacagaccgttttcccattggccgacgaccaaagccaacagcaaaatggcaaaagcgtcgttcaaactttcccaaaaccggatcgtcccccgttcgttcccccgcagcaattcgtcggaagtgtcggccccgaacagatggccaaactccgttccgagttggacattgtgcaggtcaatttgacggtgctgcgtgaattggtggcgcaaatgaaaccgacgaacgacggcggcgtcactgaagcgccggaggactttcattttgtcagaggattgcactcgacttgcaaagagatgcaaaagcgcattgtggagctgattccgtccgtctccaacgaggaagtgactttggaacttttgtctgtgaatgacgagctcaacaccaccttcgaaaagtacgac

SEQ ID NO: 93415 - DNA, 432 bp, Heterodera glycines
  misc_feature (138)..(138): n is a, c, g, or t
  misc_feature (149)..(149): n is a, c, g, or t
  misc_feature (238)..(245): n is a, c, g, or t
  misc_feature (247)..(248): n is a, c, g, or t
  misc_feature (250)..(250): n is a, c, g, or t
  misc_feature (363)..(363): n is a, c, g, or t
  misc_feature (431)..(432): n is a, c, g, or t
  SCN-specific regions: Sequence locations=1-155,200-305,328-339,361 -363,411-432
gagaaataatgcaaccatttgtccattggtcgaaatgcatattcaaacgtccattttctaattcttcaaaattattttcgtcgtcattttcaatggggtttaattttgaatttaccgaagaacaaaaacaactccaangcggctggtanaaaaggaaaaaaaaaaaattttttttttttttttttaaaaaaaaaaaaaacccaccccttttttttttttttctccccccccccccccnnnnnnnnannanaaaaaaaaaagggggggggggaagaaaaaaaaaaatattttggtgtgggggggtgaaaaaaaaaaaaaaaaaaaaaaggttgtttatttcccccccccccccccccccccacnttttttttttttttttctctttggccccccccccccccccccccccctttctcttttttttgttgggnn

SEQ ID NO: 93416 - DNA, 629 bp, Heterodera glycines
  SCN-specific regions: Sequence locations=1-42,88-112,148-407,568 -581,607-629
accacctgtggttacacatcctaccataccgtgcctgcggctcccgctcccccgccaccaccgccgcctccgcctccgcctgcgcccgtctacagccaggtgaggaattttcaaaatttctaatattaattttgaataaaatattttgaatccactaatttctggattatgaactaattacttgagagaatgtggtgggattaagtttttgatgggggatttcagtcttctgagtactaaaaaatgatttttgttttttggctttcatttcttttttttgattaataacatccatgatccccaagattgctgaactacatcaaatttttagccaaaaaaaggcataatttttgtcatatttcattcgttcagtcttcctactcctcctgttccacctgcggaggcagctcctactcctcttacccgtcttcctcttactcctcttatcccgcttcttcctcttcctattcgtcctaccccgcttcttcctcttcctactcctcttaccccgcttcttcctcctcctactcgtcctacccgtcctactcctcctcttcctcctgctccacgtgcggcttgagcggctacagcaacagctggaacaacggtggcagctcgtccaacacgtg

SEQ ID NO: 93417 - DNA, 639 bp, Heterodera glycines
  SCN-specific regions: Sequence locations=1-302,333-579,601-639
gcctggggcaaatggcttaactgtggccagacatgcttggcacccgactacgtaatggtgaccaacgaaatgaagccgagactggtcgaggaactgaaggcggtgcttgtggaatattacgggacgaatccggagacgagcaaagactacagccgagtcatcaacgaagcccactttgaccgtatttgcgcgttgctgaaaaactctgtcggcattgaaatttgcaaaatgggacagcccaaccgggaggatttgttcattccgccgaccattttggaggtgcaaaccgacgacgcgctgatgcaatccgaaatttttgggcccattcttccgtttctcatcgtccgttcttttgacgaggccattgacattataaagcggggagagaagccattggccgcttatttattcactcgcgacgagcgcaaagtgaacagatgggtcgccgagacgcattcgggctccgtttgtgtcaacgacgtgatgctccaaattacggtggacactttgccatttggcggagttggcgagagcggaaggggcagttaccgggggaagttcggcttcgacgagttcacccaccaaaaggcggtgctgaagcgctgctttttcggcgatggcattgctgctggtcgttac

SEQ ID NO: 93418 - DNA, 436 bp, Heterodera glycines
  SCN-specific regions: Sequence locations=1-436
gtctcatctcagttcactcggaggaaacttccgccaagtgaaggcgtgcttcaccccaaaagagaatctgctcagttccgcgatgcgatgcaccaaaagacagcacgacaacgcctgctcccattcttcagctgatctatttgggccaaaacgatactgccaaacattggaaaaccaagcgatggtggaaatcgatcggatgatcgttcgaatggggctggacaagagcgggtccatgaagaagctggtcagtgcgagcaagaaactgtacggatgtctgaagcaatgcatggctaataaggcgggcaactgcgaaaagcagctgaagtgtggccttctgatgccctcggacagtgccatggtacaaaataccacaagctgtgccctgaacaacgggtttaacaccgcaaccgcacaacagaacggccatctgtgt

SEQ ID NO: 93419 - DNA, 209 bp, Heterodera glycines
  SCN-specific regions: Sequence locations=1-87,109-209
tgtttcggctaaatccacggggattgattcaaaatgatcgttgataccctctaggagctgtgctttcgagttggcacccgaccgattaggcaaattgaaaaatttcttatagcgacgaagtgttgtcgcaaaaagctcatcaaatcttatcttaacggttttattgaaaccattccataagtttgaccaattttcctcacaatccgttg

SEQ ID NO: 93420 - DNA, 617 bp, Heterodera glycines
  SCN-specific regions: Sequence locations=1-8,44-90,112-192,215 -584,607-617
gtgctttttctgtttctccctccaaatcattgtctaatcttttgcttgacgacagtccgtcggatgaaagcgccgatgaacgcgatgatcagactgacttttgtgggcagcgtcagcagattggtgacactcacagtcattcgtcatttgttgccgaagttgtcgattcccttcagggggctttggaggacggttttttgagagagaatgaaaaggcgaaactgagtggggatttgctgaacaaaataaaattggaagtcaatgcctccaaattggcctacaatattcccgcagaagaagtgccgggccttctcttcactgcttttcttagtctccctggcgttgtcgacaaattttcggagttcacaaagatgtacaaccattggcgtggactttggaaaatgttttacagaaccacttttgctcaatcacaaatgctttttgctattgaggagaaagcgtctgattctgaccgcttccgtcgtgttctgccaaaagtgctttactttttgagtcaggaagttaaggcaatggacgatgctttaattgttgattggtactccaatttggaagaaaagtcgcaactgaagaaagaagagaaactggctgaattggtc

SEQ ID NO: 93421 - DNA, 319 bp, Heterodera glycines
  SCN-specific regions: Sequence locations=1-199,221-319
aaccccgggcggcgcatggcgtttggcagaggcctcatgtgcccatattttcaatttcccccgcaaatcccggaccgccgatctctcccggggttccgggggtggcgggcttttccgcgtcacccgggtgtcccggccccccgggctgtacaaactaaccgggcaattctgggtggacacgaacacccgggtaccccctgggtccggggggtccccggggatcgacgaatgtctggccctaccctgggattctgccccgggctacggggtggcccaactggtccaaatcatcaactttcccaacagggccacgtggacc

SEQ ID NO: 93422 - DNA, 558 bp, Heterodera glycines
  SCN-specific regions: Sequence locations=1-206,228-558
ggtggccatgtaaaaagaattgccgaattttgaggaaaatttgggtgtgcaacgacatttgaatggacattttccctcattttgatcgtcctcaactcggcctcaaaatggcactgctttcgccacgtttcaatgcgttggtggacaaacatttcgatggcataagccaattgacaatttggaacgcaataacaattcacaggatcggaacaaaagcaaaattggttgtagaggagaacaatgccaaatttccactgcccgaccatccgctgcgcaacaaaattcgctttaattaccttcaaatcgagtacattgactattccgtcatcacatttcttcgtgccaatcagaaaatttttgacaaaggcaccgatttgaatttgtttatgccgtactacgaccatgatgacaagaatgtccagccaatttgggatgattttgcccgtgcaatttggcccatttttgcaccaaacattcgccatttgtccttttccgatgcccatgcttttggcaatttgcgtcgccacatttcgccaacaattctcactgatctcaatc

SEQ ID NO: 93423 - DNA, 560 bp, Heterodera glycines
  SCN-specific regions: Sequence locations=1-560
aattctcgggacggacttgaggggacgcgtgccggcaatgatcacaatgcatgcttattcccaactttggatttaccctttttcccatcggcgcggcgtttacccggccgacgtcgaagaattaaaagcggtggcccgtcgtgcagtgacagcactggcggagaaattcggcacaaattaccaatacggcacggggccggagacaatttatgcttacactggcggaagtgcggattgggccaaggaaacggcgaaagtgaagtacacttacactttggagttgaggccgtcctattggtcatggaatggcttcgttcttgacagagcgcaactcattccgacggcacgcgaaacatttgacggcgtttttggtggtgatggaacaagtcgtaagggaaatgaccgagcaaacggtgcccaatccgaacgccgcggttccgttcgtccgccgttccatttcgtctgcccctctttctgctgaccgtccccaaagttcgctctctgccgatgatgttaattcgcgccatgggctccgttgtgtcgtcacgcgtccttcccaa

SEQ ID NO: 93424 - DNA, 612 bp, Heterodera glycines
  SCN-specific regions: Sequence locations=1-11,62-254,277-326,348-612
cttcatcaccagtctttgtcgttgtcgtcttcttcgtcatcatcatcattgtcgagtcgtctcctcccgccgctgttcttcatccatcatcgcgatcactttaataatctccgtcgtcacattttcaccaccgagccgtcccaaaatcggctgatcacatcgatccgccaccgccagatcaccacaatcagcggctatcattctgctgctcagatcactttcttcaacggcagcggcaattttcgtcagcacaaaacagcaaccagcaacaacaaaatgggttcaatcacgcagctgagcagtgtggagcagcacaagtgcgcactgctgcacaccaacggcggtccggcggttgcgcccgcggcaccgttgacgctggagccgttggccggccctgacacgggcatcctggtggcacggattagtgtgccatcaacgcgcaacgcgttctcccgcgcacttgcacaagcgttccgtgacatggtcgaccaattgcgctacggcctcgaaacgcgtgcgttgattttgaccagttctgtgccacaagcattctgttccggcgtcgatttgaaggaaagacgtaaaatgacgtccaacgaagtgaccactttt

SEQ ID NO: 93425 - DNA, 487 bp, Heterodera glycines
  misc_feature (456)..(467): n is a, c, g, or t
  SCN-specific regions: Sequence locations=1-6,28-49,126-127,159 -298,320-330,362-384,407-487
gcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcgggctggactgactggatggaagtgcaaggggtcgtgaacccgccgttcaagcccccgggaaacccctttcaatccattttttcgtggcaacgtaaatgggccggaaactgccaggggcttgggctcccaaagccaaattgtccctttgggccccccgggccttcgggaaccctgggaaaccccggaaaccccggggggagagaaaaccccgaaaacctggaaaagttggggaaacccctttttctggggcccgcaaaaaaaactcctcccccctctttcttgggccccccccccccccnnnnnnnnnnnnaaccctctgtgggccccccc

SEQ ID NO: 93426 - DNA, 532 bp, Heterodera glycines
  SCN-specific regions: Sequence locations=1-532
gtccaaccaccattcacagaaacagttcggagagacggcgcagaattaatcgtctttctcgaaagtgttctgcttcagacgataggttttgatctccaggttgagcttcctcatccacttgtccttcatcacatgaattgttacgcgggtggtaactcggcgatttcacgctgtgcctattggttcgcatcggagatgatccggttgaaaagcatccgcatttttgtttcaccacctccttcgtaggttaaccaccttcccggtgcggtacagcattcagactattgcttgcctctctatatttttggtctcgctctggtcagatttagagattcccgactctaatggtgttccgtggtttaaaagcattgaaccggaaatgacaatggatctgctgaacagttaatagcattcagattaaagcgataataacgggccgctctttgagcactcgccgatgagttcacgctgctttaccacgagtgtgggagcagcgaatgtcgcaaggcggtggatttgcttcagcggttaa

SEQ ID NO: 93427 - DNA, 495 bp, Heterodera glycines
  SCN-specific regions: Sequence locations=1-14,45-134,192-495
gaactagtctcgagttttttttttttttttttttttttttttttacaaatgatttatttgctgtttttttgcataattaaaaagcatttttcggtaaaaaaaatctgacaaagacaaaagtaaaaagcctattgtaataataacaataatttataatcactttcattaaatgttattttattattattattggcatgtcaaattcactgggcaattgaggcgacggacgccgcgccgctggggaaatggtggggcaggcaaattctgtcaagcacatcccgcggaatgtgttctcggagaatggcattttccgcctccaatcgaatcaccgtcgcctccaaatggacaattcgcgcacgtaacagttcaatctcatcacgaactgcgtagatgagatggcttttcacaaggtccattgcctgctcaatttttgagtctatggccaccactccgtcgcccttttgagccgtcggaacagcgccagtcgaggcggaa

SEQ ID NO: 93428 - DNA, 536 bp, Heterodera glycines
  SCN-specific regions: Sequence locations=1-536
tggccaacctttgtatttcacgcgcgaaaatgtgacggagcgatacggagaatacgaaacgcgcaaaattgacttgtgggaaaaatttatgagcacattttccgagaagcagaaattcgaattgaatcggactggatttgtgccgatgcggccggaacagatgcgaatgatttacggggcccagtcgccgttcaatgacacggaagctttgcaccgtttgtcttctctgaatgagacgcaaattcacgagggaatggagagagacatccacaacatcgcgcgtctgaagcagtggcgccttcaataccatccccgcgctgagtttcactcgcgtcggcgccgtgccgtcgttttgtcgccaattgtctcctcgccttttgttctcgccgcccctgggcttagccaagcggtgattctgtcgcccgttgtgttgtcgccggtcattttgacccccgctgtgttcgggccgttcattctttcgccatgggttttcgtgcccgtcgttctctcccctcgggtgctttcgccgtttgtgg

SEQ ID NO: 93429 - DNA, 615 bp, Heterodera glycines
  SCN-specific regions: Sequence locations=1-22,44-444,466-615
ccaattaagatttgttaaatccccaatttatttgtctaaaattttaaaatgtcgtcggccggttcaacaaatggcctcaaaatgaatgatcaacagcagcagcaggaaagtgtgcccgattctgaggtgattcggcaattgcgtgccaaaattgccgaattggaagcggcgaacctccgaatgagttcgtccactgcgagtttcgatgttttttcgtcgccaaatggggacgatgagaatgattctttcgaaggccaaaatgaacagaacggaggggaacataacgacaaaagaattgaacagttggaaaagatgatgcttcaaatggagattaatcatcagcaattgctgaccgagcacaattcgttgcgcgagaaaatggcccaaatggaaaaggaacagcggaaaatggccggtcgacagcaaaatgacaacacggaactttgtgcagcatttgaggcgctcaaacagaagcagacatccgattcggagcagatgaacactgtccgggaagagattctcgtgaaaattgacgagttggtcgaattgtccatcaataaccttgcttttcgtcataaatttgctgccatggaaaacattgtcggcattttgaaa

SEQ ID NO: 93430 - DNA, 245 bp, Heterodera glycines
  SCN-specific regions: Sequence locations=1-245
gaacaagccaacggtactctgcaattgaccgccaaactcattgacgaaatggcgcactcaaatgggtttctgcccacacactgaccgaagtcatcaaacattgtcggatcggtgatgactgataagagtgccgaaactgtgtgacacgttggctgtgttaattgctaagctggttgagcaaaacatcgtcacatcgaacgttatttcgtttttggcctataaaaattcggatggcaaggagtccg

SEQ ID NO: 93431 - DNA, 509 bp, Heterodera glycines
  misc_feature (116)..(116): n is a, c, g, or t
  SCN-specific regions: Sequence locations=1-161,184-509
ttactaataaattattcataatgaaaaggccttcttcggttgtcgcttttggtagtcatttatttgtcggctttattctgttgtcgcttttcattggcactttgggcactgagaanaaagagacgaaacctgccgctgctcattctcccgccgatgccaaacatccgccgccagtcgccgcccacgcggccgctgggcgcggccacgccttcgatccgaaacccgcttctccttccccgctggggttgctggtgcttgttcccaggcttattcgcccaatgggggggccgcccacgggggcggaaccaaaaatgggggggggctcccgctttaaaaaatatcggagagggccccacaaggtttttcttggggtggtggggaaaaaaaaaatctcctcccggccccccgaaaaaatcgctccaagggagaaatttttgagggggctcccttggaaaaaatgaacaaaaatggggggggggggcaaaatccaaaaaaaaaaaagggggggc

SEQ ID NO: 93432 - DNA, 653 bp, Heterodera glycines
  SCN-specific regions: Sequence locations=1-606,628-653
atttaatgggcaacaaacaaatggccaatgcaaacactgcgacacgcgctttttcgacgcaatcaccgccaacggcaaaaaaagtggcgaatcaccggttaaacagacgccgttccgactttcagcaaaacagcaaaagaagcgcagaacaaacgaagggggatcggcataacaataacattggcaccccatcgaatggaagtggcgatttgccaatgaattcggcggcggaaagggcccggcagcgcagacggtgcagcagcgcggcgttagtcgcagcgcgaaacggcgcaattcaaaggccaaaacgaatgactccgcgccaatgccatttggtaatcaaatcgtggagcaaaaagtcaccaaagaatcgaatggccaaagacatttttgaagcgatttttgtggaagccgaagagttaaaagcgaccttcggaattgagaagggatcgaatggcaaaaggctgagaatggagccaaattttgtggcacatacgaatatgtttgccgacactttggactttgtaattcgcaatttggacgatctttcgttggtcaccgaaaacgcagaacaattgggaagaaggcacgccgcttttccggtggaaggaggattcaaaacagaatattggaacatgttcacggaatgcatt

SEQ ID NO: 93433 - DNA, 545 bp, Heterodera glycines
  SCN-specific regions: Sequence locations=1-545
caaaaatgctttcttcttccgcctgctgtactctgttggccgccctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccagtcgaccatcagatgcacccaatcgcatggggacgagtcgtaagtttgacgagtcgggcaaattaatgcaatgccatgggggctactgtagtcaaaattacggtcggcaattccattctaattagattattttatgccaatgacccgatttaattggaactctttgattaaccaattaacggggttggggaaatcattaaatgccattgggactactgtgatcaaaaatacgatttgaaattccgttccaactggtcattttatgccagtttggtgtcccgatttaattgggactctttac

SEQ ID NO: 93434 - DNA, 280 bp, Heterodera glycines
  SCN-specific regions: Sequence locations=1-280
tgccggagagacttccattgccaatttggacgacttgagaaatgccagtggtgacgtgtcaaccgcggaccttcagctctaattaccctgcgtacaatgcaaaaacatgctccgtgctgttcaaaacgcccaccattgcttcaagaaggaattgaaaaaggtcgaagtctcttcggactacaaaaacgcccttcgcgtgtcggaccgccgattgattaagaattcctacctagttgaaacgttggaactgcataatctgctcattaatgccctccaaact

SEQ ID NO: 93435 - DNA, 308 bp, Heterodera glycines
  SCN-specific regions: Sequence locations=1-215,237-286
aaaaatggctcaaatgacacattgttgtgatgccatcccaatgttcgttgagtgaatggggcaatgtgtcattcattggcacgtcacatcacatcaaaaacaaaatggcacggcatcacttgtggccaagaccaaacatcatcaggccaatttggccattgtgtattaaggcttaagtctctaccaaacaaaattactgatggtctgctattgttgaaagaaataaggaagtgaatattcaattcacatgattttgagaagcacttaattagtatgaggtggacgcaaaaaaaataaaaaaataaaaa

SEQ ID NO: 93436 - DNA, 534 bp, Heterodera glycines
  SCN-specific regions: Sequence locations=1-272,295-346,368-371,393 -398,442-534
gacctcgaaatcactgatgataagtgtttggcagtgcattataaggaaaacgaatacgggcgccgttccgtcttcgctagacattcgctctttccggaatcagctttatctggcattttctactttgaagttttggtcaaatctatgaaacatattgccttcatcgggttgtctgaaaagcagcaccaaatttcgtttgacgaaacaattcattgcggcacggcgatttacgaatatgcaagcggcggttatctttggattagcggatcatcgagaaaatcaaatgccaagtactcttttggtgtcggtgatattgtcggatgcggcgtcaatttggccattcgacaaattttcatcaccaaaaatggacaccttttggcttcttccaaattgttcgttcctcctcctcctgcttcgtcttcttcttcctcttctgtttttgatcttccgttggttccatttgtttcattgttcagctttgatgatagaatcgaggcgaactttgggcccaatttcaaattcgatttttcaatt

SEQ ID NO: 93437 - DNA, 650 bp, Heterodera glycines
  SCN-specific regions: Sequence locations=1-650
ttgaaactgaatctatttacctatctcttgaaatgaatttcctgtccaagcctgccgtcagcaacagcaactccaaagttcatatgcaaactatgacatggaaggaatttaaagcggatgcactgaaatcggacaatgaattggagcgcgaagaagtggaaccactttttgacccgatttacgaaaaggacaccaagcggatgaaggcattgattggcacgttgagcgaggagaagcggcaccgcttcttgcgcacgcggtacgccccggagggcaccaacaaaacgctgacgccgctgatgctggccgccgtattgggcacaggcgaaatggtggaaattttgttggagagtggcgccgacccgaaccaaatgtgcgttcgcaaactcaaagacgcaagaggttctcccatcatgaccattgtaacgcccctttgggttggcgcaaaggatggccacttcgaagtgtgccaggcgttggtcaaacacggggccaacatcgatgtgggcgtgccgaaatttggcctctcaccactgatgtccgcatgtgacagcaatgctcggctggacactgttgatcttcttatcaaaagtggtgccaatgtgaatcatagcgacccaaacggtgacaccgcgttaatgggggcaacg

SEQ ID NO: 93438 - DNA, 362 bp, Heterodera glycines
  misc_feature (172)..(172): n is a, c, g, or t
  SCN-specific regions: Sequence locations=1-362
aaacgcctcggaactcacaccaaacaattgcaaagcggaaacggaggagaccaaagcgattgactctttggggacacaaagcttttgcgggcccaaaattccgtctaatgagcttcggtcgccctccaaatagcagagaatgctttcgccgttgaaattgctcttcgccatnccctagccgtaccccgacgccgtctcctcaaattccgtgggccctggcggcgttttcttcccgcccccgggcgattctttcctttcgttggaccccccttttgaggagaatgacccgtactgtccgctcttcatgaacgaccaaaacacttcactgaattcgctgttcggctgatcattcgctgcggcgg

SEQ ID NO: 93439 - DNA, 481 bp, Heterodera glycines
  SCN-specific regions: Sequence locations=1-481
gccaagtgtttcacctggagaagtcgcacgtgaacactgtgctcgaatacgtgcgacacgcggtttcgcaacggaaagttcactttttgtacgaagtgcgcgagcacgggcaaacccacacgacttcggtgcccgttgacgcattcgtttccgaactgaccttttccttggcgggcgaaagggacgacggcgcctttttaagcatttcgatggtggacccgcgaaaccggaccatcgagaaaagtgactacgaacacgagcagggcatcatcgatttgaccaacgtgaagctgatcaggatcaacgaccctttgccggggctgtggcgggtgcggacgagcagtcggctgaagcacactctccgcgtcgttggccatgggaccatcgactttaagtacggcttctcctcacgaccggttccttctgtcgatttggcccacccgcggccaatcgccggacaaatcacttttttggtggtcaa

SEQ ID NO: 93440 - DNA, 667 bp, Heterodera glycines
  SCN-specific regions: Sequence locations=1-6,28-549
gtccatttaaggctaaattataattttttctaaatggcacccgtcaaaaaaaagaaaaaattttcctccgccaatcaccgcctcatttctgcaactgaacaacagaaaccgttgggctcatttgtgacatttggaaatcggcgaagtctccgtgtggcaatgaaaacgaagagccgacgttggatttgcaacgacatttggatggacattttgccgctttttcgtcgtcgtcaactcggtctcaaaatgtgtcttctttcaccacgtttcactgcgttggtggacaaacatttcaatggccagagcgaactgacaatctggaaaccaattagaattgacgagaaaggaacaaaagcttcaccctttaccaagaatttgtttcccaaaaaataacaattaaaagaaggatcgacatattgtgaggagatataaagagggggatgagaggaatgtcatagatgagtgaagagaatgtgaaagaaaggaagggttgaccaaaattgacggatataaattgcataaaggggggaggaccggcaaagcgcagacgaaaggaagaggtaaaaaaaggaagggggggggaaaaaacgagaaaggaaggacaaggagggggaaagtaggagaaaaaagaaaaaaaggaaaagaaagggaaaaagaaggaacaaaa

SEQ ID NO: 93441 - DNA, 489 bp, Heterodera glycines
  SCN-specific regions: Sequence locations=1-36,77-489
gagaaatgccttcaaattcgacgcctttcgatgagggaaaacaacaaatggcagagaaaaacaaaagcattccgtcgtcgtcgtccatttcgaaatttgcccctttttcttcgtctgctgctgctgaaattccccccgaaattgccgcactttctcaactttcgatcagtgattctccgaaagagccttcggtcgtcgtcgccgccaattggactttgtggcgttacgaatgccgcgatttgccggagcacagatgccaagcgaagccgtgccaattctgcgagcaagtgagcaaattgaaaggggtggccaaagggaaactcagcgaaagcaccgaccgatgggacagttatttgaagcgggaaaagagctacgatgacgagcacattctgatcaaagtgatggaaggcttttcgcccagcaaattggcaaaggacgtgttctttaacaaaaaattgggcgtcgcattattccgtggggacattgagc

SEQ ID NO: 93442 - DNA, 580 bp, Heterodera glycines
  SCN-specific regions: Sequence locations=1-153,175-486,508-580
actcctgtttcttggagagcaaagcgttggaaagacttctcttatcaccagatgtatgtatgacagctttgacaatacgtaccacgccacaagtgggataaattttctgagcatgactatgtatcttgaggacagaacggtcagacttcaactttgggatactgctgggcaagaacgctttcattcgctcattccgtcgtacattaaggactccacagttgctgatgctgcttacgacattacaaatgcgaattcctttcatctaacggcaggatggattgacgacgtgcgcaccgaacggggcagtgacgtcatcatcatgctcgtgggcaataaaactgatctcgcggacaaaagacaagtttcaacggaagagggcgagcagaaggcgaaggagctgaatgtgatgttcatcgagacatcggcaaaggctggttacaacgtgaagcagcttttccgaccaattgccaacgcacttcccggcattgaggtggaaaaggctgcggtagcccaacaactcgctgacattggccccattaagccccccccgattgtcactgaaaaaggttcctgttggtgc

SEQ ID NO: 93443 - DNA, 625 bp, Heterodera glycines
  SCN-specific regions: Sequence locations=1-269,291-625
gtttgagtcagtgctttttcgttatgccaatgtgcccttcttctgagtttgtgcctttggcatgacttcgacgcttcgcggtttctgcctttcccccgctgatcagcagacgaatcttttctcattttgcagtgaaatggcgacgaacgcatcacagaaaaggaaggagatctatcggtacaaagcgtcgttcaatgtttatgcgatgggatggtcaaccaaattggacaatcacctcaaatttctcttggccatcggcagtttcatcgaggaatacaacaacaaagtgtccattgtgcagctgcacgaggaccaaggcgaatttggccatctcggcactttcgaccatccgttcgtccccttcaatttccttttatttcttccgtttagttacccctcgacaaaggtgctgtggatccccgatccaaagtcggcttttcctgatttattagcgaccaccggcgattatttgcgcatttggcgaatcggcggtcacaacggcgcttcgttggaagttcggctggacaataaccgttcgtctgagtattgcgcgcctctcacttcggccgattggaacgaagtggacgtgtcactgattggaacgtccagcattggacccaactgt

SEQ ID NO: 93444 - DNA, 538 bp, Heterodera glycines
  SCN-specific regions: Sequence locations=1-538
gaattacgcaacagaagagtcgggcaaatggatgatgttttttgagaaaggaagcgaattggacgaccattgggacgtggcgaagcgattggacgacgaagggaaattggacggcatcgcgagaatgaaagtgtcaacggcattcgacaacccaagggccagcgacagacagaaagggtgttctcattttctactgtggaccttattcggacagaagcaaagatggtcacaattgggcataatttgctctcccatattccgtacaacgatcacatggcctacaaatgggatttgcaaacccttcaggggactcgcgcgaccggaatgaagaaaaactatttgtactcaattaaaccgtcattaaccgctgctgccgggggaccaaatgttggtgaatcatcgttcacagcaaaagaataaatacgaaaggataacgaaagcgaattttgaagttgatcaatggaaataaaaaggaattcttattaatttttgaaaacctttgaatgttctgattaaatttaattgataacattttttt

SEQ ID NO: 93445 - DNA, 488 bp, Heterodera glycines
  SCN-specific regions: Sequence locations=1-110,133-172,197-275,297-488
agaaagcgatgagggaatataatgcatcaaacgacgaaatggtgctgttctcctattccatcggtttcgcctatattttggtcggcctttgcctttccggtcagattggcgaggctttccttttctttgcccaacgtcctctccaaacttacggctattccgttctgattggcatcgtcggctatttcggcgtcaatgttgtgctcacaatggtcagaacttcgggtgctttggtcaccgttacggtcaccacaatgagaaaggccgttaccattgttttctccttttactttttcgccaaacccttcactttgggctatttgtggggcggtttggtggtccttctggcaatttacctcaatgtgtacacgaaaaacaaaaagcaatttgacgcgaaattggctgagtggtggtcgaatctcgcggagtcaaacaatggccaaaagtttgccgctgagcgtaaattattgttgccggtgtaatttgga

SEQ ID NO: 93446 - DNA, 548 bp, Heterodera glycines
  SCN-specific regions: Sequence locations=1-548
gttcaatgtcttcgtttttcatgcatcaccagcagaagcggtcgcaccaacaagcggccgccgtcactttggcggacattcgctggatggaaccgatggccgcgactgaaagtgccgctacttcaacaccggcaaagcggctgttggcacgactcggcacaaccagagtgggccgctacgttcaacagttggccatcgattacgcagcttccttccgcgacatcgtcgttggaatgcgtcagcgaccgctgcgagtgcgtttaaatatgtttccgactgtcagggtcacggacatgcaattcattcgatcctctaatggccgtcgcttgcggcgccgccttggcttcgcttgtgttcactttaaaatccaatccggacgaaattgcgctgcgcgcgcgtttggctcagttgcgtcagcaaatggtgctcatcccggcgtccattcacagcactcgtgccgacgaacggctcgagcagtacaccgtcctgttgaatgggaatcggcttgaactcgtcgactttttgctcttctctgtgctcgttgagcg

SEQ ID NO: 93447 - DNA, 531 bp, Heterodera glycines
  SCN-specific regions: Sequence locations=1-34,56-268,290-451,509-531
catttaagttttaacaattccctaatattccgttcattaaaaataacacttaaaataataatgagctgtgtgagcggcgtcagtgccacttcaatgcttaggccggtgtccggaaacatgatcgccgctgcccagcaacagcaccgaaagcgccgtcagatggccatccgaaagacggactcaatgaatttggcggaacggcacaacggacgcattttggacctgatttggtgcgagggggacgagcagtcattcagcaagacaattcgttccaaagcttcggtggtcagctgtcacgccaccttcgcaagcggtcacagaagctcatgcgcaagttctaaaaaggactctgccgaaaatttactgatggtcccatcttcgaccactttaattccgtctctgcttgagcaagtgcctgaagaggaggacgaacttttggccaaaatggagcacgacgatgacgacgacgacgaggaggaggaggaggaggacaacgcgacggacgacgtggacgaggagctgctcaggcta

SEQ ID NO: 93448 - DNA, 632 bp, Heterodera glycines
  misc_feature (594)..(594): n is a, c, g, or t
  SCN-specific regions: Sequence locations=1-177,201-632
attccttctacgaacgctaccctcagcaacaccaccgcgatcaattgcctgacgacattttgccatgggtaattcacaatctggtctccccggcttccctcccggccagggcggcaagaagaaacctgacgacaaggaaaagaagaagtgggagcccccccgtggcgacacgcgtcggcaaaaagaagaagaagaaaggtcccgattccattaacaagctgccgccagtgttcccgacaacccgctgccgcctgaagcttctcaagctcgaacgcattaaggactacctcaacatcgaggaggagttcattaccaatcaagaggccctcaagcctgttcaagaaaaggaaaagctccaggctcagcttgaatcgggcgagacggccgagcctgatgagcggtccaaggtcgacgacttgcgcgggtcccccatggccgttggcactttggatgaaatcattgacgacgaccacgccattgtttcgtccacgtccggccccgagtactacgtgtcgattctcagttttgtcgacaaggatttgcttgagcctgggtgtaccgtgctgacgcatcacaagaacaacagtattgtcngtgttctcggcgacgatgctgatccaaccgtgtccctc

SEQ ID NO: 93449 - DNA, 389 bp, Heterodera glycines
  SCN-specific regions: Sequence locations=1-13,35-389
acgccgtcaaatccgactctttggcccgctttctccaactcgaactttgctccgctttgtccaccattttctcgcgaattcatttcccttttgaggagcccgtcgacctcaattcgctacactttccgctccatcaaagtgcccaaataatcaaatgtttgcagttggtaacctccgaaacggtcgccaccacttcccgaagcttttactaccaaccgaaatggccaattgaactcgttttggatgaatttcgcaaacgcttcgactaccatttctacggagaccggcccactaataacgcaacgaaacccgaatggtttttcacccagctttcctactgcgcagagaaccacatcgaatacttcgagcagcacattcagcccattgct

SEQ ID NO: 93450 - DNA, 605 bp, Heterodera glycines
  SCN-specific regions: Sequence locations=1-107,129-287,311-372,398 -399,421-605
aagcggacgctctcaggacgccgacgacgacaccccaccagacgacaaccatggtcaagttcgcccccacggtcaagctcaacaacgggcaggcgttccccgtcatcggcctgggcacctggaagtccaagcccggcgaagtcgagcaggccgtcaaggacgccattgacgccggctacaggcacatcgacggcgccttcatctacggcaacgaggtcgaggtggggaacggtatccgcgccaagatcgccgagggcgtcatcaagagggaggacatcttcgtgacgagcaagctgtggaacaccttccaccgccccgacctcgtggtcggcgccgtcaagaagtcgctccagaacttcgggctcgactacctggacctgtacctgatccactggcccgtcggctaccaggaggagggcgagctcttccccaggggcgccgacggcaaggtgttctggagcgacgtggactacgtggacacctggaaggagctcgagaaatgcgtccagctgaggctcctcaagggcatcgggctgtccaacttcaactccgagcaggtgactcgcgtgctggacaggtgccacatcaagcccggcgtcaaccaa

SEQ ID NO: 93451 - DNA, 494 bp, Heterodera glycines
  SCN-specific regions: Sequence locations=1-217,239-494
gagaagaggagctgatgagccgactgaatctggaagaaaaaaacagagctctatcacacgaactgcgtgaattcggacaacggcatcatgcgttgcaagttcgcagtgatttcgagcaacaggcagcagctcgagaaattacagtcttgagaaaagcagtaggcgacgtacatgacattcaagatcaaaacgactcgttgcttcatcaaaacgactcgttgcttaaaacaaatgaaaaattaaacaaagaaatcgtcatgctcaaaaaatggctgagagtgttgttttggctccttgcagttttgctaccgcccatcgccgtttttattcgtggaatcatgagtggtttacgttgctctgccattggacttcggtgcattaaatgctgcctcctttgtttttgtggctggttcccgggcatttggtatgccttaaacatcgtacgagagcaagaaacaaacgaaagcaatttctccaatcacttctttctcact

SEQ ID NO: 93452 - DNA, 463 bp, Heterodera glycines
  SCN-specific regions: Sequence locations=1-463
ggaattggcgaggcttcttacgcagtgattgcacccacaataatcgccgatttattcgtcggtcaaatgcgcagccgaattttgatgttcttttactttgccatccccgtgggaagtggccttggttatgtgatcggttcttccgccacttcgttggccaaaagtgcgcttggctccgtcgactgtcccttctgttggcagtggggaattcgcgtcactccgttgctcggcttcttctgcataatcactttgctgctttttgtcaaagaaccggtgaggggacaatccgaacaaagtgtggcacaactgatgccaacaaattacgaaaccggaacgatcagtccaagttcaaggcgaacagtggcatcagcagaagcaccgaatgagaacatttggaaggagtattaccatcggatacgcactcacactaaaagttattgcgcagacattggacatttaattg

SEQ ID NO: 93453 - DNA, 310 bp, Heterodera glycines
  SCN-specific regions: Sequence locations=1-227,249-310
gtggtgtgacgggctcaagcaggtcgaccctcgcctttactatgctttgatgatcactgtcatcggctcgacctttcccctcatcaacgtgtccatgaacaccattttctctgctgcagttggccctcggctacaggccaagcaacagagcattctgatggtatcgggtgggatgggccaaatgcaggacccactactaatcgggcacctcgtcactttctaccgaccaaaaataatttggatcttggaatgagagccaaacacttttactggaacgatgtgggtggtattctacaagagactggtccca

SEQ ID NO: 93454 - DNA, 359 bp, Heterodera glycines
  misc_feature (318)..(318): n is a, c, g, or t
  misc_feature (326)..(326): n is a, c, g, or t
  SCN-specific regions: Sequence locations=1-287,313-359
agatgaacgacgctaatggcaaattggaggcggcacagaaacaatttgaggcaattttggccagcttttctcccaccgccgatggcaatgaacaatcgcagcagcagaaggagcagtttttgcgatgggttcgccaacggttgcgccgtgaaaatgcgatgccaacaaaagacacactgcagcacagtgacaaacggcatccaacggatttgtcggtgcgcaagcaacttggacgtatcgcaaaacgcctgcgcgaattgaccccgttggagtactgcttggacatccccgctgctgctgttgctgcttctgttgacnaaaaacancagcagcagcaacaacattgcccgtcaccatca

SEQ ID NO: 93455 - DNA, 500 bp, Heterodera glycines
  SCN-specific regions: Sequence locations=1-500
cgggcatcaccttgacaatgctacactcaattgggcacaaagaggaagatctgaatgcttttggcacatcggtttggcctctgctggtggcaatgaatgcgtctgacggcattggcaaaatgcatttcgaatttccgatcacttttcaacttttgcgccgttccattggcccattcttcgccaagcacggcgcctgtttccccaatttgcgcatgatcagtttcgattttggcattttgttcgaaattccgcccgcggtggatgcgtccgcgttgtcgtcgtcgtcggatgataatgatgatggccaagttttgtgcaaatggctgcatacgccgcgcgcagatggccaaccaaaagtgctcaaaatgaattttgattacaactttccgattgaaaaacttaaaacgctgtttctgagtgccaccattgccgtcagctttatcatttggtttcatttctttgaacatgatgctgattccaatggggaccaatttgagctg

SEQ ID NO: 93456 - DNA, 114 bp, Heterodera glycines; identical to SEQ ID NO: 57986
  SCN-specific regions: Sequence locations=1-114

SEQ ID NO: 93457 - DNA, 211 bp, Heterodera glycines
  SCN-specific regions: Sequence locations=1-211
gaacctacctaccatctcaattgagctgacgccactgactccctccacgttgggctcgttgatcgcgatgtatgactacaaaatcttcgtccagcgcgtcctttggggcatcaactctttttaccagtggggagttgaactcggcaaccatttggccagcatcattcttgacgatcttcagggcggaccgatacacgaggacgattcaggt

SEQ ID NO: 93458 - DNA, 628 bp, Heterodera glycines
  SCN-specific regions: Sequence locations=1-166,189-193,215-449,472 -563,592-628
cccgcccaggaaagacgcctaccagctcttcgcattccaactgcagctgcgcctactacttcccacaccctttgccttgccgccaaccatgatgtcgtcgtcctccgccgatccttccaccgttccagcgattcctccagtcgacgacgacagcctcactgagcacgaacgcgaggagcgcgaccgccaggcacgcctcaaggaggaagccgagcaagccgcactgccgtacaagtggcgccaaaccttgcaggatgtcaccgtcaccattgatttgcccaagggaaccaaggctcgtgatttgacggtcgtgatggaaaagaagaagctcaaggcgggcctcaagggcaaggaaccgattatggtgggcgagcttcattccgccatcaagctcgacgacagcacctgggtcatcgaatcgggcgagctcatcatccagttggagaaggtcaacaagatggaatggtggaagaacgtgctcacgcatcacccagctatcgatacaaccaagatccagcccgaaaactcgcggctggacgagctcgacggggaaactcggggcctggttgagaagatgatgtacgatcagcggcaaaaaggcatgggcaaacccccgtcggacgagcaa

SEQ ID NO: 93459 - DNA, 501 bp, Heterodera glycines
  SCN-specific regions: Sequence locations=1-328,351-383,405-501
atttggttgaggaaaatctggaatcaacttccaacgccaattcgttaattgaaccaattattgcatcaccaaatgcacaagggacggtgcctttgccttttcagttctttgagtcattttcaactttctcatggcgcgaaattggcatttctccatggctaataaaacaattgaatgaattcaatttgcgaaggccaacgccagttcaagcgaattgcataccaaagattttggaaggttctgatgtgctcggatgtgccaagacgggcactggaaaaaccttagcattcgctttaccaattctccaacagttagctgtcgacccatatggcatttttgctttgatcctcacccctacccgtgaattggcactccaaattggtgaccaattttccgcttttggccgtcaactcaaactccaatgcagcgttattattggcggacgacaccaaatggcacaggctcaagaattgagtcgacgcccgcacattgtaattgcga

SEQ ID NO: 93460 - DNA, 478 bp, Heterodera glycines
  SCN-specific regions: Sequence locations=1-478
ctccatcaaaatggacatgttcgctctaacaatcagacgaaaactggcggtccaaaaaatgttcctgcgaagcattgccaggggcatagtccgtcgccaaaatgtttccgtgcaaatgacaaatcactgctcaatcggttcattttcgcgcgctttgcctgtgatgatccgtcagtgatccctccgttcttcgcctcttctcagtttggcattgatcgcgcaggtggacccattgttttgccggaccaagttgggttgcttatcgcccgtctccacggcgtcgtcagcaccgccgtcgacgtcgacgtgtccatcccttttgagccgaagggaggaaaagcgcaccaccagcggtttttgcatgaggccgatttgagtcaactgaacgaagcgttagaaagactgcgccaattcgtcgaaatggacccaaattggatggaacagcggttcatcagcagcaaagaagagggggaggaac

SEQ ID NO: 93461 - DNA, 589 bp, Heterodera glycines
  SCN-specific regions: Sequence locations=1-100,122-589
tgtgttggttggtgacgattttgtcgtggtcgctattgacgctcgtctgacgggcgatgctgaaattgagatcctgtcgcgctggcgccagaatacgcgcattttgagccacaaaatcataatgacttcttgcggattttacggggatgtgctccaattgaggtgcattctcaagctacctattgacctcttccagttgatctaccaaatgcccatgtctttggaccagtgcggtgacatgttttcccggactctttactcgcgtcgttttttcccctatttcacggggaccattatttgtggaattaccagtgatggccgtggtgacctttacagttacgacccggttgggtgtattgaaacccaattattcgaagcaagtggaaatggtggaagcactctgagtacatttttccagaaccaatgggcttactctacggtcgccccataggagcgtaaaaacatgccaaaaccgactttggagcgggctctttcggttatccccgatgcttttcctgggctgtcctagcgccaaacaaccaccggcgactctcccaaagtgtattgggtacgagcgggtgacgaaaaa

SEQ ID NO: 93462 - DNA, 316 bp, Heterodera glycines
  SCN-specific regions: Sequence locations=1-133,155-292
ggaagaagcaaaccaattagcctagaagccgagaacgaaacaaatcaacagaaaaaaggcttgaagcagggacgcaggatgatgtttgccttaattttaacttattacatagagaaaacggcaattttaataaatttcacctctacatttgaaactttttcgcccctatttcgcgaattttttgcccctatttaagtccctaaattggaatttttcgcccctaaaaatccgcaccctaatgatcaatttcatattcaatgtaaaaagctcgttgaattaaacaaaatcatttaaaaaaaaaaaaaaaaaaaaaaaa

SEQ ID NO: 93463 - DNA, 551 bp, Heterodera glycines
  SCN-specific regions: Sequence locations=1-551
gatcacttcattccctaaatgtccttccttcgtgtgatcactttctgctcttctgatcactctgtgctctttgacttctctgagtctaaatcggcctcattgggattgtcggtactcccgttgaagccgcttggcgcgacgatgtcgggtgaatagaatccagccattgacctactgctggcaggtcgtcaacatcttcgaggaggacgattcatcagagatctgatcgacattggcaaatttgcatttgatactggctgcaaactgttccacaccgccatttgcgacttgggcaaaaaacggaagcgtgaggccgtctacggcaaaaatgagccggcgccaaacccggcagcggtgaacgagttcaaagtcctgcagagcacccctattgacgagcttgtggaaaaggtgaagaagcagctgagagaagtggcggagaagcctggcttcaaggatctgagcccggtggaccaggaagacacacttttggatgcaatcagcgcagacgatcagtttatgaaggacctcgtaagagaatctatcgacgattc

SEQ ID NO: 93464 - DNA, 139 bp, Heterodera glycines
  SCN-specific regions: Sequence locations=1-70,112-139
gcaagagactcacattgttctcttgattgcctcggtgtgctctctgttggatatcatcgccacggccgtaactctgccatctctgtactcggagatgagccaaatgaacagtaaagtgcactacggagttgaggccttc

SEQ ID NO: 93465 - DNA, 449 bp, Heterodera glycines
  SCN-specific regions: Sequence locations=1-134,156-287,330-449
atttaatctctttttttaataatgtgtataaaaattcgactattttcgcaattaatcccttttccattcaatgattgacaagtcaatccaaggacaatccctgcgcaaaacggataatgtcctcgcccaattctttggggcattcgaatgccgcgaaatgacctccgtcttcaaaaagggtcatttgggtgaggttgtactgacgagagaccatttcacggggcaaaacaccgcccaaatcgtagggaaaggcggcgtacgccgtgggcacagcgacgtattttctgaaaataatgaaaaaataaaattcaaaaaaaactaatttataagcattcgttggacctgtacagtttttcggtatttgaatcactggcgaagtgttctttgtaatagcgttgcgaggagagaatgtttccattgaaccagtaaattgagacaattgtcaaaag

SEQ ID NO: 93466 - DNA, 515 bp, Heterodera glycines
  SCN-specific regions: Sequence locations=1-219,248-390,412-515
ttcctatcaaaatcataggacaatggcaagtattgcgatcacacaaattgaccgtttgacggatctcaaccatttgccggttcatcgattgaatccgaacaacaccgaaatatgggataagctgaaagagggaaagttcgctgaggtcaatttgtgggaagagccaatgccgaaaagtggtgaaaaaagtttcgtcacttcgcaagacaacgcgcagacgacgcaacaacagcagcagcagagacacctcaggggaaaaacgccgcaaccgatcaaacggagtatgccggtgcccgtgacgaatgtgttcatgagactgaacgacgatgcatcggtgaaacgacagcaacagaacgggacgggcaaacaacagccaaaagtgaatgtggtggaagtgaagtgagtgatgaacgatggatgctttagtcactgagaacagagctttatttcgatgtctcaccgtgtaatttatttacaaaatatatttatttgacggtgaaaaaaaaaaaaaaaaa

SEQ ID NO: 93467 - DNA, 544 bp, Heterodera glycines
  SCN-specific regions: Sequence locations=1-544
gtctcctcctcgaccaccgctctactctttcttcacttccttctcggcgtgtgcttcgccctcttcccgaaacccttacacctgatacctcgcccaaccacactcgcccacaatggtcagcgcacagacctactcctactttgtcgcatttgcggctgccctcggtggtttccttttcggctatgagattggaatcatcaacagcgttttagagatgaacccgttccgtctctactttggcatgtcgaccgttgttgacggtgccctcgccaagactgccgaagccaccttctacacatcctcgatcgtcacagccttcgtgtttggttgcatccccggcgcgctcatcatcaccctcggtggcgatatccttggacgcaagcgtgccatcttcattggcgccttcctcttcaccttgggcggtctcttgcaagctcttgtccccgctggctcttccattggctcccgcgtcacgttcatctcggctggtcgattctttggcggtgtgggtatcggcatgctctccggctcggtccccttgtac

SEQ ID NO: 93468 - DNA, 413 bp, Heterodera glycines
  SCN-specific regions: Sequence locations=1-413
cgaggaggaggacccgacaatggtggcagccaaatacggactgggggagcgtaacgacgacgaagcggttgaggaggagccactaaactcgggagacgaccaaagtgacgacgaggacttggacacgttgttcgacgcggagaatgtcgttgtttgtcaattcgaaaaggtacaccgagcgcgtaacaaatggcgattcacgctcaaagacggggtgatgcacatccgagggaaggactactgcttccaaaagtgcactggcgaagccgagtggtgagggacaaatgcgactgactttaatgggaggaagctgatctccaaatattcatttaatttattctaattttacacatgtttttgttttttaattgcaacaataaaatctctgaacaaaaaaaaaaaaaaaaagaaaa

SEQ ID NO: 93469 - DNA, 629 bp, Heterodera glycines
  SCN-specific regions: Sequence locations=1-152,176-629
agattcccttccgttattcaattgtgattttctgtgaggaaagtctcaaaattgcgaacaaagtgcgtgaattacaacgacagcaccaattgaggcgtatgcggccaatggactacttagaggctgagccttccccctctctctccaacggcactttgccgtcttcctcctcctccgtggcttctcgactttatctgaacggtcggctgaattcgcgccgaaattcgttcagctcagagcccgaattgatgcagttcaatgaccatgactccatcagtacggacttcggaaatgctaccaatcagatgtcaattttggcacaaaagttaaccgaattgcaggaggagaaaatgatgatcagtgaagaaaagtcacggctgaggacagacaacgccgttttgcaggagagagtccatttgcttgaggagcatttgcatgccaccgaacaaaggtgggcagaaaaatgcgaggaggaaaaggccaagtcgcgggaactcgcccatcggatggaacgcgaaaggcaattggaggcggaaagggaggcactgaagcatcaaatgttgtcgaaggaagtgaaacaattggaagtggaaaaggaacgaatgggcggcgaaatgagaaaagcccgg

SEQ ID NO: 93470 - DNA, 521 bp, Heterodera glycines
  SCN-specific regions: Sequence locations=1-521
ccttcgtttatttctctgatttttttttgtcgtcttgcaattttggtggtacaatgtcaaagggcaacaaaaatgtgaaggccgtggccgttttgggattggatgacacggacacggatgccacgatcgacttggaataccacgaccgacttgtggaggcatcgaaggacttcaaaagcgaaaatcaatacaaagaattgctccgtctccgtttcaaattggtcgccactggcgtgctgaagctggagcgttcgttggacggtctgcaaatcccgcctccaatactcgaaaaaattggcgaactgtttgactgtttggactgggctttgtctgccgacgacgaatgaaacaaattgagggatcaaaggccaagccgaaactttggacggatctttcacccacccgtgtcctcccaaaaaaagccatttttaccccgtaatcgaatttttgtattatttttttgaccgaatgatatcacgcgacattcatttatttttgcccaatttatcatcctcccaaat

SEQ ID NO: 93471 - DNA, 526 bp, Heterodera glycines
  SCN-specific regions: Sequence locations=1-526
gtccaattaagttatgatttttcgacaatttttgagacgctttttggtagcgaatcatcgctttgtgccattggagtctttttgggttggacgtctcaactcagttttgcattcgactgtttgtggagttggcccctccaatttttccaccggttttgcaaatcatttggttcaacatcgctttttttcttcacagtccgatggtttgaacgtcttcgaacttggctctgaggatgactttgacaatcgcgttctccaagcccaacagcccgtcatggtccaattctacgccgattggtgcggcccgtgtcagaatttggcgccgagaattgaggccaaagtgaacggacagaacggagaagttttgttggcgaggattaatgtggacagttctctcggttttcttactgcacaattcgatgtgacttcggtgcccaccgttgtgtgtttccataacggagagggcattcaccgctttgagggcgacgtcgatgattcatatttggacgaaataatcgcgcatttg

SEQ ID NO: 93472 - DNA, 191 bp, Heterodera glycines
  SCN-specific regions: Sequence locations=1-191
ttctccaccatcttacggaatttaaagtcggcaatttcacgttcaaaaattatttaaatccgggacttgattttgaacgacgaagacaccggaatatttaatttaatacatactatatatacatccacggctttgccatttcttactttctctcttctaataaggatcatttgctatgctcgtgatcttcc

SEQ ID NO: 93473 - DNA, 581 bp, Heterodera glycines
  SCN-specific regions: Sequence locations=1-286,308-451,477-581
gtccaattaagttggaaatgtcgccgtctgctgataattcatctgacgatgagcaaattgcctgtgatcccgagatcactttccgaggccgctccgttcgtccattgaaatggctttccgaagtgtcttcttgtcgttaccttcccgagggtgaaatggtcacagtctgtcagatcctcatcagtcggcttgcatatatgccaaacactgtctccgtacaatcccctgctaccatttgcggcgatattcatggacaattttacgacctaatgaaattgtttcaaattggaggtgacattctcgaaaccaattatgtgtttctcggtgactacgttgaccggggctattatagtttggaaacgatctcttacctaatgctgctgctgctaaaatacccggacagaataacacttctccgcgggaatcatgaaactcgtcgagtctcacatcagtacggcttttacgatgagtgccaacaaaagtacggaaattctgtggtttggtcctggtgttgccgcgtcttcgacgtgctggccattgccgctgtcgtggacaatcaaattttctgtgtgcacggagga

SEQ ID NO: 93474 - DNA, 475 bp, Heterodera glycines
  SCN-specific regions: Sequence locations=1-475
gaggagcaggcagtgaacttgagaccagcaaaccttcgactggcgcgtctttggctgagaagcgtctttgcttctccaagcaattcggactaccgcatttgctgcgaatgtttgtccgtttcacggacatgttggcttataccgaatggagcgaacgttctttggaggcgattattcgtcatgcgcaagacttcgtgatgttcctcagtaaaaaccatgccgatttctacgatgttgaaaaggattatatgttggcgccggctgaatatcataagcgtgtttggggcaaccattcttgacgtaaggcgcgacaaattattgggagtcactgatattcactggattttttggctagatcgattgcaattgctctcctctgtttatttattgcttttgtcacttctgttgcaatcatacagactgctcatcattgtcacagtcggttgtcaactgatgttttaaaccactcaaattc

SEQ ID NO: 93475 - DNA, 531 bp, Heterodera glycines
  SCN-specific regions: Sequence locations=1-344,366-531
aaattatatatcaatcgatagctctcggtctgtaaaatgcttttttcaccaacatttttgcgctttgtgaatctgaccaatttgccaacaacatcatctctgaaatgtcaccaaattctgaggcattttttggccctcaaatcgaccacaacaatcgcctcagcatccaaagtgccaccattggatgtgttggacagcattgacattgagtcgttaaggcggtgccaattggaatttaacagcggagcaggtggcacagaagcgtcccttttcacggccgaactgttcaacatgtacgccaaatttgctgcacgaaatggctggaaatggacaccacatgaagtaagcaaatgcaacaaaacaaacagtgttggaatcaattcggccattgttttggtggaaggcgactggtgctatgccaaaatgcgttttgagagtggtgtccaccgtgttcaacgagtgccggtcaccgagtcgaaggggcgtatgcacaccagcaccgccagtttggcagtgttgccggagccggaa

SEQ ID NO: 93476 - DNA, 504 bp, Heterodera glycines
  SCN-specific regions: Sequence locations=1-32,54-388,410-473,496-504
aatttgcaaggacaacggtcctatgtggtggttgagaatgtgcaatctgatgaagaacacgaggcgaattcactaaattgcactttaaaagtgagcggctttttacggggagcaccattgagcgtcaacaaattggttcatttgcccggttggggcgatttccaattggcacgcattgaccgcactttggagccatgtccaatgaagacgccgaatgacaagaaccctccgaccggtgatgtcaaattcgctgtgttagcaaaagcagaccccgccaagcgaactccattggattcggaaattgtgccggatccgatggaagccgaacaaacatggccaaatgaaaacgaaatcgaagaaaacaaattcgtcgtgccaaaggtcagcagaaaagtgcccaagggaacctcagaataccaagcgagttggctaattgattctgatggaacggacgaaaatgacgaggaccaaagcgaagaggccgacgaggaggagagagaggac

SEQ ID NO: 93477 - DNA, 288 bp, Heterodera glycines
  SCN-specific regions: Sequence locations=1-90,117-288
aacgtatgagattgtcgagaatgaggacggcacaaagacaacaattcacaagagcatagaacggaattttcccataaatgacggaccaacagcggaggatgaggaggaggacaagacggatcagcaacaacagttgctgcacaatcaacagatggacgcatcaatgagtggataaacaagacatatttaatgatcattttctattaaaaaacccattctattgataagtttttggtgactttccgagcatcactttttcggcacgacaaaaaaaaaaaaaaagaaaaa

SEQ ID NO: 93478 - DNA, 535 bp, Heterodera glycines
  SCN-specific regions: Sequence locations=1-26,49-68,90-535
gttttaatcgccatttacgtgccattctgtcgcttctccatccagtccaaatgtcgctttggtgtgccggatgtattgtatttgtcaatggcactgatcgcactatacccgacttggcattggacccagctccacggcggcttaagtaatgatcatgtccgccaatggttgccctgtcttttcgcactgttcgcgctgcttggcttcgcttttgccttttacgtttctcaaattcccgaacgaattttgccgggcaaattcgatgtgatcggctgctcccaccagtggtggcatttgctaatcctcgccgcgttgacctattcccactggacgggcatccaactgctgatcacttaccatcgcacggcactgatcagacagcagcctctccatacggaccaaatgcttcttcaatctgccgcttcgccttttgtgccagcgctttcgtcgtcgggccgactgggaacgaatctcttaaatcacaccgcgacatcaaccaacggcggatgaccacacaaatcataacggagggcaa

SEQ ID NO: 93479 - DNA, 133 bp, Heterodera glycines
  SCN-specific regions: Sequence locations=1-56,99-133
ccttgatctccgcattgcctcggagtgctctctgatggctatcatcgccacagtcatcactctgccatctctgtactcggagatgagccaaatgaacatcaaagtgcgcgacagagctgatgccttccacgta

SEQ ID NO: 93480 - DNA, 515 bp, Heterodera glycines
  SCN-specific regions: Sequence locations=1-515
tattatttaatccatggacattctccagcagtctgattttgcctccgtttcgaaggccgatgagtcctccgtcgtcctccgttgtctcatccgtcagcttactccctttggcccccaaacggcctttcgacaggctcaactcttccaccaatacgtccaaattcttcacaaatgtcagctccgacttcaatccgatccgataatgcccatcagcacagaatttggaatgatcaccagcggagggttggccaacttcgaatgggtcaagccgttcattgactgcacaacgatcgccacttttcccgggttggcactctccgaaatggcctacggcagcacttcgcaagagaagtgccaaacgcgactccaaactttttccggtcctaaagaagggcggcaggcggaagaacagtctctgccgctgccggacgatggcacccacgcggtgttcccttcgaagccgtgccatgttcttgtctgggacgagttgcggcaaatactcaccgatgtgctca

SEQ ID NO: 93481 - DNA, 615 bp, Heterodera glycines
  SCN-specific regions: Sequence locations=1-11,33-132,154-480,502-615
gtccatttaagattaattcatattcattttgtttcttggaacaccttatttttcaatcaatcgccttaaatgatctcctgtcgtcgttcggtcagcaaatgtttgctgccacaaattacgaatcggttgacttccaattttggccatcttcagccgtgctgctcatcccaaaaggtgccaatgtgtgcgtccgcttccaatcgttcttccgtgcgtctttcagccattttcccacgaatgctttcgtcttccgttggtgacaaatcacatgagcggccccaaatgtaccaacttgaacacattcagaaacggttggaatatacggtcccgctgatgttcaacgcacgtctcgactacactttctacaccaaagatgtctttgtggacaatcaaattctcgggagtcaactcagaagcttggaagggtttatgcatcacatttctctgatcactgtcgccgctcaattttgttgcacgcatatcgaaacgcaaattttgaacatttcgcccattttggaggatggcactgttcgccttcgttggcgtatttgttacctcggcttgctgagcatgctgaacttccgcaattttaaccgccagtacagactgaaaaat

SEQ ID NO: 93482 - DNA, 501 bp, Heterodera glycines
  SCN-specific regions: Sequence locations=1-501
ctaaaagaaaggtcagcggtgtatttttcaaagaggtgcccgccattatggcctttccagctaacaaattgcttgtgtggcaacagaatgacatagcccagacttcttgttcaagcaaaccaaacactgatcactttctccaatttgcactcgaagtgtcgccaatcaatgggaataagaccaaaagagttttctatctgaagaggccttacgatgaccctttctccgggtttaaaagtcggctgaggcataagatcagtgagttcctcggagtgcaggacgaattggcagtgcaaccgatttattcgggggaccaatcgccggcggaagcgattgaagacgtcagtctgttcgatttgtttttcaatgccactgatccgtgctcgttgtcagcacttcgaattggcacgacagattacgaaattgtgcgcgattcggcttggctggataatgtcgaaatttccctccttccactggtcggctgtccagttttaccgagct

SEQ ID NO: 93483 - DNA, 413 bp, Heterodera glycines
  SCN-specific regions: Sequence locations=1-385
attctgctatatatttgtgtgactcgaaattcaacagcaaattgtgctaattgccaaaaaatgaacagacgttggatttgcaacgacgtttggatggacattttcccctcttttgaccgtcctcaactcggcctcaaattggcacttctttcgccacgtttcaatgcgttggggacaaacatttcgatggcaaaagcgaattgactatttggagaacgatcgaaattcgcaaggacaaaggaccagaaccgaagctgtctgtacaaatggatgacaaatgtgtgccatttccattgcccgaccgtccgttgcccagcaaaatttgctttaaatggcttcggattgagtaattaaaaaacagttttatggaaataaaagcggctctaaaaaaaaaaaaaaaaaaaaaaaaaaaa

SEQ ID NO: 93484 - DNA, 630 bp, Heterodera glycines
  SCN-specific regions: Sequence locations=1-630
ctcgacccgaccgtcgtcaaccgcatcgccgcgggcgaagtcatccaccggccatcgcacgccttgaaagagctcctcgagaactgcctcgacgccaacgcctcggccatcaccatcacgctcaaggacggcggcctgaccctgctcgagattgcagacaatggtcacggcatccacccgcacgatctgcccattgtatgcctccgcttcaccacgtccaagctgcgctcctttgacgacttgcgcaccgtcgccacgttcgggttccgcggcgaagctctggcctccctctcgcacgttgcccgtgtggccatcgtatcacgcacggccgactcggactgcgcttacgcctcagagtacattgacggcaaacccctcaacgatgcaatcacgccctgcgcccatccaacggtcggcaccaccatttcgatccacgacctgttttataacttacaggcccgccgccgggccatgcgctcgtacaatgaagagcacgccaatgtcgtcgacacgcttgtccggtacgccgtgcactatccgtccgtggccatgacgctgcgcaagcacggtgccggagtgcctgacgtgtccacaagtggtggatcgacgacggatcgtatcgacgtcatc

SEQ ID NO: 93485 - DNA, 450 bp, Heterodera glycines
  SCN-specific regions: Sequence locations=1-450
tgctgttctatccaatttgtctctgtgctgttcctcctctttgctccaaatccaacgacattttgtgactgcctccattttgcgaaaatgtccttcgtccactaagcaatttgcaaatgcacaccgttgcatcagcaggacacggactctcttcatgttcattcatgacaatgagatggagcaatgggccgagaaaatgatcgaccataaattgaaagaaaacggcttggacagtgcagacgtttgtttttccgatttggtccattggtggtattcgaatgtgtacgaatccactttgaatgtgcacggtcttcggcttctcgtcaaaattgcattggacaaagaacagagtcgacagtttgtcaggaaacggagtgctattgcggaactttgggattatgtcaaagacacgatgcctgccagcgatttcctcccctttttggtcatggg

SEQ ID NO: 93486 - DNA, 452 bp, Heterodera glycines
  SCN-specific regions: Sequence locations=1-452
gaatattccaatgaccaaaactctgtccgtcctcccctttctctccccaatcgttcgcccgttcagcgcaaaagcaggtggtccccacattatgaagcgagccaagggtttggacataatcccggatgactttgtgaacattgatgggctgcccgtggacatgcgctacgtccacccgcccggacgccctcacggtgctcagatgcgcatttggagtccgcatcaatcgccagtgtacgatggggtggcgcgtaagctcggctacaaaacgaggaagggctttcagcacccatagacaattggtcagtttgccacccgcacagaaatgcatagattgattaatgttcactggattgttctatttaattcctgtttggatattcgagtgattccaactccttcgaatgcaaattaaatttctctgtgttacaatgtgtataaataacattctg

SEQ ID NO: 93487 - DNA, 238 bp, Heterodera glycines
  SCN-specific regions: Sequence locations=1-143,171-209
agacgacgacgttgaagaatgcgcttgttcgcatgatcaaaggcaacaaataagcatgatcagaaaaaaacaaatgatcactttgacactttcgaagagagaaattccataatagttatgttggaagataattaagccttcgctaattgcttttttaaaaatttaatttgcttatttttttgtaatgttgataaatttggcttgcttttaaaaaaaaaaaaaaaaaaaaaaaaaaaaa

SEQ ID NO: 93488 - DNA, 286 bp, Heterodera glycines
  SCN-specific regions: Sequence locations=1-159,192-286
aaatttttaaaaattttccagcaaataatggaaatttttttcgaattcccccccccccaaacgaaaattaaaaagtttaataggcaaatttcgtaacaggtagcactcaaattgccaaaaatttttcccggcggcgcctatcggcaccgccggacctacattttccactatttttacaagttttttgccttaaaacggccaaaatttggtcatttttagtgaaaaagtgcagttgttacccagcagtggaaaaaaagttattggttaaatagcaaaaaaaaaaaaa

SEQ ID NO: 93489 - DNA, 379 bp, Heterodera glycines
  SCN-specific regions: Sequence locations=1-25,84-92,116-182,261 -293,322-379
aatgagaattaaagaaaaaaacttcaaaaaaaagaaattataaaataaaaaatgaattttaaatgaaataattaaaaaaataagttacaaattaaactatccaaaaaacacctcactgtcacgtaatgatcatgatcattggcactttgattctgttgttcttgttgctgttccattggttgaattttaattgaaaatattttaatttactaaaataaaaataaaattctttaataagcatttttcaattttaattttaagtttgtgaatattagtcccggacctttttccactattaaatttcaaaattaaattttaaatggttccgttctgcggcttcatcaaagtgcggtggcacggcacattctctcattgctta

SEQ ID NO: 93490 - DNA, 398 bp, Heterodera glycines
  SCN-specific regions: Sequence locations=1-335,357-363,388-398
ttgagacgaactgctcgaacttcttcccgctttgctttccatggaccttgtcgacagggcgtgtcgtctgcagaatgaaatgctcacttttcttgaatttgttgctgaagtccatgcgcaactttggccctctcatttggaggcatttcatttgacgggtcccctcgcattgcatttcgattcaaattcatgtgaaccaatgcccaggaaaattcacctgacagatgaacttatgccgccgaaactgcgctcaaagggcacagaatggaaattggaaattgtcaaataataaaaaaatttcctttccccagtgaattgttgacttataaaatcaaagttttactatcatcccacactcatttgttgattttgttcaattttataaatccaaattttta

SEQ ID NO: 93491 - DNA, 609 bp, Heterodera glycines
  SCN-specific regions: Sequence locations=1-78,100-347,375-609
gggagacgaagcagtcgggaaatgagaacgaagtggtactgacagggtcggggactgaatcggcagcaaacagttcgatggacattggcaaaaaacagccgaaagaaatgaagaacgggaatttgctgacaacggtttatccgaaggacgttcccttctcttggataagtcggccaactttcgatgtggcggcaatgccccaaattttggccaacccacaaaatcggctgactgcggctgcgtttgccgacatcgtccgttcgattcagagggattcgcgcttcgtcagttatgcgttgttttactcgcggatggtccccgtttggctggtcttttccatcgtcattcttctggccgtcctcgcctcctcccccatgggtggtcttcccgtgatggttttcgccttcgtttggctttttatgctcgtccttggccttctcttctgcgcccttctccaaaaattcattgttttggcccttcgggtcctcgtcaaggaaatcaacgccatttcgcagacttttcgtcttttggtcggaattcagaacagagggatcgttttcattttctacgatttcgatggctgccgcgaggacatcgcccgccaaattc

SEQ ID NO: 93492 - DNA, 472 bp, Heterodera glycines
  SCN-specific regions: Sequence locations=1-165,188-472
ccgcctccgacatcaacgactggacccaagtcgcccaccccatcaagggcaaggagctctctgagcgccgcaaggtcctcattgcctacgactcgtcgtcctcgggcgactatgctctccaatgggctttcgacggcctcatccaggacggcaacgaccacgtcatcctcgtcacggtcgttgagcagtcgcaacccttgatccggttcaacttcaacaagggcgaggacgagatccgcaccgaaatccaaaagcgctacgaagccatccaagccgtccacgagacccttgcctccctgttccgcaagcgcgacatctcctgccaaagctttatcctcgaaggtgatgcccgcgacgtgatcctcgaggttgccgacaaggcccgcgccgactgcatcgtcatgggcgcccgtggtctcaacgccgtgcaccgtgccgttctcggctcggcctcgctcttcatcacccaaga

SEQ ID NO: 93493 - DNA, 288 bp, Heterodera glycines
  SCN-specific regions: Sequence locations=1-262
attttaaaatgcgatttttccttttctttttgctcatccttgcctttttggccccagcagcacttggcaaaagttttaagaggcgaagtgtgtctcttgacactgtgcaaaattggaaaattgaatgggcagcaaatgcaaatgacgggccaatggcatgagagaaaatggcacactgactgaccaatgtgatcgatgatcattatgagcaaagccaaaattgtgaatggatggatattcgtgataaaatttatctaacctgaaaaaaaaaaaaaaaaaaaaaaaaaa

SEQ ID NO: 93494 - DNA, 433 bp, Heterodera glycines
  SCN-specific regions: Sequence locations=1-1,32-161,191-433
aaaatctataaaaaatttaaaaatgagatttcatgcgagattttctggaaataagtttgttttggcctagttaagctgtaaaaaaaatttggggcgatttgaaagagaatagaaagaactaggttcgatgaagttttggtaagccaaaaaaatatccaaacatttaaaaatctataaaaaatttaaaaatgagaattcatgcgagattttctggaaataagcttaatagggcctagttaagctgtatttttatttggggcgatttgaatgagaatagaaagagccaggttcgatgaagttttggtaagcctaaaaaaaatccaaacatttaaaaatctataaaaaatttaagatttcatgcgagattttctggaaataagtttattttggcctagttaagctgtaaaaaaaatttggggcgatttgaaagaga

SEQ ID NO: 93495 - DNA, 477 bp, Heterodera glycines
  SCN-specific regions: Sequence locations=1-427,449-477
cacgagggcgatatcggacgcagtcctcgcatgggttaccacgcctactctctggcccggcagggggcgtatgtgaatttggtcggttacatggacaatcagccccatggagatgtttttggcgaacaaataaatttcgtcgcacttccaaagccgccgatttcttcgtcttctgacaatcctttccgtcgctttctgatccgtttggtcaagatggtttggcttctctttgctattccatacgccttttttgtgctttgtcgtggacataggcaccgtcagcttattatggtgcaaaatcctcccggaattcctgcaatgatcgtttgctacttgttggcaaagattcgtttcgctacttttgtcgtcgattggcacaattattcgagttcaatgctcgacaactcgtggatttcttatttggtcggtttgatcgaaggatttttcggtcgaagggcttcgtttaacttttgtgtg

SEQ ID NO: 93496 - DNA, 476 bp, Heterodera glycines
  SCN-specific regions: Sequence locations=1-144,166-476
caaagtgatcgaaatcagacgaacccgacggatcatccaaaggctaacggcacgactccgcgcaacgcaatttcaaagccattcaaaaagcaagggacgtccgtaagagagccattgcggcgaaggaagcgcggggcgaacctacgccgcccgaaccggccgccgtccccccgccggtttatcgtcaaagtcccccgacgggcaattcgcctccccccacttacgaagactctctcctgcaccaattcttcatggaatgcgtctcagtgaacgaaaatggccccacaatttgaaaactggttaagcttaaggccaagaagtacgtgaagaggggtgcattattggccaattcactggtgactcagacaattagcagaacgatctcatagtccaaagtttgtttagtcataatattttgtacaattcttatgaaatattttctctgctttatacaaatatttgaagcaataaattca

SEQ ID NO: 93497 - DNA, 442 bp, Heterodera glycines
  SCN-specific regions: Sequence locations=1-16,38-42,124-367,391-442
ccgtctcctccgttcgcccactctctcacgatgctttatccgtccgttttgtccccctcttccttcgccatgttcgtctacctctttctgttcttctcctgctcctgctccatctctttgtccgccatttatccacctcaaaatggcatttcggaggaaaagcgcggcttttccctcgtccgcaatccttactcatggatggcacggcttcagcagaatctatctgtccccgttggattggacgacgtttcatcaaaaaatgacgaacaattgctgacgaatcttttgctggaagaacccctctctaagcgttcgttccccgccgccccgcgacgtccccaaaatccctactcgtggatgtccttcgccgatgccgatcagtccaacatggattggctgatcactcggcttcgacctttctccgatttggtctccaaacggt

SEQ ID NO: 93498 - DNA, 564 bp, Heterodera glycines
  SCN-specific regions: Sequence locations=33-60,83-528,550-564
cctcgtgccgaattcggcacgagggacgcactaagcaaacgaatatggcagatttggaccaaaataatgctcggaatgaaagcgaaggacggagcgaaagtaccaacgaaatccgcgcgccgatcaccgaagcagaaattagggcgaaagaggttgtgatgccggacgatgtgctcggattgaactgcattactgaaaatttcctctgccgacccgaggataatgtctacgacattgagtttgtccgcttcaaagtgcgcgacatcgattccgaaactgttctattcgagattaataagcctgacgcagcagcgaacgacgactgttccgaagctgggggtaatagtgatgaagcggaggaggaaggcaatgctgaagagggcgacaagcctttcactccgcggtttatccgatactatttcaaaccatcttttttgcgacttcgtcatatcggcgcaacaatggaatttgtcgtggggaataaacccataaacaatttccgaatgattgaacgacattacttccgagatcgacttttaaagagctttgacttcgattttggct

SEQ ID NO: 93499 - DNA, 527 bp, Heterodera glycines
  SCN-specific regions: Sequence locations=1-347,369-389,411-527
atttgtggtgacgccgtcggcacagaaattcaaatgggtgaccaaatggcaatggttccgacacaatcgactccgatggaacagccaaattgtcatcagcagcatgacgacgtgcctaaaaatggtgagcatctgacaatgaaccgggagttttacagaccaacaactccgagcagcacttccgtcccgaaaaagcgcacttttgccgaaatttcgggtttcgactctctgaccgactcagcgcatgcaacagcaaaagtgtcgcgcatcgctttgatttcctatccggctgctccgcccgcagtgctcaaaagttacacggacgaccggcgatacacaatgtgccatttgcagcagaatgagaggcaaaatccgttggaaattgaagcgcagaattgtctgttggatttgcgtcaagagttggccttcgtcgactcgttagacccttccctgggccaatgtttgaccaactcgcggcgtttgctgatcagcgagtcgatgaaattggaggagtggcacaaccccga

SEQ ID NO: 93500 - DNA, 195 bp, Heterodera glycines
  SCN-specific regions: Sequence locations=1-195
gttttcctcaaaactcggcggatggaacaaagcgcaaacggtgttcgattttgtgaatgaagaaaaaatgtcgcccaatatttcttctatgcttcttcagatgcctaattcttctgattgactgatctcacaaatcaatgcatttttaaaagcaatttcataaacttttttttgacaaaaaaaaaaaaaaaaaaa

SEQ ID NO: 93501 - DNA, 320 bp, Heterodera glycines
  SCN-specific regions: Sequence locations=1-230
ttgcatcggacgagggaatgatccgtcattggctgttatttgccaagagatcataaacggacaaaaagcattagaagaaagaagcgatggaagtgttaagagctttctcgctcaatcggcccattgaatgtgtgtcaatttctggtgaaaaagtctaacgactgttctgccgtttagagaattttagggcaatggaaaaggagaaactttggggagggattgaatttcgtgagaaaaacggagaatggaaggaagagatggagaggaagaaggagcagggagaagagagagagcagagcggaggtaggggccagaggggg

SEQ ID NO: 93502 - DNA, 272 bp, Heterodera glycines
  SCN-specific regions: Sequence locations=1-126,148-230
gctagaatcaactttattgggcatgaatcccgattttctatttcatttcgtatacactgcgactcacaattttgggctcccgatcgaatcgccgaaaagctgactgaattgggcgcggccggaacggaaggaaagtgagggatggaacttttcatcttggaaaagcagttcctcaagaaattcaaaaatttatttaattactcattttaaaaacaatcgaaataattggcaaaaaaaatttaaattattattaaaaaaaaaaaaaaaaaaaa

SEQ ID NO: 93503 - DNA, 390 bp, Heterodera glycines
  SCN-specific regions: Sequence locations=1-82,259-327,378-390
agaaaaatttattcggagataaacgttcctgagaaatatctaccagataatgctcagtcattacaaaaaaaacaacagatagtaaaattaaaagaaaaaaaaataaaaactaaaagctttaaaatttttatttttacagaataatattttaatatttaaaataaaaacttaagaaataaaaatattcaattttttttacctattaatatgaaattaaaaattctaaaattaaaataaaaaatttttttttttatttaagttctcacaaatctaccttactacaacttatcccaaaatataaataaggaactgatggacaattagtactaaaaataataaaaattacaaaaaaaataaatttttttttacttttttttcctattaataaac

SEQ ID NO: 93504 - DNA, 498 bp, Heterodera glycines
  SCN-specific regions: Sequence locations=1-52,87-498
ccttttcctcctccatcttctcgcttaataaatgttctgctcaaattcgctgttttgcttctgcttcttccttttcttttccattcattgcgcttttggcgtcaaatttcgcatcaatggcactttgaagtgccgttaccgcgagggaatggagaagccgtatcgcaacgaggcggtcatccaactttgggaagcggatgccaatttatttggcttcattgacaaagacgaccttttgggggagacgaaatcttcgaaaggggacggcgtttttgaactgaaagaaacaaaggacgagtgggaaatgggcgagttggagccgtacttgctgatccgtcacatttgctggggcgaatctccgccaggggagaattgtgccctcctctcgcgcatggaccttcagccgacgcccgccgcgaaaatgcttccgccgatcattttgggcatggacagtcaattgaaaacgatagtgatgtgctgatcagaacgaatggatca

SEQ ID NO: 93505 - DNA, 568 bp, Heterodera glycines
  SCN-specific regions: Sequence locations=1-298,327-568
cccgtgtgaagaacattgataagcgggataaagcatccgaagaataagcggacaaagcttctccctttcgtaaaaacctcaagtcacaccctctgtggaaataacgaagaaaagaagaccagcagacaacgagagacatcggagagaaaacggggggagcgagagaaagaaagagggagagaaatagagaagatcagcagattttactgaaatcgcccggcctcgaatcctctccccaaagaattttctctcccgccgtctgaagagaacaaaaagtttctagaagttaatccgaactcaagacaacaacatcaacaacaacagcgaaagtgaccaccaattggcgacagaatcagcggaaggggcggaaaagtgttgggatgagagacatttttggggagagcgcattgagctttcgacggcgcaaattgactgtgttcatcgggtggacaattgtctgtccatttgggttttggaggcgagctgtctttggacgggcaagtgaaggggatgagcgttggcatttgcttttgggacgagtccatcgagttcggctccctccctcact

SEQ ID NO: 93506 - DNA, 654 bp, Heterodera glycines
  SCN-specific regions: Sequence locations=1-527,561-654
ttaaattaaagcaaagtgatcattcacgagcaatcaatcccattccacgggttcaacggatttcagacgaataaatagcgaagagatattagagaaaacaaagaaaagatacagagtgctgaagcaaatgaacgtgacaccgccatgttgggtaatttggagttggcagaattgaagaccgtctccacgttgggagttggggggtttggacgggtcaatttggtcaaacacatcgacactgaacgggtgtacgcgctgaaagtattgaacaaacggcatgtcaaggagatgaaccaggtcgaacatgtgctcaacgaacgcagcattttgctgagctgtcattgcgatttcattgtccgtcttcacaaaaccttccgcgactccgagagactttacatgctcatggaatattgtcccggcggcgaagtttggacaatgctaaggaattggggccgattcgacgaggcaaccgcgcgcttttactgtgccgcagcattggaagcgtttgattacctgcaccggcggatgatcatctacagagacctgaagccggagaacatgctgctggacatcgacgggaaccccaaattggtcgacttcggatttgccaagaaattgccgacggagggctcacgggcatggacattctgtggc

SEQ ID NO: 93507 - DNA, 612 bp, Heterodera glycines
  SCN-specific regions: Sequence locations=1-106,128-612
agaatggataagttccctcagctcagccgagtgccggccccgcccggggtcaattctgatcaagcagcgatcagcctaatggcaatggctgaaattttccgcacggcgaataaatataaaatggccatcaaatgcgttatgacttcgctgcgcgtcccctgctcttctgaactgttcgcactttgttccttcgaattgggaaaacttttgtggttatacacgaacaatttggagttggcccaattccatttgtgccaagcgcataaactgatgcgacagttgggtcccggccttgaacagccgcggctgaagacggccactcttttggccgaagtttttctcgcgcggcgattgttctccgattgcgttcagctgttgcgttctgagctgcccgattcgcaaaagtgtcactccgtccacacaaaaatgcttttcctcttcgccgaggcgtaccttcgcctgggcgacttcaacggcgctttggacatcgttcgtgccggcgtccaattctcgcggggccccggatggggcggagtgatcgccgaatgttactttcggctggtcaaatcgctggtgctctccattcaaatgactgatcagcacgaattggga

SEQ ID NO: 93508 - DNA, 618 bp, Heterodera glycines
  SCN-specific regions: Sequence locations=1-161,184-618
atttgccacgtgtacatcgaccgaaagtgcgacgaaaagatggccattgacattgtgcgcgactccaaatgtgactacccggccgcctgcaacgcggcggaaacaattctgatccatcgtgaccatctcagcacgccgttcttcgaaagtctttgcggaatgctcaaagcggagggagttaagctgcacgcggggcctaaacttcagtctctgttaaaatttggaccgccggccgccgattcgcttaaatacgaatacggccgattggaatgcacgttggagatggtggataatgtggcggaggcggtgaagcacgtgatcagatacggcagtggacacaccgattgcattgtgacaagcgatgacgccgcagcggaacaattcctggcccgggttgacagcgcatgtgtgttccgaaatgcctcaactcggttcgcggatgggtacagattcggacttggtgccgaggtgggcatcagcacgggacgaatccacgcgcggaggcccgtgggaatggagggacttctcaccaccaaatggcttctccgcggcgccggacacacggcacaacaattcaaagtcggcgggccgctgatatacctgcacgaaccgttgaac

SEQ ID NO: 93509 - DNA, 413 bp, Heterodera glycines
  SCN-specific regions: Sequence locations=1-259,281-413
attaagcatttttaattgtcgcttccgttttttattctcatttttatccgcgattgtcgactcaaacaaatcccacaacagaacagcagcagcaactgatggcgggtcgtgcagtggcgagtctttcgcgtttctctgttgtttatgtgaccgttccctccgctgaaattggcaaacgaattgctcatgaattggtccgcagtcggttggccgcttgtgtgaacattgtgccacagattacttcattttttttttggaagggaaaggaggaggaggacagcgagtcattgctgatcatcacaacgggcagagaacggctggaacagctcagagaggcagtgatcacactgcacccttacgaggtcgccgaatgtgcggcatttccaattgagtacgggtcaccacccgtactt

SEQ ID NO: 93510 - DNA, 626 bp, Heterodera glycines
  SCN-specific regions: Sequence locations=1-1,24-546,568-626
gtttaattgttattttaatatttatcaaaacatgtcactttcaaatgttcacacaaatttggtacaaaatggaaaagaaactaatgacccattcgctttttcggctgctgaccacccacaaaatgttggcaacaacgaatcatcgtcatccattgagcagaaaaggcactttcgcaaaagggttggacaattggaattggaattggccgactctcagcaaatgtgtgaagcggtgaaacacgaaaataagctcctcaggatggagttaaaccaccaaaagttgctgacggaacattacgcgctgcaggcgaaagttgccgcaatggaaaagggaccgagaaaagggcgggaaatggaattgcttcatgaccaagttgctcacttgaaagaagaacaggagaaaatttatgttaaatctagcgaattggaacagtttaaggcgaccactggccaagttgatgagttacggaaagatcagaaaaatctcttggaaagaatcagcacagaaagtgagcaacagcagaacaattttgaaacactgaaggggaaactttacggaaagattgccgaaacggacagaaatgttgaagaattgaaaaaacaatttggaaatgtttcgcagtgtt

SEQ ID NO: 93511 - DNA, 586 bp, Heterodera glycines
  SCN-specific regions: Sequence locations=1-586
ttttgacaatttctaacttccaatgaaacgaaagaggagtaatacatcacgaaatctgcaagtgcaaagtaatggcgtcccgacgaaaattccttcggaacaaactgctatcgcagctgccgccaagcaatttaaaactgatcagtcaaatcttaggctttctgatttggggggatgcgaagcgcaatttttggaagcgattcaactgatgacacacctcaaacatcccaaattatgcgaacaaattggtttcacaccgcccaagggattgttgctgcacggaccgccggggtgcggaaaatcggcatttgcgatggcattagcaggcgaacttcagttgccaattctttccgtttcttccaccgaattggtcgccggtgtttcgggtgaaagtgagcggaaaattcggacgcttttcgcagaggcaaaaatggcggcgccggcgcttttactcatcgatgacatcgatgtgatagcagcgaaaagggaaaacgcgcagagagagatggaaagacgaattgtgactcaactcatcgcatcaattgacgggctaaagtctgaaaatgacaatgagtcgtgtacagtg

SEQ ID NO: 93512 - DNA, 211 bp, Heterodera glycines
  SCN-specific regions: Sequence locations=1-161,184-211
cggcgcttgcgctcagacatgtttgctgattgagatcagcaaagagcacttcccagagggctatgtgccaacgggtctttccacaattatcgccgagtacatccaggagtatgttaaacgagtcgaacttgcgctgggcgacaccgccggacacgaggactaccaccgactcctaccgcttctttttccggatactgagccgagtcagatg

SEQ ID NO: 93513 - DNA, 602 bp, Heterodera glycines
  SCN-specific regions: Sequence locations=1-602
gtccatttaagatacctacctcatctttttttgatttatttgcctcttaagtgatttgcatatttctctcaaaaatgtctgttcgtcgtataaacaaaattctgtttcgatttcttaaggagctgattcttccacctcgaattcaagccttgactaagatttatcctgctcagaaagtgtcctcatatttgcctaaggcagcgaaacctggcaaatcgccgatgcgcaaaattcttactgggagctttcgcgctctccgcaacagaaaccaattgcttcggcctttcgtatctttgcattcttatcacattcgactcaaagaattggaaagggcgcgtggttttctgtccgttcgagtaagcgagaagagagatgtgttggaacgggtgaagcatttgttcggcaccaatgttcgctacaatcggtcattggcagtcacggaactgccggatcatttggacggatacgaaattggtgccttcattgccaaggggtgcaatggggcggtgcacgagttgaaactgcgcgtcgccgacggacattcgcggcgcatcgctccaatgacttcacagaaggaatttccactcgccctcaaaataatg

SEQ ID NO: 93514 - DNA, 632 bp, Heterodera glycines
  SCN-specific regions: Sequence locations=1-632
gtttttatccgtccgttttaatgatccgtggcttttttaaacaatatgataagaatttggtggccaaatttaattcgctgaaaaacaaggcttggcgcgttgcgatgcccggctcaaacatccgaaagttggacactaagtccatcagtgggtggagtattgtcgtggacatcgccttcaatgcactaatgaagggccaagtggtggccgtgccgaccgacacactgtacggcttggtggcgttggccgagcactcggacaaattgtacaaaatcaaacgacggtccgtccaaaagccattggggctgtttctcgacaggcccgagagcataaagaagtactgtgaccaaactgtgcccgatgagtttctccacctcatttaccccggccccgtcactttgctgttcaatcgcaccgatgccgtcccgtccgacttcaaccccggctgcagcaccgtcggcgtccgtgtgccgcaggcgaagttcgtgcgcgacttgtgccgtcgcatgcccttccgactgctcgcgcagacgagcgccaacgtcagcggaggaccgaatccattgtgcatccgagattttgaagagatttgggacgacatcgatttgatcgttgacgcgggcgaaatcatc

SEQ ID NO: 93515 - DNA, 395 bp, Heterodera glycines
  misc_feature (375)..(381): n is a, c, g, or t
  misc_feature (383)..(383): n is a, c, g, or t
  misc_feature (386)..(389): n is a, c, g, or t
  misc_feature (391)..(391): n is a, c, g, or t
  SCN-specific regions: Sequence locations=1-167,189-395
agaattcgagccttactttactattatattatccaccatcacatagcaaatgctacaatttgcacttctgctgctctttatggtgtcatcatttgatccctccgctgaatttatggccaatgaccaaattagtgcggtgcaacagcagcaagctgtaaaaccaattgttggctggcatttttggtgggacggacgaaatcgaaattggatagcaaaaaatgcggaaaatgttgaaaaataaaagaaagcaaatgaacaatcgaaaatggacagaaaataaatggcgaaacattttataaaaatggcagagataagtgaatttttgtggctttcttggaaaacgacgaaagattggataaatacatatatttgttnnnnnnnanaannnnanaaaa

SEQ ID NO: 93516 - DNA, 487 bp, Heterodera glycines
  SCN-specific regions: Sequence locations=1-451,473-487
cgaagtggaagtcagcgagaagaaggaccgtgtgacggaccctctgtgcctaactcgtgcggccgttgaggagggaattgtgccctgggggggtgatgcattgcttgacgccttgtacaacttggactcactgaaaccggacaatgatgaccaccagagcgtgatcggaatcctgcagaacgctattcaccaacctatttccaccataatcgccaatgcacggcttgagccctcagccattgtggagaaagcgttggccaatgcagagaccaactaccggtacgatgccatgaatgaccaatttgtcaacatgttggaagcgggcatcatctacccggacaaacgtcgtgcccgacggcgttgcacgacgcggccggcgctggtctcgttgatggcgacgacggagtgcgttgtcaccgaaatcccgaaagaatagccgacgatgccatccggtggtggaatgggtggcatgggcggtggaatgggc

SEQ ID NO: 93517 - DNA, 601 bp, Heterodera glycines
  SCN-specific regions: Sequence locations=1-202,243-286,311-488,510-601
aacgcccttcaggcggccatggagggttaccaagtgagtacgctggacgaagttgctgacattgctcaactcgtggtcaccaccaccggctgcaagaacattgtgaggggtgaacacatcgaacggcttccggaggatgccatcgtttgcaatgttgggcatttcgactgcgaaattaacgttacctatatgaacgagaattgcgtgtccatggagcaggtgaagccccaggtggaccgctatttgatgcgcagcggtcggcacgtcattctgttggccgagggccgactggtcaatttgggctgtgccaccggacattcgtccttcgtcatgtccgctagtttcaccaaccaagtgatcgcccagctcgaattgtacacgaaatacggcactccggacgcttacaaaacgggactgtaccttttgccgaaacagttggacgaggaggtggcacggctgcacctggacaagttgggcgccaagctgaccaaattgagcaaggaccaagccgaatatttgggcattccccaagagggaccattcaaaccaggccattaccgttattgaaaagcagcggatggaaggagaaaagcggaaagaa

SEQ ID NO: 93518 - DNA, 411 bp, Heterodera glycines
  misc_feature (389)..(405): n is a, c, g, or t
  SCN-specific regions: Sequence locations=1-156,179-199,222-411
caagcggaaataatgcgcgcgggccccgtcaccgccgccttccgcgtctacgaggactttggccactacgcaagcggcgtttatcagcacgtggcgggcaaataccgcgggggccacgcggtgcgcgttatcggctggggatacgacacggacagcaaattgccatattggctggtggccaattcgtggaataccgcgtggggcgatggcggcttcttcaaaattcggatgggcactgacgagtgcggcttcgaaacatcgggcatttgctttgccgacccggaccaatccaactgaaatgcgccctctaaatgaacgctttaattatggagaaaattaagattaattgttataatctaatggatggaataaaccacataattagttannnnnnnnnnnnnnnnnaaaaaa

SEQ ID NO: 93519 - DNA, 733 bp, Heterodera glycines
  SCN-specific regions: Sequence locations=1-508,533-710
taaggacagtggaagtaatgctggacgtccttaaattcatggattattaccagaactgcaaaatggaactgacatcgattggtttcagatcggtaatcgaccgctacagaaacgaattggcattgtgccaattcttccaaattcaactcattcccgaacccgccgttacgcttaccgtataccgccgtgccatcgaaatcactgaacatttctacggtataaatccatcggaagaatcagccgcaattgaataagagatgggaaatgaaaaatgggtccgacttctcgcgcaaaaaccgccacttttcgcatttcccgacatttcatttggctcgcaaatccaacacgacggaattgacagttttttgttgttcatcgcaaagaatgaagacgatgaacaggcgaagctgtgtttggagctccctctataccccgagacctccgatgatctagccctgggccgcttttggcttattcagctttcccgagcccactttcgctggatggacttcgggtcgcttcttctttcaaccctgatctgatcaggggctttcctggccttccccaaaagggccccccctcgggctcttcgtccgtccggatttggtttttccagtggtcaaccattgggcaccctcacaaatggcccgccccccgaaggaggacaacacaacccaaccgcgttttttggcgagattggctttttcgcgtattttccggatggggccccatt

SEQ ID NO: 93520 - DNA, 406 bp, Heterodera glycines
  SCN-specific regions: Sequence locations=1-112,150-215,237-406
atcaattcaaaatcgatttatttaatattcttcatactccatggaacaaatgaaacaaggagtacaagatgtacctaaatcagttaaaatagcaattggataaaacaaacacataaaaaatagaaattaataataaattatttattttactggcaaaaaggcgtacctcttctctattttatctcacaaagaattaaaatttttatcgtttcgattaaagacataaataaaaatttagaactattccttccaagaaagaaaatgactcaacattaaattaggtattaaataaggaaccaacttttttgaataattcacattatattcacttcgtaaagctttgttatcattgaagaagatatttatatctattcgcgaatagtgtttgagcgagggtgtactggga

SEQ ID NO: 93521 - DNA, 534 bp, Heterodera glycines
  SCN-specific regions: Sequence locations=1-62,87-190,212-534
tgctctttgacttgcgcaaaaggattttcttgtgaggaaggatggtcaaaaattggaataaattgttttaaggttttcactttttatggctcatatggcgcagaaaattttgccaattcaaaagaagccaaatcacgttgtgaagcattgggtgcaaatttggcttcactccacagctcgtttgagaatcagtttgttcaagaacttgttcgtaaatcgtacacccaatgccaaaaggacaatgtgccgtggtgttgtgactcgtacacttacgatggctattggattggcatgagtttgactcgcgcgagcaatggcacaattttgagtgccaaatggtcagacggcaccaacacacactacggtaatcccctcaaatttgccgaccgtacgccgtggtacacgcccgaacatcgtccgaaacaggacagccccgaaagcaattgtgtgttcatgttgctgaccaattcaggcatcggttgggccgactatgactgtgccatggcgaaaataggtggctatgtgtgcaaaaag

SEQ ID NO: 93522 - DNA, 268 bp, Heterodera glycines
  SCN-specific regions: Sequence locations=1-55,91-144,186-268
gcgagagactcaccttgttctcgggattgcctcggtgtgctctgtgctggttatgatcgccacagtcgtcactctgccatctctgtactccgatatgagccctatgaacagcaacgtgcgcgacggagttgacggcttccgcggcaacaccgactcggcctggactgacttgatggacgtgcaagtggtcgtgacgccgccgatgaagcctcgggataaccccttgcactccatcttctgtgccatacgtggactgcccggacgctgc

SEQ ID NO: 93523 - DNA, 697 bp, Heterodera glycines
  SCN-specific regions: Sequence locations=1-80,103-697
cctctcgaatgaatacaaaaagaaccctctcggccgattggcatttgacccgctaaaagctctttcctcaaattcgcttttctcttgtgccgctctctcttccaaaaatgccatcggatattcatcccgagccatcagtttcttcgagaattccctccgcctcttcgaccgcaccaaatcggccgagtccgaggtggaaagaccctttggtagaagagttccccgctgaaagatgggaaaacggacaagcggaaatgttggacgaagacggaaaaagaacagcgagaaaaaagggagatggaggagaagcggatgggaagcggaggaagagcggaggaagttcttctcggacgaattctacggggcatttccgcacctgagagggaccgaatcagtgaatgccgaacggtggaggacgaggagaaaaccatttgaggaagagtgttcttcacatttggaccgtttcgaccgtaattggagagacgaccccttttggcgcgatttgtacccgcgctgggccgagaccatctttacagatggcatcgacgtctaaacgaacatcatcaacgacagtaaccgtttcgcagtcgagatggacacttaccaattccgcccggtagaacttcgtgtgaacacgatgggagacactttgctgattgagggacgggcagaagatgttcgagacagagagcattac

SEQ ID NO: 93524 - DNA, 349 bp, Heterodera glycines
  SCN-specific regions: Sequence locations=1-310,332-349
ggacatccggattaaagacgtggaaaaatgggataaaacgtacaaacccgagtttttctacggaaaggccccagatatggaagttgacagaaaggcattggcacgaactacctcaattttgcactaccatgacgaaaaattagacttggccggcaaagatgaatggcaagaggcgaacgctaacgaaatcattgactttctgaaagatgctaccactgatttgctcccggatgtgatggtcagaatgggacgcccagaaggccatttggacgagatgcttggctaagtgttccagccgggagtcaacgcatttttccactttttgataaactattgaatgactcctggc

SEQ ID NO: 93525 - DNA, 202 bp, Heterodera glycines
  SCN-specific regions: Sequence locations=1-63,89-180
tgagcttgtaaaatccgagctcggattcgtgatctgcgcattttttcagcccagaaaatgtgctatataaatttttaaatttaattttcgaagaaaccacaaaactttaccattgccccataatatcttattttgcaattggaaaatctattttttaaaatatcataaaaaaactattcgaaaaaaaaaaaaaaaaaaaaaa

SEQ ID NO: 93526 - DNA, 528 bp, Heterodera glycines
  SCN-specific regions: Sequence locations=1-426,448-528
ttggatccaaactcacaaatgccgactgaaacaacggaatccaacgaaaagaaagaaaatcccgaagacatttcgagcactgtgttctttgagcatcagcaggaattattgaatgagacagtttcgagtggtgacgaagattttcgttgtgtgtctgtaacatctaacgaatctgagattcaagaacctcgcttgtcaactcccacctcacaattgccgactgaaacatcggattcaagcggaaagaaagaaaatcccgaagacatttcaagcactgtgttctttgagcatcagcaggaattattgaatgagtcagtttcgagcggtgacgaagattttcgttgtgcgtctgtaacacctcccgaatcagaggttcaagaagctcgcttattgactcccacctcacaaatgccaactgaaacatcgaattcaaacggaaagaaagaaaatcccgaagacatttcgagcactgtgttctttgagcatcagaaggaattattgaatgaatcagtttcgagcggtgacgaa

SEQ ID NO: 93527 - DNA, 616 bp, Heterodera glycines
  SCN-specific regions: Sequence locations=1-263,285-616
cttcattctatgctgctcttcacttgatcctctcaggcttcttcaaactcttccaagacccaatcgcaaatcaaccaccaccaacatgtcctccccgtccccagtccaacgcgcatcctcgccaagctctgcgccccgtaccgtggtgctcgccatggacgactcaacccatgcttggcacgccctcgaatactgtcttgccaacgtggtttcgcccgcgcgcaacgaccgcctgtttatcgtgacggtcgcgctcctctcggacacatggctcgaatccattgccaccgcgctgcgcgccgacccgggcaccatgggcgtgccctttgtcccgtcggcgcactctgccagcgccgaccgcgagttgacggatcacacacaagagcagctcaagttggcgctcgacaaggcaaacatgttgctgtcgagggcaaagcttgccgtgcgcgcaaatcccgacacgaggaacatgcacgtcgagacggtggcgctgcacgatacggacgcgcggcaggttttgacggattacgtcaatcatatgtcaccaaaggccgatgtgttggttgtgggaagtcgcgggttgggcgccatcaagcgcgccatggtgggctcaaca

SEQ ID NO: 93528 - DNA, 255 bp, Heterodera glycines
  SCN-specific regions: Sequence locations=1-255
ttcttatcatcgaccaaggctcgatgacccttgcacagttggtggcagcgatagaggcgttgcacgcagaaactattggccgtatgaatgcagttctcggtaatcgccggtgcgaattgcctgttggccagccaattgccaacgaggaccgttacttcggacttgtgaattttcgggctgaagacgttgtgttcgattgtgcggtaaaaacgcgaaattccccgcacggggttattcgggtttatgtcaaatacg

SEQ ID NO: 93529 - DNA, 430 bp, Heterodera glycines
  SCN-specific regions: Sequence locations=1-430
caaattatacgaaaatggaaaagcttgccaaaattggcccaaaacgatggcccaacttccgttgttcaacgatttctcgaagggtaatagccgtgccaattcctgcgttggctttgcgcccgtttcgggcgcacacgaagaagcactgaagacgaggcgaacggtggtgaaaatgctggtcgcttgtgtgtccgtctacttcatctgctactcgccaattcaggccattttcttatgcaggggtctcttcaacttgtccatccatcccccctacgaattcgtccttctgatgaatgccatggccattctttgctccgcttgtaaccctttgctgtatactctcttctccagtcgtttccgcgcgcgaattggccatttgttgtgcctttgctgcgacattttctatcgccgccacaataagtgaaacgcc

SEQ ID NO: 93530 - DNA, 469 bp, Heterodera glycines
  SCN-specific regions: Sequence locations=1-243,373-469
tccggttatggttacttgcgcctactagaccccagcccaccgattgggacaattacaattggtgctgcactttcccttacttcggctcctggaagccctcctgctgcccttttgccattcccacgggtgccgtaatcgccgttattattgcgtgcattatccttgtggctgttttggtcggcctttcctgctggtgctgttacttctgtccattgtacaaacatttgtacgaaaacgacgacgaagaagcggaggaggagcaaaggcaaagggagggataaaacagaggaaaagcaaaggaaaagccaaaggaaaagcggaggaaaagccaaaggaaaagcacaattgggggaagggagggaaaaggaaaagcggagggacagcgaaacagcggggagaacggaacggagcaaaaggaagaattgttggcaattcattttattattatttcttgaatccatttgaaaac

SEQ ID NO: 93531 - DNA, 631 bp, Heterodera glycines
  SCN-specific regions: Sequence locations=1-50,111-139,161-296,319 -401,423-437,459-541,564-631
tgttctcgggattgcctcggtgtgctctctgttgcctatcaaaggggcagtcgtcactctgccatctctgtactcggagatgagccaaatgaacagcaaagtgcgcgacgggattgagggcttcccgcgtcaacacgactcgggctggactgaattggtggacctgccaatgggcctggacccccccgccgaaccccctggatacccccctcactccatccttccgggcaaaagttttacttcccggacactggccatgcgcctggctcccaacaaccaaactggccccctgggccgccccggccgtcccggaccccctgggaaaccccgaacaacccgggagggcaaagaaaaacccggaaaacctggaaagcctgggcaaaacgcctcctccttgtgcgcccccgaaaattcccccggcgcaccctgtcctggttgggccccccccgcggcccccgaaggaaaaggaaccccccgggccaccaagggagcccccggaaaacctggtaacccccccctccagggggggggaacctggaaaaccttgggggcccccggacccccaggaaagacctggggaaacccggaagccccccgaaagccctgtgcaacccccggaaaacctgggaga

SEQ ID NO: 93532 - DNA, 402 bp, Heterodera glycines
  SCN-specific regions: Sequence locations=1-98,121-324,347-402
accatttgcggggagcgcgacctttttgcggcactccaatttgtgttgaacaacttggtgggcacgggcacaacggcaaaggcgaagagacaacagtccaacaacaccggcaccaccacgagcaacagtggcgtaaaacctgatcaaaaattggcacatttgttcccctacaatttcggcatgtccaacaatgggccggactatttgcaaatgttgaaaaagcgacgtgccaaagagtctctcggcatgccattccatggcattggcatcaaagtgcccgtgaacaacaaaggcattggctaccgaccgctgtcggacgacgccaaggaaaatgcacaactgaagcgaaacatcgaaacaatgggcacaacggaaaatgaagagaagaaagctgagctgaag

SEQ ID NO: 93533 - DNA, 215 bp, Heterodera glycines
  misc_feature (194)..(195): n is a, c, g, or t
  SCN-specific regions: Sequence locations=1-195
ggaatctatgaaatatgcgccggtgacttcttgtgacgttgaatgcagtttttcaatttacaaatcaattttggccgataatcgaatgagttttacccccgaacacctcgaatgtatccgatttgcaattgttttcgcgaaattgatagactgttaaaaatttgtattttttcgcataaacacacttgatttcnnaaaaaaaaaaaaaaaaaaaa

SEQ ID NO: 93534 - DNA, 549 bp, Heterodera glycines
  SCN-specific regions: Sequence locations=1-275,297-549
cagtgtccgtaagcttaaaaatctttattcaatgccggcttttgccttctgatgaaagactctgctattcaacaactgacagatccagaaattgaatctgctctacagagatcgaaacagcttgctgcttctaacggaggacaaaagagaacattttccgacgacttgaatttttatccggccaagcgaaagagtaacggtaccgacatggctaacgttggtatgggtgcacaagtagctgagacgctggtcgaaaatgtggacatccccgagagcgccgttgggctcgtgattggacgaggtggtgagcaaattcagctcatacaacagcagagcagctgtcgtgtacaaatgtccagcgaaagcaatgtcagtggatttcgtcagtgcactttgcaaggcgcacgacataacatcgataaggcgaaacaacttattcaagaagtactcgaacgcagcaatagaagtgcccctgggccacaaaatggagccaatgcaataacaattgaactgagcattccaggaccaaaatgtggacttatcattggg

SEQ ID NO: 93535 - DNA, 449 bp, Heterodera glycines
  SCN-specific regions: Sequence locations=1-449
cattgagcctgatgttgggtgccgtcttcatttatccggtctaaattgggaatggcacacattggacactttgcgttctcattttggccaatttggcacgatcgaacagctggaaatggtggcttacccccgtggctgtggttcgttggtgttcgattcgcttaatgctgcccaactttgtttggctgccggtgaaaaacattcggtcaacggacattcaatcgaagtcaaaatggttcccgccggcttttccccgctcttttccccggctcggcccaattcctccgattcggcactttccgccgcttcctccgcacctccgccgccgaatgcccctctgaacttaatctgatctgtccaccttctaatcattcgttgtttcccaacttttttctcggttttttttgccatttccgttggataaaacaaatgtccatttgtatatgcac

SEQ ID NO: 93536 - DNA, 321 bp, Heterodera glycines
  misc_feature (299)..(315): n is a, c, g, or t
  misc_feature (317)..(317): n is a, c, g, or t
  SCN-specific regions: Sequence locations=1-321
atttccacggttccattcggtgagcctccgtccgccttcgttttgctctgtcaaactttgctcggcgctcgttttgtccaaacggcacacttttgcagaacgtgcgcagtgccatcggccaaaaagcgttgcaaagattacattttactgttccgtcgaatgccaacgatttgattggggcgttcacaaaaagtgttgtgaggcaataaaacaaagaaattttgaccaaaattgtacagcaacaaattttgaggaattaaatatttcatgagtttgtgcagatacactctttattattnnnnnnnnnnnnnnnnnanaaaa

SEQ ID NO: 93537 - DNA, 83 bp, Heterodera glycines
  SCN-specific regions: Sequence locations=1-83
ccaaggtcagcaccaaaaaagcgctccctctttctgaagcgtctgacaataggttgtgtacacaaaaaaaaacaaaaaaaaaa

SEQ ID NO: 93538 - DNA, 359 bp, Heterodera glycines
  SCN-specific regions: Sequence locations=1-74,113-359
caacaaacaacgaaaggacaagagtttcacgttggcaagacattaatccagcgcctgcgctgtctgatatcaaaaataataacaaccataataataataataaaagtaataacttaaatccaaatgttttcccacccgcgccccttcttcggtcgaccgcggcattaccaagtctattaaatgtaacaccaacgcaatcagcatgtctgttgccgtcctcaaatcttcaatctttgctcggtgaagtgcccagcctcctcaaaaaccgaggccatcaggtttttgccgtgcccccaaacattccgccacttcgcctctttgacgtgcatgagcaaaagcagcctttgccgaatggtttc

SEQ ID NO: 93539 - DNA, 462 bp, Heterodera glycines
  SCN-specific regions: Sequence locations=1-462
ttgagtcttctttttcatggaaggattgggttaggttacgtgacacttggaatgccgttgttacgtcgcaatcgcagattcacaggcattctgaacagctcgacaaaattgtttcggaggaaagcagttacagaaattatgcatctgacattcaaaatcgacaaattatgatccaaattgtggaaagaaatgtgaacaaagcgagggaattggtacgaacggcgctatatcagttgaacgctttcaattcggcgctgagtcaaatgagtgcaatgtttaaatcgcaggaagagaacgattcccaaactgagcacggaatattggagctgaacaaccaaaacgccgaaatgcgcttggagttgagccgacttcgcaatgagttggttttccgacgtcgacatatgctcaaaagcctttacgaagtgttttttctgccgaagctgaagcgctcttcgattgcgg

SEQ ID NO: 93540 - DNA, 256 bp, Heterodera glycines
  SCN-specific regions: Sequence locations=1-256
aatgaaagcggagcatgaccctatcgcacgatttccgtggcgagctctatatctctccaagggccttgttatcaacggtggtgttgttgccatattttacagaatccttgccctattcaccatacatcccatgagcatggtcgcaacgcttcttcaactcgccgctggttttttgaccattgcccttgaagcgcccttttgctgtgctttcgtcgatttcatctaaagaattgctcaattttccgagtcgcgagcg

SEQ ID NO: 93541 - DNA, 517 bp, Heterodera glycines
  SCN-specific regions: Sequence locations=1-414,448-452,474-517
ggaagttggagccatcctttctttttgaactttgtgttgagtctgttctgccgacaaagaaccaacaacagattttgtcttctctcagtttacgccaactttgtcttctcagttgcttggtaaagttggaatcatcggagtataaacagcgcatcgatttcacttaccaagaaatcgcaaaagggtatattaaattcacaaatgactatgagaaatcgatgcgagtgtgcagttttgtgctgtatagagacttggacgaattggccgctagtggcgcactgagtttggcgaagggatcggattttggacaaatccaattcaaaaaagccacatcaaatgtcgaattggatgccatcattaagacaattgggagagggaaaattccaacgaaagtcgaaaattggattttatcaccagaattataattgtatttcttttatatatttgaacgcaattttattttttattatttagatttccatttttgtgttttgggataaaaaaaatcagcttggaa

SEQ ID NO: 93542 - DNA, 634 bp, Heterodera glycines
  SCN-specific regions: Sequence locations=1-17,41-583,605-634
ccactgttcaacgcacgcactgcactgccccgccgccaccatgaactcgttgcgcactggtctccccaagctcgctcgcggctttgcctcggctgccgtccaggtcccgatccaaatgcactctctcgagggccgctacgccaccgctctcttcactgccgcctccaaggccaactcgttgactgccgtggaaaccgacttgcgcaccttcaactcgtcgcttcgctcggacgccgagttccgcgccttcatcgagtcgcccgtggtcgacacaaagtacaagacgcaagctgtcaaggcggttgccgccaagaagaacttttccgccacgaccaccaacttcttcacgctcttggccgagaacggccgcttggacatgtcggttgccgtgctcgagtcgtttggccagctcatgtctgcgcaccgcggcgagatccccgtggtcgtcacgtcgtcgcagcccctgggacccaagacgctcaacagggtccgggatgccctggccaagggcggaaagttcacggccaagaaccagaccttgattgtctccaacaaggtcaacccgtccattttgggcggcatgattgttgaggttggggatcagaccattgacatggccgtgttcgccaaaatg

SEQ ID NO: 93543 - DNA, 516 bp, Heterodera glycines
  SCN-specific regions: Sequence locations=1-108,132-138,178-213,235 -261,289-324,351-360,387-516
atgggtcgtcttcaggaatactaggtcttcgggcgccacctgcgcaccgaggctaacccttcccccgccctctaccgaatgaccatcttctctcccaacgagacggtcgccaagtcccgatactggtacttcttgcgtggtctcaagaaggtcaagaaggccaccggtgagatcgtcagcatcaaggtgctccacgataagcaccctcttaaggtcaagaactttggcatctggatccgatacgactctcgttccggcacgcacaacatgtacaaggagtaccgtgagctgtcccgaacagatgccgtcgactccctctactccgacatggctgcccgccaccgtgcccgcttcaggtcgatccacatcctccgcgtcgtcgagctcgagaagaccgaggatgtcaagcgaccctacatccgccagctcacccagaagggcctgagcttccctcttccccaccgaatcaccaaggagaacacccagaaggtgttcagtgcgaagcgaccatccact

SEQ ID NO: 93544 - DNA, 462 bp, Heterodera glycines
  SCN-specific regions: Sequence locations=1-462
ggaagtcgtcgttcaattggcccattctctgagtgtttttcaaaatgagaccgaccaaattttcaaaaaagctgcgctttggatggaaaaacgcacgcggagaatgaaacaattggacaagcgaatggaaatattggaaaggaaaatggaggcggtggaaaagcttcccgaggtgcctctgctgaattgtgcctccaatttccccgagtttggcacccccggcggaattgtcgtgccaatctttggccattccgcgccttttaatcgcagaagcggcgtccattttatggaacagaaatggaaaaaggatttcaattcgaatttgctgaatgaagccaatgttcgacgcaaggattttttggcacaactttttgtgaaggaaaagcagcgaaaggaaaaagtgattttggacgtggaaacattggaaaagctgagtccatcgtcagacaatggcgattcgga

SEQ ID NO: 93545 - DNA, 296 bp, Heterodera glycines
  SCN-specific regions: Sequence locations=1-27,50-296
cagaggagcacgcaaaaccaaagcctttacaatcccattcatctccacggctaatcgcatcgccgcctcgcaacgttacattcgttcactgcaattggccgaaacgcctcggattgccttcgactgtcgtttccttactctgcacaccaaacgtggcctcaatctgacgatgcttcaactacaaatgttgttgtttgtctaccgtgaccggcaaatgccatggcccatccatttgtgcaacttcccctcaacatcatccgccgacgactgcaccggcggtgccgaggctggtgctg

SEQ ID NO: 93546 - DNA, 567 bp, Heterodera glycines
  SCN-specific regions: Sequence locations=1-567
atgcatataaaatttaaaaaggaaagaaataatgatgaatgtaaatgcatactttagcacacaccttaaatgaaaatgatacaatacaaaatacgcatatacaaaaaataaaactgtggatttaatttgaatgcgttgtttaaattgagtaaaattacataaatatgtgataaatttaaggaaatttaaaatgcaaaatgggtttgaattgtgttaaaaggtgaaaataaaacctttggctcacactttgaaaccatttaaattttcttgactaagaaccgagattagaaaaaacatcggaaaatgaaaagatgcaaaaataaaaaacaggaatggggggagaaagaattgcccagcagcgttaactccgtccgatcagtttgtcctcccgcctctgattagtcgcttccttccgtccctcccccttcgatcatttcgtcgtccagaagtccttcgctttcgcccaaaccggcgccggcggcgttcagtcgcgcgtaatagcacaattggccgatcatcgccaagtccaatacgcagcagcccaaggagccaatcacccacggcaaa

SEQ ID NO: 93547 - DNA, 444 bp, Heterodera glycines
  SCN-specific regions: Sequence locations=1-444
gcttttccccaaaaaagggctttttctctgtccttttttgcttcttactttttcctctgcttttcgctgctcgttttggctgatgaatttgccgaaaatggccaaaacggcgctttaaaaaccaaagtcagcccaaggaaagacggctgcgaaatcgcccacgcgactttctgtcggaatgtgtgacggggtaccgggaacggttttatttccattgccaattcccgaacatggacaagccttgtctgcgcgaaaatgccgaagattccgtccatcagttggacgtgttggctgccgagtgctgtgcctccactcgcctttgctccgtcgatgacattgagtcgttttgctgtcgtacgatggactgcttgggcctgtgctatggcgactccttcttggcacaaattcaaagccgcttccgttatgcggacattttgctgaaac

SEQ ID NO: 93548 - DNA, 144 bp, Heterodera glycines
  misc_feature (63)..(63): n is a, c, g, or t
  SCN-specific regions: Sequence locations=1-144
tcagtttggaggacgaaaaggtgttcgagccaacgcatccgacacttgtggaatattacaggnggagaagaacaacaagtagccgacacaattcgatgaaaaatgttttccttttgttcgctgcatttcaacattctatttttg

SEQ ID NO: 93549 - DNA, 119 bp, Heterodera glycines
  SCN-specific regions: Sequence locations=1-119
agaatgtgccgtggataatcggcgtgtgcgcttcttccgttgcgctcggctgtattgcgtacaaattgttgcagcaaaaaaactcccagaaagaacttctagacgaaatgactttgagg

SEQ ID NO: 93550 - DNA, 499 bp, Heterodera glycines
  SCN-specific regions: Sequence locations=1-499
atttgttcttctgcacaaccaacggaattctcaatcacaaagcaaaaaactttttatcggagggcttggccgagtgaacgacgacgcgcttcgtcagtattactcccaatggggccatgtgatcgattgcattgtcatcagagacccggcaactcgaagctcacgtgggttcggcttcgtcacttacgcgacgacggaaatggccgacgttgcgatggcccatcggccccacgaaatcaatgggaaagcggtggacgcaaaacgagccgttcctcgcgaaaggatgaatctgatcctcgacaacgaccccatcccctttttcatgaacattgagcctgatgttgggtgccgtcttcatttatctggtctagattgagaatggcacacattggacactttgcgttctccttttggccatttggcacgatcgaacagctggaaatgtgggcttaccccgtggctggggctcgttgtgtttgattcacctaatgctgcccaa

SEQ ID NO: 93551 - DNA, 471 bp, Heterodera glycines
  SCN-specific regions: Sequence locations=1-471
ctgtttatatgcaccgctaatgtaactgactccccacagagagggttaaaagaccgaatggagatgattgaagttgcgggttatgtggctgaagaaaagctggagattgctcgcaaatatttggtcccaaaatgccgtgagaaatgtgctttgcccgacgaaaaattggttataaaagacgatgcaatcgattcgttgataaaatcttattgccgtgaatcgggagtacgatttttgtttatagccattgaaaaaatttgcagaaagagcgcttatcaattagtaaggggagagggcgcgggaacacaagtactgccaattggggtggagaacagcgaccataaaaaaaatgctgggggagaggaggtcacttctgaccggctgcacccgacaacgccggtcggcggtagcatggggacggggtggacagagacgggaaggtccgcccttgtggcgaggcgacccctgcag

SEQ ID NO: 93552 - DNA, 557 bp, Heterodera glycines
  SCN-specific regions: Sequence locations=1-460,482-557
caaaaacatcggagaatggccaagaaaatgtacgaaaaggcgcgggacagagcggaaaggggacgcgttttgttgagcaatgagcggggcattgacaccaaagaacgttcctcaatcattctgatgccaattgatcagccaaaagtgctaaccgcagaaacttttgcgagcggacgaagtcgacgagtgaaaggcgaagcgcaagcgaacggtggggcccacacggagagaaagcccatcaacggaccatcagcggcaaaaaggccagcgaatttgcaaattgcgactgacaaacacgcggacgcaaatgcaaatgcatcgcaaaacaccgtagtctacgggccaatctttcccgccgactattggcaattgcccccagcgcttttagccgcgcggctgaggcgtttcagcaaggcggacattatgcgaagccttcggcaaaatgcccgacggatgggcgtcgatggaggcaaactgcgtgcggtgatgcgacacatcgaaataatgcgacgggaggaagcgcagctgcgcaatcaacggcactatcagctgcctga

SEQ ID NO: 93553 - DNA, 247 bp, Heterodera glycines
  SCN-specific regions: Sequence locations=1-247
caattcgctcaaaaaggtggagcctaaaactgtgctcttcatcctcgggtcggacacggtacccaccccacacaccatcaccaacgcttactctgcccgggaatggttcttgcacgaggctgtcgacacagcgcaggtggccccacactttgtggcgctgtcaaccaatggcctttcagcggatgatctcagtattgacaggaacaatatgttcgagctttcgcactggattgcaggtcgctactcc

SEQ ID NO: 93554 - DNA, 463 bp, Heterodera glycines
  SCN-specific regions: Sequence locations=1-47,69-463
tgtctgtgtgcttgttggagatgaggacccgaatgtgaatgggaatattaacttcatccagtagaaggatgactctacggtgaccatccagggtgagatcactggactttcgcccggaaaacacggtttccacgtccacgctttcggtgacctgtccagccgctgtatgtctgctgggccccacttcaatccgacgaacaaaacccatggtggacccgaggatgatacgcaccatgtgggcgatctcggcaacgtgttggtcgggcacgacggagtggcaaaactctatttcactgacaaagtgatttcactggtcggtccgcacaacatcatcggtcgcgcgcttgtcgtgcacaagctcgaggacgacttgggccgtggtgaaggactccagatgccggagagcatggagactggcaatgcgggtccccgtttggcgtgcggagtgatcggaattgctcag

SEQ ID NO: 93555 - DNA, 309 bp, Heterodera glycines
  SCN-specific regions: Sequence locations=1-122,144-158,180-184,206-287
agcagcagttgtcctccgctttgaacttgcaggcgttggttggggctggagcagtgcaccaaccgccgactcccatcacttccgccgcggcatccaataatattcccggcatttcgcaagaacttttattccaagcgactcttcttgcggcagcaaatttgaacaatcccggactaattacgtcgaacacaacaccacaacagcaacagagaccaaaatgataagaaggagagacaattaacaaatgttgtcgtcacaatttttagaaaaaactaaaatctaattataaaaaaaaaaaaaaaaaaaaaa

SEQ ID NO: 93556 - DNA, 385 bp, Heterodera glycines
  SCN-specific regions: Sequence locations=1-385
cgcctcttctttcggctcgtaacagcggctacaccggccgattccatttgatctacccggactcgcagcaacccgtgcctctgtctcactatgtcaatgggcctccggcacccattttgttaccaatggaacagcaaacgaagttttcgtcgattcaacagccgaagccattgccaaaattgtctcatcatcagccgaacaataacactaacaacaacaagcgtccggcggagtatttggtcaatgagaagtacaaaacaattttgtgcaagtcgttcaccatcaacggttactgtgcatatggggcccagtgtttgtttgcccatggcgaaggcgagttgcggaaccagaaattcaaaaagtgctggtgaattgatgatgatca

SEQ ID NO: 93557 - DNA, 554 bp, Heterodera glycines
  SCN-specific regions: Sequence locations=1-341,364-554
cagatgacggaagcggacactcggatgggaacaatgaaaacagcgatttggaagtcatcaatggcgaagcggaaatggccagcaatagcagcgatgcctccgacagcgatgatgacgaccttttcacgcatgaaacggatgatgggagcgatgcgatggatagcgacgacgaggaccaatccgacgaagatgccaaccgaagagcagacgcacttaccatggaacaggagaaacagttttggtccattgtcccagtcgaacaactgaaaaccgaggacggaaactcccaatcgtcggacaaaccatcgacttcttacgccgcttctcaggccgggcttcctccgtctcaaaagaaaaaccaagcgtcgagttcatctatgcgccatcccaacgtttgtctggacgactcctcaatgccgtgctccatttgtttgagtgacatgcgcgaggagtgcgacgacgatgttgttgtgcagctgtctctctgctctcacttattccacaaggaatgcataaagtccgcctttgctgtgaagcgacagtgtcctctgtgc

SEQ ID NO: 93558 - DNA, 587 bp, Heterodera glycines
  SCN-specific regions: Sequence locations=1-249,271-275,299-587
tggccggtgtcttctccattgaactgactgaccgtgccaggaaccagattcggccttcagcggacgcattgtccgacatggaagacgaagacaacgaatatgagaatgtggaatatgatgaaattcccacactgtcgccctcttcttcgtatataaatgggccggaaggcgttgaaaccattgaattaggcgataatcccgagttggtgaatccgctttacacaaaagtggggccggaggatttccaattgctcaaagtgctcggtaaaggaggctatggaaaggttttccaagttcgaaaagtgactgggaaggacagtggcaaaatcttcgccatgaaagtgctcaaaaaggcgacggtcattcgcaatcagaaagacacggcgcacaccaaggccgagagaaatatactcgaagctgtcaaaagtcccttcatttgtgacctccaatacgactttcaaactggcggcgagctttatctgatcctcgagtattggagcggcggccaattgtttatgcctttggaaagagaggggccttttatggaagacactgcggtattttatctagcacaaattgtaattgca

SEQ ID NO: 93559 - DNA, 478 bp, Heterodera glycines
  SCN-specific regions: Sequence locations=1-478
gattattcttgcaaacattcgtggattcagtggcggacaaaatgacatgcttcgaaatggtgcttaagttcggtgccaacattgtcgatgcacttcagacgtacactcaaccgattgtcgtttatttgcctccgtttggcgaacttcgtggcggtgcctgggcagttcttgataccaagatcaacccaacatgcattaccatgttggccgatccgaattgtcgtggcggtgttttggaggccagcggtattgtggagatcaaatttcgcgaaaaagacctgctcattctgctgagaaaatgcgacccgaaaattaaccaattggaagaatcactcgccactgcttcggacccaacagccaaaggacaacttctagacgaatacaaaagacgtatagaaaaacttcttccgatttgccgcgcggccgctgtcaaattcgccgacttacacgacaccaacggcgagaatgctccagaaag

SEQ ID NO: 93560 - DNA, 533 bp, Heterodera glycines
  SCN-specific regions: Sequence locations=1-533
gtccaattaagatcagtcaatccgcaatctctgctctctcttctgtccttccgcctttggtcgtccatcagtcgcttcgctcactttcatccaccgattctccaaatgggcggcgactaaatcacccccgaggggaggaagttgtagctgcgtctaaccagtcaatttgatcttctctgcttcgcacagtccaattaattgttttaatgaacggcggaagtgaaagagtgactcatcccttcctccctccttgggacttttcccaattattacaaattcatgtccacttaaatttgaaaatggcctcgggtgccgctccgtgcagtgaccagcgaaattcggcaaaagcggcggacaaagcgccgccgccctcgcagggccaccgaagtcgcaaatgggcgacggacggaggggcagcagcgcactgcgaaaattgcgtcgtttgcggtgatcgggcgtgcaatcaccattattatggcgttgccgcgtgccatggctgcaaatgtttcttctggcgatccatcaaaacaaaa

SEQ ID NO: 93561 - DNA, 293 bp, Heterodera glycines
  SCN-specific regions: Sequence locations=1-259
gggccggcagtggcgacggcatttgcttcgcttttgattgcgtccctttcccctcctccaatgcttttgaaatttgttccttcgcttcttttgctgagtttggtgctgtcgcagagaaataacggccaaaagtccgtgagggttcgctacccgtggatagcactgagcgatggctacggggaaaagggacattggcagccgaaggcaatggccaaatcattggcgaacagacaaacgacgagaaaaggtatttttttttggaagagcaaaagcaaacgaaggacaacaaaaat

SEQ ID NO: 93562 - DNA, 269 bp, Heterodera glycines
  SCN-specific regions: Sequence locations=1-137,159-202,226-240
cttccaccaccgcttcatctccgcacattcattcggcgagtaacggcggaaactgtggaaaatgtggtagtcattggctccaagaactccaagtactcggacccaaatttgaacattcggtcccgcaaagtgggctccagcagcagcagaagcgattagaagagattaaattgaaatttttgcctgaatcgccgaatcattcattcattttaaattcatttaaataaatttgttgaacacttaaaaaatatttaaaaaaaaaaaaaaaa

SEQ ID NO: 93563 - DNA, 547 bp, Heterodera glycines
  SCN-specific regions: Sequence locations=1-163,185-547
gtgcaatcaatttttctaaccgccgccatttcttcattggcaatcattctggacaatttttgcgattggcaaaatgtttgtcgattggtggaaccatcgtggcgcgtattttgtggccaagccacacatgcgcccggcactgttggaccggccagaatggaagcacaaatttatcaaattaaaacacattcaactacatttcgttgaaatggtggaaggcggtgcgcatgagtcaaagccggtgatgtttttcctgcatggctttcccgagttttggtactcctggcgctttcaaatgcgacatttctgtgccaaatatagagtgatcgctgtcgatctgcgtggctacaacgactcagacaagcccatcggcatcgaggaatatgggctggaactgttgtcagctgacatcatggagctgatcgaacggcttggcaaacaagtggtgttggtgggccatgattggggtggcgtgatcgcatggaacatctccatggagcgccccaaactgctccaccgacttgttgtgatgaatgggccacatccc

SEQ ID NO: 93564 - DNA, 398 bp, Heterodera glycines
  SCN-specific regions: Sequence locations=1-398
caattaagctgtgttcgtccgtccgtttattcgttttgttgcgatgttttcgccatttttgcgtcgcattttttttgcttttcttatcgcttctttttatttcggtggaaggacttttcacgcttatttatccctttctgcttcaaacaatccgcaaacaacagcagtgaagcttcgtgaatttgttgacggagctgacttcatggagaggattcagcagattatccgagaagaggtgaaagcattgctagtgaaagcgaaacgagtggacaagcgcgaaattgaggaggaaagggcgagcccggccttctcttttagactgcacatgaattttacaaagttattcggcttttgatcactctcgcggagatattatgaaattttaaaattcattgatg

SEQ ID NO: 93565 - DNA, 434 bp, Heterodera glycines
  SCN-specific regions: Sequence locations=1-434
tttcagttttcatttcggacgacgtgcacttgcccaccggaatggttctgctgcagcagcggagatggctttgttgggttgacgcgggcattcagcaattgtcatgcattgggctggacggaacggggcgaagagtgatttacgccccgcttgagtatccctttgggctgacagtgaatggagcggaggagcgcttttactggaccgattgggaagacatgaaaatccattccgtgtttgttttcggcaaagggtacacccaatttttgccaggaggtggcggaaaaggaaggccttacggcgttctcagtttgcccagcaaatgccgtccccacccgccattgtgcgagtgtatggccaacaacggcggatgtgcccattggtggctgtccgggggccgacgcggcactaccaagggtggctgtccggacaat

SEQ ID NO: 93566 - DNA, 485 bp, Heterodera glycines
  SCN-specific regions: Sequence locations=1-28,105-106,165-416,438-485
cgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgttcggacactgccagtgcgctggcctccaacagccaagctgtccccctggtccgcccggcccgtccggaccgcctggacagcccggacagcctggaggcgcaggacagcccggacagcctggcgcgcccggtcagcccggccagcctggaaactctggccagcctggacagcccggagcaccgggacagcccggcaaggacagcggctactgtccgtgcccgccccgctcttccgtgttggcagtcaaaa

SEQ ID NO: 93567 - DNA, 90 bp, Heterodera glycines
  SCN-specific regions: Sequence locations=1-90
attccttttacgacgaccgtatacgaaattgttgcttgctttttcgaagaacagctcgtgaatgcacttattatttttcattggattgat

SEQ ID NO: 93568 - DNA, 664 bp, Heterodera glycines
  SCN-specific regions: Sequence locations=1-64,86-664
cgaagctcgcatttcattcaaatcaacaattcaaccatttccaagtgaatgcattccgttgccttttcttctttatcaacagaagaagctcgcttgaacttcgaacaaattttccatgagaatggcttcgtccgaatcgatggtgtattttcaaccgaagaattagctgaactccgtgatgctgtaaaattaattgttgaaggctttgacccgaaagaccacccacggacaacttttttcacaagtgacgaggaaaagcatgtgtccgacagctacttccttgacagcgtagacaaaatcagaaaattgtcagtctgaccggcgctgttcagcctcgcgtgatgcaaagcatgttcatcttcaaacaacccaaaatcggaggctcgactaatgagcacgtcgattcaacgtttttgcacacagaaaacggagacaatcttttgggtgtttggatcgcagtggacccggccaatttggacaatggctgcctatggtttcttcccgggtcgcacaaggacgccaattatctgtctgctactaggcagtacaaattcccaagaacagaaaccaagcaccatggggaaaaaggcatccctccgatgggcccattgttaaaatcttggtgagaatcgggcttcctgtcaaagggcgccaagtccggtgg

SEQ ID NO: 93569 - DNA, 302 bp, Heterodera glycines
  SCN-specific regions: Sequence locations=1-203,225-302
acttatggctgccgtttcctctgctaaatcttcctccgccctcaaatgggtttcactgattgtgctcattggtcaaacgacagcgctcgtgctgactttgcgttattcgcagacccaaaaatcgcatccctccgacgggcccaaatatttgtcgtcgactgccgttttgatggccgaaatagttgtccaaaacaatttgctgtttttggccctttccaaattggacgccgccacttaccaagtcacttaccaattgaaaattctgaccacgggctttttctccgttacgatggtaaacaaaa

SEQ ID NO: 93570 - DNA, 105 bp, Heterodera glycines
  SCN-specific regions: Sequence locations=1-43,75-81
gacagcgaaaatgccgaaaaaatgcaaaattggaatttctcccaatttttttttgattttataaaaaaaaatttcttttttaaaaaaaaaaaaaaaaaaaaaaaa

SEQ ID NO: 93571 - DNA, 412 bp, Heterodera glycines
  SCN-specific regions: Sequence locations=1-412
gatcgtcgccagacagttggcaaagcccatcactggatattttatgggattggggaaagaacacccggcatttcggaactgagtgtttctacctgtacggaaaactatcacatattggttccacaaaattgcgaatgaaaatttggacctcggctcaccaacttcaggggtatatgtatcggaagacacagcgcttgaacaggcttcttttgtgatccatcaagtggacattttcggctactctgtcgtggtggtttacgcttattcctatttcacgcacccagaggagaaggacttggcaagcgtcgatgaattgacagagctgagcatggacacgagccaagagataatgctactgaatgagctggttaccgacttgcaagacgacatgcgaatgccgcctacggaccga

SEQ ID NO: 93572 - DNA, 529 bp, Heterodera glycines
  SCN-specific regions: Sequence locations=1-451,473-494,519-529
gaaaaatatcatccatcgcgatctgaagccgcccaatgtgctgatgaagaagaacaaccaggccaaactgactgatttcggcctcagccggcagcaggacggggtcagccgagcgaacaccgtttgtggcacgccgtattacatgtcgccggagcgcatcagagagttgccgtacaccgccaagtccgacgtttggtccctgggctgcattctgtacgaaatggccacgctgcgctcgcccttcttcggcgagaagagcaacatcacgtcgctgacgcagaagatcagcgacgcggagtacccgccggtgcccgacgacagctacagtcagccggtgaccgcgctcatacagtactgcctgcgcccgaaagcggaggagcggcccagcgcggcgcaagtgcaccgtatggcgctgctgatggcacagcggtgggagggcactccgccctactgatgatgatgatgatgatgaagcagtcatgagagaggcgcgcaattaatttttaaaatttaaatttccataattttc

SEQ ID NO: 93573 - DNA, 495 bp, Heterodera glycines
  SCN-specific regions: Sequence locations=1-302,324-495
gccccactgatgttcttctgtgtatcgtgggctgaacacatgggccttttcgcgcagagtccgctcaaggaggaacatatttgtctccttttgttaagcgccggtctgacgaatcagccccaaaacgtaatcaactcggaggagcgtcgcccttggctgagtgagactccggttgaatgggccgagtcggaagcaacgccacgacgagcggttacccgaccgtgacgacgcttcagctccttcgttgagagtcttgcctcccgggacttcgaacagcttcactgtttggactttgcacatttgggcttgggttcagccgctttcatgttcatgggagaatggcgtgagctgcaccggatcgcattgaaaacctattacagtttggtgttcatggatcacgacatgcacattctgccatctgccgatgaatcggaggccgatgatgcgtcttcgtctagtggcgctgttgacagtccgaccgctgaccactctcag

SEQ ID NO: 93574 - DNA, 157 bp, Heterodera glycines
  SCN-specific regions: Sequence locations=1-44,76-157
agaaaattttcaacttgatgtatgcaaataaatagattcattacaaaaaataaattcataaattttattttttatcgaaaataaaattgtaatccattgaaggagagaattaaaatatattctatatttttcaatcaacttagttgaaatgtaaaaa

SEQ ID NO: 93575 - DNA, 469 bp, Heterodera glycines
  SCN-specific regions: Sequence locations=1-469
tgcttggcccgatcccgtcactacttaaaaatctgcggccattgacttcagcttttaaaactgagatcaggatcggacaggtgctgaataaccgagcattgctggaccagtactgtgtccttttcctcgtgtttggcttcaatcggctgctgctggtcaccagtggaccatgtctaagctgtgttcgtatgaatgaagattggcacgactattgtaatgcaatggcaaagtgttgcgactcgttgcgaattaaaccgtgtgggttggatgacagcgatgtgacggatgacagcgacagcgagctgtcgccaacctcgtgccttcccatttacgtgttcaatgcgccacccgtggaccaatattggagtggcatatgtgaaaatcaaccgactgacaaatgcgattcttatgaagtcaatctatgctttttggacgcaaaaaagcggtgtttaccgcgcatgccatgggc

SEQ ID NO: 93576 - DNA, 272 bp, Heterodera glycines
  SCN-specific regions: Sequence locations=1-108,137-169,200-272
tcttcaaattttgcgcccgctgctcgctgtttcgctcctcgtcacctgttgccatggtcagaaggagagaaagcctaaaacgggaacgaccaaaacgagcacaacaacgacgactaccaccaccaccactacgaccactttgccaaaaatgactacgccgaacaacaccgctgcaaacggaggcggcggcagcggcaacactctcctgttcattttgttttgagttggcgtatttgtggccttggcggttgctgtggttgtggcggtcgttg

SEQ ID NO: 93577 - DNA, 442 bp, Heterodera glycines
  SCN-specific regions: Sequence locations=1-2,24-188,212-442
gcatctttaaaatgaactgtatttgagagggcgcatcaaattgccgtaaaatttggcgaagtgatcctgggcggcatcagctaccgaagcgatcgtggtgattatctgaaattgtttgaataatattgatccaacaaagggaaaaagacaataactgacctgttccaagacgagttttttgccattggtcatcatttgctggaaagtttgtgaaagcactgactccaatcttttttttatcttaacaaataggttaaaacaatgaacaaaatacacaataaccgatggcaaataaatactgatgattgacttgggacaatcttcgcaaaagttcacctaaaccaatgaaaatttggccgtataaaaccaccgtcgaatgcgtctcatgccattgcggccgccgcgtgcgcagccactcgcgggacggacatgtcggccatgg

SEQ ID NO: 93578 - DNA, 562 bp, Heterodera glycines
  SCN-specific regions: Sequence locations=1-17,39-193,215-303,326 -327,349-562
gtttgagccatttcaaattaaaaatgcatttagagtcacgccgaaatgtgacttttcccgtttgggaggcaccctttggaccaattgcattccatgagaacgatgttagctctgagaagctgatcaaaactgatcaaacagatgaggcaattaatgaaaaaggaaattcatttgtccattggcttttcctcatttttctgctgctcattttgttggcattttgtctgtttctgatcagtttgatctgccgacggaaaattcgtcaacgaatcggtcgaacttattatgtgctccaaaaatcggaaccaaaaaatggagggccaacatttgaagttcttaaaacaactggtccaataaagaagcgacggtttgggagcagaaccgattcaatggaacccattcagctggctcaacataaaagattttttcccctggagggctctttttcggccactccaccggtcacgccaacggcaccgctactttttgctgaacaaaagcctatactaaggccaattttacggcatttgcctcctcccaggctaccgtcatcatccattac

SEQ ID NO: 93579 - DNA, 221 bp, Heterodera glycines
  SCN-specific regions: Sequence locations=1-69,123-221
gtcggatgctccgtccgccacggcgaacgattggcgagggcaattggtccccatgggaagaagaagcggacaaaagcaacaacaaaaacaagaacagcagcagagatcaaacggcaaacaaagtgccatcctcggggggggggcgactgccaaacatatggatgactaatcgtaggaattgtttttccaaaatgcaattccaaagtaaagtgattaaaatt

SEQ ID NO: 93580 - DNA, 302 bp, Heterodera glycines
  SCN-specific regions: Sequence locations=1-57,80-193,215-231,253-302
agaagcagaagctgatagaagaagtgcacgctgttgtgacggtcagggacgcgaagcacacaaatttcgtcgagtttcgaaacttcaaaattgtctatcggaggtatgccggactttacttttgcatatgtgtagatatcgctgtcttttatctttattacctcgaagccattcataattttgttgatgtgctcaatgaatacttccacaatgtttgtgagcttgatctcgtcttcaacttttacaaagtttattcagtcgtacatgaaatgtttttgggaggacagattcgcgaagcgtcg

SEQ ID NO: 93581 - DNA, 367 bp, Heterodera glycines
  SCN-specific regions: Sequence locations=1-367
gccaatccccgtcatcgaattgtcttaccccgtctccgtcatttactgtggcgaatgttctatgcccgtcgaatactgcgagtacagtggcaaatttgagaggtgtcagcagtggttggaacgcaatttgcccgatttggcggagaaacaaatgaaaattggggcaggagatggaaaagcggcggatttttggaatggggaagagacggaggcaaaaaagcaccaaaagcgaggcggaaagggattgccgaaggcgagaggaggcggcaatggctcaaaagagcaatccgctacggtggcgcaaattacgctgaatacagaagtgcggatcaaaaaccaagtggtgaccgtcgataaaggcctcact

SEQ ID NO: 93582 - DNA, 524 bp, Heterodera glycines
  SCN-specific regions: Sequence locations=1-184,226-313,348-374,397-524
cttaagcttttgcttcttgcggtctccatttgagttgccatctcttaattaggctccattttctgccaaaatggtcattcgtccgtcctctgtccaaatgcatccgccgctgcacaacaatcgcttccattccaaccaattttcgtttgccgttgccgctgagcagtgccaacaaccgccgatgaacggcggcggcggcacacagccgcccccggcgggaggcgcccttttccaacagccgttccctccggcgccgccccgcgggacggaagccgcggcacagattgaacagcaccaaatgatgctcatccgacaacaccagcaacaacagcagcagcaaatgctgctccatcagctgatgctgaggggcgaagttggccttcccccgcaggggcgtccttctgcccaaccgccgcattctttcccgccaaatccccacaacaattaccaacacattgtgggagaactgacgccgcccccctctcagccgtccctcggcggactttcgtccccccaggccaacg

SEQ ID NO: 93583 - DNA, 643 bp, Heterodera glycines
  SCN-specific regions: Sequence locations=1-39,61-92,114-120,143 -316,338-643
gactgactgactgaccgacctctcatcagccactcactcccacactcacttccatttcttacattctcgtgcccattcaaacaacaaactccttcaattgtgtcttattctctcgccatttctcctcacactctccctcacatcagtaacgtccatttgccaaaatggtgaggaccaatccattgctcttcgagcttgtcttcgataatggctaactggtcgaatgcttgttgtgacagcttttcttccttgtgcttagctatcggaggaactctccatttattacattcttttcttgccggcccttttgagtgaatcccttcttctttctgcaactgctgacgttatgttttacgatggatctcaatggattcgacctgatgctatcaataacattcaacaattacccgattcgcatcatttatcaaacattcaattgatgaggagcaatgtcgatttggtcttcagaattgtggccattagaaatagggataacaaaagactcgtcaaccaacatatattccatcgtcttaaatataaagaggccactccatcttttcatcagtggcgaaatgagcataagcaagttattggtctcaactttactaatgaacaagatgcaaaaatgttttatgaggcggtg

SEQ ID NO: 93584 - DNA, 610 bp, Heterodera glycines
  SCN-specific regions: Sequence locations=1-118,141-183,205-610
acaacccattctcgtattggtcactggcgcgggtggacgaattggctattctctggttctggtaatcgtcaaacgcgatgattatggcaaacatcagcccattgtcctctcccttctcgacatccctccgcttactgaagtgttctccggggaccactaccaattgttcgactgcgcccttcccgacctctgctgagaccaggtcctaacctcggaagaggcggccatctaggacattgacttcgcttttctggtccgagcgatgcctcgctaagaagggatgaagagaaaggaccttcttgcggccaatgtccgaattttcaaatcgcagaggtaatctttggacgaattttccaagccaacaggaatagtgctcgtggagggaaatcaggtcaacacagacccattaatttgcgacaaatacgcggacagcgaaattccggctaagaattttaatgccatgactcgtcttgaccacaaccgtgccatggcacaagcggcacaaaattgcgcagatggaaccaccgatgggatggtgatcaataggatcatttaagacaatcactcaatcactcatttcacggatatccgacatgacaacattgacaaa

SEQ ID NO: 93585 - DNA, 516 bp, Heterodera glycines
  SCN-specific regions: Sequence locations=1-516
caagcaatcgctgttattcaccagaatgtatccacatctgatcatctatttggactgtccgcctgaaaagtggtttggaaaacattcaaaaacggggcaatcccgctgaagtcaatgccgtggatttggaatatttggtcaacattcaaaattcctacaaggatttttttcgggaaatgagggacgaatgtgaaattctcgcgtacgattggacaacgccccaagtccttgacgttctgcttgaggacattttggagattgatttcgaaacactcgatttttattcctccggcaaacaccgcacttggtcactgatgggaacggacacaaaccactgcttttggcgccatatggtcaccaccaaagaccaactgaaggaaagggcgatgaacaaacttggcttgctgcaaacggaggtgtccgagctgtacatttaccccatggacggtattcatcatcggaatgtgattatgcatgaggtgctaaaagatcgttgcacccacggctacacaaaga

SEQ ID NO: 93586 - DNA, 85 bp, Heterodera glycines; identical to SEQ ID NO: 66515
  SCN-specific regions: Sequence locations=1-62,84-85

SEQ ID NO: 93587 - DNA, 124 bp, Heterodera glycines
  SCN-specific regions: Sequence locations=1-66,91-98
cgaacctgttggcgatatttcaaaaggaatggctgaagctgatcgcaagatacgctcagtagaggtattaaaattctctttctctctcttaatctttgatatattaaaaaaaaataaaaaaaaa

SEQ ID NO: 93588 - DNA, 384 bp, Heterodera glycines
  misc_feature (361)..(361): n is a, c, g, or t
  SCN-specific regions: Sequence locations=1-361
ctcgttcaatttgagtgattcttcaacaaatacatattaattaaccaattgtccaattctgtgcttatgggaacggatgtcctccagcggcagacatttgttcacattgtccatcgccatcatttttttgtgtttcgcggttactgtcgtccaaacccgctaccgtttccgggaggaaccgatgccggacgaggggcttcaccaagactgggacatccgattcaggcgcttttctgaacacatcgctcaccgcattcaaagcactctgagatgagacggtgaagtgactgacgacttttttgacatcgatttgtcccgtgaccgttttgattatgatctcgctattaaacgcaaaagaccnaaaaaaaaaaaaaaaaaaaaaaa

SEQ ID NO: 93589 - DNA, 433 bp, Heterodera glycines
  SCN-specific regions: Sequence locations=1-433
gttaaggtcgcctccggcacataatcactcgtgaatttataacatccatcaatcagttgtgccgatgccaaaaactccaaagtgcaccactccgtccctgctcggccgcgtggtgcgcaaattgagcagcgcgcgcaaggcgcacccgcaccgttttgtgtttgagccgaaaaagttgctgatcgacacggacgaacggtggcggcccgtcgaacacattgtgttggtcttcagacacaggcatcgtctgttccgctccaaaatgcgctccctggaggactcttgcttggtgggcaatcggcgtgtgcttgtgtggcccgaccgcgtggtggacgacccaattgaatttgtcacgacgctgtacaaccggcggaagcagtgcaacgagttggatgacaaggaatggacattgtttgttgagggtccaatggta

SEQ ID NO: 93590 - DNA, 560 bp, Heterodera glycines
  SCN-specific regions: Sequence locations=1-560
ttctaacctaatgtccccaactaaaaaatttgttccaaagcgattgccccccgaacttttatatgaaatttcactttttgtcaatccccgaaataatttgtcttctatctgttcctcctctcgtgtattacataaatttgtgtatctgcgggtggctaaattttatcactcatccgttgaacagctcaaaacctcttatgcaaatgcgcgccgcagcccttcctgggaagctgtgaagtccgtggcttctcttgctcgtggattgcgtgacccttgtcttgatcagtttttggctgcacttgaggatgctttgggcaccggacgtcctgccacttacacatttgagaaaatcagcaaagaacgcgtcggcatcagcctcattcaaacaaagggcggcagcgaaaccaaccgcactcacactgtctcaaagacatctgccggccccgccgcacgtcgttcttctcccggcgataccagccgcactcacactgtctcgaagacatctgccgtcaccaccgaaagcagtacttctcgcttctctctgcctcagttgtttggaa

SEQ ID NO: 93591 - DNA, 368 bp, Heterodera glycines
  SCN-specific regions: Sequence locations=1-68,91-103,125-304,330-368
ttcttctcatctccctaatcattgtcggcatttcgcacggccacccggtttatgaagaggtgcctgtgtatccgctgtccaattcccagggattctacgacaaggaaaagggggaagtgaatggcagtgcaaatggcactaagcaagcgcagcataatgctatccccgtttccggaaatggcacagaagtaaattccaactcgactgtggacacggcatttgacaataatttcaatggcactgcatcgggtgtcagcaaaaatgccattccggcaccacttgtgtccggccatggattcaatggaacagagaacaaaaaacacattgggcaaagcaaaactgggaaaaagacgaagaaaagcagtaaa

SEQ ID NO: 93592 - DNA, 458 bp, Heterodera glycines
  SCN-specific regions: Sequence locations=1-135,157-251,283-407,429-458
cccattttgtgctcattgaactgttcactaaactgcaattaccaccggtcaacgggctccaccgattgttgcgctattccgttgaaaaacgcttttactgtgccgtcttttcgccgaacaacggcattcgtcagcaaaacggtggtggtggtggtgaccagcaaaaacatcaacagcagcacttacgtttcttgggccgaagcaaaggccgtcactgtgagtacgaattgataccgaaacgagcatcggggttttgttttctaccatattttttcaaaaaatttggtagtcattttcccgaaatcaagaacacagtaaacatggtaaagaaatggaaaaaaagcatatttcaaccaaaatttttgtgttttcgaccggtgcaccaagaatttgtacgtcaaaattgaaaaattctgtcctttttaaataaatccattaacaaattgcactcagatttc

SEQ ID NO: 93593 - DNA, 325 bp, Heterodera glycines
  SCN-specific regions: Sequence locations=1-149,184-255,299-299
accagctgaagatcccgagcccggaaacgctgaaccggcaaatcccacctttgctgcatggcatacgcctcccaatgccggcgggggcttcgtcttcgtctaatgccttccaagaaacactgcgagaggaggaggaagcggccgcggcactcgcatctttgaaatgatttaaaacacaacttcgacggcattcactttgatagtctcacaataagtcgattcattaccatcccatttacattctcaaattatcctcatgtttgccattttaaaaaatatttagtaaatctatttgtttgaaaaaaaaaaaaaaaaaaaaaaaaaa

SEQ ID NO: 93594 - DNA, 434 bp, Heterodera glycines
  SCN-specific regions: Sequence locations=1-434
gcctgtcaggcgttgaactgcgctttcggttccgagggattgtgccaattcaaaaccctttttctcgctgccggcgatgttccgtttgtggtgcctccgtccggcgaagggattgttgctcgtttctcccgcggaatgcgtcgtgcgattctcaaatcgcgtcactttcgccttccctccaacgaacaattggaaatgcatcttgaagcgagtctgtccaccttcggctctcgtctttacatttgtcctgacgagcagcaaaagaccgtcgcgaggctatcaatggaaaaaacggggccaaatggagtggagacggaccccctgagggaatttggatactgcgaattgctaatgggaccaaaagtggaacaacggatgatggagcggatggtcgtccaattggaccccgaattgagacacttttcattggtggc

SEQ ID NO: 93595 - DNA, 635 bp, Heterodera glycines
  SCN-specific regions: Sequence locations=1-262,284-506,528-635
gttcttgtcgcattatgctttcggcacgtactctccattttgcgcgttctcgtctttcttcgtttgcgccgctttgccgtgcttccacttcatctgtgcgccacttgtgcctgcttggacgcaatttgacgcgctatagagccaaggaaccgttacgtgaccaactgcaaaatgctctcacaaaaaatatagaggcgaaggcggcaccacgggccgactcaattccaccgaggccattgcgacaagtcatcatccgaggcggacttttctttttcgttgccagcaatgtcttctcaatgattgctgccgttaatgactttgagatgacacagaagcgattccaatcggtgattgaccaggccatttacgaattccgtcgcactttttccttcactccgccgtataagcggaaaacggaagccgccaaattgatttggacaattatcggtgccaatgtggccatcttcctactctggcgagtgccaactctggtaccattggtgtggcagtatttctccagtggtgtcgcttcgaaaagtctttgcatgccaatgcttttcagtgtgttctcccaccaaaatctcatgcatttgttcttcaacatggacgtgttgaatagctttgctatcgttgca

SEQ ID NO: 93596 - DNA, 561 bp, Heterodera glycines
  SCN-specific regions: Sequence locations=1-561
aggaagcgaagcatccgcttgactctacgcatttctcccctcgtgaaaccccaacccaccaaccgctgcacaccatgtcgaccggcgtcgctgtcaacgaccaatgcctcgaagtctttaacgagctcaagctcggcaagaagtactcgtacatcatctacaagctcaacgagtccatgaccgagattgtggttgaaaagacggccgatgcgggcgcgccttactctgaatttgtcggctgcttgcccgcgaccgactgccgttactgcgtgtttgacttcaagtacgagcacgccgagggtggcgagcgcaacaagatcttgtttgtgtcgtggtcgcccgacgacgcaaagatccgcgccaagatgacgtatgccgggtccaaggatgccatcaggaggaagcttgttggtgtgcataccgagattcaggcgactgatttctccgaggttgcccaagacaccgtgctcgagaaggtttcgcgcgtgtaacgcctctcatcctcgtcgagtccctcattcgccccttctttgatgttttttccgtcctgttgttgcactg

SEQ ID NO: 93597 - DNA, 579 bp, Heterodera glycines
  SCN-specific regions: Sequence locations=1-264,286-497,519-579
gtaacaatctcaaggatgaaatttattcgaaagaaattcattttttcctttttgttctgtgccatccaattgcactatttaaatgccaaaaagtttggcggtggcggtggattccgagggggtggagctgctcgcgctaatccagcgccagcgggtgggcatttcggcggtggtggagctcccgttggaggaggacagcctcattttgtcggaggaggagcaggcggattccatggaccgaccgggggagggttccatccgccgcctgcaggaggcggtttccacggcccaccaatgtctgctggcagtggcccgggccgctttggttccggaacgggactcggttcgtcgagccgtgccgggactttcacgactgcgctggcgggtgctgcggtgggcaccgttggcggtttggttgcctttgaagcgggaaaagcgattattcattccttcgaccggcccttccaacacgacggacgcaattactatttggacgaaaaatacgcaaagaaacagcacggagagattcagtgcaaagtgccgtgggataagctggtcaaccaatcccctgctgcgaca

SEQ ID NO: 93598 - DNA, 369 bp, Heterodera glycines
  SCN-specific regions: Sequence locations=1-136,158-347
tttgaattcaatgccaatgacaaattaatcagcaattttctgatggacactgtgattaattttgtgaaaacagctaatccgtcatccgaccacagtaccgtccaatggcttccaatggctccgaaggacccatcagaaagttttatgcatttgttgatcgaaatgccaatgccgaaaatgaacccgaaaatggaggaggaaattggcagggcccaattttggacgcaaatgcgaacaaaacacccgaagattgacttaatcaggggccaattttgaccaagccaacgcattttcactattcaatttttactctctttccctatttagaacataaagggtaatattttaaaaaaaaaaaaaaaaaaaaaa

SEQ ID NO: 93599 - DNA, 354 bp, Heterodera glycines
  misc_feature (334)..(334): n is a, c, g, or t
  SCN-specific regions: Sequence locations=23-78,103-199,221-334
ccttcttgtcctgcctggcatatggaaagcacggaatgacggcagtgacgcggcaagctgaagcaattttacatgcactgatcatgatcaacagctccatcagcttcaccttttatgttcggcattcggacgttaacaagagacccagacgcagtggaatgctcgccttcgctgagaagcaaacttccggtagggctagacgttttggaaggatgataaaaagaaaaatgcactgaagaaatatcaacgagggcactacgagtcgaagacaaagatttcgacaaatacctcaacattgtcctaaatgcaattgaacttagaattaacgctagcnaaaaaaaaaaaaaaaaaaaa

SEQ ID NO: 93600 - DNA, 364 bp, Heterodera glycines
  SCN-specific regions: Sequence locations=1-364
cttggcacagatcacgccgaacgtgggaggggcagcggacattgtttttgctgatgcaccgccgaagctttcggcagacgaaactgccaaattggtggaacaagctcacgccgaactgaaggaggatgacaatttgccaaccactcgcattcaaattgtaattccggacacggaacggcccgtcgacgcgcgccttaaccaagggcacacagtgaatcagctgcgcattttcattgtcactgccgacccgaggttggcctaccgtcccttccgacttatgacttcgtaccccactcaaccgatcgacgacgagggactcaccgtcatacacgccggactgatcaatgcgacggcgttggtcaaa

SEQ ID NO: 93601 - DNA, 454 bp, Heterodera glycines
  SCN-specific regions: Sequence locations=1-49,75-454
tgttcacttcgttggacccttctgttaagaaattgttgggctggaaaatgggcgacgaagaagagaaatgggcactgaaagcggtcgaatctttggtgaaaaagatgcaaaaacgaaagcaccatggatacggtactgtggaggatttggaatacgcactttcccaccccggctcaagcagcaattgcgtgacaattccccgctctttggacggacgccttcaggtgtcccatcggaagggtcttccccatgtgatttattgccgcgtttggcgttggccgaatttgcagtcccatcagatacgcattttgtcctttgtttacttaacatggatacttcctttacgagttaaggtccaccaccgattgtatgttcccatacgacgggcgaagtgaacagatatgcatcaatccttatcattaccatcgaattgaaatgctcggacagtcgaagc

SEQ ID NO: 93602 - DNA, 535 bp, Heterodera glycines
  SCN-specific regions: Sequence locations=1-292,315-535
cacaccttctttttcattaccattttaaattataaattcgcttctttttctctcaatttcttttctcggctatgtcgacgtcaggcgcccaaatttctattcgatgcgatgctcaggaattgctcatgggaatgttgccggaagggatcgaaaataatttggcttattcgtctgacgagaacggaatgccaaattcggttcgtacagcgcaaagaccggtggtcgtaatggtggcgccggaaaagcaaaaaaacggagaagagacaaaagttgggagagaaaaggacgagcaaaagcagcagaagcaaaagcaaatctgtggggagataaggcaaaagctgaagttggaagaacagtgaaaagagagcgaaacgatgggaggagagaagggaccgaagcggagggaaatgccgacgaggaaaagcaacttcttggacccggaaacagacagacttttggcaaacactctctgaacttagaattctgatgagaacgcggaaaacatctcatcgattaaaattcgatttcaaatgat

SEQ ID NO: 93603 - DNA, 521 bp, Heterodera glycines
  SCN-specific regions: Sequence locations=1-256,279-310,334-385,407 -423,447-521
attttccgcacgtccgtcccttttctgccggacgaaggcggcgtctgggtgacgatgatcagtttgttgcacatcgcgtcatccaaatcgtcccaaattttgtcctcactcgcctcggctccaccgtccgcggcatttccaacggattccatctccgagtcgaactggaagtcgagttcgccgccattggtcgtccactgcctcgaattggcgaagttgcggttgttgctgccgcgtttgttgcgcttggtgcgcacctccttccacccctcttcttggtcctcccccttgcccttcttctgctccagcagtgtttgctgttgttgctgttttggcacctccgtggcctcctcctcgacagtcgccgttgccgtcgcgttttggcatctctgctgttcctcttctgctgcttctgatgcgcgtgccattgttattgttgttgtggttttttcctccacttcttgcgacaacgccgaatttggctgcgtttcttgctgccgctgctgtttttccggttgttc

SEQ ID NO: 93604 - DNA, 54 bp, Heterodera glycines
  SCN-specific regions: Sequence locations=1-20,42-54
gtccaattaagccttgcgaaaatggaaaatgctgaaattaaatctcaacgaaaa

SEQ ID NO: 93605 - DNA, 280 bp, Heterodera glycines
  SCN-specific regions: Sequence locations=1-153,203-252
gacagaaagatggcacagagagcggagttcggcaattgctctttcacggcattggcgatggttgcgagcgatgcgtttcgtgtgttgaagtgctcaaaagtcgtttggccagtcagggaaaaaatgttttccaatggaatgcattgagcaacaagaaaacatcatcaacaacaacagaaaacagttcaaaatgtgatgaaatggaggccttgaaaatttcggaaaactcgccaaagttgtaaaatgtcaaccaaacaaaaaaaaaaaaaaaaaaaaaaaa

SEQ ID NO: 93606 - DNA, 403 bp, Heterodera glycines
  SCN-specific regions: Sequence locations=1-382
tgggcagatgaagacagctactgccgttgcattctcgaagaaaggcaatggcctgataagggtcagtggacgtccgttgagagactattcagcgccaaattctgcgcatcaaatttcaagtagtgcaattctaattgtgggcaaggactcatttgccggctttgacatactacttctcgtcgaaggtggtggacacatcgcacaaatttatgatgatcgtcaaccacttgccaaatctgtggcggctttctaccagaagaatgtcgatcaacaactgtactaggagctgaatgagcaatttatcccctacaaccgtcatttgatggaggccgaccctcagcacctcgatccgaagaaatttgtaggacctgtaactcgcgctcgctaccataagtcttaccgt

SEQ ID NO: 93607 - DNA, 569 bp, Heterodera glycines
  SCN-specific regions: Sequence locations=1-251,273-337,360-569
ctttttgcttttctctcccgctcactgactttcccaaaacaaacaacaaacggtcgaaacaacaacaaataaaagtaaaagtaagggaaaccatacggaccgagaaaaatctatgcacagccgagcatcttttttacgttgtattgtaaaaaacagcgaaattattcatttttcgccttatttacaatttaataatttttttgagtgatttagaatcacctgaaaacattagtttaatttgtgaaatgatttccaaatgcaacggagtttgtcggctttcaattgggtgagtgcagtaaattcacagacacacattccatttaattgcaaattcatttaaattaaattttccagttttcgatcgctaacgagcgctcagcgcgagaaacacactttgccggaccttccgtaaactcccaaactttcaattgtttattttacacttccaatttcattttagctacgattacaatgcacttgaacctgcaatttctgctcagattatgcaacttcaccaccagaaacaccatgccacttatgtgaacgttttgaatactgccgaggaaaag

SEQ ID NO: 93608 - DNA, 469 bp, Heterodera glycines
  SCN-specific regions: Sequence locations=1-224,246-402,441-469
gaaaactgaaaagtcaatttttcgataccgttaaaccgttttggacttgaaaactcctggagcaaaaatgggcttcctgacttatgcggttgtttcggtagttggcggtgcggtcgccatgactggagtgggcttacccattgcgggtttactaggattttcagcggctggacccgttgctgggtccttagcggcaggggcccaggcgtacgtgggaaacgtcgcagctggctcagtctttgcagcagttcaagcattagccatggccgctccaacgccttgaaacggtattgcttgctgtctgactggaaaagggagtatatttttaatttcagcagattttagtcatgtacctgccatcttcataaaaattctacctatctaaaaaaaatgttaatatttcaactttataattttgtaaatttatcagtcagtacaggtacttgaataaacaaaaatgcttattctg

SEQ ID NO: 93609 - DNA, 139 bp, Heterodera glycines
  SCN-specific regions: Sequence locations=1-139
gagaactagactcaaatcatttattattgttaattgtttattgcattctctaaaccattgccttgttttgtatgtattcactttgacatgtttgtgatttctaagaaaggcttaatgaataatgttttaaaaaaaaaaa

SEQ ID NO: 93610 - DNA, 205 bp, Heterodera glycines
  SCN-specific regions: Sequence locations=1-144,167-205
ttctcgccaggacagttcgcttttgcgaatgacgcaacgctttctcgaattgcacgccacaggagggattttgaatttgaatgatgccgcccaattggtaggggtctctaagagaagagtatatgacataacgagtgtattggaaagaattgagatgattgagaaggtcggaaaggacactatccgatggaagaactatgacgag

SEQ ID NO: 93611 - DNA, 535 bp, Heterodera glycines
  SCN-specific regions: Sequence locations=1-109,133-535
ccaccatgtcgtaccagccgaacatccagaccaccgcggccaacaagtatgccgtgcccacgccgtaccaaggtcctacctccggcagccactcgtactcgggctacggcgccgccgcccctgctgccgccgaatccgtgttccgcctgggccacctcatgatcgaagtcgaccaagcccgtgacctgcaatgctccgagtatttaaccaacatcgacccctttgtcgttgtcaagtgcggcgccgacgacgtcaagaccaacccgatgcgaggcgccggcgctaacccgacctttgacacgcagctttccctgacggtcgccgagggcgaaaacgaggtggttgtcgagatttgggaggccaaccagttcatggcgcacaccttcattggccgtgccaagcactcgctggccgagctgcgccgcggcaaggcccaggacttgtggttgccgattcacaacgatgcgggcgaaaagacgggcgaggtcaaggtcattttcaaccctttgccgtagatgtcggtgatttggtcgta

SEQ ID NO: 93612 - DNA, 544 bp, Heterodera glycines
  SCN-specific regions: Sequence locations=1-544
gcacttcccttcgcttgaccatttatttattatatttgtgctccaaataaatatttgtctgttcttcatatctgttgttctcggacacaacagtctgggccgaaggcggtccgagtgctatcgaaatttattggacggctgagcaggaggcgcgtcctgttagccgttactttgtgcaacgtatggacaagggccgttggattaatgtgtcgaagcccattcctttcactggacaagccgaatactgccacaactttcggcctctttcacttgttcacaacatcgagcacactttccgcgtcatcactgagtttgttgatgggcaggaggaggcgagtgaaacgtttactggccgtctcactatgaatgcgtgagtgaggaaggcccaacaaatgctgtgtcagtgtgtggagaaatgaaaaagctccgtcctcttcacatattgttgtgttgttgctgttgttttgctgttggacatacttatttaacttatttgttctttttctgataaaaccgtgtagactttctttttctttttttgcag

SEQ ID NO: 93613 - DNA, 489 bp, Heterodera glycines
  SCN-specific regions: Sequence locations=1-369,391-489
cacggaaaaaatgtattgttgatttaacaattaaattgttgaaaaatatgtccaacatgtttcaaatgtacactttacaatggaggaaagctaattcaaacacgggggtggtagaatagaattagcacttttaattgtaagatctacattgaaacgtgtcggacacagtattcaacaacaaaattgttaaatcagcaatatcgtttgttcccgtgaagatctgtgatcattctgtctaagatgaacaaaatccacacttttcagacgaatcaaaatgaagtaaataattggactacgacgatgaaagtaataataaacgaatttcaaaatctatacctgtaattcacaataattcaccattatcattgggcactgaacacgtcactggagaagtcacgggttcctgcctgctattcttgatgaaaacacacactctccattatttcacggcactgaaaaacactccatggcgaggatcactgagagcga

SEQ ID NO: 93614 - DNA, 428 bp, Heterodera glycines
  misc_feature (407)..(408): n is a, c, g, or t
  SCN-specific regions: Sequence locations=1-405
caaagacttcgttatctcttccagcagcgactcggagcaggaggacgccccaacgaaaagaagacggcatcggtgccgggaaatatcgcttctgctccattggaagagccctccgaggggaagatttacatggtggagaagggtagcacagtggacactgtgctcggtgtaaggcgcgatcgtccagccgttgttgcattggtccgctacatggacgagcagtacgaattggtgccaacgcctctgttggtgaagcataacccggcaaagttgatcgaatactatgagaagcatttgcgctttttctgatgggggcgaacttcggcggtgatccaacgacttgtgttatggcacttttctgtttgttttttttgacggcatttgttggataaaatgccaatgaatannaaaaaaaaaaaaaaaaaaaa

SEQ ID NO: 93615 - DNA, 632 bp, Heterodera glycines
  SCN-specific regions: Sequence locations=1-254,276-632
tgttaatgtgtcgtccgactcattttaatgtgaaatacgaaataaacccatggatgaggccaggcgacccggtgaatgtgcaaaaggcaacagatcaatgggaaagactgaaacgcactctcgaggaatccggcgcccaagtcgaagtgatggaacccgtgggggctgacaattaccccgatttggtgttcacggccaatgccgccgtcgtccgcggcaaaaatgcccttttgagcaatttcttttaccccgaaaggaaaggggaacaacacttttacgaccgatggtttaagcagaacgggtacgaaaccttcaaagaccttcacgtgcctttcgaaggtgccggcgatgctttgtggataggaaagtcaaagttattttgcggcattggccccaggacggacgtgcgggcgctgactctcatttcggaaaagctgcgcgactacggagcgcccttcaaagtttatggctttcgactcattgacccgcgtttttaccacatcgacacctgcttctgtcccctgaatgatcagatcgccagttactagccctgcgcttgtgatccggtggccggggatgacatgtccgatgaggtcgaacttgtacccgtccacgaggagggggccatgaga

SEQ ID NO: 93616 - DNA, 661 bp, Heterodera glycines
  SCN-specific regions: Sequence locations=1-44,67-122,144-351,373-661
agtttgagcagctcatcttccactcaccccgccttttcaatttgcctttttgcccgtccctccttatttaagcaatttcttttctcttccaaattcactttccatttgccctccttccctagccaatttgtcccccttaaaaatggcactcgtctccaaatggcgttccgaccctttcgggcgttctgactggcccagcctttggcgtgatcgcttttctcgcgactgggacgattggccccgcgattggccacgcccgggagaactgatggaacgtttccgttcccgcgacttcgaccgcgaccgttggtggcgagattggcccactgattggccccggatggacgcaattgtgccaagattttcttcacatttggaccgtttcgaccgtaattggcgtgacgaccccttttggcgcgatttgtacccgcgttgggccgagcccatctttaaagatggcatcgacgtcaaaactaacatcaccaacgacagtaaccgtttcgcagtcgaaatggacacttaccaattccgcccggaggaacttcaggtgaaaacgatggacgacactttgctgattgagggacggcacgaagatgttcgagacagagacaattacaccaaaatgtatttcgtccgcaaataccaattgccggccgatgtg

SEQ ID NO: 93617 - DNA, 216 bp, Heterodera glycines
  SCN-specific regions: Sequence locations=1-102,174-216
attataatacgtattatgtgatattattatctcccggcagatcaatgggtgagaccaatgcgatgggaagaataacacaacattaaccccggcgggggtgagaataaatttaaaaaaagaaaagaaaaaaataattattgttaatttatgattttaaaaataattttatttttcaaaacatagcaggtaaaacggattttctgtaatagctctgtt

SEQ ID NO: 93618 - DNA, 497 bp, Heterodera glycines
  SCN-specific regions: Sequence locations=1-497
gtttgagcttcaataatgttttcttggctaggcaaaaacaccactaacaaaaaggaccaagatgttctggaaactgtcagcgagggcctgaagaaaatctacaagcagaagctgtatccattggaggatttttatcggtttcacgagttccattcgcccgctttggatgatcccgactttaatgccaaaccgatgattttgttggtcggacagtattcaactgggaaaacgacgtcttttattttaaactgattatgacaatcagaagatttaagattcattcgctatctgttggaacagaactttcctggaattataattggtccagagccgaccaccgatcgtttcatcgtggtgatgtacggcgaaggttttgaactttgcccgtttctgttcatttgagcaactttagaagaagctgttattcctggcaatgcgcttgtcgtcgactccactaaacaattcagagcactgacaaaatttggaaatgctttctt

SEQ ID NO: 93619 - DNA, 562 bp, Heterodera glycines
  SCN-specific regions: Sequence locations=1-4,31-55,95-562
tgagtttttaatttggtgttttagaaatggttgactgaatgaattgcgtgccttttttcctttcctttcgttgcacttccctttcctttcccttttcccgtcgttttatgactgctcaccaagcatccgtcgcattgcgtcccttttattttgctgtccatcccgacagattcgcgacagaaccgaacattcgaaataacaatgagaaggcgctgcagccttttcccgaggccaacagcccaacaacagccggtccaggtcgatttctttgtccgagggaaagataacaaatttcggagtgttcggctgtcattgtccggctttgatgttgagcaaattgtcaggaccactttggaattttgagtctttttcggcgtcatcaaaagaatggtcagctcatggattggacgaagtttggcaggatttgcaagaaaatgagcgaatgcgaaggcaacaaacggaaagttcggcggacgaccttttttgtggcattttggtgaacagagagaaggcattgcatcggttggacaaccaccggagcataatggaactgatcagggac

SEQ ID NO: 93620 - DNA, 454 bp, Heterodera glycines
  SCN-specific regions: Sequence locations=1-107,129-454
ggctttctttactcgccattggggcgagcgattcttgccacacaaaaccctttgctcatcaccgaccattcccaaaattaccttggagcatttccggcattatttggacaacacagagaagaaacaccgtcaatatttgcgagtgcgaaaaacacttcatcggagccatggccatctcatcagagagcaaatcgcaccggatgaaatcccttcgattttcttctcctccgccttttcataccgtgactcggctacttttgaagcaggtttccttgagccccgacaaggggaggccgacaacatcatttccggggccgagcaaatacggggggccgtgggtattgactctctttatcgtcccgcgagttgtggatcgctgagctcgatgcaaagggtgcaaatgatcattgctcctgctgacgaggcttgtcacgggcgaatgatcccgcggagc

SEQ ID NO: 93621 - DNA, 310 bp, Heterodera glycines
  SCN-specific regions: Sequence locations=1-73,96-310
ccacctcaaacagcagcaaccacattttgctgcttccgtttggcatccgtcgcatggccaagaggctgggcccggctcgccctctgtgtctgtgttcatcgccttggccaaagagggacggcgtcgatggtggcactgctggcgcagcggctgcgaagagcggcggagacagcgacggcacgagggaaatggcattggcaccgctgctgctgatcagtcagtcgctgcacactgccaaattcggcgattgcttttgaatcactttgtccctgcagtcggacggcgccttccgtttttgtgttgggcgacg

SEQ ID NO: 93622 - DNA, 485 bp, Heterodera glycines
  SCN-specific regions: Sequence locations=1-76,100-169,191-281,318-485
gcgacttggctgaagaaagcgaaattgccgaaatgattgacatttttcgtgccgtggctgagcagcgggaggacgcagatgggtaaaaattatttgtttttgatccaaaaaaaccatcaataattcaggcaacagaacgagcaccaacaacggatgtaatcggtcgaatgagaggggggaaaagcggctcaaaagaattggacggatgtgccgaattatccggaagatattctcgatcacttatgtatttaatgctgtgtatttattcatatttgaattcacttgtcgtgtttgtctgctctgattgtgcataaataacattctttgtatgataaattatataaatgaattatgaccagggctgagattttttgaggctgtgattttttgtgaggtttgttttttgggagaaagcctcaaaaattgtcattattttgaatcgcattaaaatgcaaacaatttccgccgaactccaaaattttagg

SEQ ID NO: 93623 - DNA, 599 bp, Heterodera glycines
  SCN-specific regions: Sequence locations=1-599
cacagttgtacctcttcaatcacagttgtacctcttttaatcacagttgtaccttttctgatcactgttgcacctcttctaatcacttttgtacctcttcatcaaatttgtacctcttcaatctctgttgtacctcttctaatcacttttgtacctcttcatcaaatttgtacctcttcaatctctgttgtacctcttctaatcacttttgtacctcttctgatcactgttgtacctcttctaatcactgttgtacctcttctgatcacttttgtacctcttctaatcacttttgtacctcttctaatcacttttgtacctcttctaatcacttttgtacctcttctaatcactgttttacctttcttaatcaagttgcacctcttctaatcacagttgtacctcttctgatcactgttgtacctcttctgatcactgttgtacctcttctaatcacttttgtacctcttctaatcacttttgtacctcttctaatcacttttgtacctcttctaatcacagttgtacctcttctaatcacagttgtacctcttctaatcacagttgtacctcttctgatcacttttgtacctctttct

SEQ ID NO: 93624 - DNA, 625 bp, Heterodera glycines
  SCN-specific regions: Sequence locations=1-154,328-378,422-470,492-625
gatggcattgcggaagaacgaagcggaccgagcggagtggacgcaatgacactgaggatggcactgatggaagagataacgcaacgatcgcggaaaaaagagaaaaacagagataacacggaaaaggacggagagaagtgcgagataggccaacaaaagcagagagtggaagagaagcagaggatcggagagagacggaaggcggaagaagatgaggaggaacaacagcagaaacagaggaatgcgagagtgacagagagggtggagagaaaacaagcgaatgaggagagaaaagaagtcgctgaagaacagagaaagagaggaaaacgacggagcggtgagagacacgcgaggaagagtttgttcagcagcagcagtgaagaagagggcgcggaagaagaggaggaagagaaggaaaaggctttcaacatctccaccaaaccgtcgctgcccgttttggagaaccgaagacagaaattggaaaatggacccgattcgagcctcggtcgttcattgtctcagcgtcctctgtccgtccaatcgtttggctcttccgtcggagatggaacaacaaacatttctgatgaccgtaaaacaaccgtctccggtcaaacgccctctttgg

SEQ ID NO: 93625 - DNA, 385 bp, Heterodera glycines
  SCN-specific regions: Sequence locations=1-385
caagtttgagctcgggttatctggtgatcagtttccctcaattcctccgatcacatttttatttgtcccgcgtgccatcccccggcgtccatccgtcgcccatttcggatgcccgcccctgggcaatgcctttgtcgccgtcttccgtttgctcttccgctgcttctccttttgctgtttcctccgcctctcattccgcacttgccaattttttccgcttccgctgatcagtgccaagcgccgcccctccgcatcggtgtgctccttccggacgcataccggcgccgcgtggagccttggctggcattggcccaacggcacatccgccagttcagcgccgcaccgacgccaaattcgtctgcccattttcttcgtgcccattgcc

SEQ ID NO: 93626 - DNA, 543 bp, Heterodera glycines
  SCN-specific regions: Sequence locations=1-543
agtttgaaggatggtataacgagaattttgagaccgaatttgagctaggttagagaaagtgtgttttaaataaaattttgtatttttttaggagaacagcttaaggtttactgtgaaaacgatgtggaaatactgatggaggcaattctgaagttccggcaattgtttttggatattactgacgggatggatgtgttgaaggacagtgtcacaattgctggggtcgtgatgaggatattcaggacgaaattcttgaaggacaggcacattccgatcatgccggagggaggatatgaaagggctgataatcagagcaaaattgccgtgaagtattttgaatggttggcgcaccgggaaggcataagggtcagacatgcggaaaatggtggggagattaaattcggtgacctcaaagttgattgcgtcattggttgtcagaaaagaataattgagtttcaggttttcaaaaataaaagtcatccgttaatgtgagttctttaaggggtgtgcataccatgggtgcaaaaattgttttttgccctg

SEQ ID NO: 93627 - DNA, 653 bp, Heterodera glycines
  SCN-specific regions: Sequence locations=1-219,262-374,396-653
cccaagcccaagccgaaaaccctaacaaaaaaaactaataaattaaaaccattggccctaaaccgaccaaagcgttgtcattcatttagccaaatgataatatcgttccgtctaattgtcatatatttcgcttgtttttcccattctgtccatttttgctcatcgcgcgcaattggacaacggaccaacaaaaaagcatttctgaaattcacattttggaatataatatttaaagtttttttatcatttttttcaattttaccttccccaacggtggccttggacacttagttttgtgaaaaaacgctcctcagtttttggattggtcaagttaaacggcaccctcaaatgacgattatgttgaacagcgatgatgaaattggcaggggaagaagcattggaaaaagcctaagggaggggaaaacaaattaatgaaaatcaattaaataaactgcttaaacaacacctctttggccctttgaacttgtgtttcaatttgcctaagaatcaatgcgtaaatggcggcactttgtacaaatgcaaattcgtacaattagccgcgtttcgtacaaaagcatttcaaataaatttgaaaaaagctaacctatttttgacttttttctaaatgctttaaatgttatattaaacgcttt

SEQ ID NO: 93628 - DNA, 634 bp, Heterodera glycines
  SCN-specific regions: Sequence locations=1-1,23-205,227-396,431 -597,619-634
gaagtgagagggaaagggaggggcggggggaatttgcccaagtttttaaccataaaaatagcttacgcggttgcctgcaaaacaatttcagtaaaatccaaaaaattttcccgtcaatgccgataaaagtactcaaatttccaagattttccgggtgtcgtcagttggctccacccgaccttatcccctgtttcccaaagttttcctaattctttctattgtgcttcagaatgttccactgaccattcggactctgttggcggccggcattcgcatttggatgctgaccggcgacaagttggagacggccgttcaaattgcgcagtcgtcctccctgtgccacaaggacacagaactgatggtgctcgcagaacgcagattcgacacagtgttggccaaactgcaggaatacacattgaaggtggtcaaggggggtgtctccgcaaggttcggcttggaagccgcagaacaaaacggatgaggaaaaagtgtggacaaagcaatctcttttatggccaaattcaactggtggaaatttgagctatttggtaaacctgggaaattggttgccaattcctttgggaggaatgaaagcgattgggtgcaaaattgctggtttgctttccttattaaa

SEQ ID NO: 93629 - DNA, 620 bp, Heterodera glycines
  SCN-specific regions: Sequence locations=1-327,351-434,456-513,536-620
gtccgcctcgaccgtcattcagagcgtcctccaacaggttctttctgaagacatttcattggccgcgaataatgacgaaaacgacggggaggaggacacgaaaaagcaaaatggcgatgtccctcatgagcagaaggaattgaaggaggataacaacagcaaaaaggcgggccatgggacggacacggagctgtcttcgacgaatgttgtggtgcattatgagaatttggtggattcatcggccacagctccgcctcgtccccctcagccgtgccacggcacgtcgccaacccatcacaaattcaccgccaatataacgacgaataccaacaacatcaacaacagcaaaagcattgtctcagccgataacacttcgccaaaacacgctcctagcagttcgagccaaagtgaagttttgtcaatcctcacccgcaaacagcaacaacagaaaaccctgcaattgtccgccaacaaaaaatttcatcggcgaagcgcatcggaccgatcgccggcaaagctggacaaattgccccagtgcaaatcgcctaggccaacccatcagaagtcgtccacttgggagcctcatcaggcccaacagcagcacaaactgttgctgggcg

SEQ ID NO: 93630 - DNA, 516 bp, Heterodera glycines
  SCN-specific regions: Sequence locations=1-210,232-494
aatcgcttcacagcctaggtagcgaagctcaagaagcgcgaagcgcttatttagaaacgggcgcgaagcgcccgtctgaggacgcgaagcggccttaatagcccaacaaatttagaaacgggcgcgaagcgcccgtctgaggcatcgaagctgccttaatagcccaacaaatttagaaacgggcgcgaagcgcccgtataagcccaacaaaatttaaaaaacgggcgcaaagcgcccgttcgaggccgcgaagcggcctaacaagctaaaaaacgggcgcgaagcgcccgtatgagttcaacgaatttaaaaacgggcgcgaagcgcccgtccaaggccaacaaaaattgaaaaaccgacgcgaagcgcccgtaacgggcgcgaagcgcccgtatgaatcaacaaactttaaataacgggcgcgaagcgcccgtccaaggccaacaaattaaaaaacgggcgcgaagcgcccgtcttgagcctcgatgtggactaaaaacccctaaaaatttttta

SEQ ID NO: 93631 - DNA, 625 bp, Heterodera glycines
  SCN-specific regions: Sequence locations=1-234,257-625
gagggttccatcgtttttcctcgtgtccctttgattatcgtcgaaggtcccttggcggtctgtcaacttttggagactccgttgctaaacctggtcaattacgccagtttggtgaccacaaatgcggccagattccgattggctgctggcgaatccatcggtctgttcgaatttggccttcgacgtgctcaggggcccgatggcgctttgtcagcgtcgaaatattgctttatcggaggctttgatagcaccagcaatttgttggccggcaaattgtacggcattccggttagtggaacgatggcacattcctttgtcacttccttcgagcccgatgaaccaatgaaacgtccaaatttgctgcttccaaatgacaaagtggtggacctattccaactgtccaaggacaaacttgactttttgttcaaaattgattcgattgattgggaagtcgcgagaaatgacttgaacatgggcgaattggctgcattttgtgcgtatgcaattgcccaccccaaatcattggtggcactggtagacacttacgacacactccggagtggtctcatcaacttttgcgcctgtgcattggcccttgccgacctcggcttccgtgccatcggat

SEQ ID NO: 93632 - DNA, 592 bp, Heterodera glycines
  SCN-specific regions: Sequence locations=1-31,53-189,211-220,242 -282,319-450,472-531,553-592
gaaacattcaaaaatgcttataaacatacggttaaatgtttaataaaatgtggcagatgtagcggctggggtaatactatttttttcaccaaaatatttatttttaggtccgaattttccatgtaaaattgaaaatattgatccaatcgaatgtgatgcttgttaccggattttttataaccaaaaatgttttaaaaatcatcttgaaaaagcctgcaaattttataaaagatgtgtggattgtgataaggaatattataatgatcatcaacatatttgcggtaaatattattttcagtaaaaataatttttaattaaggtgaaaaaatatgtaaaagatgtaaattacgacatactaaggacgaatgttgttttatcaaaaaattaaagattccgaaattattacctaaatacaggataatatgttatgatgtggagtgtagcgtaagtatacatacagtaaaataaaataatgattgtggatttagacagataatttaattgaaaacggcaaaaacaatgggttaaatgagcataaaattaattttatttcggcacgatacacgtgcagtttgtgtgaacatgtcgtacg

SEQ ID NO: 93633 - DNA, 591 bp, Heterodera glycines
  SCN-specific regions: Sequence locations=1-591
acttggccactcttaagttcgtccacgccgtgtggcgacacggcgatcggtctccttcgaaaatgatcccttccgatcagacgaacactttggacaaatggaaggccaaatttggcggactcggtaaaaatacttgacggggaattgacaatggcacacggaaatgaagttaataatgccaaaatagtgacgatgaaaacacaaaaatactgtaggtcagctgactgccgacggtgcccagcagcacttcaatttgggtcgactgatgcgccaccgttacgacggatttctttcgtgcaaatttacgcccgaagaatttgtgtaccggtccagtgactataaccgcaccaaaatgagcgcaattgcgaacattcaaggtcaattaggggggaagggctcaaaaagcaattagcatttgttatgaatggcaggactttcaacggttttaggacttttcgcgccggacagtcaaaagggccccaaaatgccattggaagagaatgccccgcgggggttggaactgtgctttttgccccaaggccacgacccgattgtgttcgatgacgtggagtgtccaagggccagcaaagc

SEQ ID NO: 93634 - DNA, 497 bp, Heterodera glycines
  SCN-specific regions: Sequence locations=1-497
ctcctcttccgtttttgtgtttcttccgctgtggaccatttgtccgtctctcctttcggcactttgtcccatcgtcgcaattgcgacatcgtttcgtacaacttcagcgccctcgtccgaaatgctcggccatttgactcggccgaccgaacattcgtcgctgacactccgttgggcgttgtgcttcggcgacgctttgacttttcttcgccgttaacagcgaatgtctccgtccatttgtccgtgctcagtgccaacaacaaacttttgcttttctcccgcttttcctcccaaatgccatcgccggcggagggcgaaaatgcgcaaacatttcaatacgtcaactacggcaatgtgctcatttttcagctgagggcgaaatgcgccgacggatcggtgggccaaaaatgcacggaaatttgtgcaccaccgaaggcgggcgaccattacttctgcgctgccgatggaatgcgctgtgtgccggggtggggcggcac

SEQ ID NO: 93635 - DNA, 649 bp, Heterodera glycines
  SCN-specific regions: Sequence locations=1-649
ctgatggccaacttttgttctgtgctttcaaatcattttggcctttttctgctttttttggcctttgggtcaaatggccaacaaagggaacacgcggccgaagtgcgcgcagtgaaaggaaagctttttgtccacatgctccattcggcttacttctttccccagacagggtcgtcctacgctgccccattggctccatttgttcccctctcggcaccgttccatcgccttccttctcggcacccccgtctcgcctcactctcacttcccaattcacataattgcgcgtcgtcttgacacttttcaaagctcggaacggtccttcgccattatcgcgagtgacgacgtgcaattcgatggcggtgctcaacaaatagccgaaatcaaagtcaccaacgtggacgcggaagaactgatctgggaactgataagaggccacaaaatggccaaaggattggagagggccattcactcgaccttcagaggacgcggggtcaaccctttcgtcttcaatattttgcccgggacgccaaaccctccaacggatgaagtgcttcatcagttgcgccaccaattgaaatttggcgcaattgtccaagttggcacccaagcccatttccactcgaatgtgcttcagttggcgcgtggc

SEQ ID NO: 93636 - DNA, 661 bp, Heterodera glycines
  SCN-specific regions: Sequence locations=1-661
ggcgcacggaggaagaaaagtggcggaagtcacccccggaagcaatcgatggtttcgtttctcttcgccgccatttcctcttccgcgccgtctattcagaatcggcgccggaaccgacttcccccgccccgacaattgagtgtgccggaacgcggctcattggtggacctcaattcggaggacgaaccattccgactcgtccaaaaggcaccctccgtgacggtgtccgcttcttcgagttacagcaatcagcgaacgccgcccacaaatcggatgagcagagaatgcctttcgggcagccaaacggacggaatgcccccaagtggtcattctcagttcgttctgtttggttttgcctttgggccgcgttcgtcctctttcaagtcgctcattccgtcgtttcccctattcctttggcatttccgttcatttctttcagtcggttttcttccaatcattcgccgcctttctccgagtcgcattttttggctcaaattgacccaatccgtcagtgtccgtctctctcccgcgcattgcttttgcgttgtgtggacccggagcgtaagtaatgaagcaacgaaaatctatcaattgaactaatggctctgttagcactttatccgtttcttcattgcgccgcttttgacagcggagagacgag

SEQ ID NO: 93637 - DNA, 477 bp, Heterodera glycines
  SCN-specific regions: Sequence locations=1-477
gtcggtccttccgcaaaaatggtcctttgtccgctcagtttaaaccgacaactcgggtgcacttgcaccgtcctttccgaaagtcattcggtccaaattctgtgcaacggtacccaacccgacaaagtatgggcagttttgggcggtttcgcccccaacattgacaaattggcaatccgtcgctgcacaacgaacaaaaagagcagcatattgaagaatatgctcccgttgaaggttcgaagccttgagatttccaactgcgcaattgcacaaatccaaccgaacgcctttgactcgttggccgattcgttggaagagctgtccctcgaaagcaatgcgctcacttcttccgaatctccacaaattaaagcgtgtcaaatccctcaacttcaacaacaattcggtcaaagaactgtccgattcgacgttttctggactcaaggagttgaaatttctgcgacttcgaatgaacaaact

SEQ ID NO: 93638 - DNA, 405 bp, Heterodera glycines
  SCN-specific regions: Sequence locations=1-106,128-167,208-210,243 -326,348-405
gaaaattgttttttattcctaaaaaccgccacattgggcgtttcctaaatccgccatgtggtaggaaaacaaaaaaatgtaagacatataaattcataacttggtccattttcaaccaaattaataattcttggtatcattcaatagctctaggtgttttctatcagaatataattttattaaattttttacttaagtatataaaaagatatggtaattaaattccacaaaaccttaagtcataattttttgtccagaacttttttgaaactcaatgaaattttttgaaattttaaagatatatagaataaatagagtacttgaaattctaaaaagaaaatttaatctatttgcttctgaaaaaaagttataaatcattgaacaggctatgttttttgccatggt

SEQ ID NO: 93639 - DNA, 611 bp, Heterodera glycines
  SCN-specific regions: Sequence locations=1-98,123-611
tgatgcccatattggacttgtttgggtccatgaaattgacaatgtcgcgtcggattgtcttgttcatggtcaagtaaattagggaggggaggcctaacaaaaattaatttaaattaattattggccaattctttgaattatttgagtaccatgtgcccaaacccagagaaatgaggccaggtaaatgaggaggtcggaaattcgaaagaattgcatgtaaatgtagatgaggccacagaaagtgttcacggcggagatggccaacacttggagaaaagtctgccgaagggatgaaacgaaaagaaatgagttgggtggacagacccctcacaacggcactttggctgtgccattctcttaccgctttttgagcccttgaactgcttgcaaaccctcccgaagaagttttgtagaagaaaacgaaggtgaagaccaaataagcggaactgaggccgatcgttaccaaccaattgtggaatatttgccaattgttgtaatactaaattctcaggtaatagattttttgaaacttaacgaatttttttcaggataatagaaaacacttagggctatcgaaatattaagattttgaaatctggttcattttgtgc

SEQ ID NO: 93640 - DNA, 484 bp, Heterodera glycines
  SCN-specific regions: Sequence locations=1-456,478-484
ggctcgcctttcaagtttctttgaaagcattgggtggaaggtgtacaccgttcctgagactgcgtcaattctgctgagtcctggacgcattcgttttcctgacctgagtagagaccaggctgctcaattccagatagatttgctcaaaacattgatacaaattgagaatgtactgcgttttctaatgcacaactcatttctttacatttttaggtctttttcaaccaggccgaactcagtgaagcggaaaaaattatgatcattttagaccggggtgcgatggatggaagtgcttatatcgacatggaatcttggtcaaatgtattgtcagcatgtggcgtggacaaccatgaaatgcgtgaaagataccaccaaatttatcatctcgtcaccgcagcggatggtgcacaatcattttatcaacttgcgaataaccaagcccgaaccgaagcaatggaggaagccattgagattgacaaaaaga

SEQ ID NO: 93641 - DNA, 528 bp, Heterodera glycines
  SCN-specific regions: Sequence locations=1-89,116-242,264-329,369 -399,421-428,477-482,516-528
cgggcacgggcaagaccgccaccttctgcgccggcatcctgaacaacatcgattacaactcgaacgagtgccaggcgctggtgctggctcccacccgtgagctggcgcagcagattgagaaggtcatgcgcgccctgggcgacttcctgcaggttaagtgccacgcctgcgtgggtggcaccagcgtgcgtgaggacgcccgcatcctgggcgccggcgtgcaggtcgtggtcggtacccccggccgtgtcttcgacatgctgcgccgccgctacctgcgcgcggactccatcaagatgttcaccctggacgaggccgatgagatgctgtctcgcggtttcaaggaccagatctacgacatcttccagctgctgccccccaagctgcaggtcggtgtgttctccgccaccctgccccctgaggcgctggagattacccgcaagttcatgaacaagcccgtgcgcattctggtgaagcgcgatgagctgaccctggagggtatcaagcagttctacgtgaacgtggaca

SEQ ID NO: 93642 - DNA, 653 bp, Heterodera glycines
  SCN-specific regions: Sequence locations=1-355,378-653
caggagcacgcaagaaaagctggatcaacaccaaaaagtccacgacaaaccacaaaagctccatcaacaaccggagagggaacatcgaccgagacaatgccatcgacttcgaatgctgagccccgccaacggccaagtccacggccactgtcaacaacgcctatcaggcgccatgtccgcacgcggccaacaactaccgaccaaacaacaggcaccgactctcgagcagcagtccagtcaacccaaacgtttttagaaaccgtcgaaactgccacacagacagaaacagagcaagggccaattcaaaggctgtgcacggagctgaacaaggcgaaacgccgaattgggacgctggaacgccagctacagaggaaaacagaagagatgaagcagctcagaaagcgaccgacagagcaccaccgacacaagctcaaaagagtcagttcattggatgatttgtcaaggcagagccggacaacacgtgcaaaggaaatagctcggaatcttagccatctcttccgaccagacactccaatacccgaaatcgacaaagttgtgcgtcaggcccgtcatcaggccaatttcatttcgcccaaaaaatcactcggaaaatggactcgaaatgggcgaacaaggaaaaaagaacggatcag

SEQ ID NO: 93643 - DNA, 660 bp, Heterodera glycines
  SCN-specific regions: Sequence locations=1-248,553-580,614-628,653-660
caccaagcttatggaaatccaatgagttttggttcccgggaaatagcgaattccatgaaaatccgtgacgaggaaaatcacgacgaaatcccgggctaaaatcttgtcaagaacccggaccaaatcatggtaaaagtatgacagcaaatggtaggaaaataatgaaatgaacttaaactgaaaacgatggatgaaaattaaaaattcacatgtgtcaggcgtccaaacacgtgcgcgaaaatcactccttaaattaaaaaaaaatatttaggtaaaaaaaaaaaaaattaaatttatacatttttaaatttaaattatattatatatataattattttatagataatttaaatatttagtttagtaataaaaaaaataaaatttgtaaaatatttaaattatttttattaataataagtttaaaattggatattcacacagaaaaatgttttaaaataaaaaaataagaaaaataaaaatatttttaatttttccttttaaattaaaatatttttaatttttcctaattaaaaattaaaaaataaaaataatcaaaatggtacccactttaatgttatgttggtggtgcacacatttaaatgcttaaaacttagtcgagggtcaagcctaaattaaattaaaaattaaaaaaccaaaaac

SEQ ID NO: 93644 - DNA, 656 bp, Heterodera glycines
  SCN-specific regions: Sequence locations=1-465,488-656
gaacatacatcaagcaatattgtcctaagcctttggacaacgagtcgagctaggctgaaactgcttgactatatgctgcaatgttataatacaccgggcaccgagttactatacactgacacagacagtgtaattgttcggcataagcgagaccttgttccagttcacacgggcgagtatttgggtcaaatgagcgaagaatacgccgattacgacattttaacttttgcatgtggcggagcgaaacaatatgcaatgaaaatggtgcataaacagacaaaagcagttaaatttgtgcaaaagattcgaggcattacattcgacgtcaacaattctcaggagcttcagtttgagcattttgtacgcaaagtgatcaactacgggaaagaggatgagcaggagaatgcagtagtcttcaattataataaaatacagccgacaaaagataatcgaattataactaggaaacaaaataaaaaatatttacctgtctgtcagaaaggcattattaatcaaacccttgaggttttaccgtttggatatgaatgatctttttgaatgtataaaattttcagtttactatttaatttctttataattgcagccattaaaaaaatacaacaaataattaagcagtttcatcttgcatagctaac

SEQ ID NO: 93645 - DNA, 617 bp, Heterodera glycines
  SCN-specific regions: Sequence locations=1-617
gtttgagtcatccgttcaaatggcacaagttgacgacgattatgaagcgaacaaaagggtggcggatagtttgagggagtatatgggcaggaggctaaatgttgcgaatgccttcgaaacgcccattttggaagggctaatggctgctgtgaaagtggagccgctgcaacgcattggcactgtgttggacgccagcgccagatgctatgcattccgtgtggacaacacttacagtgcctgctacaaagttctttcagcggcttcaggaggagagaaaattgccccatttcaaaacgacgattggcagaacgatcgggatgaggtcgagacggtcaatgcgaacgacgagggaggggacaaaagcggaacaattgcgagcggtgaagatggagaagggagcggcgaaggaaacaaacgggacaaaaacaaactgtcgaagccattggactcgtcgagaaaagcgaagcttttgacgcgagagactcaccaattggctgagggactttggaagcgatttgcttccgctcaacactttggggacacggaagatgatttgcatgcattgttcgaccaattatcaactgatgttactgggacggtaatgaaacgacgtcttg

SEQ ID NO: 93646 - DNA, 634 bp, Heterodera glycines
  SCN-specific regions: Sequence locations=1-30,81-634
cacaagtgtctaaacaaattattggattggtaaatttttaaaaattgtcaattaaaatttaagaattttcaaaaatatttccgaattaattgccgccatttgccaatctttgaaaaaattttcggcattttcattatttttatattttttgaattatggaaaaaccccaaacgagcactctcttcaaatccatgaccaaactgggcccacccttttttaattggctttcggttgccttaaaatgccatcgaattggcactttttgccttttgaaccattgaatttgattttttcgaattattttttacgatgcgttttttctattattttttgctaaattctcttcaaagagtcacaggaacgtggtgcactgaacacatgcgaactgttctcaattcccgacctttgtcctcagcccaattccccgccaatgaattcggcacgacgcgcgccggcacttttccaatttaaaaaagtaattagcaccattttcggcaactgatatgatcaattaaatattcattcccccattgatttgtttgttcagaatgtttttgcggtcggtggttgttctggcccgggacaacatttggccaacgccgaatctgtccaatttgacggtcattaaatttta

SEQ ID NO: 93647 - DNA, 649 bp, Heterodera glycines
  SCN-specific regions: Sequence locations=1-649
aacttgcgcatttgtacaaactgagggaaatgccaaaaatggtcatcgaagttggggagcacctggacaatgtgtcgtaaccaacgccgatcacaataatggacaggggaagagcagaagccgaaagatggggggaggacacgagatgagtgatacggtgaatatgattgaaaggagaaaccgtgcaggtaaacagcctgtaaataccttcacaatttcttccttggtctcctcaaaatcggtgatcgccccatcggtgacgatcagcaaaacgcagtagcgactgccattttcgggcaatgccgcggcacggcgagcggccaaacgaatggtcggcgtgaaatcggtgggcccactgaaagcaattggcagtgagaagcgaaaacgaaaagcaacagaagcgggtgggttggtccacctgagctccacgtgtgacagcgcaatggcatacgcctccaaaagtccgtcgacgccgcgacagcgcgggtcattgacttccaagttctgaacgaaacgaattggcacgaggcgaggaacggacagacataagatggatttgatgggtgatcagtttttgtttgatcaacaaatgatcaatggtcagtttcttattgataaatggaccaacaatttggattaacaatgtaat

SEQ ID NO: 93648 - DNA, 627 bp, Heterodera glycines
  SCN-specific regions: Sequence locations=1-627
gcacacatgaatttggagctgcaacaacgttccgttgaattctcacgattactgtcaaaggatgaactgaggaatgggctgctggagcgaatgcccgccattgaacacaatgcccttcacaccgcagcgacgccaattgaaatggacgataatcaccaggaattaatagtggcgcaaaaagaacaccaaagccaaaaaccgaaggccgatgaaattgacttgctcgggttgggcaatacggattctcctgctttggttgacattctcttcggcggtggggttccaaatgtgcagcccctttcaagaaatattggcaaagaccccatcgacgacctttttagttttgagtccaggtgaaagggaccgatagatttatttaaaaattgccgtctgatttgatcggttaccatgacttcccaaacattctaaacagtttccgtgttacttttttgacacagtaataaaaacggtgcccttgtggaagatgatcagttgaaaacgggtcaaatcgtgctcaaccagcgtggtatcgagatgcaattattcgtggattccaacggattcgactccaatggattggcacaattgcggtttcaaacagttaacaatacccccgctggagtagaa

SEQ ID NO: 93649 - DNA, 642 bp, Heterodera glycines
  SCN-specific regions: Sequence locations=1-642
gtccgtttggtttcgcccgcattcacttgcaattcccaaccaaaaaccgcgtcttctcaaagcaaatcctactcttttgctgaccgggtgatcgaaacactgagtctttatgttcagtcagttgagattttctttgagtcggacagcggcacggactttgactttggcggctccattagcctgtattcactcgctttggagagcattagccccaattggagtgaggagaaggacgtcgacaccaacttgactcggatccatgacaaaaccattcggcaagtgctcttcttcaagcagctcagctggcgattgctcaaaattgaggcgagtgcccacccgaagtgcggcgccgacgagcaaagggaaccgttgagaagcaaaacaaattcaccccttcgtttgctcaccgtcgacggaaaatgtcgcatttctatcaaaaaaagcagtcaaaattgttctcttttggccggtaaaatcgaactgattctgaaggagatccattggctggcgacgatgctccacctgaggatggccatcgactttcacaaacacttggtggacctggccaactgtcagaagaaagcagattccgtcacaccttttttgggacaacgacagaacccgttcacggacgcctcttcg

SEQ ID NO: 93650 - DNA, 301 bp, Heterodera glycines
  SCN-specific regions: Sequence locations=1-88,115-301
agcctgcgccttgttgcaacgcgcgtctgcgaagcgtcgccgcttttggtaagacgacgccgcggacggagtgccggaagggacggcacgggggacagagagagaacaaaaaagcggacaatagccgaaacaaaagggagtgttccatcgaggcgaccgatgccgaaacggcactctgtgcccgcggaaccgtccaaagtcaagtccaagtcgttcagcgagtccgcgtccgccggctctgccgcttcctccattgagccatccggccatctccgtgacgtccgatcagtggctgatcgcc

SEQ ID NO: 93651 - DNA, 639 bp, Heterodera glycines
  SCN-specific regions: Sequence locations=1-286,316-639
aaaagattggattgcatttcttatttggcgaaagaggctaaaaatcgttttttcggcatcccggatcgacataatttgaagatgtttcgtgtgatcatttccacactttctacgtcttcttatttggtttcggccggtggattgcgtggctttttcacccatctgattgtggacgaagcgagccaagcgacggaggcggacacttggattcccatcggtggcttggttggccctcaaacatcggtcatgttcgcaggcgacccgaaacagctcggcccggtggtccgtccagagaatttaaaatggtttggctttgataattcgctgatgaagaggattatgtacggcgatgtatattcccaagcagacgatcgtgtttttgtgactcttaaacaaacgtatcggtctcattatgccatcctgcgtccgtgctcttatcttttttacgataacattctccaagtcgacgatggacaaggcgactttcacaaattgaccgaatgggaaggccttccaacaaaggggttccctgtcatttttcactcctctcgtggcagcaaagatgagcagggttttaacaggtcgcaccacaatttgttcgaagctgaattggtacggcattacgtggaaaggatactc

SEQ ID NO: 93652 - DNA, 325 bp, Heterodera glycines
  SCN-specific regions: Sequence locations=1-89,113-119,142-273,295-325
ggacctgacgggtgccaacaatttgttggatgagaaggagaagaaagtggaggaggctgaagccgaagtggggtcactgaaacgtcgaatggttgtgttggaagaggagttggacaagcgtgaggagggagttaaacttgccaccgaaaaaagggaagaagggacggccaattgcgacgaatcggaacgtgtggggaaagtgaaggaaaaccgttctctgaaagaagaggagcgtggcaatggcatcgaagaaaagctggaaggaggccgaatcggttggggagaagaagggggagcgaaaaataggaaggaggtcggttggaaa

SEQ ID NO: 93653 - DNA, 576 bp, Heterodera glycines
  SCN-specific regions: Sequence locations=1-18,43-576
ttttttttttttcaccattattataaaatgggcaattttaaggctgcacgtggcacgggtgcaaaaagtgctacccaaacgacaacatgctgctccccagtgggaagactgcggggcaagtgcgcgaacgggattccaagcggatggaatttctgagagagaaggtcaaccgagtggacgtctactgggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctggaccgggagagaaaatctcctattatgacttcacatcactctacccgtatataaagtgagcactgttaaatttgtaacaacttttaacattgttttcttcacagcttcacaacccgttaccccattggcactcccaaagtgcatgttggaaagcggctttgcttccccctgtgcatcacttgcgccaaagagcacccgacaggaggagtggacaacgactaccactgcgagcacaatgacagacag

SEQ ID NO: 93654 - DNA, 518 bp, Heterodera glycines
  SCN-specific regions: Sequence locations=1-518
tggttagaccgtatacaagtgatcttgcgccaccccagctccaagggtggcgcgccaagctagtaaggccagccccagctcaaagggtcgtaccccaagctagcaaggccaacccagctcaaggtggtaccccaagctagcaaggtaaaaaagagtggtgatcctccactcctgcgatcagcgagggaggagttgcacaggctccatcctgcgcgcagtgcaagactctggcttcaagaatccgcacgtgggagacacacgtgtggtcgcaaggtccttcatagccggagcctttacggccctttctcgtgccctgcttactagcatattactctatgctacctgttagcaagcaggttggtacactcggccatccgaaccccactagctcacagttctgaaaccagcaacgcagccttcgcctacgagggctagggctttcggtgcgtgtgggattacacgagactgtcatgttcctaaccagtgcgagccaacaccagaaaggggcctggacttag

SEQ ID NO: 93655 - DNA, 579 bp, Heterodera glycines
  SCN-specific regions: Sequence locations=1-113,135-579
ctgaatccccagccccagtcgaagaatctcattgccacggctggccgagacaaatacattcggatttgggactggtccaagagtacgccgcatttcatttacacagtggagacgatggccattgtcacgagggtttcatggtgcccgaacaattcctggcatgttgcttgttgctttgcctcacccagtggtttcgcttactccgataacattgtttacgtttgggacattcgccgacctttcatcccttacgcttccttcgacactcacacaaaaacatgcaccgatatgtcttggcctcgttttggaagcggtgatcagttcctttcttgcggcaaagatggcaaattggcagttaattttgctgacgatgcccaccatcccattctctacgccaattcagtcgctttggactcaaattcgccgttcgatgaaattaccgtcgctgttccgtctgatcttcgaaagagcagttcagttgtggacccgttccgacgtaaagtgccgagtaatttgttctgcgctttcccttccgacccttttttgatgacttcccgtgccgtgtcatatttcgcggag

SEQ ID NO: 93656 - DNA, 391 bp, Heterodera glycines
  SCN-specific regions: Sequence locations=1-255,277-391
gtacgcgagacttcatctctattcatacatggaaaaagtgattgcactggaaggggctgagcttctttattgtggtttgcgaatacaatagaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacg

SEQ ID NO: 93657 - DNA, 610 bp, Heterodera glycines
  SCN-specific regions: Sequence locations=1-39,61-352,375-547,570-610
cgatcactcgcgacgtggagagacgcatgtcaatgaaggcaaaggaggccgaggcaaaggcggccaagtcgaattccgacgtgaataatgaatctgccgacgatgacgacgatgtgtttggctcccatcagcaccgtcacacggggttggaccacggagttcgccgctttgctcgttcctacggcgtcggtgctgtcgatttcttccgcggggccgtccgaaaagcgaaacaaatcccagagcatttgacacgaaatgtgtccatgtcgaggtccaccaaaaaatccgaaatcattgcaggagagaacgaagacggcgcttcatcgattgctgacagtgacattgaccaattgtccatcgcggctgctgcttctgagccgaacgcggcgatgcctgccattgccacaccgtccacttccgctggcacagccacgcggaagtggcgctttgggtcagccgaaccgccgcgcggcaacactccgtccgtctcaacgccaccgaccacgtcagccgctgccacgtcgagcacccaagggcaaggaatgaattcttctgccccctcgagttccgctccgttcgctcgcaccggcgtttgccggtcaaagaatgc

SEQ ID NO: 93658 - DNA, 622 bp, Heterodera glycines
  SCN-specific regions: Sequence locations=1-622
gaaagtgctcaacgaggaagaagaagcggaagggacacagcccgggacagagccgacgaatcagtacatccaaacgacgtttatccaccgggacgcgaatgatgatgaccgcgagttcgcgcagttcacccgccttatgttggcctacgttcggccccatctgttggcgcttgcccatgtgactgtggacaacgaaaacatcgactgctccgtggacgatggtcatccccgttgtggggaatatccaatggaaaagcctttccattttttggtggtcgaagactcgcgttccggtgccgctgtgtatagcattgaacgcatgcggaattggcacgccggcggaagccgagcgcgcacaatggcacggattgaagctgcccttttggatgctttgtcccgtcacagtgtccatccgctcactttgtacgcctcggaaagcgccaccaatgaattatgttttgtccgcgaggtgagcgtcactgagctcgagcagctcatccgtcaaaatcatgccaaacggtcttccgccgcctctccgtccaccggtccgtccattttcacgcgctcgccaaccgaacttcgcctgctcaacgaccgtctcctcgcccgtcggcgtgtggac

SEQ ID NO: 93659 - DNA, 249 bp, Heterodera glycines
  SCN-specific regions: Sequence locations=1-249
tgtccatgttcgtttgtccctccttttctccttctgttcaatttctcttcagtttgtctctgtttctttcctttgtcaccttattgcgctttttctttttgtttggcgctaaacaacagatgctttgccttgctgatttgcttatttcgttttgtctgctgattgggactcaattggcgtgccgagtgtccgtccgattcattgggccaattgcaatggcccatcctaaacccatcaacagcgaatgag

SEQ ID NO: 93660 - DNA, 523 bp, Heterodera glycines
  SCN-specific regions: Sequence locations=1-104,128-264,287-523
cggcgatagtaccagatgggttggcaccgaaagcggtgaatgaacgaaggagcttttggggcctgaaaagcctatggcataagagggagtgccgagttagaaagtgatagaaaagcattaaaaaatgagaaaagactttgagcaggaccatttgaggaaaaaaaaagccgaagagtaagaccaagttacagaattctcatttaaaaattagagaagggagaaagcacagtatcccatccgatcagaatggggatgagagttacggtaggcatttaaaaatatttctgcaatttacgacctgcttaacagcatctgctgccggctgcagaagcttgtaccgaagctgttgctgctcaaccggttccgcctcgtggatcagttcgagcgcgtggtgccgtcgttggtgctgtgccgcttccgcgtcggcgctgttccgcctgctgttttcgcgcttctgcggaccctttggccgccgcgccccaccgggcggacatttgcctaattgggccgggccccgtgggga

SEQ ID NO: 93661 - DNA, 243 bp, Heterodera glycines
  SCN-specific regions: Sequence locations=1-212,236-243
ctcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagccctcgaagagctgcaccggatgcgagtgccgccgttgctgtacgctcaacggttgctgtgcaaagacggaaaattgcttatcaaaaaa

SEQ ID NO: 93662 - DNA, 656 bp, Heterodera glycines
  SCN-specific regions: Sequence locations=1-366,398-656
gtgaaacgaatttttagcacattaaacacaaacaattaaacataagcgataataattttaaaaaacgaaatgaaaacgaaaaaaatatcaaaaagattcattaattaataattaattgtcgtcacaatcgttttgagtgttcgtctccatccttccgctggctcagtcctccaagtccgtctcgcggatgggccggcagcgctcgtgttggaaaatggcgtgcgcctcgcgcagcagaaaggcaccgaactcggcgatttgtttgcgcgaccagcgcgaggcgagcccagggaacgagccacgcaccacgttggtcagattgtcaacaccttttacggggtggcatcattaatatggcaatttcagaattgtaattgatttttaaaaatcatgccaatgccagggatttgttgcccgacatttccgtccccaatattcgggggacaacaaccctaattcgggttgtcaaaatggagatcgaatttgcattttaggatccctaaaacgcgtttgtttgattagttaattagccctcctatttttaccaccgatggcgtcgatcattgcaccttcgcgcacatgcgcctcagccgagtgaatgttgcagaacaattgttgcgaaatcactccctcgcaaagtgccaaaataccccccc

SEQ ID NO: 93663 - DNA, 434 bp, Heterodera glycines
  SCN-specific regions: Sequence locations=1-268,290-434
tccttgggagtccaacaacgaccagcaaatgtgccatgtatggacttcgctcgcaccagctgatttatgtgctcggaacagttgggcacgactgcgaaggatgagggaaatgtctttgttcaccaaatgccccgatggctttaccaatctgcagctgatcgaactgtttcgactcgactggcgccgcattcgatcagaggaggaccttctcgcccactccgatcatttgcgcgacggtccgtggggccgcggctgtctgatcggcccgaccaactccgccgactgtttgcactgtttcgagcgtctccgacgagcgattgagcaagtggaagccgtccactgggcatttgccaatttgctgaaccgttttgactgtcgtctcgctaaatttggcctcgcttccgcgacagcagcccttctcgcccaacacgacg

SEQ ID NO: 93664 - DNA, 590 bp, Heterodera glycines
  SCN-specific regions: Sequence locations=1-177,215-265,287-471,494-590
gagaatcagcatacgcaatccaagccgttctttgacactgtaactattgttttttgatcatcacttcgctgttgtgtcgatgttagcctctaatcactttgccgtcgtcagccttttgtctgcccattttgctgccctttttcttcttctgatcagtgactgacctcccaaactgatcatccttctgctgctgatcagtccttcctccccctccccaactcttccgccgtcgtttgtcgaggaatgcttttccgcctcacattgttcgtccttcttccatttgtcccatccatcgctgacgaatttcgacaccgaaagttcgaaaagacgggccgtgagattcgaatggccacgaaagtttacgcctggggctatcagcaccttcaggaggaaattgcatccagcagtgccatcgacgacatccggcttcgatcgatggcactgaggacgggtcggctgccgaacagttcaggcatttggaaaaggaagtcgaaaatgggcacgaaaaacgattccaacgcaaatgaacagtcggtggacggacagcatcagaaagaaacaatgacagcacacgcgcgactgatcgaaga

SEQ ID NO: 93665 - DNA, 512 bp, Heterodera glycines
  SCN-specific regions: Sequence locations=1-239,262-282,307-512
ctcacttttggaattgattgatttagtttccagcagaagcaaaactaccaggaggagaaaaggcgaaagggctattaaaaggaggcaaaagcaaaggcaaaggaggaaaagcgggggaaaggggggagagagggcggcaagagtctcgagaatgtgttgatgcttttgtgcttttggtcaccccccccccccctcctcccattggcttcttttggaattcattccctcccttttttaccaattaaatttgtttagtttttaattcctcgaccatttcaatcaaactcttttttgttattattatttctccttttcttatgcaattccccccaagggcccaatttcatcttctcccagcggcgcccttcgtcaaacgctcagtgctcgggccactccgacgaaggccaagtgcagtttgacaacagccgaagacttcggtgggaaagggtgcaacaaaaattgttccattgggaggagccattggacgacgccaaaaggagacgaaagagaga

SEQ ID NO: 93666 - DNA, 654 bp, Heterodera glycines
  SCN-specific regions: Sequence locations=1-118,145-164,188-496,520 -543,565-654
ttttttttgaaaattgcaaagatatataaaatgccaaattttctcattctgtcctgccactatggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcggccactatgggtcaagcccagtgttagacaaaattgctcataacgccaaatagcgtaattggcgtaaatttttgcgcgctaattcaaacacactgatcactgccatttctgattgtttattttgatcagccatagctttgttcctctccaactaaattgacctaaattggtatctaaaataagaatttgaaaaggagaatctttttctagttaaaataactctacagttggccttatttttgtattaaatttccttattaatcgattcagaatttttttctctatcgtgtgcaaaatttggtggggttttaacaagcagaaaaaaagttaaacagcatgaagta

SEQ ID NO: 93667 - DNA, 634 bp, Heterodera glycines
  SCN-specific regions: Sequence locations=1-634
cggggaatgtgtggcttaatgtggcgccgattccatccttggacgcatctgctgatacgacgattggacgtgtcgggtcatagtgggtcagcaataaatcggatgtcatcatttcttttgctttttcgaaagcattttgctgttcagaagtccaattccaagctacgtccttttggaggaatcggtcgagcggtgcacgcaactcacgcatgcatttgacaaatctgccattataattcaaagcgcctaagaatgatcggagggtgcttttgtggatcggtgcgggcattttccaaattgcgtctgaacgcgatgggtctggacgaatgccgtttgctgacacaatatgcccaaggaacaaaagtttgtgctgcaaaaatttgcatttgtccagttggatgcgaagaccgtacttttttatgcgcccaaaaagagtgtaaagtggcgcgatgcgctgctccaaggatttcgtggcgattagtccatcggagacgcacgcgaagactcctgggataccggcacacatttggaccatcagatgctgaaatattgacggtgccgatgagactccgaacggcatgaggtggcattggaaaagccctatatgtgggttgatcggacacaattgcgttga

SEQ ID NO: 93668 - DNA, 303 bp, Heterodera glycines
  SCN-specific regions: Sequence locations=1-97,119-303
tttctctcctaattcttccccctcttcatcattggtgggcgaggggaggggaagaatttttttgtgtgtgccatcacaatttcatcccccccccccaccctcctctcctttcccttcccgtcccgatattattccctcaaatcgctattttctttcaatgcgcacgcttcaatcaatgaatgaataacataaatgggctgccgtagctgctgagcagcgagttcaccccaatccctccatgattgatgcagatagtgtatcaacaaatttcccatatacggggaaagggggaaggggggaagg

SEQ ID NO: 93669 - DNA, 597 bp, Heterodera glycines
  SCN-specific regions: Sequence locations=1-597
gacggattgcgtccgctgtatgcacaccgacccaaagtggggaaaagcggcggaggaagcgatgcgctacttcacttctcttgttgaaacgctcaacacaacaccgaactttacgaagcgctgagactgtcgttggagcgcgagcaattggacgcggtcagcgaacggacgtgccgacttttgctggccgagttcgagcagtccggcatccaattggcttctgtcgagcgaaaacaattcgtgaaactttccgatgaaatcttcgaggctggtacaaattttgtggacggttgtgagcggcccgtgaaactcagcagcgacgagcagaaccaattcggagtgcgcacttcgcatttgaacggcccatggacccaacaggtcgaccgacggctccgatggttcagctacagaaaatattttgaacacgacgaacagcaggaaacctttttacgccgattggtctccgcccgacacaatttggcactgctcaccaatttccagtcgtttgcccatcggggccaaagcaactctttgctgggcacttacgaaaacgtttactcatttcttggcactgtcatcgaaaaatttgtgccaaaa

SEQ ID NO: 93670 - DNA, 244 bp, Heterodera glycines
  SCN-specific regions: Sequence locations=1-193,215-244
gatggaactgatcgttcggctcggctcttatgggctcattcacggcgacttcgacgaatttaacattatgctaaatgaggacgagtctcccattctgatcgatttccctcaaatggttagcatggaccatccgaacgccgacttttattttgatcgcgatgtgcaatgtgtacgcacctttttcaatcggagatttaagtttgagtcagaggattggccccgttttggggacatggtcagaaga

SEQ ID NO: 93671 - DNA, 235 bp, Heterodera glycines
  SCN-specific regions: Sequence locations=1-235
gctttatccgctctgatgactgctctgtgtggcaaaaccaaagaattgcccatcagcaccatccttgaacgactgctatgcacaccaggaccacaactgctgaaggatctcaccggcatcctcctgcgcttccgacgcatggaacatgtaatcctggcagacatcgaaaaggcatttctgcaacttggcatccgatacgtggacagagatgcctgcagattcatttggctcaaca

SEQ ID NO: 93672 - DNA, 575 bp, Heterodera glycines
  SCN-specific regions: Sequence locations=1-575
actcaactgctgtctcccagtcggccaacactcctttgacaaatgttcctgcaattcctcatgctacggcacctccgcaaggaatgccaatcccaaaaattggagtgattgctgcaccgaaactggtcgagacgagcacgcaacaagcccaaaatttactttcccaactcggcatgtccacctctgctcaacgggttttctctggacaacagcccatggccaatgttcacgctcctatatcaactccgacagtggctatgttccggccgcctatcccaactgccactgtggcaaatttgcttggccagcaacccatgccatctttcggtgctgtcccttccattccgtcaaatctattgggaacactcaattcggcacttggcgttccgatggcaattccccctgttcactttaaccaacacacaatgccgccgatggtgggcggatttccctcttcgatgccaccgcagcagccgccaatgatgaacccagtcgagatgattttgtactcgaagatgcaattgtacagtcgagacttggctagcattgacaacatcgctgcgctcattgaatac

SEQ ID NO: 93673 - DNA, 551 bp, Heterodera glycines
  SCN-specific regions: Sequence locations=1-1,24-551
tcaaaaatggggaaattaagggcggggcaaaaagcgtgggtctgtgacccatttgtttgaaaagcaactaatcaaataccaacagatgattgaaagccgtgaagccgaatacacaaggcattgcttgaacagtgcggtcgcaaatacgaaatttcggtcgatgccaattttgctgagcaattacgcgaaaaagttcgaagcattgaagcgaaaaaaagcggaatttacggaacagaaaaacaaatggccgaggccattgagaagctccgcctcagtgtcgtacagctgaaaaacaacggcacacagaagcgacaggagtgtgccaaactgtcccaggccatcgcatcggtcggcggagagggaactgcgaacgctgggacaaaccacgcaaatcattgacaagctgagatattgtgaagtgtgagtcgcagttgaagcagctcagcgacttctctctgtaggacgacgtgtggaaaatgctgcagggcattcatacggacctgaacacattgcgcatggacatggtgtagttggccagcagtgccggggac

SEQ ID NO: 93674 - DNA, 474 bp, Heterodera glycines
  SCN-specific regions: Sequence locations=1-474
cgcggctgccatgttggatttgcgcgtggcggcgtggtggtgtggtggtgtggtggcaggaacaagggcgaagctttaacttacccggcgctcagcgcttcgttcataggttcggcgcttgagccgtggtagcggcaagtgtgcccgcggcaacgcggggcaaagcgaagacgccgatgacttgacgcctggtatgacaccttggtctatgaagtcgcgctgcggtgctgggatcaagaaacagcaactcgaggaaggtatcatcgagcgtcgttatacagcagacaaggtacgaaacggtgtgcaggagggcatgcacagcagcttcaaatggcacgtgcatggctctgttgcgaacaagctgctctgagacacggattgagagcccttaatcggtggtcacaagaggtggggttacggtatcggggcgctgcgatagtcctgcaagtgctgcctgttgaacacaagggctca

SEQ ID NO: 93675 - DNA, 598 bp, Heterodera glycines
  SCN-specific regions: Sequence locations=1-290,312-598
aagtttgagatcattctcacctcctgctgctgttatttttgaacaacagcgtccaaactcagcaagtcattctcattcacttcttcaatacatccaaaattggctcaacacattagacaatttttcacaactgcaagaaatgttgtcctggttgcttaatggtccgctcagtttgctgcttgtgctgtctggcattgtgctgaacgcactttgtgtggttgtgttcgtgcgatttcgtcgaaatgttagcggtggcacaactccgataattcactattacttgatttctttggcgggatggcactcggcacttttgttcaacgcctttttgctttactgtctaccgacaatgctttggggctccgtcgtctcatcgggtccctatgtgcatttgtacccgccaacctacgctttggcaaatgcgacacacaccggcactgtttggattattttggcactcactttggaccgctatttggcgttgtgtatgccattcaagcatcgaattttcagcaaaagaagccgtgtgaagcgtctcgttgtcgggctttcaattggcgcgctgttcttctgtttgccacgctttttcgaagtgcaa

SEQ ID NO: 93676 - DNA, 263 bp, Heterodera glycines
  SCN-specific regions: Sequence locations=1-81,103-241
gtttatttacaaaaaaaaaaaaagacgcggcgaactccctgtgtgggtcgtgagaatgatactttgccttatggatggacaaagtattagaaaaaccaaaaatggggggggggaaagacgggaaatcggagattgagtgatcactgatcaacccgatttggttggtataaactcactcgctgcggtggccaacaaaggcggcaatgaggcggagaaacaatagccgaggcctgggatagacatttaaaaaaaaaaaaaaaaaa

SEQ ID NO: 93677 - DNA, 607 bp, Heterodera glycines
  SCN-specific regions: Sequence locations=1-31,53-117,142-335,374 -468,530-551,578-607
ctcctcctgctgatcagaggttgcttttagcaaaatttgatggcattgtaaattttttttcccgaaaaatgccgattttgaaactgaattttctgcaaccactaccttgtggaaaaacaggagcagcagcagcagcagcaggtgaagaaggttcacaactgggcgatgaacggcgcgatgaacggcggcggttttccgtggtgaatgttgtggtggttgtgtacaattgttgctgggttaatgagcgttgtttttgttgttgacggccatggccatggacatcaacaacaacgcgttgctgtcgatgaagccgcttattgctgcccttaatactattgttgttgctgttgttgttgctgttgttgttgttgttagtgccatgcttctgcttttgttgctgctggtattgactaacaatggcggcggacgcggtcaaatggcgccaaattcggttgaaatttgttccactatttaatataaaaataaataaaatgaaataatgatttttaataaataaaaaaaaaatttacaaactttacacatgctccataaaaataataaaatccaaaaaaattcgttaaaaaattgtttttttttatatccgccc

SEQ ID NO: 93678 - DNA, 551 bp, Heterodera glycines
  SCN-specific regions: Sequence locations=1-551
gtgaaccgaatggcatcgagtttaaggaggagggcagtgagtccgacagttgttgctcttcgattgtccaggtgtacaacagtgggagttgtggaagcaaaaaatggactgtggaagcgctgtacgaaagctgtcggatgaaagtgcgaatgacgggatcgggtttaatgatggatgccgaaattatatcgaagcggaaggagccggatggaacatacaggttttatgtgcattacgtggattgtaatctgcgcttggacgagtgggtagcggaggaccggatcgatctcatgtctgttcgtattccccaacgcgtgaagaagtcagcatcacagcaggcaattgctcagtcgttggaccaatcattcgaccaaaattttgcgataagtgacgcacaaagctcacgtagctcaactcccgaaaaagtgattgaaatgtttcgaacaccgactcgatcactgaccggaagtcgaaagaggaagcacttaggacacaccatcgaatacgtcgatgccaattcaacctcttccgaatgctgtccttccgtcacc

SEQ ID NO: 93679 - DNA, 623 bp, Heterodera glycines
  SCN-specific regions: Sequence locations=1-83,106-595
agcaaagcttgcatcccgccccatggctttgtgcatttgtttagctccaaggtcgaatttctgtgcatataccttttcgagatggagaagagaaggggtttttccggaatgtttttatccggaatggttcccagtgcatgaaatgagaaaaagagacacacactcttctttttatagattccataagcctacccaaaattgggtcgctattcaaaaggaccccctccctcctccataaccttagccgaaattggttttgtatcagcaaatgaaagacgccacaatataatcagcaataattgttttgaagaaaggagctcaaaaaacgcatttctgcattaaaatttttcgattctgatgtcattatcagtcactagaaatcattattttggcgacttcgtcactaaaatagttaaaaatcactattttggcgtttcgtcgctattttttcactatttcgacattttttggaaaattctttaacaaaaatgcaataaaaccaaaaaatacacccctaagaatcgacaaaaaaaatttcaaaaagcactcctaagaaatgaaaaaaattttctcaaaaaggtattttcgtggcaagaattttaattttaaaaattattttttta

SEQ ID NO: 93680 - DNA, 572 bp, Heterodera glycines
  SCN-specific regions: Sequence locations=1-174,196-572
tcccatggcattttacgcgtcccatggcattttacgcgtcccatgacattttacgcgtcccatcacattttacgcgtcccaacaacatattacgcgtcccatgacactttacgcgtcccaacaacattttacgcgtcccatcacattttacgcgtcccatcaaaatttccatccaaattggtttatttacaaattaacattaaaaaataggaatatattttcaaacaggatagttgtgacgcatttcctctaaaatattttgaaatatttttgtgtttgagtggtaacgacgaaatgcgtactggtacaaatatgtttgcaacaattcagggttagtcccatgaaggtgttttaagctttgctttagagccctccaggtcgcttcaattccctgggtgtgtatttgagggttagttggatctacgaagtgtaattgatgatttacaaaacgatggttgtactgctgctgcatgttatttatcccaccatatgctgcccacccatcgctaacgatgctcgtgccgacttcgatgttttcggcaatgataggcagaagtgttgctgctgagcga

SEQ ID NO: 93681 - DNA, 557 bp, Heterodera glycines
  SCN-specific regions: Sequence locations=1-557
ggtcaatcgatttcggtttactcatctcatctataataataatttctttgccggtgctgccgttctctttcgataaggcgtggtgaatgaagcaaatgagtggatgaggcgggtgaagaaatattggcaggtgggaagagatggaagggaataaccgcgaagtctcctcaaaaggaagacatttatttaatgttttcgtttgtttgagactctgagtgaggaggcgggctaccaagaggaggacaacgagcaacttccgacgcctaataacaacagagtgattgctgttacagcaaattccatctttacggtcaacaaaatattcgaaaacggaggtgtcactgccatcggtgcttcaccgtcaaaaaagaaatcaatgcgggaacgaatggcacgcttttctatcggcggattgaacattttcgagtctgaatcggccattgcttttgcaatgagtgaacgacggaacccaaaagaacaagctccacatggaattgagcttaaaatgcaggaagtgccggtgaatgcactcggagacgaaaacgacgaaacggtac

SEQ ID NO: 93682 - DNA, 413 bp, Heterodera glycines
  SCN-specific regions: Sequence locations=1-29,51-413
gaacctttggggaggagcagcgaaaggaacttttggagcctttgctgaaggagggatgggaaacggtgcaggagagagatgccatcaaaaagagcttcactttcaaagacttcaatcaagcgttcggttttatgacgcgaatcgcactaaaggcggacaaaatggaccaccacccagaatggttcaacgtctataacaaagtggacatcacactgagcagtcacgacgtgcaaggcatttccgagagggacgtcaaattggcatcgttcattgagaacgtgttcaaaacagtgaagtgaagatggcgttcgttgtgaattaaacggatacaaattgtcattttgcaccctttttaaataaaatgataaaaaagtcacaaccaagagaaaaaatgcaactgataaataaacaaa

SEQ ID NO: 93683 - DNA, 488 bp, Heterodera glycines
  SCN-specific regions: Sequence locations=1-238,267-412,435-436,482-488
ggtcttttcaaccaattcttgggcccagtttcggacatcaaacgacgacttaaaatcccaaccggcaaagaacgccgatttgtcagcgcgtggtgccgcaaagtgatgccgttgagcatatgcacaatggatggtctttgccattgggaaattgcgccgcttcctgaggaggaatggcatgatgaacccccgattgagctgccgcacgagagcaaaacgaccttcaaaatccccgtatgttttctctcttcttttccttttctcccaatcgatcgaaattcgagtttaaataatcccacatttaacggagcgcaacactgtgccgtttgaaattaatttctaatcggaatgctaacaataagcattttactaatgttgtttttaatggtatccgttatccattcctctaagcatacatatgtatatgtatttgtttttaaatttaatttaattttttattttactttattttcgtttaactgtaaatt

SEQ ID NO: 93684 - DNA, 406 bp, Heterodera glycines
  SCN-specific regions: Sequence locations=1-406
tctgatgcatatttatgaactgcaatgggacgacatagaagatgccaatgctacttcagatgccgatcaacgtatccacgaccgatccggcattccctgcacttaatactccaccaccaaaaagcccggcttccgcagacggcgatggagacatcgcagcgctgggctggacttcgtacgccaccactactgtctcttacctcacaatggagtcgattattatgcggacgacgacgatccttaagacattcatctcgttgagcgctacatcaataaagcgagaacgattggcatctgggcagtcggtctcgccggaactgcgattgaaaaagcgccgcacgtggagaatggcaccatcacaatatgcgatagagattatgctccaaaacggcgtgtcgctgtcgac

SEQ ID NO: 93685 - DNA, 752 bp, Heterodera glycines
  SCN-specific regions: Sequence locations=1-213,235-752
gtcccattaagatggtgtgtgaatgtactcagtgattttgctggctaagattgcccagctcaggtcaatttatctgtctgtacatacatattcaatcgtctttcgcgcttccacaatattctaacaataataagatgtcttcaacaacgttcacgctaataagcgtgtcctcccttattgttctgttggtcggttattatgtgcaaaggtacggaatgccaccacccccgccaaaaattgcgggcattgatttgggcaccactttttcctcagtcgcaatttttcaaccgcagacgggcgaaacgattgtgctgaaggatccgcttggtaaaagaagcattccgagtgtagttggctttctgtagagaaaacggcgaaattgttgttggcacaagggcagtggaacagcaggaaatgaacccggagaacacaatttatgacgcaaaacgattcattggaaggcgtttttcgtcagacgatctccaatttgagtcggatcgcaaacgctatcctttcacaataaaattggacgaagatggctttgtttactttgaggttcaccaaaaaggtgtgaaaagaaaaatacgacccgaagagattggcgccattatcataaaatatttacgaaaaatggcacagaaccacttcaacgtgaacattcccgaagtggtcatctcagtgccggcagaatttgaccaaatgcagcgcaattacaccaccaaagcagtcgaattggcagggatgaatgttcg

SEQ ID NO: 93686 - DNA, 483 bp, Heterodera glycines
  SCN-specific regions: Sequence locations=1-15,37-260,290-483
gctcgtaaaaaatgtattaattcccttttttatataagtacccccatagccaaaataaaacaagggagaattagagcctcaatccaatcattttaccaagaaaacagcctcctcattaatgtttgcattattgtgtatatagcctacaaacccaaacattaaaacaaaccattatagtgtaatcagcacgctgatcttttgatctcattaaggaaattacgctaagcaataacgtacactacataaaaaatagtataaccttatttagatatattaaataaatttataacttggcatagctagaaggcatttgtcctacaaaagcctctacagggtctctcctaagaacagttgggggaagcgtacgttgtatcattgtaaaatgataaacagctagagctatgtttaaatgtacaaaaaatacacacttaaaaaaaggattgcccctttattgttttttttctacgctaatcctagcaggag

SEQ ID NO: 93687 - DNA, 253 bp, Heterodera glycines
  SCN-specific regions: Sequence locations=1-253
cttctctccattgcatttgattgccacacaccatcacattttattccggtactttgtcgatggatctgtgccctttttttggagggggacaactttgcgtcaccactgaattacatttgttggaatccaaattaaaaagtcataaagacatgtttcctgggtgacgagggtggacatacttttgggcaagaaaaagtccgacttccatcttaaaaattgtttacggccacaatttgccgcaatggcacacatt

SEQ ID NO: 93688 - DNA, 472 bp, Heterodera glycines
  SCN-specific regions: Sequence locations=1-45,68-118,140-472
gtctcttcgcacaacaaaaacgccttcgcgtttcggaccgcggattgatttggaattccgacctaattgaaacgttggaactgcaaaatctgctcattaatgccctccaaacaatcgtcgctgctgagaacagaagagagtcgcgcggtgctcacgcccgggaagactttccggttcgggtcgatgagttcgattacacgaagccaacagaaggacaatcgaagaagaaattggaggagcattggcggaagcacagcataatttaccaaaatgtggagaacggagcggtgactttggagtacaggccggtcatcgacacgacgttggacaagtcggagaccgattgggttccgccgaaaattcgctcctattagaagcaataatgacaaattgcaatccaattttgttttaccgtatttagctggttgtttcaattcgattggctttatgattaggtcttcaccgcaatttt

SEQ ID NO: 93689 - DNA, 720 bp, Heterodera glycines
  misc_feature (10)..(10): n is a, c, g, or t
  SCN-specific regions: Sequence locations=1-720
tgtcccatcnaaagttaaatgtttcattttatttttccgttttttctctttccaatgccaacattgttaaaaaaggcccttccctcctcccattatccctcctctccgatgtgccgtcccttggcttgccgttccgcatcggcttctgacccttctcacctgcagtcggacgatggcattcgcccggtccgtccccccatcgcccgggacagtccgcgccgtcgactgttttggagttgtttcgtcgtcctttgcgtggccatttccaccggttacggctcccagttgaagttctctctgctcaacaccgcttccgatcacttttacccgccctttcttctcatgtggctcaacaattgctgcttgatcatctgtttcccgctctatttgatctttgaaagagccaaatctaaggaccgatcagtacgcgaaatcaccaacgaatcggcgcgaatcgttgcggagaaaggggtcaaaagcggattggccaaggaggtgttctttctgctgctgtacacagttggcaattactcctacgccctctccctgggccgtatcacttcgagtgccgcgctttccgtccgcagtatggacgtgtccgtcgtctatttgctgggccatttcattctccatgaacgatttgttggcctcaaaacaattgccgttgtgttggccacgggaggggtgctgctaattgcacaggaccaccaatttgctgcc

SEQ ID NO: 93690 - DNA, 490 bp, Heterodera glycines
  SCN-specific regions: Sequence locations=54-304,327-397,419-490
cctcctcttccgtctcctctttcccctcctcttccgccgtcttcgctctcttcgcagcattttgtcgcaacttcgtccgcttcgtttcccgtgccctcttccaaaagtgccaatgttgcgccattgccaaaagtgcgccattctgttcagtctattttgggcgtctctcaaaaagaaaacattggcaatatgtcttcaaccgtgccaaattcaaatgtgctcaaagaaaatgccaactttggaccaacaaatgtttttcggccatttcactcgaacactatctcctcttcgcccaaagcattcaaacctgtgcttcagcagcgacaaaatttcaacaatttttgatgaattgtgaactaatgatctccgccatgttgcgctttttgaacgttccaatgccacgaaaacaatgccaaacaattgatttaacagacaacgaaattggaatgtctttcctgccaaattcaattttgttttattttttctcaga

SEQ ID NO: 93691 - DNA, 290 bp, Heterodera glycines
  SCN-specific regions: Sequence locations=1-1,24-267
cattctttgtccaaattttgttgacttccaattcataccaaaaaacttcattgtttgtgtctgtatcgatcattgttatttaattgcccatctcaaaacagttcgtttttcaatcacttatgtcgcaattcctttaaaacctttgtcctaattgcttttttgaatcgatcctcaaagtgtgtgcctcagcaaaatgacactttctttctttacttttttaattcgactttattttaacatttttttgtctgataaaaattttattggaaaaaaaaaaaaaaaaaaaaaaa

SEQ ID NO: 93692 - DNA, 319 bp, Heterodera glycines
  SCN-specific regions: Sequence locations=1-89,111-319
gcgtacaccgtctccccgtcgtcggcgtccgtcgcctgccatccgcggaccgcgtcgccgttcgcgctcgcctcgccatgaactcgcggctccatcaccaccaccggcgaaaacggaacgtactccggaaccaccgccacgccgactttgtgttctaaatctaagcagaaatatcacaaaagcgcacatggaggaaatcttcgctctgtttggggctctaaggtcctgagagttgccaatggaccgtgtgcatgtgcatttgcccccgggatgcggctatgcggagtatgaaaatgcggaggatgcgcgagaacgctcc

SEQ ID NO: 93693 - DNA, 654 bp, Heterodera glycines
  SCN-specific regions: Sequence locations=1-353,375-377,401-521,553-654
ctcattgaaacgtcatttaatggggggccaacaaaaaacgacgacggtcgaatctgtggaaggaaggccaacgcatgcgaacgcgggtgggcaaaattgccaaacctttaattagagtgaaatgtttcaaaattccatttgatcccttcgtcttttgattaggcaccggaacagtctcttccgttttgctggcgattgctgccgggcaaaagccaacgcgtgcttttcccgtagaaacggatcatggaacgggtcaaactcagttggattggaatgggaacggtcactcggcagacgcggcacagctcattttgccatggcacgacgaccaaatgatgcggaaaaaggtggattgactcctcatttgctttgccaattccttttttcttctcctctctccacagattgtccatgcttcgtccgccgaattaatgagggccctcggggcattcatcggaatgcgttgcgatcggctaaagccccattttgagcccattcagctcaccaattggtcagtcagcacaaatacattttgtaattgcaattcccttcgctaattgcccaattttcaaggctccgaagcgtcgaccgagcgctgattctccaagtaagggcccaacttgtcattgataatgcccgatgagtgacaatttc

SEQ ID NO: 93694 - DNA, 142 bp, Heterodera glycines
  SCN-specific regions: Sequence locations=1-104
cagaccatcttttagaatttgttttcgatgcgtcccttaaatttaatttatttccttcatttttttgttgtttatttttgcatttttttccgtccaaagcattgaaatttaacaatttaagataaaaaaaaaaaaaaaaaaa

SEQ ID NO: 93695 - DNA, 391 bp, Heterodera glycines
  SCN-specific regions: Sequence locations=38-38,123-123,158-391
gattggctacgttattgaaaatctttccaaccgaaaactattcttcattctctccctccttttgcttctccaatcacttttctttctcctcggcgcacttttcgctcccggcccttcttcttccatggaatttgtacttagcgcatgtgtggacaaaagttcgggtaaaagtggtgaatggttcactctccgacccgacaaaacgcaaaattgtgtgttggtccccgatctgaagcagcacagccccctgtcgtcggatgcgcgtgacattgttttcggtgcgcaaatgccccatatgcgtgacggcgtccaattgcgatattcgcccctgtgtcaatttctcattggcttgttggacttggaagttgagttcagtctcgaaacaacgtct

SEQ ID NO: 93696 - DNA, 273 bp, Heterodera glycines
  SCN-specific regions: Sequence locations=1-33,55-237
ggcactgtttgctgtccgagaaaatcgctacatggttctgaacaccgactttaacaaagcatataagcaagtggtgaagaaagacagcgacgagttcgctttctacaagtgatttgtgatcgaatgacccccacccatcgtcaaccatttgctttttgttgtttttgcgcttatatatcatcatttccccgttgtgtactgtctttttcattgcgtgtcatcgaataaagggaagtgaaaaggaaaaaaaaaaaaaaaaaaaaaaaaaaaaaa

SEQ ID NO: 93697 - DNA, 508 bp, Heterodera glycines
  SCN-specific regions: Sequence locations=1-459,482-508
gagggaaactgcgacggcggcactaaagctgttggacaacgaatggttcctaaattcgacgcgactgttcatttacgtaagccatgaacacgaaatttgcacggaagacattgtgctaactgctctcaaatagggcccagaagtgttcatccccacattctaaaaaggggccgaacgaatggacatgctccgattgtaatctgataaggaattcgattcgttggagggcactctttggggaattcgccaacactcctccagtctcagtcccctctcatttgaagaaacatccgccaaagcacctctcgatttggtcgaagtgcccggcgtggcatttaccacaagcggaaaacgacttggtcttgggcgtggattttacgaccgatttctgaatgaatacgcacaataatacggaacagtgccgagaacaattgcattggcattgaaagagcgattggtggacgatttgccaatggaaagcaaagaccgaatggtggacgaagtgatc

SEQ ID NO: 93698 - DNA, 352 bp, Heterodera glycines
  SCN-specific regions: Sequence locations=1-352
cacgcatgaccagctgaaccatagtgcgggtgaagtcttgaaacaatcccaagagaatatacgcaatttccgatagacgattgaactgcaaattgctctgaaactgtacgacccacagaaggatcagcgtttcagtggaactgttagactgaagcacgtccctcgtccgaaaacgaaagtttgcattcttggatacccatcacattgtgacgaggcctctgccgacggaattccatgcatgacagtggacgacctgattacgttgtactaggacaataatctgattcaaaagctcacctcaagatacgacgctttccttgcctccgaatcactcatcacacaaatccctcgc

SEQ ID NO: 93699 - DNA, 558 bp, Heterodera glycines
  SCN-specific regions: Sequence locations=1-558
attcgtttggcctttccaaacatcaacatttcgctgaacacactcctctcaaaaatcatcggtccgcgtcggcagggcattcagcagggcattcttcagatgagcggtgcttttgcccgagcgctcggccccattacgataggcaatctttacacagtctacggtccgcaaggcatttggataattgcgttgtcggtcatcttcaccactttgttactttggatgctgttcttccctctaatggttccgttgtcgctccccgatgaaaacgaacgacaccatccaacggaaaaaacgactgatcgtccgccctaccgcgaagaaaggacgccgttggtggagcagagcgacggaaggggccaagacgcagaggcggcggagaacggaaatgacgcgacagtgaccacaacggcgagtttgagatgagaggagagagagagagagaagtcgttttgcccagtcatatcactaatcattctcttttatgttgtgaatttcgggttttgtctgtgcaatttttttttatgtatttatacatttgaacaaagattgaatgcc

SEQ ID NO: 93700 - DNA, 733 bp, Heterodera glycines
  SCN-specific regions: Sequence locations=1-733
gtctttcaggcatgaccgcgtaagcagttggaacaccgagactgccttgcaagataatggttcgtggtcgtggatcattgcgtgatgctgctaaggaggaaatgaatcgtggaaagccgaattgggagcacttggaagacgatcttcatattctaatccaatgtgaggacaatgaaaaacgtgcgcgctccaaactcgacaaagccgtggataaagtgaagaaactgctcgtcccatcgcgtgacggaatcgatgagttgaagcgcaaacaactgatggaactgagcatcatcaacgggacttaccgtgctaacattgggccaaagaactcgccaaccgttcctcgtcttactcctctgtccatgctatcaccggtccactcacctctttcgccgcctcaccgtgtgcattccaccgtttcttctcacaatatgttttttggctctcctcttccgagccccgtgaaggaatatggctcgccgcgttcggttccgtcttcgaagtccaccagcaacaccggcggtggtcatggtcattcatttgactttgctcagctgaaccaaatgatgcatcacttcgattgaataggtctcaggtcacccatagattgtcacatttttgttggttttgtttgtttttatctcctcaagttcatccaatttctaagaattcagtcctaagttaattgtaatactaaataagccaaactaagcctaagcgagttatctaatta

SEQ ID NO: 93701 - DNA, 721 bp, Heterodera glycines
  SCN-specific regions: Sequence locations=1-165,201-638,660-721
gaccctttaaccgttgaaactcgtcgacattagcaatgaaagcgcccgcattcttcgcaatttctctcctaagcttaagcgaattcccgaatctccgatggttttgtcggcaatttcgacttccaaaagcggctcaaattcgcaatcagagtcattccgtacgggtttggaagaagaggaggaggaaagggcaaacggaatggaagaagttgttaacgaaacgcctcacttggacatgatggagacgagtgggacagggacggaagttgagaacgcgtcgaattccaaagggaagatcgaacagaggaagtcggccatcgcaccaatctgctcaatcactttgcgtcaacgatcgtccgcaatgaaatttgcaccctccgaaatgaagcggactcacattgcaacgcccgctttttttgcccccgctttgccctccgtttcaatttgtgaagcggaagggactccttccttcgccaccgcttcctccatcccctcgacgccgctttctattgataatgtttccgtcactgcttctgggcgcctgaaacgcgcagcggctaagaaagttcggtcatatcaagagccgtcattaagcaagaaaatgcgccgatagaaatgaaaaattgcgaaggaagaaaatatatttatattgatcaattctcagttttgcaaggaaattatttggttttggattcctttttcagcagataaattattttct

SEQ ID NO: 93702 - DNA, 701 bp, Heterodera glycines
  SCN-specific regions: Sequence locations=1-378,400-701
caaccgtccaggtctggaacatggcctgtgtgttgagagatgttccttggggagttggagatgaagatgcaaactcttcgctcctaaaatcattgtcactggatgcttgtgatctgctgaaacacgcaccacaaccccatcccttgactacttctttcggacaccttgtctggagtgttgtcggatgagcagctacgagatggcactgcctacagacactacgtgtcaaggacctctcagctcaccgatcaaaatcatctttcgagttagccaaggcggagaatgctgcttgcaacagttctcgcaccggcgctctgttccataccacacctgtggtattctgacttcgaactaatctgatcaatagcgtccctaccaacgaccagatcctggtccctgagacccttctcaagaagcgcaagtctcaggagaaggcccgcgctgagcgcaccgacgccatccagaagcagaaggctgccaacaaggagaagcgtggcgtcatcttcaagcgtgctgagaagtacgtcaaggagtaccgcgatgctgagcgtgagaagatccgcctccaccgcgttgccaagagcgaggactctgcctacatccccgctgaggccaagctcatcttcgtcgtccgcatcaagggtatcaacaagatgccccccaagccccgcaagattctccagcttctccgtctcctccaa

SEQ ID NO: 93703 - DNA, 281 bp, Heterodera glycines
  misc_feature (254)..(254): n is a, c, g, or t
  misc_feature (256)..(256): n is a, c, g, or t
  misc_feature (262)..(262): n is a, c, g, or t
  misc_feature (264)..(264): n is a, c, g, or t
  misc_feature (268)..(268): n is a, c, g, or t
  SCN-specific regions: Sequence locations=1-281
ctgccgttgaaggcaagggtcacaatcacggcgaggactggggcccgtctgctgttgagatgggtgtcaagagacgggaatgggccaacggaaccatcgacggttaagcccagcaacatcagaacaaagctcgagcaaaggagcaaatagcgatgactgcgggactcttgaatatcggcgttgagtaacaattgaaaaaaagagacaatagacaccaggcggctgaatacatcaccaaacggccttgaacgatngntctgcncnaaantgaaaaaaatgcc

SEQ ID NO: 93704 - DNA, 299 bp, Heterodera glycines
  SCN-specific regions: Sequence locations=1-299
attccttaggcccagttgaagatctcaatgcaatcttgaccatgcccttctacgactccctcttcggcggctccctcggcgacgacgctccgcccgccagcggctcggccaagagcacctctggacctctggcgcagacggccatcggagtggcgcccaccagcataccggctcccgtggcagtaagcagcaagaaacccgtcattccaggcatggccatcacccgcaccaccttttgattgcccttggtgtgcgcaagtcaatcatggctcggaccactcacacgcactttgccgaat

SEQ ID NO: 93705 - DNA, 787 bp, Heterodera glycines
  SCN-specific regions: Sequence locations=1-12,56-60,83-250,272 -293,315-388,410-787
ccacgtttgagcattttaataaagtttaaattaaatatattaatttattttatatgaccaccataacaaaaagtgaaaagcacaaaacaaaatgagtaagcgaactgttgaacaacaacgccagcaacagaacatgcagaaaaagcacaacaaattggagcagtttcgttcaaagttagatcagattgaaagcgaattgatggaagtgagtgatcagctgaaggatcaattggcgcgaaatgatcaatttcgaaaagggaaaggggaaattgaaaaaatgccaattgaaagggaaggcgaaaatagattaattaaggagagaatttttgtaaatgccgccaaaatggagcaaaatcatgcgcaattacggcagaaccaaaaagaagtcaattacgaatttgctgagattatcaaatttttcgacatttggctaagggagagccaaacgcatttcgcttcttccccatttactccgacaacggaaaatcattcccttcggcggcaacaaaatttaaaagcgtccatttgggccatcgatttgttcgaacttcgtcagtttcgcaacggcaattctttggcccaatgcatggaatgcgggaaaaagtttatgaccacggaagaggcggcgatgggttggcacattgtgcagggacacccgcaatacgcagcccaattgctgcagaaacagctcgaaagggacgcgcagcaaaggcaggggacaaacggcacggaaacgacggcacagaaaaggaaacgaaaagcgacggaagagcaggaaaagccgacg

SEQ ID NO: 93706 - DNA, 238 bp, Heterodera glycines
  SCN-specific regions: Sequence locations=1-68,90-127,149-238
cttgcttcctctatagtagtaatctgattagctaactgccaatagagtaatgtaaaaactatcataggccataactcccccattacatagaagcataccaacgtccacttgctccacatcataaaaaaccattttaattggggataaagctggatgtactgatctataagcagcttattgggatgccaataagcttggtaagggaaaagaatcaagccaaaaaagaaaaaaaaaaaaa

SEQ ID NO: 93707 - DNA, 533 bp, Heterodera glycines
  SCN-specific regions: Sequence locations=1-81,103-533
cgctaattcgccgtcctcttcggcggatgaggcggacgatggccagcaaatattggcaaatagtgcagaaggcgaacagcaaaacgagcagaaagacgaggaggacgaagaacggacggaaccgcactccgtggcactgagttttgacgaaaaaggggaagtagccgcaacaattgtcacaggtcgtattcaagaggtcgtccatgtgttggccaatttcaaagtgcgcgcagagtcgggccttaaacgcaaaattgaaatttttgattttggctcttcgaactttgctgtttttgatggcgttgatttgctgcttcgacaatttcgtttgctttgccattccgtccaccgccccaaaaatgaattggtcaccgaattgccaaatgttccggccgttcttctccctgaacagactcaagttctgctcgagaacggttttgccaaattgcgacgcattcgaaacaccggcggaggggcggacggagagcaaagggaaagcgatgaacagacggaaattgaggcgattccgtcgc

SEQ ID NO: 93708 - DNA, 251 bp, Heterodera glycines
  SCN-specific regions: Sequence locations=1-251
gtccaattaagtaatttaacaaagttcccaaaatgatttcactggccattttggtcgtcttcgccctttacgaggcaattgccgtgccactttacctgcgcctcatttacgtgatgctcaaagacacccatttcgcaggcagtccactctttcgcattgtttcaatgattggcattttggaagtgtgccattttctggtcgttctccttttctaccgacttccgctgttcgcgccgactgctgagtttttc

SEQ ID NO: 93709 - DNA, 852 bp, Heterodera glycines
  SCN-specific regions: Sequence locations=1-852
cacgtggccttcgtgccagttgcttcatccgggatggcctttgtggagcattcgtaggactttcgctcgaaattttggcgggatgacgactcgttctccgtacatcagacattcttttgtgatggagaggtcatcttttcgacgaaagaacaattttatttcttccgtttccgaagcaattgctttatcattgggccatccatctttgacaaatttcttaacctttttgatggtttcgtcttcgttccctgctgaaattatgtccttcgatgagagtgacactgtttccaaagtgttgatgaagaaattttcggcttccttctcaaattccatggacgcgatgactcggtcttcttcaggactggtgctttttgcaatcagccttgagagcgcatccgcttgtccaaattctgtggtgttcacatactcaatctcgaagtcatacgccaacagcataagtgaccatcgtaaaagacggttagcactcatttggcggattccctttttgttgccgaaaatggcgaggagtggcttgtgatcagtttgaagaacaaattttcttccgtagatcattttgtgaaattttcgcactgcgaaaatcaaagccaatccctctttttcaatttgggaataatttctttcagcgggtgtcaaagatgatgaggcgtgttcgatggccttaattgctccgtttggaaatcggtgggaaatgactgcgccaattccatgttctgaggcgtcagcggccacgatgatttcccattttgggtcatagtgcgtcaagagcaaatccgaggacaaaatttccttgattttaatgaatgctccttggcattctttgccccagtccca

SEQ ID NO: 93710 - DNA, 852 bp, Heterodera glycines
  SCN-specific regions: Sequence locations=1-135,157-791,813-852
agcgtaaaaatggttttgcaattttcctccgaacaaaagcgtcttcttggcttgggtcgtgtgccttcgcttcgccgtgggcttcttccacgaacctccctctccgatcagctttaccactgtctcaaaacgtttctgactgatcctgattctggatggtttttggtccatggattggtaggaactggcaaatccgaactcgtgaccaaagttttatgggaacgacccgagctatgtttcgcactcgtcgaccgaatcctttggatcaccgaccgacgctttcatccggctgaattgagtcaattggcggccgacactcttttgctggcggtttcactaaactctccgacgaacttttcgcaaatggacgagtgcgatgcttttttcggatgctcgcaatcggctggcaaaagcggcgaactttcgtccgtcgcccattctctgcactctctgctcaacgataactttgcaaaaacccttctgatcgtcgacggagtgcaaatggccgatagtgtcaaattcttcgatcaaatcaaaggaaaaatgtgcaaaattttggccaccagcaccagcagaacactttttaatgggttggagaatatacaaacatttaaaataccgtccgacaattgctccggcgaagagttggcacagatggcgctgaattacggcattaaagagacattttcggccgaacggataaatgccattctttgtgagacgggcggaaatttcgcacttttggagaaaatgttcgtgatggcacggggctgtcccgcaattttcgactctctcctcgcccaacttcgccattcgcccctcagtttggtcagctgtcacagtgcctattac

SEQ ID NO: 93711 - DNA, 736 bp, Heterodera glycines
  SCN-specific regions: Sequence locations=1-176,198-736
gctttatgtttgagttgcgtcgcagtgtgtgcttgtgatgactgcctttgaggagttgggcgttttgcccgaattggcaacggcactcaatgatttggaatggaccttgcctactgacattcaatccgaagcgatccccgccattctcgggggtggcgacgtttgcatggcggcggagacgggcagtgggaagacgggcgccttttgcattccgattttgcaaattgtcttcgagacaatgcttccgtcaaaccccaaacggagtggtgctgtcgaagacaacggttggcgcatgaacatctttgaccgtgaccacaatttgggcatcgacgccagcggatttgtttgtgagagtaaccatcccaaattgtggagcggctcgcgttcagtgcgtggagttaagggatcgggcaaatattattacgaggcgaccattgaaagtgacggactttgtcggatgggttggtcaacagcgcgggcaaatctcaatttggggaaccgatgaccagggctggggatttggaaggcacggcaaaaaaagtcacgcgggtcaattcaagactacggacaaagtttcacgttgggcgacaccatccgcttgtttttggaactcgaaatgggcagaattccctttgctaaaattggcttgacttcccagtggcttttgcctaaagcaacaccagattcagcaaggcttttccctggccgtgtgataagaaagctcgtcttcgccttt

SEQ ID NO: 93712 - DNA, 322 bp, Heterodera glycines
  SCN-specific regions: Sequence locations=1-269,291-299
gatttcattgtaattcatcgtccgcgacggacatctcttcgaatttgcttcgctccaaaaattccctcgtgattgtgggccctccactaatgagacccttttgttcgacgccggaaatatttgccaggaactgatggatcacttgggggaaatttcgtgcagtgcgattgcgctttgtgctaaggagaactgattttgagatcgacttttgccacattggatgattttttgtgaagttatttgccaaataatggcgtttatttatttatcgtattgttcaaaatacaattttaaacattaaaaaaaaaaaaaaaaaaaaaaa

SEQ ID NO: 93713 - DNA, 299 bp, Heterodera glycines
  SCN-specific regions: Sequence locations=1-88,128-147,178-275
aacattatgacgttatctttttggctgaaatgaatttgccaaaggaatgcgacggcggtggcaatgcccaacggcgggaggacgacaatgttgagcagcagcaggaggcggcggcatgcagcaacagtgaggcgcaacagcccgctaatgatgaggatgaggacgatgatgatgatggccaaaccaattttgtgtgcaaccggcaataatgccgtcgatgtaacatgatggattgtttaaatgcattaacttttgaagtaaataccgcatgaattaaaaaaaaaaaaaaaaaaaaaaaa

SEQ ID NO: 93714 - DNA, 559 bp, Heterodera glycines
  SCN-specific regions: Sequence locations=1-68,90-559
accgaattgggattggagcagagagcacgtcatgttgcacgacccttctatcgtgaatatggcttcgtacgacagactcaaatcccttttgcgcggaagctcacagcgtcggtaacagccaattgacttgtaacgcttccgcagaaccgaccagaattaccaagacacagttgcctctatggagcctccgatcctcgtccctctcgccaagtcggccgccccttctcgttacgacctctcatcactgaaactgattatgaccggtgctgccccggtgggcaccgatctgttggacaaagtgaggagacggattccctcactgaaacaaatctgccaagggtatggaatgacggagcattcgatgtgttcgcatttgtcaatgatcggatcggacgattccaataccgcctgtcaactaatgcccaatttggatatgaaaggtgatgacatcgaaagcagaatgcctttgaggtgcgcacaaaattggtgaatttgcactcaatgtccaaccacaatggctgactatgtgaaccccgctgatacgactgcgaaaacactg

SEQ ID NO: 93715 - DNA, 232 bp, Heterodera glycines
  SCN-specific regions: Sequence locations=1-107,129-232
ggcgtggtaaatggagcacggaatggatgccatcaaaaagagatctcctttccgagaatgtaacgacccgctaggcttcatgacgcacgttgcactaaacgcggacaaaaagtaccaccaccccaaatggctcaacgtgtacacagatgtggacataacgctgagaagccgcgacgcggatggcatttcgaagagggacgtgggattggcatcatttgttgaggatgaggtc

SEQ ID NO: 93716 - DNA, 480 bp, Heterodera glycines
  SCN-specific regions: Sequence locations=1-56,80-340,375-421,443-480
gaaccctaggagggcaatggccatgcaaagggaggcgagggagagcataaacatccgatggagcaccaccaccagcaggaaggcatcggttctgcagctggggactccgctggaggcgttgcgacggttgcccatccttcgaacctttcgtctgcctcctctcaaatggaaaatttgcgtcccgccggaactgtcgtccgtcacatttatccaattggccaaaatccgtctcaaagtcagcgcgttagaggggccgtgagcagtatgactgaaggcggcgacggcactggccaaatgccacacgcaacgcaatacggcctcaacagtccgtatgacgacgagtacgacgacgagctggaggatgacgaagaggatttcgagtatgacgagggggacagtgcggacattgatgacgatttgggtgcccaagtgaccatttgattttctgatgagggttttcgccaattcatccaataaagt

SEQ ID NO: 93717 - DNA, 474 bp, Heterodera glycines
  SCN-specific regions: Sequence locations=1-474
tccttaagcactccccaggaatggcataaaactggcgctttcctggaaggccgttgctttgtggacacggcacaacgccaactcatccctttgagagatgtcaacggaaatgcaaatgtccgtgaagttgcagtgattcttcttatggacagacacttcacccaacgcattggtccctccgagaagggccccgaccgaccgaccggcatcaatcagatgaacattcgtcatttaaaattggctgggatccatccgattgtattcaccgaacggcacttccgcgaactcggcgacgatgaacgatctcaaataaaatttattcgagagaagatcctttccttatcggaggaatttcacaccaacgaatggacggaagagaatagcagttaaagtgtgggcttaacttacgaattgtattcttggcaattattgatttgtttgtgtgatttattcccaaaaaataggaattctttt

SEQ ID NO: 93718 - DNA, 299 bp, Heterodera glycines
  SCN-specific regions: Sequence locations=1-8,30-277
gttccatcaaatattcaaatataaataaaaccaatggctgtcaaacatgacccgccggaaattagggcactgaagctgtggaaggcggacgtcaagaactcacagttgattcgcggcatgattcgcggcaaaacgaaaagtacgcttcatgggcgagtcggatgattgcattctgcgcttggctcagagggatggaataattccgcaaaatttgtgaacgttgattcttcacagggatactgttgattttgttgcctgcagaatgataaacactgttaaaaaaaaaaaaaaaaaaaaaa

SEQ ID NO: 93719 - DNA, 513 bp, Heterodera glycines
  SCN-specific regions: Sequence locations=1-513
gaatcgtcataagaagctaaaaaaggaaaaagtgagtgtcgattttcccttgggtggggaggccaccgcctgagaataacaatatcattgccgattttgtcgaccttcttaacggggctgaagagggaaattcgcatttgttggtcgtgatgggtggagacaccaaactggatgatgttttgctccgttcgcccatttttgcgggttcgggggctgcattaggcgcaggcggagaatttggcatcaacgaggaggacgacccggaattggccatggcattgcgcatttcattggaggagcagcgtctccgtcaacaacagcagcaaggcggcgaaggaacggactgaaagatcgaggcgcattcaaccccaatttacaccatcccagacaattctgaaacattggacggagggaaggatgatggtataccaaacgatcatgttgttgggaagtttcggactcactttattttgtgtacgaataaacaaaaattgaaataatgtgttaggaagt

SEQ ID NO: 93720 - DNA, 858 bp, Heterodera glycines
  SCN-specific regions: Sequence locations=1-556,578-645,668-682,704 -704,726-858
atccttttggtggaacgcacaaaaactcgctcggacggcgatcgatttactgacaaaattttgcggatgacttcgcggacagcggatgccaaactgaatccatttttggagtttactcgacgcattgggaacatgtacacgccgtcggtatatgctcagctgatcaacgtctttctgaacactgaactttccgataaatcgaacgggaaacggatcctcatattttcttatggcagcggatgtatcgccgcaatgtactcacttcgtttcaatttgtgcacggaaaaactgatggctgcctacggcgcaattaaacaaagcgcgaaaaaggcacacgcgcgattggaccagcggatccgacacagccccaagcagttcacagccgcattggagagaacggaacaaattgtcgctggaggggatacttacatcgaaactcccgatgatggcaaacgcagtgatggcattccaatgtttgccgggaccttttatttgcgagaaatcgactcaaaacacagacgcttttatggccaaattgatgatgccaatgagtgatgacagaaagggaagaaaaaacgcaatattcgacgaaatcccatgacattcccttcccttaaggatggcgtcggtccttaataattttattgtcccatcactttccaattgtccccgccttccgtccatttttaatttctatagatgacaaattattttataattttatctcatgaagctcagttaaattttgtgattctttttccataattttcgccgtctaagatttctcaacagccagaggttcttgcttgcttcatttattgtttcctttcaattgcctttctcagtcttccaaattct

SEQ ID NO: 93721 - DNA, 134 bp, Heterodera glycines
  SCN-specific regions: Sequence locations=1-48,77-82,104-105
atttcattgaagtgccactccttaatttattttgttaagttattgtctttatatattttgttgttttttaaacattggattattaattgcaagaataaattaattaaaaagcaaaaaaaaaaaaaaaaaaaaaa

SEQ ID NO: 93722 - DNA, 484 bp, Heterodera glycines
  SCN-specific regions: Sequence locations=1-484
ccgctgtgcagtccggacggcggtggggcgagaattaggagtgccgttccaagtctctggtccgagattgacaccaacgaacctgtcgaggagttggtctctctcgaaagaaaagcaatgcgcaggcgcagcatccgttccggcatcgcgtctggggaaataagtcgggtgtcgccctttctgaacgacattgttcacgtgaacaagttgggccatgaggagatgatgaacagcagcaaattctcgtccgctgcctccgtccgttctgccaatgtgccgcgtcaacgaatgcgttctcgttccgctggtcgccaatcgatcgctcgactcatcccagcttcaaaaccgaatgttcatatccataaacccgccattccggcttcaagaccgaatgttcagatccataaacccgctccgaaagaacacatttaaattgttgtgttttaatgaagtttatttgtatcaaatgggtcttgtttaagta

SEQ ID NO: 93723 - DNA, 365 bp, Heterodera glycines
  SCN-specific regions: Sequence locations=1-73,95-312,334-365
gtccctttaagttgtccaatcacacggtttgaaaacggtggtattactccattcacttcgattgtatgcatttcacctccgccgacccctcctcgtcctctgcttacaattcgcagcagcgctttccgccgatcggcggccaattccatggccatcagccccagtcgcagcacttccggcatcaatcgcaacagaatggcgcgggggacagcggggcgggccgaagctgtcctcagctgacactcattctgatcacgttggtcatgtttgtgactgcaattaatctgggcgggattgctgtgatgaccccatcttggcaaactggggactttcccgagtttcaggcggaaccccttcatggcctc

SEQ ID NO: 93724 - DNA, 356 bp, Heterodera glycines
  SCN-specific regions: Sequence locations=1-336
cttccttaacctcctctgatgaactctatggaactaattaaacgattgttaatgcaaggaatctaaaccctaagaggataacatttagggaacccaaatattctaattttagatgcagatcgaatcaattaatctttaattcatctataattcgaaaccgaatctaattgttagtgtcgatgaagcttaccatcgtcgtcgcggttcgtaacacatgatcttgaaaggggaaatcaatttcaaaggcgggtcgatttggccttcaaactgcaactttcaaatctcaaattggagtttggaaatcaaattcatgaaacctttggcctggttttggggaaaaaaaaaaaaaaaaaaaa

SEQ ID NO: 93725 - DNA, 811 bp, Heterodera glycines
  SCN-specific regions: Sequence locations=1-100,122-574,596-612,634-811
caccttttctgccttcaactcagacaattatgcaattttctgacgtgtcgagctccaacccccgaagatcgaattgtttacgtctgtggctcttttgaccttttccacattggccacctttgcttcttggaagaagctcgtcgtcttggcgattatttaatcgtcggaatatactcagaccaagacgtcaattcgtacaaaggacagaattacccaattatgacactccacgaaagagtcctcagtgttttggcctataagcccgtttctgaggtcgtcatcggcgcccctctgtgcgttacgaaagaattgatcgaccgatttcgcattaattttgtggtgcaaggcatccgaaccgaacaccacactgctaccgaggaagcagattgttatgaggtgccaaagcatttgggaattttcaaaacggttgattctggaaatgagatgacaacggaacgaatcattgagcggatcatcaagaacagattggaattcgaacaacgcaatcgtgcgaaagagaggaaagaaattgccgcatttaaagcgcttcaaagaatgaaaatgactgacggaaatgggaccaatgaggaagaaggaaatgcaaaacatcttgaagaagaaaacaatggaaaatgcgatgagaaaaatggccgaagggaataccaaattgtcagcatcaatacggagaatgtctaagtcaacaaataagaagcttatgccattttaaatacctatctccttaacctcaagcttaatataaaaaagaatttagctctatttatccttttaattcatatagtgttaagaaagc

SEQ ID NO: 93726 - DNA, 540 bp, Heterodera glycines
  SCN-specific regions: Sequence locations=1-67,98-168,190-365,387 -481,504-540
ggtcatcgtttggtggccatggttgactcgccattacttcatgtgattctttccattcaataatctcgaaacttttgtttgtttgttttgcgtttgtcagggaaaatttcctatatggtacttcttcctcggctttttcttgataagtatcagaacaaatattatttgtctcttcaattcattttcctatggagaagtcaacagattaaacatactgaaccattttggcaaaattcatacccctgcatttcattttgcatattcccggttgttatttgattattggtcactgatcacctcttccgattccaattcatccaaataccaaaatttttgattctctaataaatgtattttaatcgaataaattatttatttgttgaaaatttatttctccttttataaaagtaaaatagaaatttcctaattaatttggcggtttaacagctaacaataagataccattctcagttaagcacaaaaagggctttattttcagacaaaatcgcgaattaacacaaaaaaacattgaaagatttt

SEQ ID NO: 93727 - DNA, 565 bp, Heterodera glycines
  SCN-specific regions: Sequence locations=1-565
ccctccttttcgtggcacattgctccgacccttctaaagtgccattctccgccatgtctttcgggttgggccgtgccgagtcggtcactcggctcagcgcattcgagccaaggccgaatccgtcgctcgtccgttgctcctctctgatcgatgtcaaccgtttctcccgtgattttgatcgcttttctccgcgttcgtcgcgtctgtcccaaaatgactcgagcgcattgtggtcgagcagaatgtaccgaccatcgtttgtgatggacaaccattggttcgacaagttttactatttctcgccaattttcaagggcacccaaccgtacaaatgtcacgtggccagccatcgtctcacttatccctcctcttggcatcagccccacgactattggcgccgagtacaacacttttggtatgactcggacaacgattacgcgccacttcaccgccgaatgttcgaaccgttttacggggaatcggcgtacactcagcgcttttggcaccgttaccgttcacatctgttgaacaatgatgtgtatgaatgatgaggcgaggaatatgc

SEQ ID NO: 93728 - DNA, 229 bp, Heterodera glycines
  SCN-specific regions: Sequence locations=1-10,33-229
ttttcagctgtacgttcgtcgtgtgttcatcaccgacgacttccaagacatgttgcccaagtatttggcattcattcgtggtctcgtcgactcggacgatttgccgctgaatgtgtcgcgtgaaatgttgcagcagcacaaactgttgaaagtgatcaagaagaagttggtgcgcaaggtgttggacatgctgaagaagatttctcccgaaaagttcgacgagttttgg

SEQ ID NO: 93729 - DNA, 710 bp, Heterodera glycines
  SCN-specific regions: Sequence locations=1-710
tcccattaaatgatttacaatcctttaaagaatagacctgattaatttccattttttgcattttatttttagggtacaattagttataagacaaacgtttcgcataaatatttgttcaatttcgtttttgttctcacaattagcatgacgtggaaagggatcagacggtggctgaaaatgtgctaaaacttcaccgatatcgccctcaaggcgaatcggttggtgccgttcaggttttcggaacggctatggaagtacgaacgacatttgatgccgaaaagggggacagtcatggcagaatggaagtgtacgagaatattagggaatggacggcggtggaggaagggcagaaaattttgagcacccaattcatgcgcaaatacatccacacggcccgggatgtgaagccaaaactgacggatgaagcgtccacattcatttcggaacgttacgcggaactgcgatcaaccgatttgatcaaaacggactgcgaaaggacaatgccatttacagcccgacagttggagacaatgattagactttccacagctatggccaaggcacgactttcgaaaacggtcggactcgaagacgcgaagagtgcgtacgaacttctggactttgcatgctttaaggaaaagccgagagagcgattggaatatgaggaaaaaaaaaacagaaagaaaatggaagaggggaaggggaatcag

SEQ ID NO: 93730 - DNA, 600 bp, Heterodera glycines
  SCN-specific regions: Sequence locations=1-600
gagacatcctaaaaacatttaattttgatggcatctattgacgattcatcatcagaagtcaacggatcaacaaatggtaatgcatcggttcgatcctttgctcttcaaacaacagtaacttctgctaaactcaacagtggtggttttttgagtaaggcacctgatgcttacgttgaaatcattgttgactcgaaggaggaccaagcgaagaaaacgagtgttaagaagaaaacgaattccccgcattgggacgagtcattcactctgaatgtcactgagaattcggtcattgagttcaaaattttctgcaaggccaaagtgttcgatgattctttgctggcttctaaatcttttaagatgtcgaattggttgcgaaaggagtccaacaacggaaaatttgaaaatactcccgtgacggtgcctttgatttgtcgtgatgcaaaaacagaaagagagagtaaatcaggcgagctcaaattgtcccttaccggcaattttgagcggagcagaaggagaagttcgggattacgtgcaaactcgtcgactccgtcaactgccgaatcagccgtcgtcgaatctgccgcgggtccgtctacctcc

SEQ ID NO: 93731 - DNA, 639 bp, Heterodera glycines
  SCN-specific regions: Sequence locations=1-639
gccactctaagctcttctcaaattctctcttctgatttgcgtctgccctttataaggaaaagcgttggattgactggagcagtcggcctcggcacagaattggatttggccatgggaaggagacaaaaaaggcggaaaatgagtcggacgaagaccaaataggggacacgaagcaaaagggggccgaatttgggttggaggcgcggaaacgaacaggcagagaaatggcactttcattgagacgtcatcttcggcacaacgccgagcggtggcgtcgcgcgcgcgacccggccgaattggtgcgcgaggagcctttgccgaccctttcgctgtttccgcagctgctgatcagccgccgccccttcgacatttcacggcgtttaaagccaatgcatcgacatccgctgctctctttaagacgcccaattctctcagagcaacagttgtccaagcggaagctgattctgaacattcaattcgccagtttcatcccaaaacgtttcgttaatggcggcccttcccaaattttcttgcacttttcgacaaagagactttggcgatggaaatgggcagagagaaagaggacgagggggaggagggcgactgtttggaggtggacatgttcgacgtggaagtacg

SEQ ID NO: 93732 - DNA, 296 bp, Heterodera glycines
  SCN-specific regions: Sequence locations=1-145,181-296
ggtccatatagagggcaattgggtaggaaaatgggcgaagagacggcctaaaatgccggaggcattgtcctttgggccaatctttcgggacaggtaagtgcaagtaaattgtgggcgggggtggcaaatggagcggcaaaaatgggagggagagagtgtgggagagagagggggagagggcgtaagtgacgggagagaagggccgtgtaggaagcggagctcagttagcgcttcttttcttctttttttttgctagtgatactcgggaacggactctcgacaaaagcggagggatt

SEQ ID NO: 93733 - DNA, 544 bp, Heterodera glycines
  SCN-specific regions: Sequence locations=1-44,68-197,219-268,290 -506,535-544
gttaacgcttgtccatgggtcgcccctcctttcctctcaacggcatttctttgctttttcttcttccaattttcgccttcccttcggcgtttggttggcatttcggaactttggacagatttgatccgaattccgtcgacaatcggcgtctgtacgttctgaaaaagtccgagtcgccacaatgggaggatttgggctgggcctggggaaaacgttcacttccaaattcggaaaagtcggcacagagcagcgcaaattgggacgatttgggctgggcgtggggaaagcgatcgtcggccggcggaggaggcgaagcgatgaggagggcaaaagcgcacgggactgacccaattttgtcggtagtcgccaatcgggttgttcgttcgatgagcaaacagagcccggactggcacgacttgggctgggcttggggacggaggaagtgagtgaggagatgaacagacaacggcgtgaagaatgaaatgatggatggtcggatgaaaagacacaaagaggaggagaagagaagggacgaaacggaaga

SEQ ID NO: 93734 - DNA, 314 bp, Heterodera glycines
  SCN-specific regions: Sequence locations=1-111,133-314
gtacccatttgccaaagttggtgatcggtcgttgatttttggtatcctctttccaaattagctgaaaagctagtggggtaggggggatagggcatctgagcgccaattcaccgcagacatctcaccaccgccacttcagcgccagccaactgagcgccgccatttcagcgccgccatctgagcgccaagcaaatttgagtaccgactaactgagtaccggcgactcaaattttgcaccaaaaaaggcattgtttgcgcaaaatcggatagtttcaacagcaaactcctatttcactccaaatggctcgcctttt

SEQ ID NO: 93735 - DNA, 275 bp, Heterodera glycines
  SCN-specific regions: Sequence locations=1-60,82-85,107-192,269-275
catggcccttaccgcaagggcacacaaaacaatgaacacggccacttatcttcaccaacatcagcacaaccaacaacaacagttgaacaactgcagcaacaaccgcggggcaacacaggaggcaagggcacaacttttgtagaggaggacgggcaaaggcacggaaatgatgaaggacagacaattcaatgctttatattttcttttttttaatatttattcattttaataagcattttgtaaatttatttcaattgtttttatttttcggtcga

SEQ ID NO: 93736 - DNA, 564 bp, Heterodera glycines
  SCN-specific regions: Sequence locations=1-150,176-276,312-564
gacactttaaaaaatcgatttttttgtttcataaatatttttttcacctagagctctaaagcgcaccaaattccctcggaatactgtaatttggtgacactcaattttcgacctttgcctttgccttaccatttggagaagacgcaaatttaattttcaaccacaacaaagtgtacacaattattgtgccgcccatcactccgttgttcaaaattgtgatgataaaattgtttccacctcccgccacaacatcaattgaggagcacaaaagtaatctaaaattaaaattaaaatattaaataaaaataaatcggcgcctttccggtgcgttgaacccaacagataagcattggtaaatactgaacggtgcatggagaagcacagaaaatatgcaagtccaaaaagcatatttgcgttggttgcgactccttgacctgagaattttttttcacttaaaattgataataattagtcaattatctaattgattaccaaattgggaagagcacagcgacgtaccgttcgatgccgagaaaaagcatcataaagatggaagtccgattg

SEQ ID NO: 93737 - DNA, 622 bp, Heterodera glycines
  SCN-specific regions: Sequence locations=1-5,39-361,383-404,426-622
caaagcaacaacaattataacaacagtaacaacaacaaactttaacagtaccaacagcagcagacaccgcaacagcagacaaatactgtaaatacagtaacaacagcggtgacaacgactacgatgatggagggcgacgcgtggttgatgagcacagtgcaagcggaggacaaactgttacaagcgcacacgaacagggaaaaagtgttttccattctgaagacattgcgcgacagacacttggacttcagtggatcagcaacaacaaaacagctggtcaaagtgagcagagaagggaagggtcagatcaggtcaaaaagagatgagcaacaatgaatgataggcaaaagattaccaatacaaaccaaaggggggaaaggaatgaaccaattttgggtcgagaatttaaattgaaattattggcacaaagcaaataattaataaccattattatgcattatttaacataattgtcaggtgctcgtgctgtatgagtgcgaaaaacattatgccaaccatgaatggaacggtaacatttttaaaccttttgaaaacgtacaggcaaatggtattttcagatttctgtcttggcgaccgaatcattggcattcttctgcaaatg

SEQ ID NO: 93738 - DNA, 553 bp, Heterodera glycines
  SCN-specific regions: Sequence locations=1-553
aatgtctttacttttgcacgagaccgatggtgccacatcagtgaatcctcagtgcctggggtagtttttttgccgggtcctggcaagcagctggtcactgtttgtgcaaaatacatcaaattctaccgacggaacccattttttgtgccaccggcggatggtttcgatggtcaaccaccaacagtccgtttggaatgccttctttccttcactctgatggcacctgtgcgcagtttggctgttgtgcgattaaaatcaacacctttcgttgcaccacggcattttgcccaattctccgggcaacaccaatgccatggaaattgaattgttgtgcacaaaattgccaaggcgttcgtccgtccaatgccatgccgtcgttgtcccgtcaattggcgaaatgtgagaaattgcgcaaaatttgtcacgcacaacaaattcaaacacgcgcaccggcagcgccatcacacacagacagagcagaaagaagcaaaagttgcggaacagctgaacaaatgtcgagaccattcccgaaactcgggctgtccatcggacg

SEQ ID NO: 93739 - DNA, 772 bp, Heterodera glycines
  SCN-specific regions: Sequence locations=1-119,141-608,630-772
ggaaattcattgaactgttcatcacaccatggccaacggacaaacagcaacctttgcgatggccatcgaccttggctccgagttcatgaagatggcattgatcaaaccgggcgtgcccatggagacggtgctgaaccgggactcgcaacgcaaaacgccaatggcactgaccatccgggacggggagcgcttcctgggcgacgcggcgctgaaaaagttgcttgtccgtccgaagaacaccttcatattctttttggatttggtcggcaaacagtttgacgacccgacggtgactgcattccgcaacgaattcccatatttgcgcctcaaagcgcaccccaaacgaggcaccgttcagtttgagacggatgttggtgacatgtcgttggagtgtgcgttggccatgctgttgtggaatgcgcgtcaagatgtggatgcatatgctgaacaacctgtgcgcgacgtcgtgatcacagtgccctcctattttggtcagatggagcgtgcggcggttgaaacggcggccaaaattgcggatttgaatctgttgcaattgctcggctccggcaccgccgccggactcaactacggcgtgtttcggcacaaagaaatcactgaaaaaccacagaccttgcttatctacgatgtgggttcaaccaagaccctggtgaccattggcccatttcttctcgtcaaccattcccatgagggtggcagcagttatccgcaggtggagaccctcggagtgggtatgaccgtgcgcttggcgggc

SEQ ID NO: 93740 - DNA, 651 bp, Heterodera glycines
  SCN-specific regions: Sequence locations=1-108,131-651
gtagcgcgtgttaggtaggactcatgccaaagtatttttggctcaattcctctttatgaatccaatcgccttttatgagtccagaacagggacgggcgaaacttcgaaaacttcgggttttttgggcttcgaacctcgtgcttcgaaaaaaaattgtgcttcgccttcggcttcgagtgctaattgtaaaacgagcttcgtccatccctggtccaatattttatgagtccaataaattgacaatacttggtttttatacaataactttgttcattcatgttcgaacaaaccctatctttttggtatcattcgaatgcaaaaagtctaaagaagcgaaaatatataaaattctcagcgtttaggcaattgccaaaaaagatttgattaattaattaattgctgattatttttgttcgtaagttttttttttaatgttagaattctctggttttttctcgtattattacattattcagactttgtgctttcgaatgataccaaaaatattttgggtttgttcgatcatgaacaaagttattgtatgaaaaccaggtattatcaattgattagactcataaaatatctttggactcataaaagtcgattagacctagagctggtattttcatgcaaaagctcaaactcttctga

SEQ ID NO: 93741 - DNA, 611 bp, Heterodera glycines
  SCN-specific regions: Sequence locations=1-145,168-229,251-276,298 -340,386-611
agtgagtgccgctaaaaccaaaaaccaataaaatacctaatagtgaaggtcccatggactgatgagaagctccatgaccgagttcggagtacgaccattttcatttgttcttattttcggaaattggtgaaccagggttcgtatttggtggatggaacgttacctaaacaaaccaacaggaaaagccgactatttgcccgtctttctgtcccaatccgcgcgtctttacgatgaaaaagttcttcgagttgatactgtaatgcttttgtactttccaattaacagtaagtcttcccttaggcacttttgaacgtttctccgccggataagcatggttctgttacattttttaaatttttgctgatttatgatgatgatgacaactaataggttactgctcacttggcgttagtgtcgacatgtccaggtcactcatttgccgcccaattcactaaatttggcaaatgtttcccttcagtgccgccgctcgaaacgcgaaaagagtcattgcttccatcaacaaaacgcacccgcgcaccttcggagacgccgaaattcacatttcccaaattgacgcgcttgtccacccggaaacaccgatttatgagttg

SEQ ID NO: 93742 - DNA, 554 bp, Heterodera glycines
  SCN-specific regions: Sequence locations=1-554
ccttcgtatattttgcgagttaaaaaggaattgaccctttgtgtccttttgttggaacgcgcatggaatgatgcggatcaaacgcatggtcaatttgtacttcggcgacttgagggacatgccgaaatcttcgaggaggaatacgaaggcggtgttccggaggaattgcgcgactttttccgctcgccaatgtttttgctcagtgaacgcgctgcgtccacagaagaacccttggcgagtgaagcggcgcgtccgtctgaaaatgaacggcagcggaaggcggcggtgatcgcctgtcattatcaggtccaaatcttcttcaacgatttgattgtttgtgcctctgatcccgtgccgctccattggccttcgttttgtgtcccatttgcccgaattttcgatttacgtgtgtttgaaagacccgagaagattcgaattcgcctgatggagcgtctgtcacgaatggcaaaatggcaggaaattggggaagttttcttgcctttgttagctgaccataaaaccggcacttctgctgacgataatcgtaaggaaga

SEQ ID NO: 93743 - DNA, 544 bp, Heterodera glycines
  SCN-specific regions: Sequence locations=1-167,189-544
gcttttgcatggagagacggcgaagtggaaaagttttgcgccgttccctctttctgggccgtgcccatttgctcctctcgctgacaatttcctccgtttttgtcggcctttttctcggattcgctcttcgcattttccaactttcccctgaaaccgttcgtctcgtcaattttcccggcgaaattttcatgcaagtgttgaaaatgatgattttgccgttgatcttttcgtcgctcgtctccgctctcgcccaaatggacgcgcgtgagtcgggtcaaatgagtctgttgaccgtcggttactacgtcatcaccacgcttttcgccaccgtgacgggtgttctgctggtgatggccatccatcccggcgacccgtccatcaagcaggacttggcctatttggaggtgcagcacacgcccatttcgccgctggacacttttctcgacgtcgttcgcaatatgttccccgaaaatgtcgtccaagcgaccctccaaagagcacagacaaaatattttgccccgagaagaaacgcacagcaaaaaac

SEQ ID NO: 93744 - DNA, 473 bp, Heterodera glycines
  SCN-specific regions: Sequence locations=1-473
cgtccggctgtctcatctgttccgttgataatatcatcgcaggactccccgtcgaggccactgaacagtttggctcgttgctgctcccttatatgatggatttgctaatttgtaacactgatcagccgttcgcttcgctgcaatgtcgcgacgaaatcaaacgggcgataatcacttcagatgggcaattaacacccggctacaaatacattgacgagcttagattggagcagagacggtctgcgcacaaatcgcgtgttgtggctgttagttcaaagcgtgtgctgcttcttggcgccggaatggtgtccgaccccttggccaaatattatttttctcgatcgaatgtccaattgaccgtggccagcgattcgtcaaaggaccgccagcgattggcttcgcttgggagtaacaatgagtcgggggtgggagacgggaccagagagccggaagtgatcattcgctcatttcgg

SEQ ID NO: 93745 - DNA, 532 bp, Heterodera glycines
  SCN-specific regions: Sequence locations=1-377,399-461,489-532
caataagctataaatcccctcaattcactgcggtaaatgcgtcgactattcttacaagaaatggcatttctttgattgagacgcaaccgcaaattaagttgtatttgtttcacgatctcttccaccttgaccaagacccatacaaaaacataatccatgcagaatttctgggagaattgcattcaactgatgattttgtatgggagttacgaaaaaagcgccaaaaatatgcattatttcggccacggctttttgttacgttcgattcgactacaaaccgttgggttccaactcacttcgatgaccaagaaagtgttccgctcccctcgacgagccaagccacagaaactgttgtattccgaccccagaataagaactcattgtcagatggaattcttggaaagcctcggctaaactatggtgctgattttggcgacggaccgaagaattttcagccgtccaacagagaaaatgaaaagcaaaaatccttcgtggcgcccgtggaaaatcgggcgcgtacctgggctccgaa

SEQ ID NO: 93746 - DNA, 519 bp, Heterodera glycines
  SCN-specific regions: Sequence locations=1-495
tggtgtctctgactcagtcacacgttgttccttgtcttcgatggcattccttatacggggcaaaaagtgcttgatggttgcatttacgcatacaatgcgtttgtttcttcaatgcattggctctttactaagcttgcaaacactgttttctttgtgtgggaaagtgttgtcaatctctgctgctctgttgttgaccaaactggacgtacaatttcctttgtgagggacagtgctgttaatgtcacacggtttaccatggagaaaattggcagtgccattttctttatgtggaacaatgctgctcatctcttccaatctggctttgaaaaaattggcaatgccattttctttgtgtggcataatgctgctcatctcttccgatctggcttcgaaaaaattggcagtgccattttctttgtgtgtgacaatgttgctcatctgttccaatctggctttgcaaaaattgggaacgcttttattttcgtgagagataactttacaaatttgttttggaaaacg

SEQ ID NO: 93747 - DNA, 828 bp, Heterodera glycines
  SCN-specific regions: Sequence locations=1-217,240-710,733-828
aatgccattcctacagcgccggccattgcaacaaatgacgtaaatctctagaagaaatttatgggcgcggagtccgagtcggaaggcgaagagtccgagtggggtactgagtcggacgaatcgtcatccgcttccgatttggaaccattggagggcaaggaaatggaggagcttcgacgctatttcttaaagaaggacaaaacggacagaggcaaaacaaaggaaaagaaggaaaaggcggcacaacgcgagaaaatagcgctggagaagaagaagttggaggaggcagacgggcagaacgaggagtcttggcagaagatcacctacaaacatgacgtggccaagcccctcttcgacggccaggccgaagtgactggcgatttggtggtgaagaaacttctcgaattgggagccaaccgaggccgacgggcgaccaaccgaaaggtgtacgtgcgctacttgcaggagttgtacaaagctgcagatgaacacaatttgggcgttggactgctcgcaaaggtgctcaccgccattatcgctgcactttttgagctcaacacacgcatttccgatgcaatggaattcaattcgtggatgaagactgtcgaaacggtggatggattgtttagccttttgtccgaacatccaaatgttatcatttccatttcgactaatgaagacgaagaaaacattttggatcagtcaaaaccgttttgtttccatggttctgtcattttgatgggaaaacgattggatgatgagctgactaaaatttaccaaagcaccgattgtcaccgctccgaatacctcgaaaaattgcgcggtgaa

SEQ ID NO: 93748 - DNA, 576 bp, Heterodera glycines
  SCN-specific regions: Sequence locations=1-422,444-576
gcgtcgtcaccgtgctgcggtgatgaaggagccgcgttcacgtgccttaaggggtgccaccccagcatccaatttgcacactgtcactcacgctgcctgactacattggaccgttgccttgcatcagtgcgcaggctgacatgcaacgtggtgacaagcagcagccaccggacggcggtgcaccacgcgtgccgtcagtaagcgaacgttacgcagaggcgctgcatgcaaacctggccgaggcatacccaaacgtgccgcttgaactggtggctaaacgaatcggcggagactgggctcgtctcgcccgtgtgctcggccttcaccccgacgacatccgccaaattcggaaggaattcaatgcgggcggaggacaggagccaatggcggcactgaaaatttggctttggctaaaggcaattcaacaacagaaacagcagcaggaagaagcaaatgtgtccgacgacttggaaaaggcattacgccaaattggccgtgacgacattgtgcatcgcatgtacggcttggacatcacgggcgccaccgcggcggacattgacgacgcatggcgtacca

SEQ ID NO: 93749 - DNA, 493 bp, Heterodera glycines
  SCN-specific regions: Sequence locations=1-54,76-93,133-159,181-493
agaagtcgttatatgtactttgtaagataaattatcaaatcattcggcacgttgtaaagcttccaattcctacgccgttcatcacacgcagagtgaggaaaatgaactggaagaaattgaagaggaggaggacgcgttggtgcttcgcatggaggagatgatgatggcggaggaggaggagcacaaccgagcgcagggcggcgcggaaagggacggcggcgaggcggacgaacgcgtttcatttgcggactcagaacggttttttgatgacgacgaagtgcaaatatcgagccaaaacagcagcgagtcgggctcacttgaccacaattgctggaggggttggacacttacggattaaagagccgccatcggaatgcacgatttcttgcccgatggtgatcatacgcttttgcgcgagttgatcaagcgttcaaacacaacagccgcaccgccggtgattccgcctttggtcgaattggccgcgcgaagggtc

SEQ ID NO: 93750 - DNA, 469 bp, Heterodera glycines
  SCN-specific regions: Sequence locations=1-469
ccctcctcatcggctcttacgtccgccgcatatcaacgaaaaaaaattgctctgacctgcgcccaataacatgccaccactcgtctatgagggactcgctcaaccgatgcttggacatatgcataccgagatcttcgaaattatggatgatgcgaaagccggtatcaaatacattttccaaactgacaatgctctgaccttcgctgtttcgggcactggccatgccgggatggaatgtgccattttgaatctgctggagcctggccagaccattttggtgatgaaaaccgagtgagggtgcttgcggacaaagaatgtggccgatagacttggtattaaagtgcatcgattggacatacccgacggagaagtgattaatttgcacgattttgccgaggctgatgataactaccgtccccaagtggcattcgcttgtcatggagagaggtcgaacggagtcgtccatccg

SEQ ID NO: 93751 - DNA, 498 bp, Heterodera glycines
  SCN-specific regions: Sequence locations=1-498
gcgatcctgtaaacctggacgagttggtggagttcgacttggccatctgctaccgtaacgtgttggacttgtccactgaagacggccattgttccgttctcttcacgcatccgctggtgtacggggacaggtacggtgtggcaaagttggctgttgctgtgatcacacattggctggaccattcgccggtggcctccaagctcaattttgttggcattgcgtgccaaagtggggacattctccagtgctacatggacttgatggctgagctggcacagcatggttgggccgactttgtggctgcacattccagcgcactgttctcctgcctggtcgactcatttgacacgggcaacaaattcgagccgtccggtgccagcaaaggggctgcagcttcactggaggatcccgctttgcgtgtccatcttgttggtgatgacccgcgacgtccaaggcgaggacaaccgaagcaattggtttcgtacgaattggggatgc

SEQ ID NO: 93752 - DNA, 469 bp, Heterodera glycines
  SCN-specific regions: Sequence locations=1-175,212-238,277-338,372 -376,400-469
cgttgctgctctcgagctggacaatgggtccggaatgtgcaaggccgatgtcgcgggcgatgacgctccccccccgcgggttccgtctattgtgggcgggccccgtcatcacggtgacatggtcaggatgggactgagagactcgtacgcgggagacgaagcccagtcttagcgcggtattctgactctgaagtacccgattgagcacgggatcggcaccgactgcgactgcatggacaagatctggctccacaccttctacaactagctgcgtgtcaccgccgaggaccaccaggagctgctcacagaggacccgctgaacccgaaggccaacgcagacaagatgacccaaatcatgttcgagacgttcaccacgccggccatgtacgtgtccatccacatcgtgctggcgctgtacgccgtcgggcgcagcagcggaatcggggtggacttcggcgatggtgaaacc

SEQ ID NO: 93753 - DNA, 615 bp, Heterodera glycines
  SCN-specific regions: Sequence locations=1-50,74-615
tcctccgttcaaaaatgttattcaatcatcgccaaacagttcaatttccttctgttccaaaatggctccaaaaaagtgtgggcccttctcttcgcctatttcttcgcttctctgatggtcatttcgtttctctaccaaaacccgtcttcctatgacgccgctgaagagataacgaacatgacatgggcacagtttgaccaccactgtgtacgcaacggggacaaccaagtcaacgcgcagagagagtgttcacagttgaaaggaactgccatcaattggaagggcactgtccaatccgttcgcatcattgacattgacaatccctttgaaacactgctcgactatttgcccgactctgtggcgcaggcgttgcgctgcttttacgacacgacggaggaggaggggggccaaaaaagggacggactccggtacaatcgatgctcgttgacccaccacaaccactacacgtacttattggaagtcagtggcccttacggagagaagttccaaatcagcgtgaataagggacaacttttgttggctgccgcgcactcttttggtgacactttgtctctgctcggcgagggcgacattgtccgttttgtggcctttttc

SEQ ID NO: 93754 - DNA, 274 bp, Heterodera glycines
  SCN-specific regions: Sequence locations=1-68,96-118,141-170,214-274
cccccgcctctgggggggggggggtgccaaaatatgggggcggggggaaaaaaaaaataaaaaaaactcccgccggaaaaagggggcggggaaatggccgaaaataccggccgcgtggacccggggaaagtgaaaaaaaagggggggggggggggaaaaaaaaatatgggaagggggagggttttaattttcccccctccccaaagggggaaggggtccgcccctaaaaaaaaagaccccgggggggggggggaaaaaaaaaaataaggggggg

SEQ ID NO: 93755 - DNA, 493 bp, Heterodera glycines
  SCN-specific regions: Sequence locations=1-438,462-493
ctgtttcgttcagtgtcaccctgtccacggaccggaacagtgccgaacctgaaaggcggttcggttccgcgtccgcgcggcgcccgattcgttcgttggactgctcgcggtggaccaaagcgtcctgttgctcaagtccggcaacgacatcagcaaggagttggtggagcaagacgtggaggagtacgacaccaccagcgacagcggagcgcacgtgtggaccggcatgcggcggcgaatgatcggcggagggcgcaagcgcagatcatcttggtacccgtggtggggcgttggcggcaaagatgcaagcaccgtattcgagaatgccggcctcgtggggctcactgatttcttcctgtacaaagagcccgagccgatcagggactggcgcttccgtcccatgtacatgcacatgcggaccgattttgccggcggcgaggagcgcaagctgaaggagcagccccggagtgccgggcccgcccatgccgcttca

SEQ ID NO: 93756 - DNA, 421 bp, Heterodera glycines
  SCN-specific regions: Sequence locations=1-382,404-421
cgactctttaacagagaccacaattcaggcggacatttattcgttcgctttcaacgctcttgagatggccaccacgggtgcactgcaaagtggctgtttcaacggtgctcctccgtccagcatggcatcgtccgccagcgtcgccccaccctccgccgcctctttcgcgtcgcttccgcttcatgcgacggctgtgcctttgccttcatccgatcgggacagaggagcggtgaccgaaaatgaaccaccaaatggcaccggttgttccctggcgtccgcagcctcgaccggtacactgcaggcgacggtcagcaactggccaaccgcgactgtatcagctgtgacatcattaccgcaatcagcagtatgctctcacgtggtcacccaggagatggtgcacaaggcgctcaactcgttggac

SEQ ID NO: 93757 - DNA, 340 bp, Heterodera glycines
  SCN-specific regions: Sequence locations=1-340
cgaattggacccttacgacgacttggaccatttttactgtggcatggaagatgcaaattcacgcaatttggacttggtcaaagaatggtgacagacggtactcaatgtgaacatggaaaagctcttcgtgattatgctaatggcactgattttcacggcccgcaaagacttaaaaggcgctttgcaattggtcatcaacgccctctccgattttcccacacattatggactgttggagctgatgcttaaagtggaagtctaatacggacgggtggaggaggtgttgcaaacgtaccacaatttggtctatttttggcgcataacacatgctccggcggaa

SEQ ID NO: 93758 - DNA, 487 bp, Heterodera glycines
  SCN-specific regions: Sequence locations=1-169,191-487
ggtccgctctttgttcgacatttgtctggcctgcgattgacagagtagtttggggtacaatgccgacctttctcttctcccctgctactgtaaacaacgcttgatggagcttttcgcatcccatgagcaattacactccgaacagtgctttgggcttatgttacggccaatggctggtcggaatttgactcgcctctgcttttacctcaacgaccacttgaatgattcgagcttggaagctttggtcacctttatcctgaaccatcccatcatctcgatcgtcaaatgcccccgggtcactgatacgggaattggcaccgtcactctccgacagaataaactcggctgccttgagttaatcggaattccgctgctcagttcctatgcgactcaggctgcgaattccaaccgtctgacaaaacgccatttgagtggatgcccacagatcgcttcagaaggcaatttctacttggcggttaataatccg

SEQ ID NO: 93759 - DNA, 639 bp, Heterodera glycines
  SCN-specific regions: Sequence locations=1-319,343-639
gtcccttttggctttgttccgccccagttgcgttctcgtgacttcctcctcatttttttcctcaatttgtgctttttccgcttcaatttcttctaatggcttccattccgcgacttcgaatggctcatcttctcggctttcgtcttcctccttccgtttaacatcaatcgttcgcaattcctcctcagtgaacgcttttggcgttttgaattgcaattccaccgttatggcccttccttcgtccgtcgaacattttccctcctcattttgtgttctcaatttttccgttgacactaataaagggaagtcaatgctcagtgaacccggcaaaaaatccagaaagatgccggagtcattcatcatttgagcggttggtccatagttccgttcatcgctcattcgtgccaacgccgaactctgttccggggaagaatcactgagaaacgctgagtcccgtgaacgaatgttgtcgtcgagaataagctcgggaggttgaatgtcgatcggatcgggcgaagtgccaaagccaaactctgaagacaatccgccagagtctgaacgagttaatgggcaaaggtgtcgcggatggtacgccaaattggagtcactcgcgtagtgatcgaagacggattggtcgcg

SEQ ID NO: 93760 - DNA, 604 bp, Heterodera glycines
  SCN-specific regions: Sequence locations=1-8,31-604
ggcattccttgatgccaatttcaaaaactgcaccaactttcccgaaagtcctgccgactctcagagagttgcgttcggcttcgttcgagaaggaatttgcaattcccaattggccgccccttcgctttgttccttcgatggcttcgattgtcggcccaacagcagcagaaaagtgtccaccacttccttggaaagtggcggatcagcgtcgagcggcggcggaatcgccacactgtcgcgacgagcactgatcacaacgagcagagacgagactcttggactgagtgggaaaacggggggcgttgccggaggcgcgaaaaacattctgatcagtcgccaaaatttggtgaacagttcggcagcgtctgcagcggtggccaggggaattgcgcggaggcacgggcgactgattgagcagcaggccgaggccaacaatttggtcgtggccaagtctctttcccctcgtgttcagcaacaaccgctcgccactgtccagtcatttagcccaacaaatgtgtgccgtcctccgtggactcctcagacggaaaagcgtcggctgatcggtgtcaaagacttcgtcagtcaaaacactttcagcaaagag

SEQ ID NO: 93761 - DNA, 660 bp, Heterodera glycines
  SCN-specific regions: Sequence locations=1-57,117-189,304-370,441 -486,508-660
aaatcccttagagagattaaatgtacttcaaatttttaaatagttaatcctttcaagaaataattaattaaattaaatttatttttaaaaattaagaaaattgatttcctttattccttcctttttttaatttcaatttaaattccctcggggaaaaacggactcaaatttaaattgtgatgccgctggaatttattattaaaatgagtagattatattaaatttaactttaaataattttcaaacatttaatccttataagaaaagaattcattaattttaaattttttaattaaaaatatagtgtcctttattccttttcaatatttcaattccccgagggattgaatttaattggcaaaatgaaatgccaaaagggttttttaaatttattcattcaagaaattaaagctgagaaattaattttaaaaaagttttttgccctcacaatttttaaataattcagagaacttaagatcgattttcaaattttttaaaaatttatttgaaatacaaaaatcccttattgctcggactaatctttgaattgataatctaatgaattatgaataaaaaaacaatatttctattccattcataagagtgactctctctctttttttttattattttggcgttgtgttacgctgaaaatccgtc

SEQ ID NO: 93762 - DNA, 367 bp, Heterodera glycines
  SCN-specific regions: Sequence locations=1-367
ataaggtgaaaacacacattttacaacccatttttggccagttgtaaaaagccccgtttttttcgttcgaacgcgtttttctcgaaattttccgcatatgactaatttttccacctggatagaaagatagagaagaccgagctctttcgaatggtaccggtctcggtgctcaactctcgatattcgcttgcggccaggtcgttttgtggttagccccccccttatttttatatatagataactagccgggcccggtagatggctgcgcaattgatggggtcggctggtaggccacacgaggggtagaagtgtgaggtgtgcaccgtcgcggttgttagcgcactagcagctcaggcgcagttgcgtg

SEQ ID NO: 93763 - DNA, 605 bp, Heterodera glycines
  SCN-specific regions: Sequence locations=1-605
ccatcgcttcataaaaggaaaggccgtccacgcgacgccgtgccaattgggctgtaaggagtttttggctggtcggactgcaccaaacgctgctcaactcgccgtacattgcacatttgcactctccgaagaccatcactttgctctgcttgcggctgaccctcggcgacccctttggcattttggacgaccaaaccgtgccgcctttcactctgtccgcccagcacagtgcctgtgccccggccggcgcttacctgtcttctgtccacgccccacagactgtgctcagtgcccactctccgccagcttcgttttgtaacgtcgtgctccgattgacctcttttctgatgattatttgggacagctcgttttttcgctcgagatgatttgcggtgtggaaagcattggcccattggcggaacgtcccgaggcaattctgtgccaatttcttatcccaatgtttttgcgtgccgcaatttccggcaaagaagcgccacagttccggcccaaagacttgaacttttgtctgagtctgctccaaaatgccatttctccgccctctttggccaagcaaagcgtggcgccggcaatgagtggcagcagtt

SEQ ID NO: 93764 - DNA, 474 bp, Heterodera glycines
  SCN-specific regions: Sequence locations=1-42,64-117,158-283,307-474
gtcccgtgaaaaaattgccaaaaatgtccaaaagccttacgattttcttcataaattcctctccacaacaatttccgtcctgctcctcattttgatggacttgctgaacagcttgggttcatcttcagctgctgctccattgtcctcctcctcctcgatttttaccaacccaaacagcacattggtggtggtggtcaagcagtatcagcaacaacagcagctgaacaaccatcaccacaaccatcgcaacaaccatgccgcggcagcagctgctgctgttctgttgccattcaacaacaacaacaatttgacggatgaaataacagaattggcacacgcgacagtgcggggcgacggcgatcggcattctgatcactttgctgatggcaccatcattctgttccacggtgcggctgaatggtgcccgaacgtgtcgaatgccgtcgtgtggccctcgtgcattacgctgggaga

SEQ ID NO: 93765 - DNA, 699 bp, Heterodera glycines
  misc_feature (3)..(3): n is a, c, g, or t
  SCN-specific regions: Sequence locations=1-7,29-699
ggngaactcttttttcctctctgtccatgacgttggctccacgccccacctttcagggaatttgtgaacagtacagcgatgagcagtgtccaacagcactccgtgttccttcacgtttgtgtgccgggccaaaacgacggggcaccgaaattggagggggattttccttcaatggatcaaatgggcgaaagtttggtgcacgtcctgaacacgttggatgtacgaaattgcattggcattggtgagggtgctggcgccgacattctttgccgtttcgcaatggcttggccaaatcgcgtcctgggattaattctcatccattgcttggcaacaccgcatggcatcattgatagtttcaaggaaatgcttcttaatttgcgcttggaggatgggaacatgaacagcgccgcgtgggactatcttttcctgcacaaatttggaatgcatgaaaaaatgatgaaggaggcattcatcgccgagctgagttcagtgataaacacacacaatttaagccgtttcctttacgcttacaatcgacggacgaacatatgcgaaataattggcaaaaaattggcaaataccgacgtgctccttattaccgggtcgcgcgcgccgcacaacaaaaatggtcgacatatgttcgaaaatatgcgccgtgataagagcacgttgcttgtcatcgacgaagtcatagacctc

SEQ ID NO: 93766 - DNA, 354 bp, Heterodera glycines
  SCN-specific regions: Sequence locations=1-328,351-354
tcaattggcccctgccgccgtttcctctgttgccaatggccccctcccgcctgccgcccgaacttttgttcgaatttgtgcccttcgtccgtgccgaagatgccgttccgaatgcgttctcgtgctgtcgactgtttcacaaccttttgcttcaacgtgtcgaccagtggagagaaataaacgagatgccataagaacagaataaagaattgacggaagagaacaaacgattgaaggccattattgaagagctgaaggctggaaaactttttgctgtcactgaccagcagccccaatcatcgtcaaccgcctctgccaagtcaccatcaaagcccttccaagagaaagtgaaag

SEQ ID NO: 93767 - DNA, 410 bp, Heterodera glycines
  SCN-specific regions: Sequence locations=1-82,106-410
cattgctgttcaactaattggttactaattgggtaactctgattaacctctgagactgttctactttcgccagcaatggctcccaaatgccttccgctcgaacttttgttcgaaattgtgccttttgtccatgccgaagaagccgttccgaacgtgctcttgtcctgtcggctgcttcataaccttttgcttccatgcgttgtcaaatggaaaaagagaatggcggaagagaaaaaagaagaggacttgacaaaacaatttgctgcaatgtccaaagcattgacaaaacgaatggaagcggttgaggaagaattgaaaaaatcgaccgaagaaacgaaaaaatctacctttcgaatggaagcggttgaggaagaattgaaaaaatcgaccaaacgtattgaagcggttga

SEQ ID NO: 93768 - DNA, 399 bp, Heterodera glycines
  SCN-specific regions: Sequence locations=1-399
cgaagacattagttaccgactgtggtacccaatttatgagctcaacattctatatcattggcaaaaacttggggattcgaacatcaaaccacagtgccctaccatcaatcggccaacggacaagtggaacgatataaccgtaccattgtggacatgcttgtcacaagtacggaaggaaaaaattgggcggcagcgttaccattaatttgcttcgcttacaattcttcaattaactaccaaatcggcaattctcctttttatgtaatgcatggcttcgaccctagacttccaagtgaagtgacactcggaaaggtggaggataatttttcggatatggcaatatatgtgcatgagttgacaaaacgaatggaagaagttaagacaacagtaaaagaaaat

SEQ ID NO: 93769 - DNA, 350 bp, Heterodera glycines
  SCN-specific regions: Sequence locations=1-350
tgccgcgagtgttatgaacaccacgccaaactgtctcagtgtaaaatcaagcgtggcaccgaagtgacaaccattgaaaaatcgatctgcaaaagctcgaaaaagtgcatcgactgtggagttatttaccaaatacgggtagcatttgatattttaaattgaaaacaaaatgcttttaagcaccacaaacaaaaggctcacgaatgcggccagaagttttgcaaagtgtgccttggctttcacgttccacgtgaatgctacatcccggaccggccaaataagaagaccgaaaagaggatcatcttcatcgactttgaatgtactacggacttcaagccggaccccgaact

SEQ ID NO: 93770 - DNA, 648 bp, Heterodera glycines
  SCN-specific regions: Sequence locations=1-648
ctctgccctaaaagttaccacgtgaactgcttcagattgtactcaaactctcgacatcaactgcaagacaacttagcagtaggaacagcattttcgagcagcaaacggcaactcgttagccaacaaattgcccccggctctcaacggttgttgatcatacaatcgctggaagccgaaacggaatacgaattgaccattgaggcagaaaattctgtcggaaaaggcgaccgagtaatcattcggcaaaaaactctcgtcgaaccgccagaaccaccacaaattttccttgcccaagcaactgcgaattcgttgaaattgaaatggagtgacggtggagaaaacaacagttccatcggtgcaaacggtcacggcaattattattactatttggagagggaaaatgagaacggcacttattcgcccgtttatgaaggtgaactccgcactgcgcgactgaagggacttcgtgagcaaagtgtccaccatttccgaatccgtgcgtccgtttccaaaggccttctgctgggtccctggtcacatcgcttttctttccaaaccacaaaattgcctccgcctgcacctaaacaggcgcccatcgttgctgagcaaatgcaggaccatttccaatttgagtggaactccgtccgc

SEQ ID NO: 93771 - DNA, 746 bp, Heterodera glycines
  SCN-specific regions: Sequence locations=1-592,614-746
caacataataattgcaaatgagttccattgaaattgaggcggctgatgttgttcaacttgtgcaacagtacctgaaggagaacaacttggtacgtactctacagactttgcaggacgagacgaacattactcttaacacggttgacagcatcgaccaattctgccaggacatcaccagcggtcattgggacactgtgctcaaatgcattcagccattgaagttgccggccaagaaactgattgacctttatgagcaaatcatcgtcgaattgttcgagctgcgtgagttgggctccgctcgtttaattcttcgacaaaccgatccgatggccttgctaaaacaggccgaccccgagcgttacacccaaattgagaatttgttggccaaaacatatttcgatccgcgtgaagtatatcctgaagggggctccaaagaaaagcgtcgcgcggccgttgcccaatcgctgtctgctgaagttcacgtggtgccaccatcccgacttctgtctctgttggcgcaggcactgaaatggcaacaacatcaaggacttttgccgccaggcaaccaaattgatcttttccctgggaaagcgggaattccaaaacaggaggacgaagcgtcaccgaacactttggaagggaacaatcaatttggggccaaaagtcattcccgaatcggcccgttccaccccggagggcaatatttggtcaccggaacagtggacgggtttatccgaagttggaaa

SEQ ID NO: 93772 - DNA, 396 bp, Heterodera glycines
  SCN-specific regions: Sequence locations=24-68,92-182,211-327,349-396
aaaaattaaaatttttaattaaactcattaatttggatataattttaggaaaacaatggaatggtggtgcaacaacaaaaaataacgaaaaattttgctccaacaaccaaattaaatgatcaacaaaaagtgctaactcaaaaagatgatcagaggccgccgactttgtggacaatgtccagtttaaaacaaaaatttttaaaaaataaaccgattattttaactgcatttcaacaacagcaaaaaagtgaacaaaatccgccagtcaatccaaattatattcaacaaaatcagtaccagtccactaaactgtttgatcaaaatcaatcccaaacaacttctccaacactgatccaaccaattcagtatcaaccggcggttcaaaaacagctccaa

SEQ ID NO: 93773 - DNA, 535 bp, Heterodera glycines
  SCN-specific regions: Sequence locations=1-32,56-328,370-476,498-535
acgacccttacccctccatttgatgtcattttctgttttgaaaaccactttgaatgatgaaaaagcatgtaagaattgccccgatagattattcgaaggttgggaatttcatgggctttgtttgggttggaattaatcgagtggcgggaaaggtcagtgattatttaaattaattgaacacattaattaattatgacaaaaaaggaaacacagccaccagcagttgaattgccaacgattaaattggatatacatatttatatgttgtttaaaacaaactatttcaacagctttctaacccatagaaatctttaatttttccattgaattgtttaagaaacaaaggcataaaaataaagaaagtataaaagaatttttggccaaaaagcagccatcaacatttttaaattgcgtataaatctcgcaaaaatgaacaaattgtttataaattagagtccggaggaactctcgactcaaattttaatttagaaaataaaaagtccacaagaaataaccaagtttgtcaggttttttg

SEQ ID NO: 93774 - DNA, 310 bp, Heterodera glycines
  SCN-specific regions: Sequence locations=1-310
tgcaaatggtggcccctaaaagaccccgtgagggcgatgcctttgcccgaacactcaccgaggaacacaatgccaattcttcataagagacccaaactgcagggatgtggcagattttccaacagaactcactgccgattggcaaccgcaagtactacgaccaaaagtaaaatgcacagggaaacccccgtgcacatgccattggagaataaagcctgttgacggccaaaaagtggcggtcaaaatgttgcgtttggaggcggccgcgtttgaatgcgagcgcccatgtggcaaactgaacgttgaattc

SEQ ID NO: 93775 - DNA, 622 bp, Heterodera glycines
  SCN-specific regions: Sequence locations=1-188,220-494,516-549,583-622
aaaagcgaaaatgattccaaattatgagttaaaatggcatatttggccttttaaactttgcttagtatcgatatatagattcaaatcagatcataataacaggcatgtatgttagttaaaatgacaaaaatgtgatctgaaattgttcgtttttcaaaaggcctgagaaacaaaaaaaatggaatgagttaaattaaacaataaaaataataataattaccatatggaaatgagtgaattaaaaatgtgtgtgaatgaatatttgagaacgaatttggaaaagatttggtgagaaaagtgagacaataaaaacaaaaatggcaaacaaaaaaaaaggcacgtggttttggacatcatataacacaacaaaactgtaattacgctaattagtggatgatccccgcacgaggatccgaacctcgtgtggcaaagcggaaacaactcgctgttaacaaccacttgaccacaaagtggaccagcgtttgtttttgtcatacagaaattttttggaaaaatttaacgcaaaatacaaaaaacaactgccgcgtactctctctctctctgtctccccctccctttctcgtctgcgccagccactccattttgcatgtgctctctcgtc

SEQ ID NO: 93776 - DNA, 585 bp, Heterodera glycines
  SCN-specific regions: Sequence locations=1-21,43-522,557-585
gaaaaaccggttcgacactcccggatgtgaaattctctactttgacacggcctgcatcatttacgttcaccccgaggacaacgacccactcccgacaggaaaaggacatctcggtgagctgactgacgaaaagccggaccacaacattttggagttcatcagcgctggctgcaaaaactacgggctgaagttggaacgtaaggacaatgggcaaattgagtacgacttgaaaataagagggataacactggatgaacaaactgtgcaaactatccattatgacagtgtgaaagatcaaattatgcgttatggttccgatgaccccgcggaccccattattgtaacatatccccattttattcgccctaatctaatccaaggcaaagtgtacactcaatctctaactaagcattatcaacctgtcttcacaaaaggtattattaatgattcattccaagtcctcgaatttggttatcgcaaatgataagtatgcattctcaattaaattttctaaatattagttttcttatggttcccttcttttctttctctctgtttatatcactcatgtgggacggaatgacc

SEQ ID NO: 93777 - DNA, 470 bp, Heterodera glycines
  SCN-specific regions: Sequence locations=1-108,130-194,216-470
gattcttaaaatttcttgttgtgtacatttcaccgattgcctttcctttaagatgtccgatgctgaaacgtccattgccgaactgcccgtacccaaattgaacggcagcaactctgccaccagcggcagtgacggcgaagtgccgtcctcgtccgcgtccaaagttatgcctccgaacactcacagtcaaccgcctcagcagcaccaccacgtcactccgtcacagcccatgccggtgccgatctcttacgcggcgagtgccgcagacttttccacgatggtcggtacgcccgagttcatccaggatttgctttacacacccaccggcagcgccaacggtggtttttccgcgccggcggcggtgttcggctccacgcccaccaacaattacgggttcggctcgttcggttcggtgtatccgccgccatcattggcagcgaatcgaccgctttcgcatcaccaacacaatg

SEQ ID NO: 93778 - DNA, 680 bp, Heterodera glycines
  SCN-specific regions: Sequence locations=1-399,421-493,515-612,634-680
taacccatatagataacagtaactattgtaaaatccagttaatgacctacaagacagtattttaggccctcgtggttgtagtattgaaataggccagcaataacctgaaataagcaacattaaaactaaattccaaaaaactatacctggtctttccattttgatgtcataagccgagactcgttggagataaacaaagagccaccgtcttctactaaattatcatcgacacactaacaatggacgcaaaaggaaccgactttccctcccccatttaaccgttttggtcgtgatttccacagctacaaagaaggaggattttcagggtgactaattcctctggtttcagctgcagtttccttagcggagtggacacttcgtcaatgcaacggtcagtcatttgcctgtaaaggttctcttgacgccacttcctatcctctgttaccaaagtctgaacgaaaatgtttttttcgaatgtcgcccggtctcgccttgctttctattggcaaaacattaacactcctcggcatgcaagtgccatttgaaattagccaaacatcgtcaaggccaatttgggcagtgaaatacccatattcgagcacattgcatggcattgcaaatcttttcagcaaaatcatttgatcattcacgggaagtgaacaaaagataggcaaagtctg

SEQ ID NO: 93779 - DNA, 584 bp, Heterodera glycines
  SCN-specific regions: Sequence locations=1-150,174-266,303-486,530-584
tcctccttgaatcgtcctcaatttttcggacccgctcttccagggcttgggattgctcagaaaccagctgcttcatctgcgtgaatgcggcaattgtcaaagatgcggcatctatacgagcaatcattacataacaaaaatgaacaaatgtttatttataaataataataaatgagcattacagtacctctgtccacttccgataagccgtttggcaccgaagtggacaataacttccgcttttttgatggtgaattatcaggtagtggtgatgatgatgatgataatgatgatgatgatgaaattgttcgttttaatgatgcgagggcagtttgcacaactgcaacctcaacattgccgtggcgcagaatccgatcggccatgacgtcgtgcacattttcttgttgcttcaacaaatcgaacgattcacggagaacggctggtgaaattgatgaagtcgtgtcgagcggataaggcgaaaagtgctaaaattattatcactaaaaataattaatttaattattattttcacttcgcttgccgcccatttctctaacagctctgttctcgcgccatagttgatg

SEQ ID NO: 93780 - DNA, 732 bp, Heterodera glycines
  SCN-specific regions: Sequence locations=1-287,322-501,523-610,634-732
cttcttcttttagtcagctaattaaagtaccataaaaaaaaaccacggccttctttgaggaaaattaggagaggaattgccacgacacgagacaaatgacggaagcgaagaggtgattagagtaactgtaaaaacaatatacgaagttacggtatgccataaaataaattggcatttgctttacgtgagatttgccaagaaaagcgcggccatacaaagcaaaaaaatggtcaaaaggcaagtggactcgaccagcacagcgttggctttgtattgcaaaaactgtgaaaaaaaataataaataatattttataaataatagttctattatacgttttgttccacccgtgtgtgcttgaaccgcagtgaatgcctaaaaatgatgatagtgctaggacaaaggctatgctgatggactgacgcgaatttttccagcagatcgaggagcgatctctgcagtttttgatcagtgctcgcatgccaacatcggaagcagccttctctccttctctgatggcactcatctgcacccattgtgaccttgtcttagcaaatagaattatatttagtcattttaaagagacttagatgaagcattcccaattgaaagaatttaattttatattaataattcagatttatgcatccacctgaattcgtctcggaatgcccgatcagtccattcgactggcaacaaacacactgtattgccccaaatgtccggatttcccg

SEQ ID NO: 93781 - DNA, 628 bp, Heterodera glycines
  SCN-specific regions: Sequence locations=1-628
cactccaacaatcgtcaacaatgttagtctcgacccccaagtgagcgccaatttccttcacacagccatcgaagagaagcgagaggatgagattatccatttgctgtgcaccatttccaaccaacagcggcaagaattggcacgcgaattcgaacaagtgttcggagaagatgtgtccgccaaactgaagaaggcactctctggcgactttgaggaactgattttggctttgttggaaccgccagctgttgacgatgcgcagaatatgcaccgcgcgatgtccggcctcggcactcgcgaatcagttctgattgagattttggtcacgcatagaaaacgacaaattgatgagatgatgcgcgtggaccagcaactgtacggccattcgctggagaaagacatcggcgaggacacccgcgggccatttcaacggatgcgcggggcgttgtggaacgattcgcgcgacgagaggtggagctctgacccgatcaaagcgaatatgacggcccgtgctcttgtcaaataaaaccaagtggaaagcgggggcaacgaaagtctgttcaaccagtggtggggcacgaaatttcattccgttgcgtttgatttcgaggagatcccaagggcagcg

SEQ ID NO: 93782 - DNA, 698 bp, Heterodera glycines
  SCN-specific regions: Sequence locations=1-191,213-698
atttactgatgtccatttgatttcagttgatgttttgtgctcttaacctccaccccccccccattttttcactgttttgtccccattgcacccgcttgcccccccccgttccattttaattcaattccccccccccccttatcagtgattcgttccgtcacttttccttccgaattccttctgcctccttttttcattttattcccaaaaaatcatttgagtgcattcattttgttcattccgtgcgtccgcttctttacaattgccattattctctcctcaaaatgacaatttcgacgaatgtttcccaatttgcgctgccaaagtgtccccaattggtccgtttgtccgatgatcggccaatccctcgcctccgccggcgtttccttccctttttcctctccgatcacttccgtttcattgtgttggctttggcgatgctttgcatgacctcgatctcagccaattccctgctgttcaacttcaccgacatttgcatggacggcgatgcaaatttcaccgccaaccaaaacggccttttgatcgccggcactgccatcggcggaattttggccattggacccgtgcctcatgcaatcgccctgtttggcctaagatatgtgttcgctctgtttggactcctctccgggttggtcactttgctaatgcccgtgctgttctatatccagggcgggttt

SEQ ID NO: 93783 - DNA, 663 bp, Heterodera glycines
  SCN-specific regions: Sequence locations=1-29,308-372,394-626,654-663
ctttcccttcataactcttcttcggtccctcctccttctcttcctcttcttaatattccttctcccccgtttcttccgtttccgttttgctccttcctcccctcttttttgtttattttatcttccactactttcgcctcttctgtttcgtgttccttcttccgcccctcttttccccctcttccgcgtcccctcttttctcctccccctccctccgctccatttgcccccgccccgatcacttccaattccaccgtcgcttcgttcgccctcctcgtcatccccgccccgtccctcgccttcactcgcactttggccacttctccctctgccattggccttttctatttaaggttggcccaacatcgtggccactggcactgctgagagtccaatgcgaacatttcccctttctccgccgcccctttttcgttttgcgttttctccaacgaaaagcgacaaattccgccaattcctctgtcaatgtcaatcacttccaaacggcgcagaaggaaaccgggggaagagagctgtaaaaagcgaaaaagaaggctaatggacaagaaaactgctgccggggaaaggacttcggggacgatcacttcggcggggaaagggccgccgaagaagcggggagcattgtcattgacatcgaccaattgt

SEQ ID NO: 93784 - DNA, 763 bp, Heterodera glycines
  SCN-specific regions: Sequence locations=1-243,265-763
ctcatatttatctgtgcagtacgacccaaaagcgttcaaccaataatgtaataacagctcctcacgagctatctccgcgcagaccccgaccagatacccaaaggctcattacaagttcaacctggttaggagaaacctgggcagaacgacagctttataaggcagagtgcttatccgacacatcattccagaggtaccaccccaaccaccccttatctgacgagcaaagcactcgccagaccagctccactagcccaggctggcactagtaggaactgttcctccggaactacggcgtcatcagaactctccgccaaccatcatccacatcccaagtcgcccgggggcaccaggtctatctttacctgcataaaacatgcctactaacgtatacatgagtaggtattaggaaaggagttaagctttggagaaatcgaagaaataatgcacgataatttatcgcaacaactggaaaaagagatcaatatgatcaattgctgagatcatcaagatctattccggtttgttggacgaatggcgccgcaccttcttcccagacggaggggctcccccctccttttgcgcggcagacggcccatcagcgtccagctcaatggtttcggcccctttggcaatgccatcggtttcgtcccctttttgctttttgccgccgtcctccgtacctggaagtcaaagtattgcttcgccgtcaatcatgctattatctctaacccgtccccgctttctctctcttctcccgctg

SEQ ID NO: 93785 - DNA, 367 bp, Heterodera glycines
  SCN-specific regions: Sequence locations=1-270,294-367
ggacgccgtctttacgaagatgcaagttatgatgatcgacaatgacaatgacatctacccgtgggacacctccgaggaattgtgtggtcccactctggaacgggtggagcgtgtctaggaggaattgcgggactcgccgaatatagtgatggcgactgataacaatttggacgatgctcatgaggacctgacggctgccaacaatttgttggaagagaaggataagactgtgcttgacgctgacgccgaactggctgcactgaaccgccccatggttctggtgcaagaggagatgcacaaactcgcggagcgccttaaacttgccaccgagaacatggaagaagctacggaccattgccacgaatcg

SEQ ID NO: 93786 - DNA, 334 bp, Heterodera glycines
  SCN-specific regions: Sequence locations=1-106,129-172,195-334
ccgggctttgctaccatttaacatggcatgctgttccaaccgtgaccactactcgaagacagctttctcctcgctgggagtccatcgcacactcctcaaattccctttttgagacccccgctgagggggatctttaccagcacaatcatcgctggggcaccggtgcattgcgacacccttcccattatgacttaatgtgccggaagaaccctgtgctaaagagcacattttgggataatttctcgcaggcacagacatagcaatatgacttgaaagctcaggtatatgttgtaaaaaactttttctcatatttatctgtgcagtacgacccaaa

SEQ ID NO: 93787 - DNA, 244 bp, Heterodera glycines
  SCN-specific regions: Sequence locations=1-68,90-197,219-244
ctctcatacattcttgatcaacttgatcaattgatcaaacgacgtaataccatttcccgaaccggctgaaattttttttttttttttttgctataaaagtgggccgaaccgacgaaaaaaatcattccataaaacggatcgccaaaaacaaaaaccaacaaatccctcaaaaaacaaaaatgtctcctttccgcttcctgatgatgttgctggttgcgctggtcgctgccatggccatgggcag

SEQ ID NO: 93788 - DNA, 706 bp, Heterodera glycines
  SCN-specific regions: Sequence locations=1-334,356-706
gtttgctgtaattaaatgcaatctgcagctgttcatttttctgctaccgtagatggtgaaattcccgatgcgccattagcacaagttgacgaattggaaatggttgagggcagtttcgctgctttctcttcgtcactgaccgatatttcagcgggagattgtgagaagtcgcagtcagacgagggccctggcgaagatttgtcgaattgttctgtcaatttgtcttcgtcgctgcaagacttagtcgagtcttttgacgacaaagtcgcagtcgttctgaaggacttcgaaaaagatgctgaaaaaatagcgccaattaaaattcgttctcaggaagaaataatgtctgaaagccaattttggtggactttgactggcaattatggaaatttgccgccgattgacttcgataattcgcaaatccgaaggaaacaattggaagcactgaatttcaattctccgaaagtcatttcgcctgtctttacactaataaattgttttttgtttttttttgttcttagcagggaacgccgaccgatcgaagtgtcgtctccgactgcgactcgtcggaggacaccgaacgaatcgactttcaccgactcgcaactgcgcaaacacacaacgaaaacggcgaatccctttcctttaacgccgacaaagtcatcgaggaaattgatgagattttacaggccggcgatttgatgaa

SEQ ID NO: 93789 - DNA, 724 bp, Heterodera glycines
  SCN-specific regions: Sequence locations=1-724
ctcaacctgtccccccaatttcgccatcaaattcccttgcttttctttctgttattgacttttttcgcctctgcaaatggcacttcgaaatgcgtttgggtccgcggcgcactccaatgccatcgcgacccgagcaaacatcagaatgtggaagtacgggtcattgaccgggacggatggggcccgttgaaggtgttggaccctgacgacatgatgggcgtgtcttttactgagcaggacggcacctttcagctcgacggttgtggcaacgacatgaacttcctcccgggcgtgcccaatttgcccgaccctttcgttcgcattttgcatttctgcaacagcgaagaaggcgaaaccatcgaattgcccgaattccgaatttttgtgccggacacttatgacttgggcatcctcgtgttggaccagaagactttgcccaattccaccgttaatttccccgtgcccgagaacccccgtcgacgcctgcagcaggcaaaaagaccgacggaagtcggcactttggacgaaagcaatggcaaaaagggggcggaagatgggtttgtgactgtcgacgcgccaaaaagtcacaacgccaaaggcctggacgaccttttgccgcccggcaaaacggtgaccaaaacgaacggcgatttgttgtgggagacgcaatcggtggagatggaggaagtgccggccgaatacgacacgtcgatacggcaaagtc

SEQ ID NO: 93790 - DNA, 608 bp, Heterodera glycines
  SCN-specific regions: Sequence locations=1-323,345-587
tccttttggcttatttctatattttgcaccactaattttaaacttcgcgcggacatcgaccggcatccacgacaacatcgtcgagcagtgcggctgctacttcgtcgtcttcaagcagtaacaatttccaacagcagcaaacgccgaggagaggcaacagaacgttgggatggtatttgggcgacaaactcagcggaagcagtcccaatgaaggggacagcagcggaggaggaggagcacttccgccgcgttgtttgttttccacaaaatgtcttcgtcagtttaatcctccatttttttgtgccaatgccttgcaattgtcagccgattccgccgccgccgccctttgatgtcccccctccccccgacccatcgtttgtgttccatttgctgagtgacgacccgcccgaggcatttgaaaagcttcatctcctccactcgtgccctcttcaaaaacagcttttcttcttccgttatccgttcggtcgttttcttccgttcgccacagtcgctgcttttctgctgctcacttccttctcagtcacggcctttgttttttggaggaaacggcggaggacgcgaagaatggaagagagggaggaggaaga

SEQ ID NO: 93791 - DNA, 699 bp, Heterodera glycines
  SCN-specific regions: Sequence locations=1-61,83-122,144-699
caacaccgtaaaaagcaaaaacccatcattggggtgggacagcaacagcttgtgaaaggaacacgaggcagaaagcggaagaagcctttgccggagaatgtgcgttcttccgtccttggcggtgtgccattcactgctttgggcactcaacttgagcgagatgtgtacgaaacggtggatattctcgttggtttcgtcgctgcaaaaatggacagcagtagcagcagcggggcacctgctgacgataatttacttgttcagaaaatcctgtcacaacaaaataataccaacaacggcataaatgccattgcccaacaatgtccagggaaggtcaaaaagaggcgacaaatttagaccaaaacacgcagtcagcccgacactaccaacgaattggacttgattcaggagcgcatcaaaaaaacggttgagttgataccaccgatcaacaactacatggagcagtaccaggcaaatgacaagcagatgatgaagtatccggatcagtccgctctccctgaccacgaggggtcggagccgcctttgcatggcaatgcgaccggcgaatacacattgccgttcatgcccgattattacgacgaattggaaacggtgcgcgaatacgtcgacgaggagacccttttgccgccaacaatgggcgaaatttgttggaacgtcgatttggacgcattggcaaaagac

SEQ ID NO: 93792 - DNA, 770 bp, Heterodera glycines
  SCN-specific regions: Sequence locations=1-38,60-341,363-553,594-770
ccctaaaaaatcgatttttttcataaaatgatatatcaaaaattaatttgtaaaatattcaaatgtgattctaagcctattttggtcatttttatggcattttgtgcctatttcactttttacgaagaattttttttccaaaaaacagcatttaaaaaattatatttacatattttcctacatatttgaggatttttgtacatatttcataaacatatttcagtgttttttatacatattttatttacatatttcgcgatttttcttacataaataaatgatccctatttaatacaataaaaaaattttgctcacaattttcctcaaagttcgtttctttttatagtaaatgatttcatttaactaaaagaagcaacaaataaacgcgacgagcgattatcagctcaattaaaattcacaatgatcgatcagaatttctcatttcccaacaattcattcactctttcttctgttgctgtccgctgggcccgggattcattttcagacgattttttgtgttcttttggcccgactttggtggagacattcgcctaaatgaaataaaatgtttaaatttgatttttaaagcaaaaactgtttctctcatcagactcacccaatacagtatttgccattaagaggccagaaattgatattgctgaaattattcgtctttttgtcctcccaccgaaccgtcgccccaatttggcatcgcttcaccaccacgatatagtcatcttcgtcttctttctccatgttttcatcaccgt

SEQ ID NO: 93793 - DNA, 464 bp, Heterodera glycines
  SCN-specific regions: Sequence locations=1-139,161-464
agatgacatttaaaaaaaacaacaataggcttggagagcccttgaagacctgcaccggatgcaagtgccgccgttgctgtacgcttagcggttgctgtgcaatgacggaaaattgctaaatcagaaaaaaccaaatattatcaggaatacactctcccatctcacccgtagacaaaccgaatggtatatgttcgaacggcaagttgactaccgtacctaattaatatttttgggatgccaattgttaagtgcgtaactgatatgaaaaaagggtacgaaaaactgtgataaccccattcagagactagctaaaaaaatcagaataggattggatttgcgtaccaattattatttttataatgggtttgttaaatgcgaaacagatgacaaaagttgttataactccattcagagatgagatagaaaaaaaacaacaataggcttggagagcccttgaagagctg

SEQ ID NO: 93794 - DNA, 756 bp, Heterodera glycines
  SCN-specific regions: Sequence locations=1-263,285-756
aacatcccttgaagtgatcatggaggagggatcagcatctcttccgactcttcctcaattgctgatcgttttgcagagcatgttcaaaatatcggaagcacttcggtctccacggggccactgggcacaagcggtggcggatctaacgctgcgtcatcgatgttcagcgatgccacaacggcacttcaatcccaaattgagtctttttcgtccgttgcctctgcttttcgtcgtcagttttccacctcttccacttccgccaaccaatcaataattcccaacacgggagcctctcgtgccgatgcttttgcagccatccgtgccgccattgagcgaagtgaaaacataatcccttcgttaccaatcgatgtgatcatcggatcatctcctgtcaatgaagggcgaaatcatcgatggcgacaagccctactggacgaattcaatgcttttattccgccttcaatgggcagtcaaagtgatggacgacagcgaagcaacgaagaaggaaattgtggacgagcggctcgaacaatggcaaataaaacggcgatacaacccggtggttggaatgacgattttgtgcttcgtcgtcagttcggggcactcatcccagccttcgaccctcgccccggtcgaaccaatgtcaatcagacacaagatgttaaattgccggacagtattcaattctgtacatacagacgcaaagggtcgttgattagagaggagcctaaaggagggggaacttcttccactgcc

SEQ ID NO: 93795 - DNA, 568 bp, Heterodera glycines
  SCN-specific regions: Sequence locations=1-568
gtcggactgttggcctccgcacccttccatcatcatcagcagggaatgcccattggtgtcgcatatccctacggcatcgccggcggcaatgccaacattgtgcagcagcagaacacggacaacgcacacgcgaatgttgtggaccaattcggacaacaacagcaacagctaatgttctcccccttggaacatcaccaacatacttcggcatttgcacctccgactttggcatccgcttctcttctgctggactcggctgtgagtgtcggactggcggggcacggcacaacgacgacattgatggaagcagcgaacaatgcttttgttgcaaatgattcgttgcttcgcggtcagtcgaccctcggcgcttttttgggcactgatgcgcaacaattttttgtgttctttgtgcggtcgtaaatttcgcaaagagtcggaactgtctctgcacaagcaaacacattttatcgaaccaaatgcggcggtggcgcgtcaaaagggcgcgggcggcgcctttaaatgcagcgattgcttctgcgtcgtgcgatcgaaaggacttttggcacgc

SEQ ID NO: 93796 - DNA, 531 bp, Heterodera glycines
  misc_feature (480)..(481): n is a, c, g, or t
  misc_feature (515)..(515): n is a, c, g, or t
  SCN-specific regions: Sequence locations=1-127,154-531
cttgcttattgcatgccctcctcaatgccggacacattggctccccttccctgccattggtcgctgtgaaaacgcagaagccgatgggccaaataaaagttgactatttgttggcaacctcagtggactgggaagaggaggaggaggaaaagcatgccacgagaatggagacgacctttgtgaagcattggaagaagcgacgcactttggaggtgggccaccgcggcagcggcgaatctttcacaaaattcgcaaccgcgcgggaaaacacaattttctcgctgaataacgccgcccaaaggggcgccgacttcgtcgagttcgacgtgcagctgagccgcgaccgatcggtggttgttttccacgattttcacgtgctcgtctctgtggcaacgcgaaacgcgcaacttttgggacatccgtcggcggaagagacgaaaaatgccacggcaaagcccggctcaaagtcggagaccaaanntttgagtgagaggacagaagcggcgacggacggnggcggcgaactgcaca

SEQ ID NO: 93797 - DNA, 811 bp, Heterodera glycines
  SCN-specific regions: Sequence locations=1-314,336-811
cacaacagtgactatctgcaaattagcgaataaaatgaatattccaacttctatcgagatgggcgtttttccctttgttcaacaaactgatttatgcgactccgaggaaattgtggagacgtccgcgtttgggtcggttaaagtgaacattttcgggaattctgagcgttatccaattgttacctttcacgacattgggctgaatgcgatcgccaattttgagaatttctttcaattccaaactttttctaaactgacggaacagttttgtgtctacaatataaatgcaccaggacaagaattagacgcaaggaagttgccagaaaatttccattatccgacaatggatggtcttgctaacattgttggcgatgtcgtctcacattttggtttcaagtcgtttattggcattggagttggtgcaggtgccaatgtattgcttcgtttcgctatgagtcatcagaatctgttggatgccctccttctgatcaacgccacctcccaaaaggcggggtgggtcgaatgggcctaccaaagatggaatgtgaactctctgcgctcggaacggatgactcgctttacagtcgactatttaatgtggcatcacttcggtaagtatttcgaggagtgcaatccggacattgtgcagcagtaccgcgactatttctactcccatccgaacccatcgaatttggcactttacattgaaacatttctcaaccgaaacgaattgagcctgcgtgatccaaaaagcacttcggattttctgctcaaagtgcctgttttgcaaatcgtcggcatcaattcggct

SEQ ID NO: 93798 - DNA, 199 bp, Heterodera glycines
  misc_feature (100)..(100): n is a, c, g, or t
  SCN-specific regions: Sequence locations=1-199
tgtggctgaagtcttgaaacaatcccaagagaagaagcgcaatttccgagaaacgattgaatttgcaattgctctgaaaaactacgaccccacagaggancagcgtttcagtggaactgttagactgaagcacatcccttcgtccgaaaacaaaggttggcttcttggcgacccaaaactttgggacgaaggcaatgcc

SEQ ID NO: 93799 - DNA, 793 bp, Heterodera glycines
  SCN-specific regions: Sequence locations=1-793
atcaacggatacgcgtcgaacaaactcagcgtcagattcgttttctcgtcgttgggaaggcgtacaaatgggcccacaacttggcgaacaaaccaatgccaaccgctgtatttcacctatttatgtataaatgaatatttaactcaaataaatgttctgttcccacgcttcaccttctccatgtactgcttcgcctcgtcgtttagcattccgttgaattttgcccaccgttttttgatctgtgcccacgcgtcttcgagcagttcagccgttttaggcgccttttttttcagctcacgccaaacttggtcgccgctttccatgcgttcggcgccggcgtataattcgacgatggcgccgccttcacttgtcattgctttgatcagtttgagtaacaaatctttgggcaatagagctggaaaaaattgtttcgccaaaaccaggaaagacaattcgtttaacacctcgaaaatgttcagggagccaattagcgataaattgtgtcacattttcgggcttaattagatcagccaaattaccctcctctcctaaattgcaatatttgaattattttacataaataggagggaatgctaatttttgactaaattctcacccatttgcttttgtatctcttctgcccatccgtccttaatccccgctgagaatgcgtccgcgtggctttggaattgctttcggatgtgctcgtccacctcggggtcgtgcccatccaacggaatttcatcacaacgaattggcggaattgcgagcagaaacagaaaaataaataata

SEQ ID NO: 93800 - DNA, 666 bp, Heterodera glycines
  SCN-specific regions: Sequence locations=1-666
gcgagcccttcattgtcgtgcatctaaacaattttgaaaaatcaacaatccaaacaaaaaataaatgacgaaagtaggggagcagctcgtccctcgcgccgaaaaatttcaaaaaatttactaacttacaattcgaactatttttcaaaaaaatgttttcccaaaaaatcgtatccttttcgaaaacatgcaaaagtaccatttggacgatgtaagcgagcgcatgttgcggatctttttgcgccatcggagtgtaacagatggaaatccattcgcgcaggatgttctccactttgctctgcagaatttggtcctcggttcggacgcccaattcgttgcctggcgccggacagaaggcgccgcggccttcagagaaaatgccgggcggaagtgccattctttcggcggtcataatgggcgcggcggaatgaccaccaatgggcggcggatgatgggaagggatgacgccatggagagtggtggtcggagtacgaacatcggtcatggacatttgactggaagggatgaacggtgtggcgagcacatttgtcggcgttcgagaagaagcagcagttggtgtgttcatcagaccaggcttggtaaactcgataaatctgtcctcgggcgcgagcggtttgaagccacagattttcctacaaaattttc

SEQ ID NO: 93801 - DNA, 487 bp, Heterodera glycines
  SCN-specific regions: Sequence locations=1-423,445-487
tctttacatacttccaattctcgtctgaatgggctctccgtctttcagcggacatcaacatgttgcccggtaaattccccagcgcacttcagccgaggttttttgatctgtgcgaacaattgaccaagcaaattgtgcccactttggagccattcttgcgggaactaattgcagttgatcagaggtccattgctttgcgagtccatatcgacggcgaagtgatttcttacgaaactgagaaatgggtggcattgccggaacaacactttgggtggacggtgacacttgatgaacaacttatcccttttctatatgggctatgttcctggttaccaagcgtttttttcgttgaattgcacacatttattgtgtccactcggccgcttccggctcttactgttcctgacagtcccggcgattcataacataaaaatcacaattctgtctgatttaaagtgaccgaaaatagagcccggaaattttaaaa

SEQ ID NO: 93802 - DNA, 544 bp, Heterodera glycines
  SCN-specific regions: Sequence locations=1-544
gccaactttagcgaatgatttgcgcgggttgttggcttttgttcacccttatgcccatctgtacgaaacactgaacgtcgaattcctttccgcgcgagtgttcgagcgaattgatgccgagtggctgtcgttcttgtgccgcttggacagtgcccagttgaacatggtgcccgtagagttcgagcagtacccggattgtcccgcatcactcaaacacttttttgcctccgctcggcgcttttcactgctggataaatacagcactccgtttgttgaccaacagcagcataacaacaaatacagtagcccggagcaattgcgaaaagtgaagcggaaaaaggcgcacgaattgggcgcgttcggcgaacttttgcgggccgaatgtgcaccacttggcattgaccgagtggtggacatcggttgcggattgggccatttgggacgagtgttacggcttaacaacgaatcgctacagctacaacagacaagcaatgacaacaacagttcactgcagctggactatgttggcattgaggcaaatccg

SEQ ID NO: 93803 - DNA, 349 bp, Heterodera glycines
  SCN-specific regions: Sequence locations=1-125,147-349
ctcagccgttccctcgtgcgtcttccgagtggcagcgctctccactcctctctcgtttcggcaatctgaaaacgcagccaagaattcgtccgctgctgttccttggtgcgcgttcggttgaactgagcattttttgagaaccgttcggcttatcaccgacgagttggacgacggcacggtcactttgctggcggaacgacccgcgcgccggcactacgcgcatacattgggtcaacgaccaacaaaaccatgcagtggcagtgaacaggatctgacggttgagcatcatctattccgttcgtctacggtggcgcccgtccaaactgttgctgtctgttgttgaccgatt

SEQ ID NO: 93804 - DNA, 698 bp, Heterodera glycines
  SCN-specific regions: Sequence locations=1-646,688-698
agaccccctttaatctgttcgctcctcgcataaactcttcatcatctcctgggtaagcccaaactccctcctcaaacagggcatatgaggaaaacaattacgaggaaatcgcccgacgagttctcttctgagactgcaagttttgcctgcgtgactgaattccgatacacttccatagaatgcggccccggaaactttttggtgctcaatccattatgatcaacaaatactccctccgttttccaaaaatatgagcagcgatgtgattgaagaattgttatacttcgtttcatggtgctagaggaccagaggcggccaacgtgactggtccggacggagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcagaaaacaatggaaaagaggctaagaaggaagaggttgcaaaggacgccaacggaggacgtggcggtgggcagcgtcgaggccggggcgttcgtttccgcgggcgccgcaacaatcgtcgaaacgtcgcgggctcaacatctggtggcacagaaaatgaaggcgaacagaaaaaagaacaaacgcagccggaggaa

SEQ ID NO: 93805 - DNA, 321 bp, Heterodera glycines
  misc_feature (249)..(249): n is a, c, g, or t
  SCN-specific regions: Sequence locations=1-70,221-286,314-321
ctgaggaactgaaccattttgaacaattagtccagtccttttaaatgaaccgcccattatgggtctctgactctctctctctctctcctccccctacccttcagtctctctttccgttctctctctctctcctcctcctacccttcagtctcctttccattctctctctctctctcctccccctacccttcagtctctctttccgttctctctctctctcctcctcctacccttcagtctcctttccgntctctctctctctctctttcctgccaacgacatcgtcgtctttctgcctctgtttccccttctctttccttt

SEQ ID NO: 93806 - DNA, 758 bp, Heterodera glycines
  misc_feature (678)..(678): n is a, c, g, or t
  SCN-specific regions: Sequence locations=1-313,336-409,432-758
atggcttggattgctcttttccttaatatgagcatctttttggccacaatatacagcactttcgcttgaccttgggcatcgatctcccttttgggagcatgcacacggacattgttgccgtccgttgcccgagagaaggccgtgtataattgaccatgggtaaatacttccctttccaggtcaatgccgacagtgcggattgtttgaccttgacctttttgaatggtcatagcgaatgcaggcttaattgggaattgcaaacgcgcgtattttagcccaccaggcgttttgtcctcgaagatattgtgagatctttcaaggaaaaacctcacttgaccaccaatagcattgctattgattgattacacgaccgacaaggcgatcatcgccaagttcttcgaggacaatgcgtgtgccattgatcagcacttccctatcacttttgttgataaggaggacaagaacgcttccgacctttagttgcagacagtggggaggcatcccagagtctgtgcgtctgtttaatgctgccacttcggactcgatctcatcgatgtccaatgggcgatcgtcaagaggtttgtccgtggacaaatattcccgcacttgacctggcacattcgccatcatcatttcgttgatctcgtcgcacgtatggatgttcgcggcgagtatcanacggctgagcagctcctttcattgccaaggagttgttgaaagtttggataaacaaagtttatcagctcttccctgctttt

SEQ ID NO: 93807 - DNA, 659 bp, Heterodera glycines
  SCN-specific regions: Sequence locations=1-25,49-283,307-502,567-637
gccagcttttcgcaggaaagatgccgttcaagcgctacgttgagattgctcgcgtggccctcatcaactatggccccgagttcggcaagctcgtggtcatcaccgatgtgatcgaccagaaccgggctctggttgacttccccgagcaggagcgccgcgtggtgaacttcaagcgcctggcgattactgacttcaaggtggacatcaagcgccacgccgtcaagaaggacctgaagaaggccctggctgacgccgatgtggtcgccaagttcgctgcctcttcgtggggccagaagctggccaagcaggccgccaaggccgccaccaccgacttcgaccgctacaaggcgaccgtcgcgaaggcgaagaaggcccgcgccgtgcgcaaggtcctgaacggcctgaagaagaccgccgcccccaagaagaagtaaaccgcttcttgtagcatcacgcacctcttcccgggcatcaggctgggttgaattgtgagcgccaggcggcggggcgaagtggcgcggagcggccgagctggagcacggagcggctgcgagcggcgcggagcgcgccaggctggtgtaggcggcggcgggccgtcaggcggcgcgggagtctggagtcagggggcgcagcggccggagggcagcggcgcggcggct

SEQ ID NO: 93808 - DNA, 636 bp, Heterodera glycines
  misc_feature (8)..(8): n is a, c, g, or t
  SCN-specific regions: Sequence locations=1-260,282-299,321-549,573 -578,602-636
gatatgtnacaatttataatccattacctaaaaagttagaaaaagggttttagcatttttcgacgatggcagtcaaaaaacttatattgaagaagaattagcaagaagccttaaattaacagtgattggaagacaaaaattagaactttctggtttaggtggagtaaatttgggaaaattcgaaagcccagtagttgaatttggcttaaaagcgagagattttaatatgttaatgattggaagagcaattaaaaaagtcttaaaagaaattcccgttttggattatcaggaaataaataatcatgaattaaagaaaaataaaatttcagttccatatttactcgatgaaccaaaaattaccatcgggagcgatttttacaattattttgacattagacctattaaacatttaaattctggtttttggatcagcaattctaaaatcggtaaaattttgagtggtgatggaaaagtgacctgggccaatttttatgacaaaaaggtgaatacaaaggacgaatataacgtatcagccataaactcaagtgcaatacaatgtgaaactgaaataactgatcaaatggaattggacaaaaacaaggaattgattaaattggttagacaacacgacagttt

SEQ ID NO: 93809 - DNA, 823 bp, Heterodera glycines
  SCN-specific regions: Sequence locations=1-77,99-109,146-530,576 -663,737-753,779-823
cgcttccctaaatcatccatccattcattcgcaattaaatgccaatgacctttttggctaatttttattaattggccttttctttttactttatccatccatcattatctaaattatcttttttgtattattatttttattttttgatgcacaaaaattgtgtcaattccgttcatttgccaacacttttcccaaatgattggtcggaaaatgaataaaataatttgtacggaatattttatgttaatgcgaaaattgtccgatttgtccattactttccaccggaaatggcattccatcgcttcattttggcgatgattgcgatgattaggcttcccatttttgcttttcccccgcttttgcatcgcttttttgctcaatttgccaacgcttttcccagcgatcggacaaaaattgtgtgcttagggagtgttaatttgtgatgatttgtccactttttctgatgcttttcccattttccgcccctttttttgtgtgtccataaaatggcaatgaaagcgtagcaaaaatcattcatttttcattcactaattattcattcatcccatcattcagctcccttccattcttacttcatccgatcccttctcactttgtatttcatccaacacaaaaaaaggtaagtaaattaaataattagcgtttaaattaataaaaataaatagtaaataggtgattttaaaaatatttttaataataaatttttaaaaatattcgtccgctctcattccaatacaattttaaattcaaaaacaaattcagagctccaaaaatggtcctcatccgctccatgcatcttctt

SEQ ID NO: 93810 - DNA, 775 bp, Heterodera glycines
  SCN-specific regions: Sequence locations=1-730,768-775
cccctcatatttgctgtgccatcgaagtgctccattccgatcgtccgcccattgcccataggcatttttcggctcaatgccttccctttgaaatgcgaagatcatttgcagggacttaaagccggccaatttgatgttcagcgacccccaaacattgcaactgatcgattttggctcggccactgagtgtccgctgcgcattttggacgcacgcgacagccgacgcattttggacgaggcggccgaactttgcacaatgccttatagagcacctgagttattcacgtgtgaaattggagcgatgattggggaaagcgtggacatttgggtgggtgccattggttttggtaaaaccaattaattagggacggaaatgccattaacgactgactactattaatcggtctattactctccccccccccaatttgccattttgcttcagtctctcggctgtgtgttgttcgccctgtgttactttcgctcgccttttgacggcgttcatgaaaggggcgacagcgtcgctttggcggtacaatcggcgaagataaacttcgacacggcggtgccgtaagttctaatctcattaagcgagcagtaataaagcctatttttgagagttgatcggcacattgccgaactgatccaatcgatggttttaatacggccctcggaaaggccgcacatatctcagattaaaaaacgggtcgaccaaatgcaaactttggatgaagtgaaggacaacgaatgaatgagtgaatgaatgcttcgctga

SEQ ID NO: 93811 - DNA, 818 bp, Heterodera glycines
  SCN-specific regions: Sequence locations=1-818
cttttctcttgaagaagagttcatgaggccaatgattttggtcctttgcgtagccaattaggcccaccccaccacgaagaatgggttgagagctcttctggtgtagctcctcttgttgccagatcagccggattttcagctgttcgaacaaagtgaaacgaacactttgttatggtgcgaatttctttgattcgccgttcaatgaattttggttgggcttcttttgaagccacccaatttaaagcaatttgagaatcactccacaaataggagtgttcaattgctcggcgcaattgagtttgtatgaattttaagcctcgaattccaataagaatggccatcagctccattcttggaatagtgagtgctttcgaagcactctttggcttaaggcgattttttgagaaaatcaaccaattttgaattttatttgaactctccactcggagataaattgcggttgcaaatgtgtggatcgaagcatccacaaatgcgtgcaattgaagggagcattctccctgtatcattgtccttcgtgggactcggattcgcttgtctttccaagattcttggaaagcattccagcgagtcgagtcctcttctgagagggcatcatcccagcctttcttttcctcccataaactttggaagaaaagttttaaaggctggatgcatgggcccatcaatcccaaaggatcgaataaagaggccaaaaaactcaggacgagacgtcgattcactatctttaatgaatcgacagatgggaattcaaagacaatgtcgtctttgtcaatgtcccaaataagtcccagcacttt

SEQ ID NO: 93812 - DNA, 668 bp, Heterodera glycines
  SCN-specific regions: Sequence locations=1-422,455-668
ctagactatatagaaagattaaatagcaaaaaaatattcaaagctcttcttagagtgctgatcaaaattcgaacaagtttagggctcctatgtgatccgaattccctctatagacccaccctcagcttcacacattgaaaaaaataattttattaaacattcaataaaattcattacgggacatggacaattgaatcatcaaaattttcaaatccttcaattttcctgcatatccctcaatttgagagtgccggcggaattggaaaatgtggtgcccgaacgatttcgtcctcccatgctgtaaatgaatctttttattgagtttaagagttgatggtgccggtgagtcggtgccgaactctaggggtagccgcatagcttgttccgagttgatagccgaaattattgtcccgagtgcagctaaaaatttaaattttttgaaactaaacgcataaatttaaacaaacaatggttgccgatgggtgaaaaattgagtcgattatctcaaaatgcgtcaacaccatccaacatctggcgctgtgtcaagccgatatatgttcgagagaagtaaaggaagaacattggcattccaggagacggccaagataattgagaaaaactcgatttgtgcatcttcagcaatttcctgagtggtgtgtgaatctaaa

SEQ ID NO: 93813 - DNA, 811 bp, Heterodera glycines
  SCN-specific regions: Sequence locations=1-26,49-811
gtttgaccgtaatttctgagactctcaaaatggcttctgttccaactcccttgatgagaaaacgaaacgaaatgaggagttggcaactgcgattctcaagaaaatgccgaagccgaacagactcattgtggaccaatcgcccaaagacgataacagcagcgttctaatggcacagactaaaatggatgacctgggattgtttcgcggcgattcgatccttctcaaaggcaaaaaacgtcgtgagacaactagcattgtcatagccagtgacacttgtcctcccgagaaaatcttgatgaatcgagttgtgcgtcagaatctccgcgtcaaactgggcgatgtcgtcagtgtttcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcc

SEQ ID NO: 93814 - DNA, 302 bp, Heterodera glycines
  SCN-specific regions: Sequence locations=1-302
tcgtcactcattacattcgacctttcgaagtgttggatttgagtgccaattcgcaaattccgcccgcactgtgcggacagtcggacattctgttcgggaacatccgcgagctgttggatttccaccgttctctgctcctacccgccctgcagcgctcctcaaactcgtccatgggatttcttttgtgctcaatgcccagcggatcgtttgctttcgcttaccgcgcctatggcgcaacaaccgatcaggggagcgttgaggaagaaaactcgattgacactccaatttttccggagtgccac

SEQ ID NO: 93815 - DNA, 463 bp, Heterodera glycines
  SCN-specific regions: Sequence locations=1-112,134-463
ggtctatcgcttgagtgtggaaacacacgccggtggccatcaaacgaattcttgggaagtgcggaagtgacgaaaggcagcaaagggagcgaattcgtcagagtttacaagaattgaagactttggcaaagtttcgacatgacaacgttctctcactgtacggttattcgctggacgggcccgagccttgccttgtgtaccaattcatgtccaatggtacgcttgaggaccgtttgctatgccgggtaacttacaacggaaaccatttaatgggacggagccactcggttgggccaaaaagctgtccatttgcgggggcgtttgtcgcggcctgcactttctgcacaccatcaaccaaatgccaatcattcacggcgacgttaaatccgctaacattctgctggacaagcattttgagccaaaacttggcgattttgggctcagcagatacggacaggttgaa

SEQ ID NO: 93816 - DNA, 815 bp, Heterodera glycines
  SCN-specific regions: Sequence locations=1-497,520-629,651-815
cctttctctaaaggtaaatgaccatgtcggaggtgccgaaagcagaactttattgagcagagtttggccaacgtcgtcgacaaagttcgggtcaacctgaaaccacgagtctttgagaattacggtttttagcaaccgttccattttcgacggcatcaattaacgcgtccgtgtcacgcaatcgaattgcgtcaattaaattgcgatgcgttttgtcaaaagcgggaggagcaacttaaaagaatttggataaaaaaaaagaaagagagagagagaggagtttgtgtacccgaatcgtttaataaaactcggtttttggaaattgcagaccgtccttcacagagtaagacaattagaaggtcaatgaaacgcaacgaatcctaaaacaaagtaccaaaataaaaaacaagaagtgttgacaaacttacgttgatacaacgttcatcctttccattgagaaccattttcaaagcaggaaccaatttggacgagctaaaagagaattaaaaatgcaagaaaaataaattggaaactcacgaaagaatttcttcagtgagggcgaaagaacttttgcacagattgacaaagagtgagaaaaccatagagatgaaagcggaacttctcttccgaattctgcagttttccccattcgaagataattcagtgggagcattttcgtgcgctgtcgaagatgaaccaataaggtcgaagagatgcgccaccaatctgctgggagaggccaacgccattgggtccatttgacgtcgcacgaaacgatcggtcattgcggcaaaacatcgcagtgcacactctgc

SEQ ID NO: 93817 - DNA, 748 bp, Heterodera glycines
  SCN-specific regions: Sequence locations=1-31,53-337,359-369,391 -701,723-748
attttcatgaatcgcccgtcgaaaaaagaaacgaattttccggcgcccttatgtcttctacaattagtgaaaatcagcagcaatcgtggggttcttttgtaaaaacatcttttggaacacgacggcattgttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaggttcaaaggaccaaaagcgaaactgtctgaatggatcgatgacaaatgggtggcatttcctttgccggaccgtccgctgcccaacaaaattcgttttaggaaccttcggattgagaaccccgaccattctgtgctcgcatttctccgtgccaatcagcaaatttttgaaaaagccaccaatttatgtttgtctgtttcttcatgcttccatgattgccttttttcattcgtcgacaataatgtccagccgatttgggatgtttttgcctgtgaaatttggccgatttttgcgccaaacattcgccgctttaactttcgcgatggtgatcatttggacaatttgcgtcgccgcatttcgcccacaattctcaccgatctcaacaaccttagtgccatcacttccggtcgtctgttccccgatggcatcgctgatgatgggccaaatgcaactgctgg

SEQ ID NO: 93818 - DNA, 482 bp, Heterodera glycines
  SCN-specific regions: Sequence locations=1-270,293-421,444-482
aattttcaatgataaaatgctattctaaaaaaggtcaaacttcacagctctttggtctaaaaaaaacccaaacaaattaaatatattcaaacgaaagaataagcaacaaatcaatagatcagccaatcggagggaagggccgcccctcccgttcactcccggggcccctctttataagcccgggaattccttcccaggcagttcagtcgcgacgatcagctatatcatattcaattccccatccatcgatctcgtcccccttctccagcccagggagagctcaacgcgcgggctacggcccgggatggacaagaggggatccgtgggaccggcacaactctaactggtagcaccgatggttctgaccaaatcctgggcccaaggatttggttcggagtggaattgaatgggtgctgatcaccccggggagggctttggccctgagctcaacattccggccgatgccggccaacaaaaaaaaa

SEQ ID NO: 93819 - DNA, 640 bp, Heterodera glycines
  misc_feature (633)..(633): n is a, c, g, or t
  SCN-specific regions: Sequence locations=1-105,127-640
cacctgtcactgccattttgcgcacggtggccaacacttttctcagtactcgctgaagttgcccacctggttggagagtcgttacaagcgcgttcactttgcggatttgttgcgtctgttgatcgattatgacgacctcagtgacgcatttcgccttctccattcacacattgactcggcacggcagcgactccgggaatttgtggcgcgatggattcgcaccaaccctaaggcaacattcatccccgacgaggaattggccccccttttgccgtacacacacatcaacgaactgttgcggttggcggagaagcgcactgacagacagcaattgcccatcaaagagacggtggacaagttgaggcagttcgccgacttccaaaaatcggtcacaaagaatccgatgccatttttggccaaatgatttgctctcgcacagggcacggcaacaaaaacacattttcttgcacctttttaaatattttgttgtttgtcctacactttgtgctgtcctcctttttgatctgctgatgacacacaaatgacttgttgaaattgaaatgcgattgactgccttttttaattgtaatttttgttaacaattttttattcgcataaattagtgcaatttanaaaaaaa

SEQ ID NO: 93820 - DNA, 718 bp, Heterodera glycines
  SCN-specific regions: Sequence locations=1-614,636-718
taatctctctacacacttcaactaaagaaccggaatccgcaaccccttcctcggggtgaccctcactttatacaatcccttatacttcaaatcctccggtctcatccaattaacattaatttcatcagtcttcggtataataatttcaggtaatccaatcgggtaagctgtaccgtaattcaccgacggatacagactcacaatgtcataaacactaatctttttcttctcatccgatttcgcatacaatttcatcggtccggtcctccctcccgcataagccatccgcggatcaataggccccttctcgttccctctgtcgtcgaagaagtcccgcatctcttcatcctttttcaactccttctcaatttgacagccctaaaaattcacaataaaaatgtaaatgtcaaataaacttacccaaacttcttcgacgtccaaagtcttccgcagctccgccaatctctcctgcgtctcatcattcaattcctgggccgtccttcctccaatcagttccgccgccgggtcataacagttcatacatccatgtatatagcatcccataacttcaatgcatttgtcgcgccctcccacattcgcaataaaaatccatccaatttatatttcccaactttgacctcccgtccgttccccgcgtgccgtatctcaattccatcccgcttgctccgccactccaaatactttattgccatcacgc

SEQ ID NO: 93821 - DNA, 817 bp, Heterodera glycines
  SCN-specific regions: Sequence locations=1-115,148-340,362-709,731-817
ggcctatatgttcagcctttgctgttggctccgcttctcacttctcccgccgcttgtttttggcccggcattggccagcggtggtggcccaaactcttcgcagagacatccatcgcatcatcaacagcagcagcagcagctgctgcacagtgaaccgcttcaactccttcactcatcagctgaagcacatccaacggtggtgaacatgagcagcactaacggacgacgggcggcagacgccgccacacttggcaaaagtgggccggaagggccgccccctggcaaatggttgggctgcgaagacgcgccggacgaatggcgaagacgaacctgcattaaattgcgacagattgaccgcaaggcacggcaagcgttgacccgtcgcgtcaagcagatggtctcgccaccgtcgatgcccggctcgccggcgtggttgaagccactcccggtcccagtgaaccatcggggccaaatcgcgtcgcatccctttgagtgcatgacccttcgctgcctttgccccttcttcaaaggcaaaatgcgtcgcgatggcctttgttatttgcccagcggaaagccgctttcgatggcctaccgtaaggagtaccgtatgctcagtgatgaggaacggcgccgtttccatgtcgcaatgaatgagctgaaacgccaaggcatttatcgctttttcggcactcagcaccgccgggtggccaccggtggggcccactcgggacccgcttttttgccgtggcaccgcgaatttgtgaagcgcttagagattgccctgcgtttgctcgacccgtcgctggcggtgccctat

SEQ ID NO: 93822 - DNA, 255 bp, Heterodera glycines
  SCN-specific regions: Sequence locations=1-125,162-183,205-235
gtttgactccgtttcatttccattcacgggatttgccttgccattttgaatcgaaacgggcttaaatttaaacagcaaataggtaataattaacgatagcatgtccgtacattagcggacgctttggccggctgtgccttctgggccggttttttggccggcacttcgtcgtcgtctcccgaactgctcgactcggacaccgtcggaggtatggccttggtcacaggaatggtctaaaaaaaaaaaaaaaaaaaa

SEQ ID NO: 93823 - DNA, 488 bp, Heterodera glycines
  SCN-specific regions: Sequence locations=1-488
ctcactcttctacaaccgcggactgtcccttctccgtccgcgagtctctccccaactgatcaaaaggggtggggcacgctgaagaattcgtcggatccgtcgacaataaatgtgccgataaagacgagtgtttgcacggaaacggtgaaaacggcgaatgtttgtggcagagaaatcggcacagtcggccatcggcaccaactgcagcagagccaatcgaagtggcgacaagcggcggagctgaatgtcggcgacagttcgaacttggccagtccgccattaacgtccgtcgagttgggaacagcacagcgacgagttggcactgcattgcgtccactcgaagtcagtcggccgtgccgttcggtcgcttcgaacacttcgccgccctccccgtgccgaactccgccagtcgcgcgccctttggcccagcggagcattgccgcgttttacccgttcaaaagacgcgccttgattgattaccaatcgcc

SEQ ID NO: 93824 - DNA, 642 bp, Heterodera glycines
  SCN-specific regions: Sequence locations=1-33,55-497,519-642
gagttaatttgtacaccttcttttacaatttttggtttttcctcaaaagttaaaagaaccttttcattgtctgcaataaatatagtgccaagcatttgtcctttgaatggacctagcggcaaatactcacattttttcgaaattgaggaattccaaaggagtaatgttttgtcttctaagaaacattggcctttctcaaatgagcagtgatcggagtctccaattgaggtttgaattgatgggctcccgaacttattaattattctcgttttaaataggtagcaattttcactgcttgccttcatccaactgaatgatccgaagagccaaacccgaggagacatatcgattttattgtcagtgtgaaatagttcaccttcctgtttaagtgtgccaaaactgcacttttggtggttaatcatctgttggcattcttctctgtccatgcttaacaattcggagtctagtttctcaattatgggaatatttgtgagggaagtgtgtttttgaatatttttacgaacttttcggcacgcccaagcttctacctcatactgaaaggcatttggtttataaagccaaatggtttgttttcgtgagccctgcgcttgattgaaaagaggagtgggacattgagtaggt

SEQ ID NO: 93825 - DNA, 332 bp, Heterodera glycines
  SCN-specific regions: Sequence locations=1-332
gtctgacgtcgcgaagcggccgaaaaggcccaaataaatttaaaaacgggcgcaaagcgcccgtctgagctcaacaaatttaaaaaacgggggcgaagcgcccgtccgatctcaacaagtttaaaaaacgggcgcgaatcgcccgtctgagctcaacaaatttaaaaaacgggcgcgaagcgcccgttagagcaaaacaagatttgaaaaacgggcgcgaatcgcccgtctgagctcaacaaatttaaaaaacgggcgcgaagcgcccgttagagcaaaacaagatttgaaaaacgggcgcgaagcgcccgtactatgccgcgaagcgtgcg

SEQ ID NO: 93826 - DNA, 773 bp, Heterodera glycines
  SCN-specific regions: Sequence locations=1-773
caaaagcaaagcgacagtcaccgttcgaccggaatgtggtcgagtggaaaattgaggagttaggccaatacgaaagcgaattcgaacggttggacagcgacagagacggatttgtagaggggggcgatgttcgggacgtatttctccggtccggcctccatcagaatgttcttgcccgaatttgggctcatattgacgtgtcaaagacgggcaaattggacttggagcagtacgcaaaatgtgtcgagctcatccgcgagtgccaagccgagcaaaacaatgcgacaatctctgccgagttccaatcggaggaggccatcgtcggcgctggcactccctcgtcgccatcgctgccggggcacccgtcaaatttgacacgtcgcgactcgcaaatttcgaatgccaccaacaattcgtcgacgggtggggcaaagggggcgctgtccgaggcgactcagcgagtgatggaactgaacaccgaaatcgaacagatccagcagagacggagacaggctgaacaggaccttttccaggcggaggcggacatgaaggtgaagaactcggagatacggaacctggagatcgaactgctgacactgaacgcgacggtgaagcagttgaagaaccagcgggtggaagcaaacaaacggctgaacgatttggacaccaaaattgtgagattggaggggacggcagtggagaacaaaaaacggatggaggaggaccaggagaggctgaccaagacccaaatggacatccaaaaagccaaggac

SEQ ID NO: 93827 - DNA, 561 bp, Heterodera glycines
  SCN-specific regions: Sequence locations=1-561
taagacctttcggcgctttctttccaccacacaccgaaaacgcggagccgttcagcattagtctgctgctaccaaaatcggactgtaacgctttaactatttggtttgtctgactttgtaaagaatcaacgagatagaatgggtaacctaggtattcgattccggctgcagattttacccgcttcaagaacctggcagcatcagtatttgtgcaggagtttaatatctgcgagaaaaagccataatgatcagcccggaaattttacgtcaaaataatattgttgcactcgaacggtaagattttatggtaatctaatccaaaaaaatctgttttaggttcaaagacaaggagaaggcataataactttgccgggagcggcaccttttggattttcaaccgtaaattgttaggttgtttgggatcttttacgtatttttagggtgttaacaccgccatcgcgtggaacgtagggccgctaagctgggcgccctacgggttagactccaagccaggatgctccgatttcttttaccctgtcatcgacaccctggagcttatta

SEQ ID NO: 93828 - DNA, 228 bp, Heterodera glycines
  SCN-specific regions: Sequence locations=1-228
gtttgcgcttaacaggataattttgagagtatttctatttgctttcgccctcgccccctaaatgattttagtgagtttcgagtcataatattttacaactaaaaatggacgtggataggctctcccggggaaaaaataaataaaaaggaaataaacagtctgtttacagttacctcctcgtcaacgacgtcctcacttcttacattgtctaaaaaattgacccctttt

SEQ ID NO: 93829 - DNA, 748 bp, Heterodera glycines
  SCN-specific regions: Sequence locations=1-619,673-748
gccggccatcagaaagtcggccatttgcgagagcgaccagctgagcactggcgcttctgagtcccgtttagaagtagcaaaaaatttcttacgtcgcttttacaaccattcgacgctgagactaacggggcggagacggcggcgcggaaatggcacaaaaaggggcgatgccgacaaagggacagcggagccgccgctgatgtacagctcggcattgggtcctttcttcgagatgagaaatccacagcccgcggaaatgccgtttctcccctacaacattcactacactatcgaatccactgacgaagcgtccggcgcttcggacgacgacgcggacggtaccgcggccgcggtgcgccgtccgttgcgtgccgtgtcgccacagtccgtgtggagttgctcgcccacgtgctcatccgcaacgataacaagcccaaacagagcggaaatgaccaccaccaccagcacacgcagccaaaacagcagcagttgtatggccatcacagcaaatgtaacagcaaaaagagagatgattagcaacagaaaatgaaatctttgcattttgcagaatttcaaacaaagacaaaacgcagcgaatgccaacggcggggagatgtaccagcaccaacagcaacaccaccaacaacatcggcaccagcggcagcagcagcaatttgcattcaccagcagcagaacatcggcgggtgctcagctcttttccccggtgctccctttttttccatcggtg

SEQ ID NO: 93830 - DNA, 773 bp, Heterodera glycines
  SCN-specific regions: Sequence locations=1-475,497-523,546-550,581-773
gttttctgtagaaattcgacaatcgaaaccagcagagccaatatagacctaacaagccgccaaatgaccggagatggaataatcgtccggtttgcaattattgtaagaaagttggacatgttgctaatgcttgccgtaccagacttgcagactttcaaaacaatcagcggcctcaatcttttaatcaacgtgccaaatcggacagatggtcgacaactccttttgcctctggtgccaatgccgtccatcaggatcaaacattgtcgctgcttcatgaaattgcaagaacaatgaacaaattgaccgtcaacactgatcagcctggacgcagagatgatgtcaacaccattgtcacttcgacagagcagtgccatgtcaagaaagtacacatcaaggataaatcagacatcagtaagtcagagcctttacaagtctcgtcatgggaaaaagcgactttgggtcccaaaattcaccctttcattttcattgtggctatattttgtacttgtggccctgtcttttcaaatacagcaatgattccacaaggaccaatgctatgccaaactgaaacccaacccactctttggaaattaccagaaattcctgaatgccctattccaaaagtgacagtgggacacgtcccaatttctcaaatcagggaattgtatattcctaatgctattgagcacaatactaaagcatgggcgtgtaggaaaatcatcaaaagagcaagaaagttcacttcactttctggagtgccaatcacggaggct

SEQ ID NO: 93831 - DNA, 253 bp, Heterodera glycines
  SCN-specific regions: Sequence locations=1-253
tcggttgctgcagtgtcgttggggcaacattctcatggagggccatgagaccgttttccagcaaatggaccagccattgcagtgctacttcatcaacagtagtcacaatacttatttgaccggtctccaagtgcacggcaatgccaccgtcgagggttacatgtcggcacttctccggggctcactgctggtggaattggatgggtttgacggggaacatggtgagccacaaataacgcacaaacgcacattc

SEQ ID NO: 93832 - DNA, 801 bp, Heterodera glycines
  misc_feature (64)..(64): n is a, c, g, or t
  SCN-specific regions: Sequence locations=1-291,313-470,494-801
agatgccgtagacgtccacgaaatggcacactttgaccgagagcgcatctttagagcgcgtcgnccatgccaaaggcggaggagcgcatggctattttgaagtgaccaacaaggacatcgccaactacagcaaggctgccatgtttagcgaagtcggaaagcggactccacttttcattcgcttttcgagtgttggtggagaggccggaagcgcggacactgctcgggacccgcgcggtttcgccatcaaattctacaccgaagagggcaattgggatttggttggcaacaacacacccattttcttcattcgcgatccgtttctctttccgaatttcatccatacgcaaatacggaacccagtgacgcatcttaaggacccggagatgatgtgggatttttggacacttcgacccgaagcactgcaccaagtgatgtttctgttctccgaccgtgggactccggacggattccgccacatgaacggctacggtagtcatacgttcaaactcgtcgacaatgccggcagcgccgtttattgcaaatttcacataaaaactcgccaaggcattaagaatttaactgctgagaaggcccttcaattggcagccgaagaccccgattacgcaattcgcgacctttacaatgccatcgccagcggagactttccccaatgggacttcttcatccaagttatgacctttgaagaagcgtcgcgttttcgttggaatccgttcgatttgaccaaagtttggcctcaccgtgacttcccattgcttcccgttggtcgaattgtgctca

SEQ ID NO: 93833 - DNA, 270 bp, Heterodera glycines
  SCN-specific regions: Sequence locations=1-270
gtgttcaagtgttgaagatggacgagaaggtaaattcaatggaaaaaagcgaatggtcgaacgaatggaaggcactcacacaaatagagcccgaacagtacaatcgatacttatactttttacgcactttttcgaaaaccagaattcgctttacagcttttcccacggccctagtctctgggtcttgaatgaattttggaaaatgatgcaaaagacctagagttctgttaaaaaacaagaattttgtctggaattctgtccgggtcccag

SEQ ID NO: 93834 - DNA, 597 bp, Heterodera glycines
  SCN-specific regions: Sequence locations=1-372,396-597
ggtgcccttacaagtgtcccttaattaattccctaattaattaattaatctgttagggtccgtcggcacaaaatgcgccttctcccgggcccctcgtcgtccagcgaagaggtcgacgactcgtcaaccgaaggccccccgtgccattgtccctcctcccttcattcccctcgggtcccttcccgtcgtcctttgtctcgtgccgtcctttggtgccgtccccgtcggcgttgtttttgtctcgccatttgtcttaccgtcgttgccctcgtggccaatttcactctcttcttcataatactcgacattttgttggcattgttaagacgaaaatgtgccgacaatggatatggacaacaaaaaacgatgggacaaagttcacaaattggtcaaaacattgttaagcaaacattggccaatgccaacaacggcacagagaatgccaatgacagccgtacaaacaacacaagcgaattggcttcagtaaacaggcaatttgccattccttccactccgtcgtcctatctctctccaatcggtgccattccctctgcttcgtctccaatcggtgccattccttccgcttcatctccaatc

SEQ ID NO: 93835 - DNA, 588 bp, Heterodera glycines
  SCN-specific regions: Sequence locations=1-214,236-284,313-316,338 -445,467-529,551-588
taacttaaatcattgaaaataacgttaaaatgcacaaaaaaataatgttacaccgtccggattcgaacctgccccccccccccccctcaaaatgatgcctcagaatccccaatcacacagggattctgatgtcttatcgatgtcaaaagtaaaatctgatcacgtattcgtgatcagcggcccaaataacccctaatgacatgtttttggaagatttttgtcgaaaaaattttttcactcaaaaaccatgtgcacccccctttggtcccgaatctcaaaatcacttttatttttataaaaattcttaaaaaagtgataaaaatgccaaataaaatttatataatagagcaaaaaactgcggatttttgtagtattttatttttccagactatcttttcagaaccgagttatgaatttttttctgaaaattcgaatttttccagaaattctgcaattttgatgaagaggtacaaatgtgatttaaagaggtacaacagtgataaaagaagtataaaagtgattagaagaggtaaaaaagtgattagaagaggtacaatggtgattagaagaggtacaaaagtgattaga

SEQ ID NO: 93836 - DNA, 732 bp, Heterodera glycines
  SCN-specific regions: Sequence locations=1-519,566-706,728-732
gaacccctagacggcagcgaatgatccgtggggaagtgaccaaaggctattcgacggtgtccgtggcggccaaagaggccgttgcggcggcagcggcaaacgaccggcaacaaacggctcaaacccaagcggcggccccggacggaccgcaagacgcgttcaccttgccgaacccgcaaatttcggccagcacttcggcgatagcgcagcgcaaattgcgcatctatcgaacaataaaaaacagggacggcaccgagtcgaatcggatcgaaacagtgtcacatccccaactgatcgaagcgtatgtacggatccgaacaacacgtgacgacaatttcatcaaagtttacgcccaaatggacgaccagtacaaagaagagaagcgtaaggagcggcgccgtcagcagcaggaagggggccgaaggccgcggaagggcggcgccgcgggcgaaccgaagtcagtggcacaacggcaggacaacatcgcggcagcagcatcgtttgtcaaaagtgtgctggaacaacaacagcaactgcagcagcagcaacagcaaaaacaccaacagccccagtcgcttcccgccgcacaacttccccatcaagttcaagcagtacagcaacaaaaccctcagcagaaagacacgccggcggcactttctgttagggctcaactgccaattaagccaggcccaaagccgaaaaaaccacaaatggaaaagaaacagcgaaagg

SEQ ID NO: 93837 - DNA, 487 bp, Heterodera glycines
  SCN-specific regions: Sequence locations=1-487
caggcaatagaagaatgtgaaatccctccaaatcttgtccccttttcttatttacgcctctcacttcatgcgatacagaggaaggaaaagacttttgttgcaagttttctgaacaatataaaggacgaactaaaaagaaacaaagaattgcaggacaacaagaaattgttggaagaaaggcttaaacaattgaatgacagcgaagtgcggaggaaatatgacaaaatttccaaagaatctgccgaaagcaccgatatcatcaaacatcacttgaaggaattcacagatcacatgaacgcgattgtatcaaatgtaaaagactccaaattgggcaaagatgcgattcatcagctaaaggtggcaacagaaactgccgaaagagttgctcaacaagttggcgaaatgcaggcgtataagcaagtgtcttatatggccaaggaaatcgaccgattggccgatgttcgaatgtataaaaggccagatgaac

SEQ ID NO: 93838 - DNA, 540 bp, Heterodera glycines
  SCN-specific regions: Sequence locations=1-244,266-540
gaatacattgtttgccttaatctgaaagtattttcatataaaaaaagcaattaaaattatatatccgagccctattaataagtagggatgccatttctaagaacaaaaattgctaaataggcacccaaaaaggcagaaaaaaatcgtaattaaattaaacaagtgcttaattcaaaaatttggtaaatcaaacataattaattagaatttttatcagaatttcgattttaatttagtattttataaacaaggaaataaaacccttcaaacattggtaggaaataagaactaaaaaagagttgctcggtttctataatttttttgacaagaaaatcaaataaaaatggcaaaaagtctaactgtttttttttgtaagaaaattcaattcgaagaaaagaccctgaaattcgatgtttaagcatcatattttggatttgtccaattatgtatttaacgtttactttgccttacatatgcaaatgaatcgcattcgcccgcaccagttaatctgctgaatgatctcaacattttctcatcagt

SEQ ID NO: 93839 - DNA, 749 bp, Heterodera glycines
  SCN-specific regions: Sequence locations=1-200,222-558,580-697,723-728
gcggccatttattctgagcaaaaaggcgtcattgaaagcggcatcggccgctgttgcctctcccgccgcggaggcggtcgtgccgacggctccgctgcaccgcccgccaaacaaacggaacaacggatggatcggagccgacgacgacgatggggacagtggtgccgagccaaaaaagaagaaacagttgcacaatggcacggcggaggcgggcggcggcgtcaataaacacggtgccgagatggcaacagctgcggcacaaaacccttcctccgcgtcgccggctggcaccagtggtggcggaggaggcggatcctcactgaccgcagtcgcttaagggttgtgttcgttcgttcggctcggccacgcccgcggcaatgttttttgacaaatgaattagtgaatggaatggtgccgaaatgacctcacactgttagctgttcctcctttgtctgtgctgttgttgaattttggcttaatgattggcgctcacatggaaaaatgacactaaaatttgacccaccgacagacactaaatttgaatttaccacttttattcatttttcgcctctttttgttacatttattccccccgcaaatcattcgttgtttttatttttaattttttgttgtttttgctcaaccgtgttgttgttttgctgcttttcttcacacacatataacatatattattttatgacatattttttgtccattttctgggatctttcgtcctccttttcctcctc

SEQ ID NO: 93840 - DNA, 682 bp, Heterodera glycines
  misc_feature (14)..(15): n is a, c, g, or t
  misc_feature (24)..(25): n is a, c, g, or t
  misc_feature (30)..(30): n is a, c, g, or t
  misc_feature (32)..(33): n is a, c, g, or t
  SCN-specific regions: Sequence locations=1-186,208-336,359-445,467 -467,489-604,626-636,658-682
caatgccacggggnntctgctggnncgcgncnntgccgccgcttttcctttgttggccgtcattccctttatgctcggcctttacttccaaatgctcgtcatttctcctcttcgcgtggccattttccaatcgccgcttttcttcccctggaaagaatgggccatgggtgttgtccacttcaaaattgtttgtgcttccgttttgatgggccccgactggtggctgaagacggcttttgaacaggtccaacaacgcacatgtgctgggttgtcactgtttgtttttattatttacgccgatggcatttggaacatccgtttgcgagacctttacacgaacctggtgttcccaattgtgaatacactcacttttctgatcgcgtttccttacgttctcagcaattttctcctcttttttgtcggtaagcgatttaaatttttttcttttcccaaattttaatatcaaaatattttatcactattttattctgtgttttcagatgcttcacgcgaggaacaaatcattgtgatacgatttgcttatccgtttctgctcggctccatttgtttctgtgctttaatcacatggcaatggcaaaagctcaaacttttggcccagaaaattcgtaacgacaaggtgctttgttttgctactctaataatgaatattgggtagggtttt

SEQ ID NO: 93841 - DNA, 669 bp, Heterodera glycines
  SCN-specific regions: Sequence locations=1-276,298-313,335-599,623-669
caacataaatgggcgttgcgtcgctttgttccattgcggcctcttggctactctgatcgttgtgcctcagctgtaccaacagatcaacgaggtcaactcgcgagtgttcgacggtgttcaggctttccgcgtgaacaccgactcggcatggactgagctgatggacgttcaaatcagcgtcacccctccggcccgtccccgtgagaatccgttcaattccatctttctgcgccagaaacgtggcaacggcgggttgccgcctcagtgtgtgtgccagctgcagcagccgcaatgtccgcccggaaccccggggccccctggcccaccaggacccgctggacttcccggcggaccaggacaacccggaggccctggccagcccggacaacagccccctccttgccctcaagcttccgccgggtgcccttcgtgccccgccggtccgcctggacaacctggaggccaaggaccgcccggaccccctggaggcgatggacaaccaggacagccgggacaaggcggaggacagggaccgcctggccctcccggacctcctggcccgggaggaaacccgggacagcccggaggacctggccagcccggacagcctggagccccaggaacgaaaagttcatcagtgcccggcccgcccggacctcccggacagcc

SEQ ID NO: 93842 - DNA, 745 bp, Heterodera glycines
  SCN-specific regions: Sequence locations=1-63,85-164,189-443,465 -546,572-745
gctgcactgttatgcaagtgccgccgttgctgtacgcctaacagttggtcatcaatagacggaaaattgcttaaaaaagaaaccaaacaaactcatcaattgttagctcccgttggcaaaccgaaggctacattggggcaatggatgttgggctaccgtatcagttattaaaattgatgtttttcaaaaaggatactaaaactgggataaccccattcagagacaagtcaaaaaaaataataataggcttggactaccatactaattagaatttttagaatgtgtctgttaaatgcaaaactgttgtgaaaaattgttataactccattcagagaagagatagaaaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaaaataataggcttggactaccatactaattagaaattttagaatgtgtctgttaaatgcaaaactgttgtgaaaaattgttataactccattcagagaagagatagaaaaaaaaataaaaataggttta

SEQ ID NO: 93843 - DNA, 819 bp, Heterodera glycines
  SCN-specific regions: Sequence locations=1-34,57-622,688-819
atttactgtccttacattccatcctattgtttagaaaaatttaaaagctttcattgatccaatcggattaaagcatttggtcaaggaaatggaaaaatttatgctagaaagaaaagccacccaaaagaaaagtgatgatgatagtgcacaaacagactaatgatctaaaaactcttcacttcgtttcctcactctgatcaccattttgacttgtgatcagtcttttttcatctccgatcactttgctttgtcattgcgtgtaccggttttcgacttctgtttcctccattttgatcagttcgttctgtccgcctttgtcagttttggtcactccatctttttcctttttgtccaatgatttctgtacatctttcatcagtttgatcactttcagtttggcctcctcacatgggtccgttgctaccatttgtttttgagttttgtattccattaacaaaacgccaatatatctttcaagtttcagagaatttccttggtcgaattggcgcaataaaatttctttcaatgttacaaagtcttttttcaaagaataatccggttcattagtaacttttttctcgtgatcctttccaacattgcaaattgttgaccaattttcaggttttaaaatttttcaaaatttaataataaatcttagctttaaaaaaaagattttattataattttcaattaccgagccgagttgcaccgaaacctttcacaacactttaatgttgcacttaacccatccaaattttttctcgtatcagtccataacaattgatcaaggtcgcaatccttctcatttaccaaaataat

SEQ ID NO: 93844 - DNA, 741 bp, Heterodera glycines
  SCN-specific regions: Sequence locations=1-1,23-266,288-566,589 -674,696-741
cttaggtctttgcttttatttcggtttatttctgccgtttatcgctcacactaaaagtgtcctaaatgggagaatgttcctccaacaatgacgtgccaaacgcatcaaagaaatggccatgcgcttactgcacatacctcaactgggaggccagtctcaaatgtgtgatttgttgccagccgcgcaaccgtccgatgatcatcgaagaactcggtgccatcgaagagttcggcagcaaattggtcctttccgatcgttttgttaaggaaagtgcgccccggtggtcgtgtccgacatgcacctatttgaactgtcagcggaccaaacggtgcgcaatttgtggaagtacggaaagacctgcgcgttttgaggaagagacatcgcccaccgaaaatcacccgaatcggaaagataaaacaatggccactattctgtcaaaggatttgctcaacaaatggtcgtgcagcgtatgcacttttgacaattggccaaccgccccaaagtgcacaatttgcggccgtttgcgttccggcggcagcgcaaatgaaagcgaagtgcggcaaattcaacaacagaagcagcagaaggcgcaacagctgaacatcggtcgcaccgggcgtcagcgatcgtttgcattgtctgcgaatggtcggaaacagcaacagcacaaggacgacgccgacgatgagcaacaccaccaccacaagcacagtgaccaggacgacgagtgatcggcgcgac

SEQ ID NO: 93845 - DNA, 720 bp, Heterodera glycines
  SCN-specific regions: Sequence locations=1-26,51-514,558-672,694-720
tctaaccctttcgtagcttcatttacaaaaaaaaaaaaaaataataatttcctctgtcgaaaaacggctttggttttaaaattttaaacttttcctttgggctatcgaatgaacagaagagcatttgattggttgtttcttggccaagttatggagcattgaggaattcaaaaatttagagtttaacattttgaaaaaaagccggatttactagacaaaaaatccaggcccaggaaaaatccatgttccctgaaaaagggcctagaccttggccaggaaaactacaggcctgagtacaggttcaaatcaaactcaaaaaatttccttttgatttaaaattaaaaaaaaacttttcagcaatttgggccgacagcgatttgattggtgacacactttcggccgtgccggtaactaaaatttttttaaacacacaaaaaaatgcaataaattttcaaaggactcgcccagcgatgaagacccatatgccagcacaatttatcgcccagtttccatggtgtgatttatttattttttgctggctttcaaatttaaaatttgggtttgtccaactaactacccacgacggcacttttttttgtattggtgccgcgattcgtttaaaaataattttttttctgcatattttaaaattaatgccttggttttttttttcaaaattttggggaaaaaatcggggcgcttaaactgcacacatttggg

SEQ ID NO: 93846 - DNA, 603 bp, Heterodera glycines
  SCN-specific regions: Sequence locations=1-303,463-603
tcaaaaaggtcggacaaattccttttgatattggggagctagcggctcaagtcgacaatgtccaagatgatcatgccctgctccagaatcaagtcgcaaacttgaacaaccaagttgtcaacttgaacaaccaagtcgtcaacttgaacaaccatgttggagcactcttgaatctggctacacaacagcagggtcagattagccagttgcaggaggcgcttcagcagttggtcggaccggcgattggacaagccgcagcgggcagccaacaacaagaggagaagagcggcaaggaaaagcccaaggaaggcgaggacgaagatgaggcggggggcgaaataactgtggccgaggacaaagaggaggcggagggcgagaaaaatgtgcccgaggacgaagaggaggcggagggcgaaaaaactgtggccgagggcgaaggcgaggacgaagaggaggcggggggcgaaaaaactgtggctgagggcgaagatgagggaaccagcgatggagagccgaaaacgaagcacccccgtttgcaattttaagacgatctgtttcttgccatttcaaatgttttttgaacgcaagaaaataattgttgaa

SEQ ID NO: 93847 - DNA, 727 bp, Heterodera glycines
  SCN-specific regions: Sequence locations=1-233,255-727
tgagtgctttttatttcaaataatgaccaccatcgaagaaaatttgttcctcggggctccggctggttactgttcctcatctgaggaagatgaagaggagtttgcggtttcaagaggcgcaatgccatgttcttccgcagtcagagcttgcaattagatcgagacggacggcacaccgcggacggggccgaagggcgttttggcggactttgaacgttcccggcgagaaatgatggccaaagcttcgttggaccaggcaaagtttctcgaggtggcaaatcgtttctcgttgtcgcaaaagcccacaacggaggacggagatgaagacgaattgcagcgaatctgaagtcatcgcgttgaacagctcaaaaacatggccaagggacgcattttggaagtgccgagtcgtctcgactttttgttgcttatcgagaacgattcatgcaacggctcactgctgttcatccacatttacagcgatgggtttgcctaaaaacggtttctaatactcctgaaaatttttgggaccatgtgaaaacaagtgacccttcagattcagtcccaaagaggggtgagggggagacgggatatatctcttaatagacccaatgtttagttgactgttaggaccccaccaaaaattttaatgtgctactgtttttggatctttcatttagccacgaacagttcaatcaactgaacgaagcgttgttggaattggccggac

SEQ ID NO: 93848 - DNA, 814 bp, Heterodera glycines
  SCN-specific regions: Sequence locations=1-74,97-183,212-762,784-814
cttttctcttcgcgttctttcgtctttcgctgtgtgttccgaattaaccaatgcacttcgttcgttcattttcgttttcccattcgccatttttaatctcaaaacattcatttggcgtcaaaagggaggcgaagtgtaaaacgaccgatgattcattcattaatcgaaagatcattgccattctttgtcaaatttccaaaacttttaaagtattatagcgtttattttaattttctgatttcgaaatgccaaattcaattaatcgcctcttccgtcgcttgcgcgaaagccatggtgatggtgggaaaaagcccaaaaaggcatcggtcgtttcgggctgttgttcgcgcagaacgtcctccactatttctcagccgtcaaacagaaaagtgggattgactgggataactcttccctttttgatcttccacaatttcctccctcgcagatgtccgtccccgtcaaatgcaaatgccatttcgatggtccgcttttgcccgaggcgctcctttttcgcattttcgacggcgttgacagtcctttcgaacttttttcgctgcgacttaccaacaaaaattgtgctgactttgtccgctcaaaaatcagcgtaatttgccaacattggtccaaatgattggcattattcattcattcctcttcagcgtgtctctgagatggaccttcgccgcgtctcttttgaccaattgtcttcgctgtccgccaattcgtccggcacttccgcccaatcggagaccacagtgattttgcaaggggagcaatggtgagggcactcgttcattaagcgtggtatatt

SEQ ID NO: 93849 - DNA, 594 bp, Heterodera glycines
  SCN-specific regions: Sequence locations=1-167,189-594
aagctctgcgaagggaatgaatgggagaaaggtgttcggttttcggaattcctacatttaagcagaatttctaagcatttccttagtttcatattttctctcccccattgtttttttctttcttttttcccaatttcgcattttgttctgttaaggttcgtttctgcttgttcaacgcttacacacaatggtgcactgcttcaaaaggtgatccccgaggccgatcgacaggaatgggccccgagcaacacttaccgcggcattttccaattttgcttttggcgctttggccgttgggtcgacgtaatcatcgacgaccttttgcccaccaaaaacggacaattgctcttcgcccgttcaaaaacgcccaacgaattttggagcgctcttttggagaaagcttttgccaaattgtacggctgttacgagacgcttgtcggtggccaattagcggacgcactcatcgaactgtcgggaggcgtggcggagacactaaacgtgcgaaagtttttgcacatccataagcaacaaatccaacaacaacagcagccgatgttttccgcgtcgttcaatgcctgcggaattaccgtactt

SEQ ID NO: 93850 - DNA, 747 bp, Heterodera glycines
  misc_feature (524)..(524): n is a, c, g, or t
  SCN-specific regions: Sequence locations=1-317,339-747
ttctttgtcgcttcccaattgccctattgcgatgggttcatcgccaaatgtgatcccgagttaaccgagtcgttgattcgcatcgtcgagaattgttctctcatcggttggttttaaccgtcccaaattggcatttcttcgtctttctcatcagatactcccattcgtccgattaccgtccgcctttgctgccttatccttcgccatgttctcctttctcttggctctgaccaaaactttcattcggccgtcgaattggccgttcggcgaagtcagcacaaattgttgaatgttctcagaggcgcactgcaaacggagaaattctttttggaaatgtttgaagacgaacattggcactttcaagtcgcaaaaatcaatctttgcattttgccaaaattgcatttttagaagggggaattgacaatgaaagaactcctcgaagacccggcacttttcttgcccccaagcaacacacctttatcgtattgcattttcgattattatttgtgagtttatcttcttanattcacaatttcagaggagttcccttgtcgaaacgaatgccaagcggaaatgatgaacacattcgacgggtggaattaaaattttaattaactgattgtgaaatattcattcccatttagactcttcaatttttctttgaccttcgcaaattcggccaagatttgtccggtcagaatgaacagcttttgcccctttcgtcccgtgtccaagaattggtcgagg

SEQ ID NO: 93851 - DNA, 488 bp, Heterodera glycines
  SCN-specific regions: Sequence locations=1-74,97-259,413-488
gtttgcctttataggtggcactttcattggactaaaatgataagtgccctgcagccgatgtcgcccaactccaacaacaaaatcactcccaaaatgcgccgtctctctcctttctgttcagcgggccgtccgccgatggcaccgcaaattgtggtgcctttcaccaaaatcagccaaatggaggagccctttatcagcagcacaatcatccgcagcaccaccaccattcagtaattgtgcatacgcatcaaatgccaacggcggaagggacggagagagacaatggggagaagagagaacggaagagaaagggacggaagagaaagcgaagggagggggcggaagacggataagagggagcggaggaggagcagcggtcgcagggcgaggaggaggcggacgagggggacgaccgcggcacgacggcacgtaccacggcaccgtccccgcgggcgatcggagtgcgccgattcatcagtcccttcgaa

SEQ ID NO: 93852 - DNA, 473 bp, Heterodera glycines
  SCN-specific regions: Sequence locations=1-473
attcatcctttcaaaaatattcattctcccaaaaatattcaatgactaaccttacctcgctctcaaagtgaatattcgccaatgtcaaaacaaagcgacattcaccaacttattgactcacaaatgaaatttgccaaaaacaccattgatgccctaaacaaactccaagattccttcacccttgaccaaaagccaattctctcccacttaatctccaccttgtcgactcaatttgaccttttgaactcatcgattgttcatctccgctctgctgacccaactcaaaaagacgtgcccatttcagcagaggagttagaacgacaaagaagtgtcgtgataataggcctgcctgaacataatgacatttcaccatctaagcggggggagatggaccggtccaaaatcaattgtctattcgattcgctggggatcgaatgcggcaccatatcgtaccgaatgggccgtccttacaa

SEQ ID NO: 93853 - DNA, 780 bp, Heterodera glycines
  SCN-specific regions: Sequence locations=1-43,66-643,670-780
gttaaaatggatgtttacgcgagttatgtgcctcaacagaatgggatgaagcagcaaccgcaacaaaatgcccattatgcgacgagcactccgccatccgtcgattctccgtccgcagccccaaccaccaaatttgtcgctatgcctttgcttcaacaaaccgcccgagtttttgttgggcctgggcagcagaaagaagcacaactgatcggacttgggcttaggaaattgcgcacttatgaaaaggaggacttggaacgggcgaagcgttacgcgatggaccaatccgtgaaatatgtgatgctgaaacagcgcgaggcacaccaacagcaggtgatgtgtgatcggacgatgagcccgaccaaaactgacaatgaatgggcattcgttggcattgtgttttgggaattgagtcggtcgaccgttgtgacctggcattatccctccgaccgttgtccaaatgggaaatgaatgctttgtttcccaaagtcattatttgttgcccctcccttcagaatggactccgcaaatggtaagactgacccgctgcagacgaaccattctttcatttgcttaaccattcatttttcaccttttctcccattaagaaggaaattactaaaagggagtgtgatgggacaattcacacaaacaaacaaacacagaaaatcagcagaaattttgtgctctttgtccgacgattgtgcgttattaatgctgtcccccaatttcagcaacaaaaagtctccctctacacacaggcgctgtccatcatgtcca

SEQ ID NO: 93854 - DNA, 500 bp, Heterodera glycines
  SCN-specific regions: Sequence locations=1-500
caaaaactcgttttgtcccaaaacattggccaaaagtacggctcattttcgccattttggacggacacttcggcatttcttttccgttcgtcagaattgtgccaatggcgtggaattgcccgagggtcggaacgtttctcgcatttgacagagaaacaacgctcggggggacagaatggtacagcgaagaaaacctgggaaattacgattaaaagcttacaattccattgaaacggcacttttaatttatcccatgacttttggctgttctttttgccagaaattggccgagaatttgtcggaaatgagcagcgattgtcagggggtaaaggcgtgacaagttgacgacagcacaaaaacgccgtcaacagcacaccgaccacaataaaaacgacgactgaaaagggattggaattggaagggattgatcagtgatcagcagagagagtgagagaggaacagcgaaatgatcaatcaatcagtaaagggactgagaatga

SEQ ID NO: 93855 - DNA, 789 bp, Heterodera glycines
  SCN-specific regions: Sequence locations=1-308,541-592,766-789
caaagccttgcctaggacttgagttataacgtgatgaacatttgaaactctcacaacttttttctgagatgtcaaattgcttagcattcacttagaaaaagattccccttttcaaaatctttttttagataccaaatttgttcagtttaattgggaatgaagcgagttatggcagatcaaaataaaaaatacaaaaaggcattttccagtgtaaattttgaattaacgcgcaaaaatttacgccaaatgcgctatttggcgttatgagcaattttgtctgacactggcgcgtacccatagtgctgtcgctctatctctcgccttctctctcgctctctccactttatcactgtcactcaatctctctttttctctctcactctctcccctttctctcacactgttcactttatcactcactatctctcgatctcttcattttatcactgtctctctatctttatccattctttctcatagaaatcccccgccctctctccctctgtcttctctctctatctctttacctctcgtgctctcataactttatctctgtcgccatatccaccctctctcatagacttcaccatcttccctatctttactcccacccttttctcacagttcccctctcatcctctctctctctctacgctttatcactgtcgctatatctctctccctttccctttccgtgttgtctctgcccttttttctcctctctctctcccgccctcccccttttgtccactctctcctccgctcgactgatgacgtcagacttccgcc

SEQ ID NO: 93856 - DNA, 705 bp, Heterodera glycines
  SCN-specific regions: Sequence locations=1-97,121-487,510-705
attggccttttctagttatcacattcatcacacatctttctctaaaataccatgcaaataagcagggttcgcagatgcgagactttgaggcctacataagccgaaaatgaaaagcggacattttcgctccgtttcttgcggaccatttttacccaatccatttgccatgccatttaatacactgcgttttttttttgcccgggaaatcaaaaaggcgacggcacaacaccagcaaagcaaatcagtgcaaaagtttcattgtaatcaaacaaaaatcatttctggccatcatagaaatggggacacaatgagtgattatacaaaattggcggctggcataactgaaaatgatgagagattatggaaaattaatgacaaaaaaacgaaggaacaattcaaaaacattttgtgttgtgtgtgggctatgggattttactaattatgattcgatgtaagcacagaagaagaaaaaagaaaatcaaaaatgagaggcaaaaggaggagaaggacattttgtagtggctggctggcaaaagcgattcattggcgataatgagggtaatttgtggcggttttttcgttgataggcaaaaacaattagcgctgtgtttaaacattaaggcaaaaaaagaaaagaaaaaaacgatgccacacaaaatcattttctttttttggacacttttttccgtcttttattgtttttgg

SEQ ID NO: 93857 - DNA, 754 bp, Heterodera glycines
  SCN-specific regions: Sequence locations=1-70,92-754
cgcgagcgttcaaagacttacaaacaggacgaagtgcagattcattgccctacgagtacgaggcttcggtggacaaagagggcaatgtgagcaatcagcgcgcccgcgtccgtctgttctgtttggcctttctcagcggcacttccttcctggagatcggactgaacgaccggcgccgtgagggaaaagaggtggtgcgacgcaaagacattttgccaatgtacacggagcgatggatccgatttgaagcacccgaactccacgagacggtggacaaagtcgtgtgggaggaggaccaggtgctacgcatcaatccgccggacggatgcttcttcgaagtaatgcgtttccgcgtgcgaccgcctcgcaaccgcgaccgcccgctgaatgtgagatgtttgatgcgcatggccggctcgcacattgagctgcgcattgacgcgatggcagtggcgcatcagcaaagggcccggggcaccgccgcgtcgacgcgtgccgtcccttgcgaggatatcgtcgtccgttttccgcttcccgaggcgtggatttatctcttccgcgagcaacgcccgtggggcgtcggttcagtgcattccaagcagcgcaagccgggcaaagtgaagaacttacgcgacaaattgatgggcaccgtccaacataacgagccgagcttgatcgaggttggcatcggtgaggcaaaatatgagcacctttaccgctcgttggtttggcgtattccccggctgcccgaacg

SEQ ID NO: 93858 - DNA, 688 bp, Heterodera glycines
  SCN-specific regions: Sequence locations=1-688
cataatgctaaagcggggcctacggttgcgagcggaacgccggcaccctacgagtgatgggcaccgtcgcacagtttcgtgaccgcgacaattgtccggtggcggaaagcatcgatcgactttttgtcgttgcgcttcggtccgtcggcatggaatcgcttctctccgccgttccgctgaacgtggacgtcgatgcgccagtgctgccgcgcgacttccgccgttcttggctgcctccgattttggcccgacatgcccagggcgactcgttggactttttcgcccgttcgcttttccctttggccgaacgacttcatcagagattgcaccaactgccggaattgccgcagaaactgtacacgacactcgaacaccaaatttgggccattctcccacgcctaatggccaacgcaccgcgcgactttcacgtcgcaatgccaacactggcgccaattatgggtgctgctctgaacgaccgccccgacctccgtctcaccattctccgtgcacttcgcgaggcactcaaattcgaaacgcaaaacgacggcatttgcatgatggagcgatacgcgcgcaactttttgcccattctctttggcatttacaccgcaagtgcggcaaatacggacaaagcggcgcaaaagggcgacgaaaacggagacattggcaaagggcgaagagcggacga

SEQ ID NO: 93859 - DNA, 791 bp, Heterodera glycines
  SCN-specific regions: Sequence locations=1-172,229-285,319-367,389 -434,482-643,665-730,752-791
ttttcccctcttctcctccctccaatttgggcccaaagttcagcccaaactctgccgtttcataggcaatgattccaaacgcccaaatgtccgtttttgaactgagccgcatcgaacgctcattatgcagcatatagccccaattgcatagcttatgatgttcggggctctgtaaaataaaaatatttttttttataaattcattgataaaataattaaattttaattcttacgcatagaaatcagggggataggattaaagaagattttggagaaaagcccaacacaaagaatgaaaaatatttttcgtttgtttcttaaacagatagatatataaagtaaattaaattttgttggcttaattgccaattaaaattataaatattttggcaattggccaattaaaaatataaaatgttttggcttaattggccaaatattagaaattttttagtagtaaaaaataaaattataatttttaggctaaattggccaattagaattataaaagattttagcttaattggccaattagaattataaaatgttttggtttaattgaccaattatctttttctggtgtgggtggcacttgcctcgtaatatttggtggtcaatgggtcattgatgacgaaccatttgcaaaagtttgccatctgctgtcgttgtacatcctcctcttcaacaatgaattgagcagttccgaaatctatggctttcatcactgaatcctctccattttccttttttacataaagcaaattttgtggcttcaagtccaaatgcataat

SEQ ID NO: 93860 - DNA, 487 bp, Heterodera glycines
  SCN-specific regions: Sequence locations=1-487
ggatccttcaggcggagcgctatttggacaaaataacggagacgactttcaaagacgttctgaacgaagaacttataacaaaaaacatgacgacaattgtggagatggacaactcgggactcttttacatgttgctcaatgaccgaattgatgatttgcgctgtctgtacgaattgctcaaaagagttgaaagcgggcctaagacgatgacaaatacaatgagcagatttttgcgtgccaaagggaccgcagttgtcaacgacaacacccaacagcagccgcagggagaaaccgtagagccaatcggcggagtttcaaatccaatcattttcatccagagtttatttgtactcaaagaacaattcgaccgttttctgctcgaagcgttcaataacgacagggaattcaagcagtgcattcagtcggactttgaacactttctcaatatcagtccaaaagcacccgaatacctttctctgtacatcga

SEQ ID NO: 93861 - DNA, 740 bp, Heterodera glycines
  SCN-specific regions: Sequence locations=1-740
cctttccctttcaagaggacgaaggcaccaacaaacggctgatggcttacatgaaagcgcaacacggagacttggcacacaattttctgcttaccagcgattcaattgccgcagctgcaacttcgtccgacaaaggtggcattgttttgatcgctggcacgggctcggcctgccgtctcctcaaggaaaatggcgaagtgtttggagttggcggttgggggcatttaatcggcgacggcggcggcggtttttggatcacaatgcgtgctattaaacgaattttcgatgttgaagatggacttttgtggagctccgataccgataatgaaaaaactttggcttttgtcgactctttcaaaaagactttgttggaacacttcgccgtggactcgaaattgggcttgctggacattctgtacagcccaaagttcaacaaatctcgcattgccgctttttgcaaggaattagctgaagttgccactggtggcgatgcttttgctgtcgaactgtttagcgatgctggcaaggctttagcgcaacatttggtggccatttcacggcattgtgacgacaaaatgttaagggaattgcccgttttgctggtcgggtccgtcttcaagagttggcattttatgagacttggttttgagcgatgtataaaagagtcaaatggcgccgtgacagatttgaatagacggatcaatcgagtgatgcttttccaattggagtgttcagcttcg

SEQ ID NO: 93862 - DNA, 720 bp, Heterodera glycines
  SCN-specific regions: Sequence locations=1-56,83-185,208-209,235 -390,417-546,575-691,718-720
ggttcgatgaaactttttaaaatataagcctaaactttttggcctgcttaaaaaggaattaaaaatttttaaaatatttattcatctcccttttgatagaaaaagcatcagagagccttaattaacctgtaaataaagttttgtgtgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcattgcagtgcttttccttgtctttttgatgctctcgcaaaatctggttcgcttctgaccagtttataaaaaaaaagttaagcctaaaatttttcgcatatttaaaaagcaattaaaaattttta

SEQ ID NO: 93863 - DNA, 485 bp, Heterodera glycines
  SCN-specific regions: Sequence locations=1-229,251-485
gccgagcgtcaaaatcgaaatcgtccacagaaacgccgttgagtcaaacatttggcaaatcagacgataaaacaacggcagaaaattccggaaatcgtgcgaaaagcaacagcgaaagccgcgttaaaacaacggcatctcagcccatttatttgttcggcgttgaagaatgcattttggaagcgcggagagtgctgaaaaatgttggagaaaacgaaaaaaatgctgctggaggtgggcacaaagaactaaagcaccagcgattggaatgtccccgccatggcattgttcgttgggatagaaataatcggcaaactgaggaatacgtagcgtcggcaccatcatcgtcttcattagttgtgcccgatttgtccaaaatggggccggatttgctgtttgttgaccttgaacatgaatgggctgtcccttcggttagcattcaacgggggaaattggtcggacgtggtgcgtttggcttcgttttc

SEQ ID NO: 93864 - DNA, 802 bp, Heterodera glycines
  SCN-specific regions: Sequence locations=1-120,142-187,209-294,345 -551,582-672,726-802
ccatggccttttcctgaactgttgataatccaccgaaatttttgttgtgctaattccctgtgactcggcaatattttaataaatttgccgttaaaattaagaattccccttaataattttttggttcgattttaggttttactctgttctgtcattgatcctcacaacacaaactatcccgttaatgacacaaaacaatattcaaaaccacttgtttatcgtctgtttttgcaagcacgcgaatctgttttgaatggatcaatggaaaatgtgaacaaagagcgagaaaacgtgaaaatatatatttattaattataaatgtttatttgttttttaatttaatacaaaatctatcgtaatttatctcgttacagtacattttttggattgttggcggctccggcattctgtgcgcatttttactgattttgattgtcacaatattttttgcatattgtcgtcaacgtgacaaaaatcgtaaaaaccaggccaacatggaacatttgcgtcggaatcgtgaccaacgctacacagattttcctgcccgaaggtatttaaaaaaattatattaattaatttttctcgaataacaaaactctcttctttctctaactgtctgtgctctcatttttaaccactctctcactactcttttccatcattaattttctcttaattaatgaataattagttaatttaaattttatttattcattttttattaagtcgtgaagaccaatgggagttggaaaggcgaaatttgatcatttatgaggataaacgattgggttctggcgcattc

SEQ ID NO: 93865 - DNA, 778 bp, Heterodera glycines
  SCN-specific regions: Sequence locations=1-185,232-401,423-569,592-778
atttcctttctgtgacaacaaattggccacttggaaagaaagcgaacttcaggtaaaaagaaaagatttggccgactgatgggtcaccaattggctaacagatgatactgtgcccgaccaatgagactacggtatgcacaagtgttgatgggttcatatgatcaatgaatgattgatgattattcaaaaaaaaacaaaaaatgtttaattttaattattgaaaaattaaaaggataaaagaaaaattatatgcaaattaacagaaaaagggaaagtgaggcggtcatttattaaattcaattgggcccatttgtattaattagtcatcaattgcattaattaattggtcaattattttattaccctcgctttgcataagaaaatgaaaatttaatcaatggtaaaaaaaaaatttttttaaagtgatcacttatcaatcactcattccgttcctccttccatcgtctttttgttgttgcggcagcggcgtaaattgctcacgacgaataatctcgtcggtcagttcctcgtcgcacaaccaccgctcgcctaggaatagtatccccttccgggggcggggtcgggggagggtgcggaatcgctgccaacatgagctgattcgtcagctcctcttcctgcagccagcgctctccgaggaatagattttcagagtttctatatcgtgaaattatatgctcaccctggtagtcacggtattccgctacagcccgccgatgctcttaagtcaaagcattgagtctatccgttcgcaggtctt

SEQ ID NO: 93866 - DNA, 654 bp, Heterodera glycines
  SCN-specific regions: Sequence locations=1-303,325-477,499-654
caacactcttcaacgttgtcatgcgattttgagaggcggaaagcgggcttacaacagcgatggggtcgacgagtgttcgaactccggccggaggtctttatttgttgttatataatgcccaagcttttctcaaaattttgagaaaattaacaaaaaaaaaatagagggatgggagcgaattttagggttgtttatgacaattcaaatacgtaaaatcgggcgattttctcaccgctcgaatttgatatttgcaatacaatctgataggttgttccctttttaattgacttttcctcaattctcttcatttttgcatttttctctaactctcgcctttttccagccatcgatggtccgccttcggccgactcccatccgccttcggtgggcactgccaatggcatggcgacgggtcgtccgggctctgttcagcaacagttcggcaccgccgcttcgcaagtggacacggaggagcccgagtacaaaatgttgctgaaaaagttgtgcaaataccacgcggatgtaaagcgactgttgggccgtttcgagttggacacattgcccggggtggagatgaaaatcaaagcgtcactggtcaacgtcatccaagtgatggaaggcacgcggaagggcgggtgcgtttttgagggggcg

SEQ ID NO: 93867 - DNA, 807 bp, Heterodera glycines
  SCN-specific regions: Sequence locations=1-52,79-405,429-472,494-807
gctttcttcataaggcactccctcagaacatcggcattgatctcacccttagaaggcaacaacagcagcagcaaacagtgggactggctgcacaaaaagtggtcgtaatgaaaatttcatccgagccaattccgacgagtgcggacggcgtcaaacgaaggcaccaaaagcggaaaggcggaagagcgtcggaagaacggacggacacaactttagtaaagcaaatgaaaggaaccgatacgggtgcaatgggaacaatgaaggaagaaagggaggaacaactgtaccagcgagaggggaaacccgaagcgaaagagaaggacaaattgaagacggcacctgcagaagcggagaaaaagacggagaagacgggcaaagatgggaaaagaggacggaagaagaagagggacaagcagcagcgggaagagggaggcagcacgaagttcaattggttcgccgagttcccattcgacaccgccgccacttccatctctgaagaacagtcagcaccagcggcaactgatggtgggatccccgccaaagttttcgcgtcgcccacccgttcatttgtgctccctgcccacgagcgtcacttgctactgcttccctacatggacattggccttccggactggagagtgcacgactttccccaaccggaccgattcttgtttcctgagccaagtgaatggcacaaaaagccttcctgaagagaccagaaaattcatcccgatccctcattcataaatctgttcgcttttcttcttggatgctttatgacacatcggacaccaatcataatcccat

SEQ ID NO: 93868 - DNA, 815 bp, Heterodera glycines
  SCN-specific regions: Sequence locations=1-368,390-815
cttcgccctgaattgacagtctcttcgccgatgcgtacgcttttattgctcaaggcctttgctacgacgaagtggacgaccgggacaatgcatgtttaatgtacgagcgcgggttagagttgggggacaaagcgctgcaattggacacggaacgactgagcggacttcgcaacggattggagagggtccgtgggatggtggccgatcggattgactccattcgcagcaaagcaccgcacgtggacaatcggcaagcggtggaaaacattcgccattcgctggtcactgtcagcgacgccattgccggctcaaccaccgacgccgaactgttctattggctgccggacggtgttcagcttgtggtgatcgaaggagatcaaacaaatgcaccaactccgccctcctcgctggccatcttcaaattgactaagccggaagaagcgcaaaagacggagaaagcgagcggtgccaccatcgaagcgaaagacgcggccacattgccgttggcgtcctcttcgcccgccgctttcatccaagtcggcccctgggcctacccattggaaccgggcaaaacggcaattctgaagaacgaattgggtgtttacgtgatgccgaacccaagccctgaccatccgaatatgttcgtcggtatcattttacctcgcgggttggcgcccggacttgagtccgaatttgtatatgccttgaagcaatttgcggtgctcaacagcagcgacattgtggacagaatgagcgaggagcaacgcgagaggaccagcgaacgtatcgctcaatttctcatccgagctggccaa

SEQ ID NO: 93869 - DNA, 401 bp, Heterodera glycines
  SCN-specific regions: Sequence locations=1-100,122-401
caaatccagaaaaaccacagggatggattgcatcagcacggttggaagaagctagcggaaaattgcaggcggccagaaacttggtcatggaggggcttgagaagattgaaaagtcagaagacctttggctggaagcgattcgtcttcatcctcccaacgtgggaaaaaacattgttgcgaatgctgtacgggctttgccccattctgttaaaatttggttaaaagctgctgatttggaggccgatcttaaagggcggaagattgtgttgctcaaagcactagaaaacaacccaagttcggttcgattatggaaggccgccgttgacctacaagggccggaagatgcccgatcactgctcacgcgggcggtcgaatgctgcccattgagcacggaactttgg

SEQ ID NO: 93870 - DNA, 759 bp, Heterodera glycines
  SCN-specific regions: Sequence locations=1-260,284-592,614-759
gtggtccgttcccctgcgaaaatttgtccatttgcttttcaccagcgaccttatgattgtcattggcttccgcgaccgcgtcgatttgctttcttcgctcattgtcatggccattttggccgtcggctgtctctttgcgttgcttttcaccctttttcaacttcactccgagactttgcatttggccaaattgggctccaatgtgctctcttccaatccggattggcttcgcgacgcgctgaactacacgggaggccatctgacggaggaggacatcgacgcttacatggaacaagcatatcagcagggccggacttggttggccagcaacatccgtcagctggcggacccaaaggatgcggcaagggccgatcggttggaggaccaagccaaattgctcgtcgacaacctctaccatttgtgggaggaacggcgaatcgaagacgaaacgtacaaagacagtttgaccacctttggcagcaccggtgaaagtacagcagggaacaagcgaaagcgagaattgtcatcctcacaaagcagcaacggaaatgccgacggggaaggcgaaaaggaaaacgacgccgggggcgaagagaacgacgaagagaagcgggcgtggctttacggactcgtcagaaatgccaacttagccatgtggaagacagaactgacgtcgatggtctcgcagaacatcgaaatggtgtggacgattgctcactccctttggcactttctgttgatgaacatctctttgctgtc

SEQ ID NO: 93871 - DNA, 199 bp, Heterodera glycines
  SCN-specific regions: Sequence locations=1-30,52-73,97-125,147-199
gaacgtccataaggaaatgttcgaattcgatttagggtttttggtccccttataggttttcagtcaaaaatcatttttcccccaatttttaaattaaatcgttgagagaatggcgctgtctttgccctccatttgtaaattgttttgtttgcctctgcgctggtcattttggccttgacgcattttgccgggcgaccgg

SEQ ID NO: 93872 - DNA, 677 bp, Heterodera glycines
  SCN-specific regions: Sequence locations=1-677
cgaatccctcagactggaaaacgctttataaacagagtaatcgatgacctttcaagcttaaagggaacaatagaaacattggctactgagagtaaacggggagcggataatgtttttgagaagggcggatttcgacgccaatttggcacaggaggacgaagaaacagccaagcggactcgaactttcactctgccaccaaaccaaacacactaccactctgccacgagaccagttgccagaataaggataaatgtccactatatgctgcaaagatgatgacgtcaccactgcgaggggtacggtagtccggtgaaaattcgcaataaattagccgcaggcaagtggactcgaacttttggtctgccaccaaaccaaacacactaccactctgccacgagaccagttgccagaataaggataaatgtccactatatgctgcaaagatgatgacgtcaccactgcgaggggtacggtagtccggtgaaaattcgcaataaattagccgcaggcaagtggactcgaacttttggtctgccaccaaaccaaccaaacacactaccactctgccacgagaccagttgccagaataaggataaatgtccactatatgctgcaaagatgatgacgtcaacactgcgaggggtacggtagtccggtgaaaattcgcaataaatta

SEQ ID NO: 93873 - DNA, 472 bp, Heterodera glycines
  SCN-specific regions: Sequence locations=1-472
tttgaaaaggcccacaacaatttgttgaggagagggccgaccctttctcgtcgtccgggaacaaaaagggcacgtaacaaggcgtcacaaagggcgttgttgtcagtgctttaagcgcaaaaattggggcgataattccggcaaaggttgacaaaacgatgatagctccacagagaagcaaggttttccaattcgccctctccaccatttctatgaatggggccggctcgttgtttccaaaatgttcggactcttgggatttgcattctccggccgccaagtacaggtaaaacacgctggggaacacaaccgaagtcagcgcaaccgttgaaccaccgaagaagtcgagggcgggcccaaagctcggcacggactcggaagtcagcccaatggcagccattacggacgagcggaggacgacgcgtttccagccgaaatcatgggggacggagaccacttcccccctttcctg

SEQ ID NO: 93874 - DNA, 290 bp, Heterodera glycines
  SCN-specific regions: Sequence locations=1-290
aaatcctgttctaaaaagttattctaaaaataaaatttcgaactcttctatactttttttctaatgcatccaattgtttagcttttgcttagaaaaagcttctcctcatcgagagcgttcgagtgataccaagtttatgcaatttcgttggtaaaaacctccaaaaataatttttaaaaatcgtcattttttaatattttggacaaaaataaataaaaatattcatgttgcacaacggactcgaaccaacaccctttgtccccttactatcttacaaaaaccactgagcc

SEQ ID NO: 93875 - DNA, 350 bp, Heterodera glycines
  SCN-specific regions: Sequence locations=1-57,96-227,254-350
attcgctctccccataaatctgggcgcatcgcttcggggggacggctcgtataagccaaaaaaaaaaaaattattttgaaaaaaaattattaaaaggaaatgactagttactatttgaataggttatttcgcgtccgttcaatgtccctgcaaagtttggtgtgcgtgcttctgatcagtttctgaaaaaaaagttaagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaa

SEQ ID NO: 93876 - DNA, 647 bp, Heterodera glycines
  SCN-specific regions: Sequence locations=1-187,209-647
ctgttccctgggctcccagaaaattggatgagttaccaagctgaaatacgcatgccaaaaatagaaaccacgcaaaacaaatgaacatgaacgaacattgacgaagttggacgcaacgcagcgttaagccgaagcattgaagcgatcagtgaacgcgctgtgtgatcagaatctgtaattggtcaacttaagtcagacattttatgtaatataatgactagacatggaaaaaagccatcaaacgatcagataaaaagtaatgagtaatggtccgatcaagatgggttccaattcagtaatctaaaccaccgatcctgatcacgggtatgatgatgcatcgatcagtaatcaaaaccatcaagtcagatgttttctagaattaattatgataaacgatggttcaaattaggagtagtatagagtaccaaaagcgcacggttgcgcacgggtgtttcccgcacgaacccatgcctatgggaggggcgcagccctttgatgttgccgccccgcacgaacccatgcctatgggaggggcgcatccctttgaagatgccgcacgaacccatgcctatgggaggggtgcagccctttgaagttgccgcccgtggacccatgcctatgggaggggtgcagccctttgaagttgc

SEQ ID NO: 93877 - DNA, 693 bp, Heterodera glycines
  misc_feature (7)..(7): n is a, c, g, or t
  misc_feature (16)..(16): n is a, c, g, or t
  misc_feature (21)..(21): n is a, c, g, or t
  misc_feature (30)..(30): n is a, c, g, or t
  misc_feature (39)..(39): n is a, c, g, or t
  misc_feature (42)..(42): n is a, c, g, or t
  misc_feature (48)..(48): n is a, c, g, or t
  misc_feature (50)..(51): n is a, c, g, or t
  misc_feature (60)..(60): n is a, c, g, or t
  misc_feature (63)..(63): n is a, c, g, or t
  misc_feature (79)..(79): n is a, c, g, or t
  misc_feature (82)..(82): n is a, c, g, or t
  misc_feature (93)..(93): n is a, c, g, or t
  misc_feature (106)..(106): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (128)..(128): n is a, c, g, or t
  misc_feature (133)..(133): n is a, c, g, or t
  misc_feature (136)..(137): n is a, c, g, or t
  misc_feature (142)..(142): n is a, c, g, or t
  misc_feature (149)..(149): n is a, c, g, or t
  misc_feature (160)..(160): n is a, c, g, or t
  misc_feature (165)..(165): n is a, c, g, or t
  misc_feature (179)..(179): n is a, c, g, or t
  misc_feature (187)..(187): n is a, c, g, or t
  misc_feature (194)..(194): n is a, c, g, or t
  misc_feature (210)..(210): n is a, c, g, or t
  misc_feature (215)..(215): n is a, c, g, or t
  misc_feature (219)..(219): n is a, c, g, or t
  misc_feature (222)..(222): n is a, c, g, or t
  misc_feature (238)..(238): n is a, c, g, or t
  misc_feature (245)..(245): n is a, c, g, or t
  misc_feature (261)..(262): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (307)..(308): n is a, c, g, or t
  misc_feature (318)..(319): n is a, c, g, or t
  misc_feature (322)..(322): n is a, c, g, or t
  misc_feature (329)..(329): n is a, c, g, or t
  misc_feature (332)..(332): n is a, c, g, or t
  misc_feature (334)..(334): n is a, c, g, or t
  misc_feature (343)..(343): n is a, c, g, or t
  misc_feature (350)..(350): n is a, c, g, or t
  misc_feature (382)..(382): n is a, c, g, or t
  misc_feature (410)..(410): n is a, c, g, or t
  misc_feature (415)..(415): n is a, c, g, or t
  misc_feature (421)..(421): n is a, c, g, or t
  misc_feature (432)..(432): n is a, c, g, or t
  misc_feature (448)..(449): n is a, c, g, or t
  misc_feature (459)..(459): n is a, c, g, or t
  misc_feature (466)..(466): n is a, c, g, or t
  misc_feature (477)..(477): n is a, c, g, or t
  misc_feature (480)..(480): n is a, c, g, or t
  misc_feature (483)..(483): n is a, c, g, or t
  misc_feature (496)..(496): n is a, c, g, or t
  misc_feature (502)..(502): n is a, c, g, or t
  misc_feature (514)..(515): n is a, c, g, or t
  misc_feature (534)..(534): n is a, c, g, or t
  misc_feature (537)..(537): n is a, c, g, or t
  misc_feature (542)..(542): n is a, c, g, or t
  misc_feature (556)..(556): n is a, c, g, or t
  misc_feature (561)..(561): n is a, c, g, or t
  misc_feature (565)..(565): n is a, c, g, or t
  misc_feature (573)..(573): n is a, c, g, or t
  misc_feature (604)..(604): n is a, c, g, or t
  misc_feature (606)..(606): n is a, c, g, or t
  misc_feature (608)..(608): n is a, c, g, or t
  misc_feature (621)..(621): n is a, c, g, or t
  misc_feature (643)..(643): n is a, c, g, or t
  misc_feature (667)..(667): n is a, c, g, or t
  misc_feature (669)..(669): n is a, c, g, or t
  misc_feature (671)..(672): n is a, c, g, or t
  misc_feature (674)..(674): n is a, c, g, or t
  misc_feature (684)..(684): n is a, c, g, or t
  SCN-specific regions: Sequence locations=1-693
ggtaatnatgaagatnttttngaaatggtnaatgggggnggnatgccntnntttatgggnggnggaggggggttgtttnagnaaatgtttagngggggaagggagnggtngngnaagggggagaaganggttnagnntttanaagtttngttggaagaantgtanaaagggaagaatanaaaattgnaattgangaagaaagtggtgtgnaaaangtgnaanggaattggtggaaaanaagggtnggtttggaaatgtganngttgttagggaagtggaaaggtttttngnangngtnagattgggnntggaatgatnnaanagatggnggngngatgtgatnaatggtngggtgaaggagaaatggttgatgaaaaggaangatgtaaaaaatgtgttggaaggaaaanggtgnaggaanaaaagataatngaagtgaaaattattnngggaatgggngataatnaaaagattgtnttntanggagagggggaanaggagnttgggattgaanngggggaagttgttttggtnatnaaaangaagtaaaaagaanaattngagngaaagggngaagatttttttatgaaaaaaaaggtaagtntngnagaaggggtttgnggttttattaagaccattaaanattttgaaggaaggaaaattaccntnannangatggccggngatattata

SEQ ID NO: 93878 - DNA, 488 bp, Heterodera glycines
  SCN-specific regions: Sequence locations=1-488
atcactccctcatagtccttccggctcgatcttcgtccgcctttcccacttcgactgactctccgcccacagaccgtccgtcgtctgtccgtcgcttagccaatggactcccagcagtgtcccatgaaagagacggatgagcaccgtcagatgcgccgtatcgctttcgttgcggtcgttgtttcgacggttgctgtgattgcttccgtcgttactttgccaatgctttacaattacgtccagtccttccaaagtcatctgatggttgagacggattactgcaaagcccgtgctcgtgacatgtggctggagatgaccgccctccaaattggcaagggacatgtgaaccgcatcaaaaggggctggttgttcggccaatgggtgcccgagagcggcgccgatgcttacgctgcgggaggtgggccatccggcggtgctccgtcgggaggtgctccgtcttctgcttcggcacccgtcggggctgtgcc

SEQ ID NO: 93879 - DNA, 556 bp, Heterodera glycines
  misc_feature (5)..(5): n is a, c, g, or t
  misc_feature (11)..(11): n is a, c, g, or t
  misc_feature (13)..(13): n is a, c, g, or t
  misc_feature (16)..(16): n is a, c, g, or t
  misc_feature (25)..(25): n is a, c, g, or t
  misc_feature (27)..(28): n is a, c, g, or t
  misc_feature (35)..(35): n is a, c, g, or t
  misc_feature (37)..(37): n is a, c, g, or t
  misc_feature (43)..(43): n is a, c, g, or t
  misc_feature (48)..(48): n is a, c, g, or t
  misc_feature (55)..(56): n is a, c, g, or t
  misc_feature (59)..(60): n is a, c, g, or t
  misc_feature (68)..(68): n is a, c, g, or t
  misc_feature (75)..(75): n is a, c, g, or t
  misc_feature (78)..(78): n is a, c, g, or t
  misc_feature (85)..(85): n is a, c, g, or t
  misc_feature (87)..(87): n is a, c, g, or t
  misc_feature (90)..(90): n is a, c, g, or t
  misc_feature (96)..(96): n is a, c, g, or t
  misc_feature (98)..(99): n is a, c, g, or t
  misc_feature (109)..(109): n is a, c, g, or t
  misc_feature (121)..(121): n is a, c, g, or t
  misc_feature (129)..(130): n is a, c, g, or t
  misc_feature (133)..(133): n is a, c, g, or t
  misc_feature (141)..(141): n is a, c, g, or t
  misc_feature (150)..(152): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (181)..(181): n is a, c, g, or t
  misc_feature (187)..(188): n is a, c, g, or t
  misc_feature (195)..(196): n is a, c, g, or t
  misc_feature (199)..(199): n is a, c, g, or t
  misc_feature (204)..(204): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (223)..(223): n is a, c, g, or t
  misc_feature (232)..(232): n is a, c, g, or t
  misc_feature (235)..(235): n is a, c, g, or t
  misc_feature (244)..(244): n is a, c, g, or t
  misc_feature (247)..(247): n is a, c, g, or t
  misc_feature (249)..(249): n is a, c, g, or t
  misc_feature (259)..(261): n is a, c, g, or t
  misc_feature (273)..(273): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (287)..(288): n is a, c, g, or t
  misc_feature (292)..(293): n is a, c, g, or t
  misc_feature (296)..(296): n is a, c, g, or t
  misc_feature (303)..(303): n is a, c, g, or t
  misc_feature (308)..(308): n is a, c, g, or t
  misc_feature (316)..(316): n is a, c, g, or t
  misc_feature (321)..(322): n is a, c, g, or t
  misc_feature (325)..(325): n is a, c, g, or t
  misc_feature (331)..(331): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (345)..(345): n is a, c, g, or t
  misc_feature (355)..(355): n is a, c, g, or t
  misc_feature (368)..(369): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (406)..(406): n is a, c, g, or t
  misc_feature (408)..(408): n is a, c, g, or t
  misc_feature (411)..(413): n is a, c, g, or t
  misc_feature (421)..(421): n is a, c, g, or t
  misc_feature (424)..(424): n is a, c, g, or t
  misc_feature (426)..(427): n is a, c, g, or t
  misc_feature (430)..(430): n is a, c, g, or t
  misc_feature (432)..(432): n is a, c, g, or t
  misc_feature (438)..(438): n is a, c, g, or t
  misc_feature (460)..(460): n is a, c, g, or t
  misc_feature (469)..(469): n is a, c, g, or t
  misc_feature (474)..(474): n is a, c, g, or t
  misc_feature (479)..(479): n is a, c, g, or t
  misc_feature (486)..(487): n is a, c, g, or t
  misc_feature (493)..(493): n is a, c, g, or t
  misc_feature (502)..(502): n is a, c, g, or t
  misc_feature (507)..(507): n is a, c, g, or t
  misc_feature (517)..(518): n is a, c, g, or t
  misc_feature (535)..(535): n is a, c, g, or t
  SCN-specific regions: Sequence locations=1-556
tgaanaatggngnganaaaatgttnannggtgagngnataaantttanggagganngannagtggttnatgttgntgnaaggaananatnaatgangnngatatttgtnaataataatgangttatggnnagngtaatggnggtggtgannnagatgaagatgttttgnganganttgatnagtggnngatggannggntgganaggggaangnatnaaggangtggttaanatnggaattggnggntnggatttgggnnngttgatggtganggaagnantnaaanngtannaanaaggggntaatntggatttngtgtnnaanattganggnantnatttggnccaggtggtnaaaaaggtggagnntaaaattgtggtnttnatnatngnatngaagaagttnanaannnaagagaanatnannaangnggagtngggccgggaatggtttttgggngagggtgtngaaanggggnaggtggnnaaaaantttgtgggngtgtnaaccaatggnnaaaaagtggaggatttnggtattgaaaagaagaatatg

SEQ ID NO: 93880 - DNA, 612 bp, Heterodera glycines
  SCN-specific regions: Sequence locations=1-509,543-612
caagttcgtgttttaactaaaattttatcgaaaccgttaattcgcaaccacaaaatgccggcccaatcgccattctttctttggtggctttgtatccgcctgaatttatgaattggcattttaggatgaatgagaacagggagagattctacgagccgggaatgactcaagcggacgtggcgaaggccgcaggtcgccattttaccgttacagaattattatgctgtacagtagcccagaaaagggaaggcaaaaaccatttattttagtcttaattattggttccgattcctttataaatcgttttttggattaacaaatgccatttcgggaggattgcactgggcgtattttcctcaaatagtaaaacattttccaggcgaggaatggcgccgtttgcccgagtcagagaaggccaagtggggacagagatcggcggaggaacgaggacgtcaaggggggcaagatgtggaggaagaggagcagtaaaacggagaacaaagggagtgaggggggaaacaaagagaaaacgaaaggaagaaaaccccctttgatcatttaatttgatggcactccaacacattctcatgggcatttcagcctttcttctta

SEQ ID NO: 93881 - DNA, 385 bp, Heterodera glycines
  SCN-specific regions: Sequence locations=1-295,317-385
aacttcctttatacgaccccagcagtatttctctcttttcggcaaatgccttgtccgttgatgatcagagcagcagcactattgccgaagaaaggcctctttcgtccgagtcacaattagccgccaaaaagtcaattggcacagatcagacggaacatggcgaaacggacggaagattttccacttaccatcgaagaaaaaacatggaagtggtgcacagacggaatttgatcgaacgtttggataaactgaaggcatcgcacgaagccttcttcacagttccgcagcttaaagccgtctcaaataatcaattgtctctttttctgcgtcggctgctaaagtcagcggacatcaaacagcacatttcaacagaacttttggaaag

SEQ ID NO: 93882 - DNA, 685 bp, Heterodera glycines
  SCN-specific regions: Sequence locations=1-658,683-685
acgaactgttatggatgggcccaattagcagaaacaatttgacaattgttgaagcgaagtccgaaattttcgacgcactcgacaaagtgggcaggcgcaaattcgttcgccgcggtttcgtctccgccagtctccgaaatgaaacaaatttcgttgtccgttgtgctgttgagaattgctttctgttgtccgattacgagggacttgacgtaatggtcacgcgatttgacgccgaaagggacgaaaagcgggcggaaaaagcgaacgagtggcttaaaaagtgccaagaaaacggaacgaagaacaaaacggccgaaaggacaatgagacaattcatcgaccaaaattataacattggcaaagtgtctgagctgctggacaactttgagaagcagcactttaacctcaccaacgatgctttgtaccgtaacatcgccattctgcgcgattacggtagcattgaccgatgtgggattacggtctcttcaaatgaccgtccatcggacaatcacacggcaaacgctgctgctatggtggactattacttcgcggggtccttttggcgcgcctgcgaaagttatgccatctatttttacacttgacaaattcagcaccttggcggaggacggaacgccaaaaatttcgattggattatgccatttaaaaaaataataaatttaatgtt

SEQ ID NO: 93883 - DNA, 401 bp, Heterodera glycines
  SCN-specific regions: Sequence locations=1-401
ggtttcctctaccaaaaaaagcgacgcagcaaaagggcaaaaaggatctttgaagggccctctaaggaggggcgacggacagcggcaaaaaggagcagtcgaaaggggcggggacatccgtaaaagtacgccacattctctgtgagaagcaatcgaaggtattggaggccatagagcggctataagcgggtgagaaattcagcgaagtggcagcaaaatacagcgaggacaaagcgcggaacggaggcgatttgggatggatggttcgcggctcaatggtcggcccgttccgagaagcggcttttgcactggccaagagcagcgtggacaagccaatctacacggatccaccggtgaaaacaaaattcggatatcacgtgatcatggtcgagggaaagaag

SEQ ID NO: 93884 - DNA, 312 bp, Heterodera glycines
  SCN-specific regions: Sequence locations=1-175,197-248,272-291
gtcatccagcgatgccggacagcccggcgagccaggcaacccccgtggagcgggcgagcccggacaacccggagagaagggagagcacggacactgcgaccattgcccaccgccacggactgcgcctggctattgagcattgggaagccaattttggagatgacaattgggaagaggagaagaaaagtgggagaaaaagcaatgaaagacgaacaaaaacaatttgggaggaaaattcattcattgacaatttaaaaagcaattaaaaatgataatgataaaagcaattccaaaaaaaaaaaaaaaaaaaaa

SEQ ID NO: 93885 - DNA, 216 bp, Heterodera glycines
  SCN-specific regions: Sequence locations=1-189
gcctttaggaattggacaacaatcaggtcaaaatggaaacgatcctagaagagaaaaaaggcaccggcggaggagggaaaaacagcgcatgaattgatgatatatgttgaaatattttcttgtttatttggagatttcaaatttatatcttttatttatcaatgttccgaaaattgatacggaaacagcaaaaaaaaaaaaaaaaaaaaaaaaaaa

SEQ ID NO: 93886 - DNA, 474 bp, Heterodera glycines
  SCN-specific regions: Sequence locations=1-88,110-474
ctccttcgtcaccaacgaatcatttggtggcgttggtcactccgcctacttccgggtttcggcaaatattacagacaaaaaacatcgaattcactttgcctttcaaaacgacagaatttgttgagttgggccgagaagattgcccgaaggattttttgacaaatatcggagacgaaagtattggcatggaccatgacgaatggctgcgtgaccttggcatttcgccacgttcgaaattcaaattaaaacaaagtccctctgagttggacgtgtcgtcggcttcgcttttgtccaacgaatcgaagaatgattcttccggccttactaattgtaagagtagcgaagacaattcgcgcggtttgtccgccgtttcgtccgtcgaaagttcgaagtccgccgtactcatccgtggcgccaaaaatgtggaagccttttgccgtcttttgattggtcagccgactctttgctccacca

SEQ ID NO: 93887 - DNA, 415 bp, Heterodera glycines
  SCN-specific regions: Sequence locations=1-415
ctcgttccagtgacatgaccttccccgaaattaaactaggccttgactccattcgacaatttacaacgaagggctgggaaaattgttgggtcatagataccacccagggtgttttggagtcgctctacactgattcgcttggggaaggtttgaacaccgacaatgttgaccacgcgcagctggtggatgcacagtgtgatgctctgggtgtgttggatgcgccgaaaaacgcgtgccgccattttatttacactgcttgggtggggcactccggtgaggaccacacgcgccgattggaagaccagcgcagccacagttttgcccattgttgtacggatgcgcatgatgatagcgtgaaagcgcctggggttatactccgtgtttgagccacgctgcgcaattgccaagaattgct

SEQ ID NO: 93888 - DNA, 193 bp, Heterodera glycines
  SCN-specific regions: Sequence locations=1-193
atccatcgattttcgcttgaggcgcgtgcccaccaattgttggccattgctcggcttcactgttacgaattctcaaatttttatgccaattgcgtccccaatttgctcagcgaattcggacgagagaacggtttgggcgagcagagccgcacaaaacttgagaaagcattggcccattcgctgttcaaagact

SEQ ID NO: 93889 - DNA, 372 bp, Heterodera glycines
  SCN-specific regions: Sequence locations=1-145,168-213,235-288,310 -326,364-372
attcctttaacagtattataatgaagttgttttcaacatttgttccatgttagatgctcatcatcggactgatgggcattattgctccagtgaattcggaagaggaacctggccaagaacaagcttctgctaaaaaggaagaagatgaaaagccaaagcccccaaaaggaaagggagcgggaaaattccgttttttgggcggacgacgaatgaaatgagcagagaagttgctgatttgcttagattagaggctattaaacaccaaattaccgatgaataatcatttaacaataataaatatttgctctcttttttttgattgaaaaacttggaaaaacaaattttatccaataaacttttattcatcgtacc

SEQ ID NO: 93890 - DNA, 206 bp, Heterodera glycines
  SCN-specific regions: Sequence locations=1-48,70-180
atttcttgcttttggccttatggacaaatgttccatttttgcaagcttcatttgtaatatttgatcatttccaatatctcccagcatttgtctctttcacgcttttgtccatgttttaaacacagacgatgcctttcactcactcagaattaaatttttaataaatcagattctcgacttaaaaaaaaaaaaaaaaaaaaaaaaaa

SEQ ID NO: 93891 - DNA, 231 bp, Heterodera glycines
  misc_feature (24)..(25): n is a, c, g, or t
  misc_feature (34)..(35): n is a, c, g, or t
  misc_feature (37)..(37): n is a, c, g, or t
  misc_feature (39)..(43): n is a, c, g, or t
  misc_feature (52)..(52): n is a, c, g, or t
  misc_feature (55)..(55): n is a, c, g, or t
  misc_feature (69)..(69): n is a, c, g, or t
  misc_feature (89)..(89): n is a, c, g, or t
  misc_feature (115)..(115): n is a, c, g, or t
  misc_feature (119)..(119): n is a, c, g, or t
  misc_feature (122)..(123): n is a, c, g, or t
  misc_feature (128)..(128): n is a, c, g, or t
  misc_feature (145)..(145): n is a, c, g, or t
  misc_feature (153)..(153): n is a, c, g, or t
  misc_feature (157)..(157): n is a, c, g, or t
  misc_feature (163)..(163): n is a, c, g, or t
  misc_feature (165)..(165): n is a, c, g, or t
  misc_feature (171)..(175): n is a, c, g, or t
  misc_feature (178)..(178): n is a, c, g, or t
  misc_feature (184)..(185): n is a, c, g, or t
  misc_feature (195)..(195): n is a, c, g, or t
  misc_feature (220)..(220): n is a, c, g, or t
  SCN-specific regions: Sequence locations=171-231
gggggggggggggggggggggggnnggggggggnngngnnnnnggggggganggncggggggggggggncggggggggggaggggcggnggggggggaggggggggggggggggngganccnnggggnggggggggggggcaaanggcggggnaggnggggcngnaggggnnnnnaangcgggnngtagggaagngggggggaggggagcgggccacggnggggcgggggg

SEQ ID NO: 93892 - DNA, 760 bp, Heterodera glycines
  SCN-specific regions: Sequence locations=1-760
aacccttctcgattttgcgctctccgccacagcgccacaatcgactttatacagaccgaatggagtccatttggcgttccgctgatgggaaaacaatcaaattttacggcaacgttttcgcttctcttgataattggttgctgtacggtttgaactcgatggtcgcaactctgttggccaaggatgtgtttgaattgcaacgaattgtcgcacgacttccctttgagcagcaccgttcgttgtccgcctcgccaacggcacttattgcccagctgacaacgaatgcggcagagtttacacagtccggtccgaatcgcgaactgttgttcgccctcgccaaattgggtcagcaattactgttgttacgcaatctgcaaatgttcgtcaaagcggagaaacacagccaattgggcacactgcaaacagcggaacggacactccgaaggctcacaaatggtgaaaacatatcgaccgacgaaaacaatccgacaatggacttgatggtcctaaacactgacaatgcgttgctcgactttgtttccaaacatcaatcgcttaagtctcccactgctcaaatgtttttcctttctgtgattttgtacttttcctttgtcgctaaagacctcacaacaacgacagcctcccaaaaaggtgaaaaaatcgatggagttgcggtgatggaaggggcgaagctgatgctgcaacattcgcttctttggacacatttatcctccgattccacacatttatttgtgaatgc

SEQ ID NO: 93893 - DNA, 665 bp, Heterodera glycines
  SCN-specific regions: Sequence locations=1-148,172-340,363-417,439 -626,664-665
tccctgcgttgggtgtggcaataaaatatgcacgaaattcatcctgtaaaggcatttcgcatgaacttgacgaaattgagttggtcaacgacggcatcaaaaacatggcatttgaatacatgcaggcgttcattgtgaaggcgccggcattttttgaattccctttttcaattgacgtggtcgactcgctgatcaaaaatttcatttgctatttccgcgacaagcttgtcgaaatgtgcaacctttgtgaggaggaactgtactcgttgctgatgatgcaacatgacaaaacggcgcaccagcaaatggcggacgacggcgcatcattgccatggcaaacccatcattctcatcatcatcattattcgccatcgtcgctgtcgaagaaagcggtgccaaactttgccaatttgcacttcaaaacattccttgaactgatcgccacactttatgagcgtgaaacggaccaaattgttcgatgctcgcgtgaatttacggacccaaattgcgaaggattgtacgactttgtgttccgaaatcgggcaatctcggcaccttcacttaaaattgcctatttgtcaatgctcacttcgctgtgcaaaagtgccgaatcggcagacgctttctttaattttttcaaataatttttgattttatttttttgt

SEQ ID NO: 93894 - DNA, 466 bp, Heterodera glycines
  SCN-specific regions: Sequence locations=1-349,374-431,453-466
cttctttatatccggattggccaccaccatcgcctcaatgcccgcgtttacattgtgaagacgagaatccaaaacatgagcgttgttgacggtcgtcctgaattctccggcgtcgtggacgtcgtccgccgcgtgttggccaacgagggcattttcgccctttggaagggctttttgccctattacatgcggctgggcccgcacactgtgctcacattcatccttctggaacaaatgaacgccctttacaaacggttgaaatacggcgcctaaaaatgcatgagggagaagaatgaacacacttttccgatttcaatttcactttttaattttgttgtaaaatgtcaccaattaattttaattaaaattatttggtggtattaatctttaattggcactttcatcgtcgtgtgagcattaacagatataatttcttattttttgccggttttctgtttttgtacgc

SEQ ID NO: 93895 - DNA, 127 bp, Heterodera glycines
  SCN-specific regions: Sequence locations=1-127
tgactatgaccatttgttcaagttgctcataattggcgatagtggagtgggcaagagcagtttgctccttcgctattcggacgacactttcatctccagatacatcacaaccattggtgcggatttc

SEQ ID NO: 93896 - DNA, 372 bp, Heterodera glycines
  misc_feature (24)..(24): n is a, c, g, or t
  misc_feature (214)..(214): n is a, c, g, or t
  SCN-specific regions: Sequence locations=1-68,90-372
aagatatcgacctggggcaaccgnctccagctccgtcagcacatgagccggacccaactgcggatcccgacccagacccggacccgagcatcgacgaggaggccatggtccaagccgaccacgcgctcgcactgcaactcgcccaagaagaccaagttgaggtcgacgagaacgatgcggtttcgttctttagcatagctggaccacacacagncgttgcgatacaaggccagcaaatggagtgtatcggacgacctgtgggccaacaagttgattgtgccgtgcaacctgctcatttttgtcgtctcgatcgcttcggtcgtagtcacagcttccctgccaggcccatcgccggcgtcaacgaccgagacg

SEQ ID NO: 93897 - DNA, 271 bp, Heterodera glycines
  SCN-specific regions: Sequence locations=1-271
aagagccaacacggccaaagatgggctcccccgttgttctgattgattcatccgatggtttgagatcgacgtgcctgaagccattggaaggatggccatttttactcccggcgactgaattggcatcggagtgaccggcggtgatgactccacggtgttgggacacgtgcttgctccgctgaacgaaaagcattcctatggattgccattggatcttttgtgcgtggaccagggcctaaaaagttaccgggacagactcattctttcgatg

SEQ ID NO: 93898 - DNA, 715 bp, Heterodera glycines
  misc_feature (706)..(706): n is a, c, g, or t
  SCN-specific regions: Sequence locations=1-597,619-715
ctcccttttcgtcctttctatttgagcagtttttcccatggttgctttccttaattgctctgttctctataattatttggttgcgaagcaaaacaaatcgaactttgtttgtgaatcacgaaaaagggagaagactaatggccgtgcttggttctggcggacatacgaccgaaatgctcaaattgcttgctgcccaggacgaccttttccctggaaggctgtacgtaattgccaaatcagataacttgagcatagtaaaggttgaggagtttgagcgaacacatggcaataaattctgtgtcagaatcgtcccaagggcacgtgaagttgggcaaaatttgctttcttccctcgggagtactgtcgttgccttcttctactcctttaaactcgtttatcaagaacgagcggacgttgttatcagcaatggacctgcaattgggcttgggatttgcctttctgcctgtttattcgattttctccggttgtatcgttgccgtgttgtctttgtagagtcaatttgtcgtgttcaaaagctttcactaaccgggtggctaatttactatttccgaatttctcacgcgttcatcgtccaatggaagaatttgcaaaagaaatacccaagaagcgaatatatgggcaggctcatttaattttcatgcttgctgtaatttttcagctaataaattggtactcatgcaaaaanaaaaaaaaa

SEQ ID NO: 93899 - DNA, 470 bp, Heterodera glycines
  SCN-specific regions: Sequence locations=1-470
cacgcttgagcgacaacgaagcaaggcatgttggtcaaagacgcactagtgaggccggacatttcgaagccgcgctgggaccagtcgacgttcagtggtcgcgcacggcacttcttcaccgtggtcaacccactgaaccttttggcatcgaacaaccaattggaaaacagtcgcaaaatcgtcaccgattacgagaaaggcaaatactccgacaatttgtccgtcgatgagttatggcgtgccaaacatctgtacgactcggcattccatccgcaaacgggcgaaaaactgttgctgatcggacggatgagtgcacaagtgccagctaatacgatcattaccggcggcatgctcagcttctacaagtctactcctgcggttgtagggtggcaattcattaaccagacgtacaatgccactgtcaattactctaaccgttcgggcgatgcgttgagcggcgcacaactttt

SEQ ID NO: 93900 - DNA, 479 bp, Heterodera glycines
  SCN-specific regions: Sequence locations=1-360,382-479
gtgctactagcttggggtcggatggtccgatggcagcacaacgacttggtgggcgacgtggtcactttgctgggccaatttgcggtggtcggccgattggccggcacagtgttcgacgggcaggacgtgaggacggcatgggacgtggacaacgccgcctccttcgcactgctgcgccaaccgtcggacgaagtgtccgagacgctggacgaagtttggctgtacaacagcagtgatcagcccctgttcatgtgcgtttcgcggaacgtcgcccgtgccgcggcaccgccctccgactctgcgctcgtgccgaacattcgccgtctgtccccgggctattgcgtgcgcgtgcaccgcatttgtgcaccccccgcggcggttgggtccgccgccgaccacgcgccgccgccccttccgtccgtcgcttcgccattccataggcaccaattcgttggcaacgatctcacgctgttctcctc

SEQ ID NO: 93901 - DNA, 591 bp, Heterodera glycines
  SCN-specific regions: Sequence locations=1-10,33-169,192-591
cctccttccaaattcggcacgagggtccaattaagtgccattgggcctacgtgccgttcattcagccggacagcgccacgtacatttgtgctgaaaatgacgcggtgcgagagcccggcattcgccaacagttggtcacattgttgcgcgaaaagaaatatgagagccgaatgctgttgctgttggccaaaacgtatttgatggtgcagaacaggccgaccgccgccggctgtttaaagcctcccgaattctcgaaggccacttcgagccgttgttgtacattgcggtggagtactgttttgccaacaatttcaagctggccgccgactttctgacagacgcggcccaattgctatggatgcccttcgtctgctcgtcggtgccaacaatacttcaaatttgagtgccgttgttgacgaacaacaaaatgccatcgacgattattcggacggtcagcaacaaccgccgcaacaacagcatcaaacggttgaacaactgatggcccccggtcatcgacttcgggagccgttgttttgatcaattttcatgatttttgttttttttcattttgtctttcctcacctttgtttt

SEQ ID NO: 93902 - DNA, 807 bp, Heterodera glycines
  SCN-specific regions: Sequence locations=1-96,118-526,549-680,702-807
ctcttttcaaaatatgggctaaatgaagcgaaaaagcgcgaaattctgagcgcttccgctgccgccggtgtttctgttgcatttggcgcgccaatcggaggagtgatgttcagaaccgtggaactgtgcgcggtggtgggcgtccatggaacggaacggccgcgttttgccattgtgtggagtgccgccgtccaaagggatggcacggacgcggtggaggacgtggaggcgcaggacccagcggatttggacatgggggtcgcggtggacgtggcagcttcggcaacggacaacacatgggacacatgcgccgttgaggaaccgagacaaagaattgcggagacaattctcggaggaggggaggaatgtggaatctgccattctctggaggaggcgagttattattttccgctcaaaacgatgtggcgctcgtttttctgcgctttggtcgccggtgttatccttcgttttgtcaacccgttcggaagtgatcagacttcgctgtttcacgtggactattccatgcgttggacattcatggaactgattccgttcgcaatgttgggcattttcggcggtgttcttggcagtttgttcatttgggccaacatcaaatggtgcgcttaccgaaaaaacagccgatggttgggcgcaaatccaatcaacgaagtgctcatcgtcagtgccatcaccggtgccatttccttcttcaacccttacactcggaagagtgcaagttcattgatcaaacagttgtttgaccgatgtggtcccgaggactacaccatggatttgtgcgattacaac

SEQ ID NO: 93903 - DNA, 599 bp, Heterodera glycines
  SCN-specific regions: Sequence locations=1-94,117-527,556-599
gccttatgaccgcaattattgacgaggatccgctgggcgttgcatcatgttgacgaggacccgcgtcaggctgacggcaaacccgtggacgaggaggaggaccgggaggaagtgtttgtgaagccgttgatcacgtattactgccactgtggccaaatggcaatgatttccgacaccgccgtcgcgcggatgccgttgcgtcgccgggacggcgctcgggtgatcgaccccaaactgacggttgcgaaaacgttctgtgaccagggcgagacggtgtacatacgacgccgggaggggctggaacagcagtaccggaagatttgccgtaactgcaaggtggccctgttctaccagcatccgttcaaccagcacagtgtgctgttcatcttccgcgacgcgctcctttccgccaaggaagtgggcggactggcgggcaaaagtgaggaggaaaagtcgcgcaaagtgacgctgacgaagcacgtgcgcaaccacggcaaagtcggctcagtgacggtgtccacaattggggaggacgaggaggaggtggaggcgcgcgagctcagcgagtcctactcactgaacgcacggattgtcgaaga

SEQ ID NO: 93904 - DNA, 811 bp, Heterodera glycines
  SCN-specific regions: Sequence locations=1-148,170-747,769-811
tgtgcgtcaagcggctttcgtagtaaattttttgtttccattgtctctggaaagaaggtgccttggcaacagatgcgtccgttgtttcattgccactttccgctgggtccccgttctgttcgtatgggccatcatttgctgggcctattacgtttacgtcgtcattttttgtcttgggatggtcgagtcaattggtcttcaaattgtctttctgttcgcttttaacacgcttattttcctgtttctttggtccaacacccaaacagtgatctctccagtcggacgacccccggaaattttcaatttgccccaccaaattcgttccgaattgagtgccgccgtcactgagacggaatttaaggccattctcgaacgttttgtcagagagcgtaaaatcccgatgttcagcaggtctaatgacggagctgttcgctgctgtttgaaatgctcttgtgttaagccggacaggagccatcactgctccgtttgtggccattgcgttctaaaattcgaccatcattgcccctgggtgaacacttgcatcaatttcaacaattacaaattcttcatgcttttccttggctatgggtctcttctctgtttttttggctttttcacaattcttccctttttcatctcattttggcaacataccgacctgtcacgggcggaagtgggcaggttcctcgtgttctttttgttcttcctcgccggtctgttcggcctgtccatgggctgtctgttcgggtacaatttgtttttgatttccaaaaatcagtccacaattgaatcatttcggcctccatttttc

SEQ ID NO: 93905 - DNA, 769 bp, Heterodera glycines
  SCN-specific regions: Sequence locations=1-769
attcacttaaccacctcacgcaaacatgtcccgcccagtctttgcccactcgccaccgaccaccaagaccaatgacgaccacggcttcatttctatcgcgtccacttggcgctcggtacgcaccgaatcctcagcagccaccgttcaaaccgatcccgttgctctctcctcgtcggcatgtggccctgaaccacccgtcagcatcgagtgccagactaccgacgatctcgccgggtctcgtcctattgggtctgcggccgccgcacggtctgccgaactctcagtctcgacgtcgcgtgggaaactgtttgacgtgatcgagctggccactttcgtccagcgagttgaggggccgctgtcggaaatgctcatggaaaacctgcaatcgtccgcatttgacgactggccgcttgtcaacccgctcgcttccctctctcaagacgacgacaacgcaatctcaaatcaagttggactacttgcgctcagcgacaccctcgtcgccgaccctcaatccacctcaccctcatcagcgaatggtctttcactcgtcgctgccgaccgatccaaatcgggctcttcgctcatcctcgcctacgcccacccacacgacacagccaatagtcccgactcgtcgtcgccctggtgcacgcacacggcacacgtgtccgtgatcctcaacagccagaagcagcgcacggcgcattggcacgtcaatgcgtgtccgacgacactgaccacgcacccggacctgacaaacttagtcgccgtg

SEQ ID NO: 93906 - DNA, 745 bp, Heterodera glycines
  SCN-specific regions: Sequence locations=1-745
cgaggaaggcgccgctgaccagaacatttgggacgttttggtcgcggggtccaacggatggtctaattacaggcaccaggcggatgtttgccatgcgtggcatgtgttagtcgaccacggagtgagcccggacagaataattacgatgatttacgacgacattgcgcacaacaaaagaaacccttaccccggcaaactcttcaacaatccgacaatgaaagatgtgtacgaaggcgttcgaattgactacagaggcgacgaagtgacaccggcgaatttcaaggccattcttctcggaaacgaagaagcggtggaggggaagagagtgctgaaaagcaccagcaatgacagagtgttcgctttcttctctgatcacggcgcttttggtttggtcgcttttcactacggcgacgattacactgaaaatatcttaaccgtaatggaattaacgcaaactttgcgaaaaatgcacgcgaaacgaatgtatggccagatgacattttatttggaggtctgcgagtcgggatcgatgttctaccagaaaattgcacagcaaataaacgtgttcgccgtcactgcttcgaatgctttcgagacgagttggggttgatactgtgacacaccaatcgtcgggttacagtacacttgcctgggcgaacttttctcagtcaattggatggaggactcggacatacagttatttctgcgcaacgaaacaatcgccgaaacattcaattcggctaaa

SEQ ID NO: 93907 - DNA, 326 bp, Heterodera glycines
  SCN-specific regions: Sequence locations=1-326
gtccgtcaaactgtcagaggcgcaattttccatggccattgatccttagatgagtgctcttaaaatgggctgcatggattatgacgagagttacaagccaaagtttatgtttgttgtgggaaccaagcgccatttcaaaaaattcttcatggttcacgatggtactgttgtcaatctgacgcccgggtcggtgattaacgagaaaatggttcggccggacatacccgagtttttcatgcaatcacactatccaaaaaaggggactggcaagccagtggagtacagtgtgttggtggacgaaatcggcatgacgcaggatgaacttc

SEQ ID NO: 93908 - DNA, 277 bp, Heterodera glycines
  misc_feature (255)..(255): n is a, c, g, or t
  SCN-specific regions: Sequence locations=1-23,46-255
cgacgatgttatttatctagaaggacaaacttttttaatcggctcccttggagcgaattatggagggtcggggagcgcattgatcacccccgaaggtgcgctagcgggaatccttgtcggttcggattcgaaaatgaccgtcaatgatgcacttagtgaatggctcgattcactacatgaacaaaggcactcaaaaatggtcgatatcggtgccatactaatttcctatcgaaacatgataaacaattaggttcnaaaaaaaaaaaaaaaaaaaaaa

SEQ ID NO: 93909 - DNA, 474 bp, Heterodera glycines
  SCN-specific regions: Sequence locations=1-54,76-436,458-474
gtccatatgtgggaagtattgggtaccgcataaacatttttagcctgtatttagaaaaatatttattgaggagggtgagaatattttggggatttatggacattttatttaggaacggggacgaaaaataaatttttgggtgcgagtgggattgattttttggccattcaattgcataaaagcgaaaataagatgggggaaattaatttgcataagagggattcgaacctgtgggggcaaaaacaaacgccaaacgcacaacctccgcaccatcgaacaacacaaaatggtgcaaatgtttattcgatttattgggatagaaaaaagtttggcacgtcatatctcggcactcgtacttatttcgcagaaaataaaaccacttttcttaagaacccatgggtgctctatgcacccaccaaatttcattccgaaactccacggacacctccagaccttcctttgtgagcacagccc

SEQ ID NO: 93910 - DNA, 577 bp, Heterodera glycines
  SCN-specific regions: Sequence locations=1-4,26-30,57-63,90-395,417 -577
cttctttcaaaccctccgttatgccaatgccattctcttcctcctcctcctccgatgtgccaatgccattctcttcctcttccccaccgcctcctccttcctctaatgagtgctccttatgcctacaatggtccgaatggaatgactgttcccaaatgtgcggcggatgtggtcgtaagacgcgtcgtcggcactgtccttccgctgtttcatgccaaagggaggaaaagcggatttgcaatcgaatggcatgccccgaaggcaccaattttctgttcaataacggcgagttccacctgttgtggaagggctgctgtgtagggctgatcctgaacaacagcacggcaaagggtgatggttcgtccgtccgcggagagtgcggtccgttggaaaacagtgaaaacccttttttacgaattatttcgtctctgctgagttcgcacgacggacaaaaagaaaagacgaaaagaaatggggggaaaagcaaaagtggtgaagacaaaaacggacaataatcaagcgcattttgttaattttattaatctctttgttactgtaaaataaaattgacgacttc

SEQ ID NO: 93911 - DNA, 711 bp, Heterodera glycines
  SCN-specific regions: Sequence locations=1-481,503-711
ctcctgaacgggcagtcgcatcatgtcagcctcaccctcagcccctgacaggtctcacggccaccacgacctccaccggccgggcgtcgatcaccaatccgcacagtttgccaacccccacattcctccaatcgacatgctacaagcattttgtgcaactgacgagaaatcacgggtgtgggacccaacgttcgactcggtcttgagccacactgccaacacaggtgctttagccgttgactggacactacttcgagagctcatcaaagctcgaatgctccatgaagtcagcggccttcacgcacaagcagagcaacagggacaatccctaaaccgggcggaaatcaacgcgcaactccatgtgttgggcggatttttcaacgcacttacgacggctccattcaccgtacagcggatgtgtgaaatagccctcactcgacagcataccaacgtcatcaagtacttgcggcaaatcgagcgcgtggtctgtgtctcctcgtctgtttccgactcggactggatcaggaatggaactgctggtgaagacaatgacattgtgcccattggtctggtcgcttcggacgcgaacatggcaactgcggaaccaattgacactgacatgtcctgagcagactttagctgaggaaccgcacgtgtgtgagcatttgtacatttaccttgtctctttggtatacctcaccataacccggc

SEQ ID NO: 93912 - DNA, 468 bp, Heterodera glycines
  SCN-specific regions: Sequence locations=1-45,67-277,299-468
atcccttttccggattcttaaattggatcgtgaattttttttcgactttacaagtgatttcaaatcgctttgtaggacttccaggggcccgaaaattaggagatgagttttccagtgccttctgacgatgatttttatgatgaaacaacagactatttatatttgaccaatgacaatgcaaatccgactaactgtgaacagactttggcgaatgaacacagtgccgtggcactttcgtcggcaatccccggcaatgatgaaaattcctcgtcgcccgccgttccctctgaacgaagtttagaattgctgaagaaatatttcggttattcgcgctttcgccctttgcaatacgaagtgatcgaagcggctctaagcaaacgcgaccaattggtcgttatgtccaccggttatgggaaaagtgtgtgctaccaattgccctctctcattcaaaataatctcactttggtc

SEQ ID NO: 93913 - DNA, 820 bp, Heterodera glycines
  SCN-specific regions: Sequence locations=1-93,115-702,724-820
gatgcgtcagacggatggacaaactctttctccgctgcccatgacccctgagggcgcgtcgcttgaggagcggcttttcctgtccaacctttccctggcagatgagttcgatgtgtccatggcgtttttcaacgaatgtgtggacatgaaccacttcctgtgggagttccagcgtgatcccacctcgcgtccgatcaccgccgccattttcgccgttgtctattcgctgatcgttctggtcggcgtctctggcaatatttgcgtccttttgtccatcggccggacgcgttctctgcagacggtgtccaacctgttcatcttcgctttgtcctgctccgacatcgtcgtctgttgtgtgtccgccacctttacgccttacaccgccttcactaaagtttgggtgttcggagttgcgctttgctctttggccaatttcaccgcgggtacatccctttgcttttccatttttgtcctcgccgcaatttctgtcgaccgttttttgctcattcgctttccgctcaacaatcagcttcggcataaccacgcgttgctcattatcccgattctttgtttgttcgcaatgttcgtcagtttccccatgattttcacacaaaaattgctgcggatggagggatactgcggcgaattttgcgttgaagattggggcacaaatgaattgtatcgtgaaatttacggcacccttctgttgattgtccaattcttcgtgcctttgctcataattaccatttgttacatcggaatttcggttcggctgaacagaaacattttgctacgccgtaaaaagatgggcaattcgtgg

SEQ ID NO: 93914 - DNA, 321 bp, Heterodera glycines
  misc_feature (299)..(299): n is a, c, g, or t
  SCN-specific regions: Sequence locations=1-231,253-294
atcatcaaaagttccgtttataatccatgtccattcaacgtccctgaaggaggactgggacaatcgcgaactgaacagcattatatccgacaacatccgccaaatttccgagtttttgagtcatttcgacgagacctgcaaggcaaaattggccacgctgaatgacaccatcacatcgatggagcgaaaggtggaatttctcgagtcgacggtgaccagaggagaaacgctgaattgattttccttccttctcatttttatttatttatttttgtaattcaataaacgtttctgaaacnaaaaaaaaaaaaaaaaaaaaaa

SEQ ID NO: 93915 - DNA, 291 bp, Heterodera glycines
  SCN-specific regions: Sequence locations=1-33,55-291
tctctcggtgtgcattgcgcgtgatgtggaggcctctgctgtcgcgattttgccaatgcattcttatgcccatgtgatgaaatcagtgacagtgccttcggtggtcattggcggtggtgcggatttgaatttgccaacttcatcagatcacgttccggcggctttcattttcgctgggccagtcaccttcgtcctgttttttgcagtcaatgcgttcaaatggcttctcccagtgttctgcaaatacgtgtgcccccgttgatgaagtgctgtggtccccaagaaagcgga

SEQ ID NO: 93916 - DNA, 471 bp, Heterodera glycines
  SCN-specific regions: Sequence locations=1-471
agttcatcgtcagcagtctcttcggcgtcctccgttggctcggacaatgaacggatcaatcggcggcacaaaaatttacactccagttcgtatgtcaaccaattgtatatgaacgcagcttttggctcgggcgatgagtcatcttcgaccgaaacgaatgctgtggacgaaaagcggaaggctcgcgtccgaggacttctcgagcaaatccccgtggacatttacacggagggagcgaaagggccggcggagtgtgcgatttgcatgggcgactttgaggagggcgactccattcgctttttgccctgagtccattcttatcacctccaatgcatcgacgattggctcctccgctccttcacttgtccggcctgcatggaaccggtggactccgcgctgctttccgtcttcacgggtaacaccagcaccgacctgaacgccctcaccggcagtgcgtccgcgtgcaattcc

SEQ ID NO: 93917 - DNA, 405 bp, Heterodera glycines
  SCN-specific regions: Sequence locations=1-405
atgttccaatttggatccagctttgattaacgttttgttggacgatgtccaattgctaacagactctcaaactgataatgatacgttgctgtttccaattgtaaaagcttttagacaacttcatgctcaattgaaggaggagcttagttgcgttttaagtggacaaattggcagtgaaccaaaaccttttactctactttcgattttggaaaaacaaccaaaaaaaaagtctgacgataaattggaaaaagaaaaagaaatgccaaattctaatggtaaagaaaaagcattgaatgaatgcgctgaatcgattgaagtgatcagtttgaaagagcagaaagcaagcgaactgaacattgataaaatgaaaaccgatgttgccaatacgacgcggaagaatgtact

SEQ ID NO: 93918 - DNA, 478 bp, Heterodera glycines
  misc_feature (10)..(10): n is a, c, g, or t
  SCN-specific regions: Sequence locations=1-478
tctttatagngctcattctagtacagaaattgtgggcattcctttaaaggccttcgtagttaaaaaatgtggtcagcccaaaggcatttgaacattggaacatgactgtgcttgtggttgagaccgttgttcaagtgttcaagaatagtgttcccgagaaatttaatctgatcactgtaaatggagccgatctgaaatttgccggcaaatcctacgttgaagacacgtggtttcccggaatgcgttggacttcttgcgtgtgctcctcctgcagttcacatattggctggtatttcgagtcacagaaggacgattttgtcggtctcgtcctcgattatttgatcagttcggaatacgccgacacattgacaaaagtgcctttcggctgaatttgttcatcactcttttggctgcggtttatttacgttaatataaatggggaggcattggtcctttttcttgtcaaacttcaaaatgt

SEQ ID NO: 93919 - DNA, 277 bp, Heterodera glycines
  SCN-specific regions: Sequence locations=1-277
aaggcgaagaacaacatcagcagcatgagagagtgttttcttcagtgactgacgcggtcaaattgggttttgtggacgaatgggagcctaaggaatgggagccgactgacaattctcttcaatccgcgttggcctgcgaaccgcaattcagtgaacggttcacacaaaactacgagcaatggttggaggaagaagtgtacggtcagcagacggattgggactcactgctgcgcaactccaggggactgttggacatttactgctgattcgatagaac

SEQ ID NO: 93920 - DNA, 464 bp, Heterodera glycines
  SCN-specific regions: Sequence locations=1-187,210-287,309-372,394-464
gtcctactagcgcacccactgaattccatcgtcaaatcggcggactttattcgccgacggagatttgccgcaatttttgttgcgattttctgatgaacgtggaaggcccaaccaaagacacagagtgttcccgaaaatgtgccaaagcatcgtttgccattggcacatccatcaaaaaacagctgagggacttgcggaggatgggctgtgccgcggcaaaaacacaatttgccgcattggaggattgcctaaagggcccagcacagtatttcaacgacataagccaaagaagcagcagcagaagtgccaacgacgacgacgagcaggacgaggaaatggcaaaaatgcgggcactgaacaagggcggaggagcagcagcaggacaaatgaccaaaattctttgaaaattatacttttggcccataaaataattagggatggattaattatttgtattctttcca

SEQ ID NO: 93921 - DNA, 302 bp, Heterodera glycines
  misc_feature (1)..(1): n is a, c, g, or t
  misc_feature (27)..(27): n is a, c, g, or t
  misc_feature (247)..(247): n is a, c, g, or t
  misc_feature (257)..(257): n is a, c, g, or t
  misc_feature (276)..(276): n is a, c, g, or t
  misc_feature (280)..(282): n is a, c, g, or t
  SCN-specific regions: Sequence locations=1-222,244-302
naaattccttttttaatcggcttttcnatcgtaaagtgcattttttttgaagggagttggggcgaagtttttcgggactttttatcaaagttttcgccgttttttcggtttcttcacagaaagggttacataacttcggttttgtaacccagtttcgcgttctgtgcgccgattacatcttatcgcgtacgcgataaacatgtggcaagcatcgttgcaggattcagatgtttcctccttacttggncggctaaggnatggatttttttttttatncccnnngccgggcggggcagggcggg

SEQ ID NO: 93922 - DNA, 229 bp, Heterodera glycines
  misc_feature (202)..(202): n is a, c, g, or t
  SCN-specific regions: Sequence locations=1-67,95-229
gcgattttttgctgctttccgttgaagaattttccccaaaattcggggtgcatataagaacaagcagaaatgtaattttaaagggaaacattttggtggtttttgaatttggtggggaattgcaagcttttctcgggtatttaaacgaaattttttcatcaatttttcattaaattcttgaatttcatccatttctggcttnttgtgggccgaggccggtcctctgcgg

SEQ ID NO: 93923 - DNA, 439 bp, Heterodera glycines
  SCN-specific regions: Sequence locations=1-5,29-29,51-238,263-276,301- 330,362-439
cttaaatgctcccgcacttgcacaatgggtggcaggttgaccaggccattttggctgaggaggaccgtgtcgtgctcatccgatttggccacgattgggacccgagttgcatgagaatggacgagacgctttacaaaatcgccaacaaagttaaaaactttgccgtcatttacttggttgacatcagtgaggtgcccgacttcaacaaaatgtacgagttgtacgacccggtcaccgcgatgttcttcttcaggaacaagcatattatgtttgacttgggcaccggcaacaacaacaaaatcaattggccaatgcacgacggccaagaactgatcgacatcatcgagacggtgtaccggggcgaacaaaaaggccggggtttggtcatctcaccgaaggattaatccaccaaatacaaatactgagcaacacaaatggc

SEQ ID NO: 93924 - DNA, 425 bp, Heterodera glycines
  SCN-specific regions: Sequence locations=1-332,356-425
gttgggtgtgcaacgacgtgtggatggacattctgccatcgtttgaccacgctcaacttggcctcaaaatggcattgctttcgccacgttttgatgcgttggtggacaaacattttgatggcaaaacgcaatttacgatttggaaagcaattaaaattcgcaaggacactgatgaaatgccaaaactttttgttgaaggcaaatcggagggatttccattgccggaccgtccgctgcccaacaaaatcatctttaccaaccataagcaccttcagattcagtacattgatcacttcgtcatcgaatttctccgctccaatcagcagatttgggacaaaggcagcagctttagttttatcgtttgttcagcagataaaaacgaagataacaagccgatttggagtgtttttgtccgtgaaatttgg

SEQ ID NO: 93925 - DNA, 224 bp, Heterodera glycines
  SCN-specific regions: Sequence locations=1-162,184-224
tatggcccaatatccggccccaaattccgccccccctgggcaaagatatgcaaattcactataggagagaggagagaaacagagaaaaagagtaaaaaaatatgcgcgagaaaacaaagaaaaataccacttaatcctgtgtaaaatccttaattcgttgtaaacccttgccccccagggcagagaaaagcgcatttgaaaaaaaattaagaaaaaaaaaaaaa

SEQ ID NO: 93926 - DNA, 144 bp, Heterodera glycines
  misc_feature (34)..(34): n is a, c, g, or t
  SCN-specific regions: Sequence locations=1-66,90-121
ggaccttttaggacgacggacgcttctgacccgntttcgtcattacttaaaagttttgatcaacaattcttaatttccatctaatttatttaatgcgatcaataaaagggttctctctgttaaaaaaaaaaaaaaaaaaaaaaa

SEQ ID NO: 93927 - DNA, 179 bp, Heterodera glycines
  SCN-specific regions: Sequence locations=1-61,83-126,150-153
agagagaaaagggagggagaaagaccttataagaatataaaaaatgattaatgattcattttcctatttttatatttaaaaatgcttgccgcaaacacataaaagagaaaaattgttctaatgaaattttaaatgaataaacaattaaacattaaaaaaaaaaaaaaaaaaaaaaaaaa

SEQ ID NO: 93928 - DNA, 513 bp, Heterodera glycines
  SCN-specific regions: Sequence locations=1-465,487-513
gagtccataagtcgatcaacgcgttacgttgcgtacctcctttccctactgagggaggcaaacgaaacaacgtcccttcgcctgtccgccttttccgcactgctcagtcagcagcatatttttgacgacgacgaaaccgatgccaacggttggctggcgccgtcgcgggcgaatgcgactcgcagacgcaaacggacgggcaaattggtggcgcaattggttggcattgtgtccaccttcctcgacgcccaatttgagttggcttacttgtccgatgtcaacgattatgtcattcggctgcgcgagtggtcggcgtcgtgcagcgaatcgcaactgtccgccgagggccgtgccgacccgacaaacgcgtggtcccattgccaggccattctgttcctcaaccgaattgggatgcatttaattgacgagaaaacgagcgacgaattgagcgccgcgattggacggaacggcgcggaggaaaacgaagtgcaatgcccatttgaacagctcgac

SEQ ID NO: 93929 - DNA, 558 bp, Heterodera glycines
  misc_feature (1)..(1): n is a, c, g, or t
  misc_feature (10)..(10): n is a, c, g, or t
  misc_feature (28)..(28): n is a, c, g, or t
  SCN-specific regions: Sequence locations=1-299,321-558
nagccttaantgctccatttgataaaangaataacctcacagcatcgtaaaaagaggcaactaccgaagcaagacacacatctcgcactcagcaacacccttctccctctcctcgtcagtcacaaaccgccaagatgtctcagtcaatgcgcatcgtccccggaaacaacaacccccagaccttcacccacacgacgcacacctcgtcggcgccttctgccccgggcatccacgacaccctccgccacggcgtcggcgtctcgccctacgacgccaagtcgtcggtccccgtgtcggcgcaccccctcgaggcccgcctcaagaactgggaggccacccaggagtccctgcgcatggagaccctccgccgctcctttggcatggccgagcccatccgccgcggcatggagctcaagattgtccgcaacggcgagtggcggcccatggctctcggtggaggtctgcctagtgtccacgaggatatcctcaagggtcgcgacgacatgattacctgggaggatatctttaccggcgatgagacgaggggtcttgctggtt

SEQ ID NO: 93930 - DNA, 480 bp, Heterodera glycines
  SCN-specific regions: Sequence locations=1-179,201-412,435-480
gttcatcaaagagatttccaccgaaggtgctgccactttgacgcgctttgcaggagcgcagcgccagcaacatttgagcggaaatcccaccggctcattgacggcctccgatcgcctgatgaaggagctgaaggaaatttaccgatgccaaaactacaaaaacggcgttttcaccgtcgaactccaaaacgacaacctatacgagtgggacgtgaagctcaaaaaggtggacaacgacagtctgcttgctgctgacatgcgacagttggccaaaccgccgcacaaccaagaccacctgctcttccacttcacttttgccaattcattcccctttgagcctccatttgtccgtcttgtttcgccggtagttgcaaacggatttgtgcttagcggtggcgcactttgcatggaactgctgaccaaacagggctggaccagcgcgtacagcgtagagtcgctgatcacccaactcggcgcgac

SEQ ID NO: 93931 - DNA, 663 bp, Heterodera glycines
  SCN-specific regions: Sequence locations=1-663
ctcactacaaacaacggccaagagaggaacaagccgaggcggacttatccgaagaggaagcggccgcgaaacaaaccaaagacgagaagggcggctccttccaaaccatttccatgatctaccgcgactcactgaacaatctgatgacttcactcgcaacgtgtgacaatttgcacgcgcgatggaatttccacgaaatccgtgccatttttctgcgccgttaccttcatcagtacaccgccctggagctgtttctcgcttcacgaaccgccatcatgttcgcatttcctgaccatgaaactgtcaaaaaggtggttgcccatttgccacgcgtcggtgtctgcgtcaaatacggtttgccgcagaatcgaagggccagtctgatgacgccgaagcagctattcaaacactcaaacatgccccaaaaatggcaacagcgcgagatttccaactttgactattggatgttcctgaacacaattgccggccgaacgtacaacgacctgaaccagtacccagtattcccgtgggtgctgaacaactacacgtccgacagattggacatgggcgatgtggccaactttcgcgacctttccaagccgatcgtcgcactgtccgattcgcgccgaaagcacttccaggcacgtgacaacaaattgacca

SEQ ID NO: 93932 - DNA, 752 bp, Heterodera glycines
  SCN-specific regions: Sequence locations=1-16,56-140,162-440,464-752
gttcgtcaaattttccaattatttttgattttacgcattttcttcttttgatcacccaaaatgccctcttcagcaccggaaattccgcccgtccaatgcttccatcacatcgaattttttgtgtccaatgctaaacaggcttctttttggcattgtttccatttcgattttcgtcgttttgcgcagcgtcagacggaaaatgcctccgaaattgccattagaaagggaccgattatttttgtcttcaaatgtagcatttcgccggacgattcggagggaattggcgctgaagtgggaaaacgcggagattttgtcaaggacgtgtcttacgaagttgactatttggacgccgttcttgcgaccctccaagaaaatggactggaattattggcacctaagcaaatgaccaccgatcaaaatggctgtttgtttgtcgcaaaaattgccggttccgccgggtccattgcccacactttgatccaaaacattgactaccgcggattattcatgccaggcttccgtcccatcgctgacttttctctcaccagcactttgcttccgtccatttctctgctttgtcttgaccacgtcgtcgaagcgcatcccgaacaatcgcttggcaatgtcgtcgattggtatcagcaaactctccaaatgcgtcgcttttggtcaattgacgacaaaacagtgcacacagaattcagcgcactcagagcactgctggtgggcaatggcggggcgagcggaagcgt

SEQ ID NO: 93933 - DNA, 794 bp, Heterodera glycines
  SCN-specific regions: Sequence locations=1-794
ctccttacaaagattcggcacgaggtagtatttttcttttgaatcttataatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccggaaccaccgccacgccgactttgtgttcgaaatctaagcagaaatatcacaaaagcgcacatggaggaaatcttcgctctgtttggggctctaaagtcctgtgagttgccaatggaccgtgtgcatgtgcatttgccccggggatacggctatgtggagtatgaaaaggcggaggatgcggagaaggctctgaaacatatggacggaggtcaaattgacggactggaaattcagtgcgaaatgacttttcctttcaaagggaccggcggaggtcgtggtcattcgcccgtcgggattaattctatgggcattgggatcaagcgcgagcggagccgttcccctgcgcgt

SEQ ID NO: 93934 - DNA, 439 bp, Heterodera glycines
  SCN-specific regions: Sequence locations=1-439
gttgaacaaccacatccaccattggtccgggctgagctggaacatggactattacctgctcatggaaaggatcagacccaagagggaggaccaaagcgatactcaaggagatcggcggttcgcgtacgtagactagcgcaaccgccaaaccaaactggacatctactggcatgagatggtgatgtgaaacaacgaggaacacatatacactggtactgacttccttcggggagcggcggctcaccttctccgaaagggcgacttaccatcccagagtgaccggaaagtcaaccgaaacgacactcacaagtccatcgcttaccttcttaacgccgaactgagcataccagacactgatcatgtgcagctacacgagtgaatggaggacccaaaacccaccggcagtggagtaacttctaggctcattctcccaaaaaaa

SEQ ID NO: 93935 - DNA, 385 bp, Heterodera glycines
  SCN-specific regions: Sequence locations=1-130,164-259,296-385
cgccaaccaaccacttacgcatccaactggcttcactcaaacaaaagcttgagtatttcaggtccaactaattaaaagtatgaaaagagcatgcccaagtaaatgagcaacacatcttcccttctagcacggattccgacttagaggcgttcagccgtaatccaacgcatgttagcttcgcggcactggctgttcagccaaccgcaaataccaatgatgcgattcaacggttcctctcgtactgagttgaattactattgggaaaataaaattccatcagtagggtaaaactaacctgtctcacgacggtctaaacccagctcacgttccctattagtgggtgaacaatccaacacttattgaattctgcttcaatatgatagga

SEQ ID NO: 93936 - DNA, 532 bp, Heterodera glycines
  misc_feature (20)..(20): n is a, c, g, or t
  SCN-specific regions: Sequence locations=1-310,334-383,405-471,493-532
gattccgtcacaaggtcttnttttggaattcctgtgggagatcttactgatatctttaatgaattttttatatccgccatcatttatggcattttatcgccatcattacagtccgccaccatttgtgccatttgtccgctcacaatatttaatgccattaatccgccactatttacaccatttggccgtgcccttttgtccctttatcaatttttctctgtgtcttccatttgtctcatccccctacttcatcattcatcatcgatcatcatcattcatttcgtcaccactttttcgcccatttgtcccttttacttccatttgtcccttttattcctttttttgcccttctcgattgactaaatgctctgctgtccatcatcatttattttatgatttattttcattgccatcactttttttgctccggtctccgcgccattgccccataaaaaacgccgtcgactttttgtccgtccgtcggtccgtcgcccggggggaggacaaaattttgtttgattgatcgccgctg

SEQ ID NO: 93937 - DNA, 473 bp, Heterodera glycines
  SCN-specific regions: Sequence locations=1-23,78-473
gaccgtccaaggaagcatctttcaaaatttatttattttttaatctttagaattatttttcttaaaaaaaattaaaagttggcgtggaaaggagccgaatctcctccaaaatattttccgttcataaccactgacaatgagacaagaacttgacaaaaacggaactgtcaaaattttcttaaatggaataaatattcttaaattaatttccccccccccccgaacaattgagcacggcgtttacctgctgtccttttgtactgcgatttgctgaccaatcgctgcttttcttctcgtcggcgcgttcttctactgccgattggaaccgttccgactcagccatttgttgaggagcagtgaacgccacacaaaagcagaagcatgatgatgatgatgatgagagcaaacaaaaaaaataaatcgaaactcttgctcattatggaaattttagagaatttgttaaatgctaaagg

SEQ ID NO: 93938 - DNA, 411 bp, Heterodera glycines
  SCN-specific regions: Sequence locations=1-341,409-411
ctcagtaacaaatcagctacaatttaagtttcccagttttgagtcttatctacctacatatgtcggacccgcaccttcaacttccgatcggtcgagtgaagcgaatttgcaaattggatccgcagatgaacactgtttcggcagatgccgttaaattgctcgcgttggctgcagagaaatacgtagctctgcttggacgttgtgcaggaaaatgggcattagctaatggaaggaaaaccgttcaaatttgtgacgtcgaacaatgtattcaaaaagattggctcttcgccattttggaagatgcgcttacggattggcctgaagataatgcagcgaatcgcgaagaagggcaaagtgatggagaagaagaggaagaagaaaatgagaaggaaacgaggaggggaggaatag

SEQ ID NO: 93939 - DNA, 487 bp, Heterodera glycines
  SCN-specific regions: Sequence locations=1-60,82-487
cactctatcaatgcttaatccgcctcaaaatgtccgactaatacctgacgttgttgacatcgaaaaggacgaaaaaggccaaataggaattgccattggcggcggtgctccgcattgtccgtgtctttacgttgttcaaatttttgaaaattctccggctagaaagaacggactgcttggtataggagatgaaattgttgctgtaaatggcaaagttttgaagggttacgagaaaaacgctgttgcctcgatgattcgcgatgtaaaaggcgttgtacgaatttcattcaaccgacttcatcttgttgcggacactgatgtggtccagactttggacattctcttgaagaagttcaaacaccggctcgtcgattctatggacgaagcaaccgccgatgcgctgggcttctcacgtgccatcctttgcaatgacgtgttggcacaactcaagacgcgaatggaccaaaagcagcaattttacggagca

SEQ ID NO: 93940 - DNA, 667 bp, Heterodera glycines
  SCN-specific regions: Sequence locations=1-667
gcacgactttccctcatttgcctttcggactatccatctcggcttggtcggtccaattcgggcgattagcgtgtcgcactggggagagttgggatggaggctgtacatcccaaacgaactcgagttaaacgcctatgaacagttggtggacgtgggggtcgagtacagtctcaggcattgtggctattacgcacttcgacacttgcgaatcgagaaattctacggttattggggacaagacattgacagcatgacgacttctgtcgaatgcggccgggttttcagggtggactatgaaaaagaatttatcggcaaagaggcgatgaacaggcaattggaacgccgggtcagcaaacggtttgtccaactgtaggtggacgggcatgacatggacagggacccttggccgcacggtgacgagcgcatctacagagatgggacattggccgggaggacaacgacggtcgcgtacggattcactctggaatgacaggttaggccgggctacgtgcagaacgagcagattggtgtcaccacagattacctcctgcgagggtcgtacgaagtggagatggcaggcaagcgatttccgagccggatctatttgcactcaggcctattgccaatgatcttcgtcgaggatccacaacgctaaagaccgacacaa

SEQ ID NO: 93941 - DNA, 407 bp, Heterodera glycines
  SCN-specific regions: Sequence locations=1-363
gcggcactctgttgcgctacgtcgcctcctggctccagtcgctggtgacctttgagctgcccggcgcgtactccgccgacgatcggctcgacctgaacagatacgagccctacgagttgttggcccgctgccgacactttgtgcagcagaaagacttgctgaacgctgtccgagtggccaatctgatcagaggcgagtcggctcggattttcagcgattggctcaacgacgccaaagcgcacttggaagtgcggctgctggttgagctgctctttgcccatgctcaggcgacgggaattaggacgacctattgaaaatggacaaacgaacgaaggaatcaatcattttatttgatgtgttttcaaaataaattatgtaaattacctaattaaaaaaaaaaaaaaaaa

SEQ ID NO: 93942 - DNA, 692 bp, Heterodera glycines
  SCN-specific regions: Sequence locations=1-253,275-585,608-692
aagccttaatatccatcaaacaaagatcaaaaatagtggagaaatctacgaggcgaagagtgattgttttgcttttctgctctcctcaaaggccggcgggtgcggactgaatttgatcggtgccaatcggctggtgatgttcgaccccgactggaacccggccaacgacggacaggcgatggcacgcgtgtggcgcgacggacagaagaaggcgtgttttgtgtacagacttttgtcgcgcggttcgattgaggagaaaatcttccaaaggcaagcgcacaaaaaggcgctgtcttcgtgcgtcgtggacgaggagacggacgtggcccggcacttcagtttagaccaactgaagacactgttcgaattcaacgcgaacaccgccagtgacacacatgacaagctgaaatgcaagcgctgtttcctcggcagagagttgaaagacccgccggaggaagccgacacaaactccgacctgacccagtggcaccactccgagagggacttcggcaaagtgccggaccaaatgctgaaggccgttagggactgtgccccggacattactttcgtgttccatcaaaagtcccatgatggtgagacaaacagatcaaattcaccgccagcagacaacgggaaaggacggagagatggggcggaagaagaggacagagaaagcgagggatgaaagacag

SEQ ID NO: 93943 - DNA, 328 bp, Heterodera glycines
  SCN-specific regions: Sequence locations=1-288,325-328
cgaaaaggaggacacgaggccccaatgcaaaacctgattggacacggccaaagaagcggccggatccacgcgcggacaaccgagcagccggccgagccaataccaacggacggacacgcgtcccaaccgccagctgcgccccgagtgcaaaacggcgaccagcaaagacacggcgaccccgccccacggccgcggcggcggggacagcgacccgcgcgagaaaagtcgaccacggccgccaggaccacgcacaaaggagacaaaacaaggcccccccaggacggtccacgggggcggcgacaacggcggccacggcggcggcggagcg

SEQ ID NO: 93944 - DNA, 818 bp, Heterodera glycines
  SCN-specific regions: Sequence locations=1-16,45-47,503-503,573 -579,608-608,695-719,746-818
gtgcctcaaggagggccactgttctccattgtgctgttgctggtctttccgaatcctcacttgagattgtcaagctcttgcttgatgctggggctgatgctgagtgccttgatgcgagtggcaacaagccggttaatctgattgctcctgcctttgattctttgtccaaatcgcgaaggaaggctttggagatgttcctcaggggtggtggggaaagagatgaactcatgagccaggagatggagctacagatgttttctgttccagagaaaaaagaaggaagtgataataagaaagaataccctgttgatatatcgctgcctgacatcaacaacggtgtatatggaacagatgagtttaggatgtacaacttcaaggtgaagccttgctcaagggcttactcccatgactggactgagtgtccattcgttcatccaggggagaatgcgaggaggagagacccacggaaatacccttacagctgtgttccttgccctgagtttcgcaaagggacctgccagaagggtgattcctgcgagtatgctcatggtgtttttgagtcctggctacatcccccccaataccggacaaggctttgcaaggatgaaacgggctgtgctagaaaagtatgcttctttgctcacaaacctgaagagctaccccctgtgtatgcttccactgggtcggctatgccctcacccaaatcctattcagctaggggacttgacatgacagcgatgagtcccttggctcttaattccacattcttgccgatgcccactgtttcaacccccacccatgtctccctttggcagaag

SEQ ID NO: 93945 - DNA, 727 bp, Heterodera glycines
  SCN-specific regions: Sequence locations=1-727
aaatcctttaaaggcgatcaaaggagcgactaatgggattggattggcaattgctgaacgattaagccacttagggagcactctctgtgtggtcagcactacagacgaagactatgtgaagcgtgcgatcgatcggatcgtctcttcgtgactgaagcgttcggaccttgccggatgcacttgccatgtgaccaattctgaggaccgatgtcccctgctgaaactgaccatccaacggatcagaagtgtgcacattttggtgaacaatgctggcatcaacccaattttcagtgatttactggacttgtacgagtcaccctgggacaaactgttcgacgagaatgtcaacgcggacttcatgatggccaagctgttctcgccagaaattgaacgaatttgtgtagggtccatcgttttcaactcatctatctgcgcctatcggtccccccagggaatcgctgcttacgggatcacaaaaactgcactgctaggtcttaccagagatctggcagaatcacttgcacccaaatggattctcgtgaatgcaattgcgccagggattatcaacacaaaaatgatcaaatcgctttgggaaggcattgactaacggaccagtgactaagccattgtcacacttatgggacggctgggaatgccggaagaatgtgctgcactcctcgcttttttctgctcttctgacgccagttacataacgggcgaaactgtg

SEQ ID NO: 93946 - DNA, 486 bp, Heterodera glycines
  SCN-specific regions: Sequence locations=1-486
gccctcaagggaattgcgcttggggttacaacgcttgagcaccttattatgcggcccgacttcggggagtcacggcacggctttctcgaccagaacagagagggaattttctcgctgatcggctactgcttcatctacgcgctgtcgctgatgtacgcgcggagcagcgccaaactgacgctaagagacaagaagctgtccccgctgaatgtcgcgggcgaactcggcttcagcctgtgctgctactgctcgcagagggtgctcgaggcacactttggcttgagcgcctcccgaaggttggccaacttggcctactcgttcgccatgttgaccctgttcagcaccacctgtgccctgttccagctcattcagctcgtcgttccgttgccgcaggatgcgcgccggggtggacttgtggcagcgatcagccgaaacgcactgctccattttctgtgtgccaatctgatgactggcttcgtcaatctg

SEQ ID NO: 93947 - DNA, 471 bp, Heterodera glycines
  SCN-specific regions: Sequence locations=1-7,30-375,397-471
atctctcaatccctttgtcagtttatcattctttgttccattccttaaagatataatggaacaatatttttaattgatattttttagaatgcgttttttaccgtcgtgattatttaaaattttcttaaaagcaaaattaatgggaggcaaacatctgaggcgcaatcatagtcactagaagtaattggacgataattatcgcctagaacaaagcctgcgggtgttctattttccaattccttcaaaatgtcaacccttttatatgcgttaattaatatgtcactttacattgtcaataacataagtgatgcgcgtgtacaagcaggtggcattcacattgacctggaaaatgaaaaattgatttgcctaattattccttaattaatttttacataatcgcaagtgtcacagatgggacagatcaattcatggctaattcgtccttggcatacatcattgctaaaaaaaata

SEQ ID NO: 93948 - DNA, 670 bp, Heterodera glycines
  SCN-specific regions: Sequence locations=1-648
ctcagtacaaccagtacaaagaggagcaggagcgcaaattggcgcctcttcaagacgagctaaaggaactccgtgataaaatggtgagcagcggaaaggagtgactgaccccaaaaaagagaatttccgtctgcctctgaccaattcatttcattccctcccttttgcgttgtgttcttcacaattcttcactttgtgttgcgtaacttgataatgtccgaccattgtttgtctcactttctttccattcccaaaatgcctccgccgtcccttccattcgaaattcgaatagttttgccgtaattcataaaattcagttgcttttaatgttgtgaatgtttgaagatcccattcttccggtattccaatgctttgttagttcgttcgaccaaattgcgtcccctttcgtccctcctttgggtggtcccgaattctttcgtttgttccttttagtgcctgctaatttaacttatttcatttcaacaatcagtttgtttttttgttttgctttttctcccatctcatccaaatttgcgtattacttaaataaacacaggggcttatgtgtacacctttgaaatttctacgttttattccgtcatttgtgttatttttcgtttgccgcttttcattgtttggtgttgtatcattaaattaaataatattaaag

SEQ ID NO: 93949 - DNA, 589 bp, Heterodera glycines
  SCN-specific regions: Sequence locations=1-112,143-316,338-589
aactatacaaatattccctatcgtttaaacaaatgcatcgaactcttagcgatcgcgcggtggaagaggtagaaacgcgggacaaaaactgctggcagcagcagcgcacgcagcttttcccgggggaaaaaatgaattgcttcacacaatgtcggcgatcgaaaatgacgagacaaagagcagaatttggcagcaactgaagaccaaactccactcgacgatggtcgccttcggaagcgggtcggtgcagttgcccaagctgatggacacgttcaggcatgattggggctccgaattgacttcgtacgcggtccaactcggcttcggctgcaacgacgcggcggtgtacaaaatgttgctgacgatgcccgacgaaattgaaagcggcttcatatcggccactggcaccttcgcgttcaaagtgattccgaaggcggagaccagcgaaaacttgacgaagatcgaccagagcaaccaataccaagatgaaatgcgaagaatatttgcacggcgtcgctcctcaatgtcgagcggcttccatcgttcattccctttcaaccagtctttccatgtgcgtccgcctgtcaga

SEQ ID NO: 93950 - DNA, 592 bp, Heterodera glycines
  SCN-specific regions: Sequence locations=1-533,556-592
gttcctcaacgaaatcgccgagtcatttcttctaccgcaatatctttagaggccatccgatgggttcacatggaaaacggcgaaatgtttgcgtggcaaagaaaatgaacaaatcgttagggacgacgaagccaaaacgctgctgctcccttcacaacaatttttggatggacattttccccttttttgaccatgctcaactcggcctcaaattggcaatgctttcgccgcgtttcaatgttttggtggacaaacatttcgatggcaaaagcgaattgacaatttggaagctaatccaaattcacaatccgagaacggcaccgaaactttctgtgctcgtcaacaatcgcaaattggtgccatttccgttgcccagcaaaattcactttaagaaccttcgaattgagtaaagccattggcaatttgccgaagatgatttttggacgttttgcttcgactcacttcgccctcaatgctcaccgatctcaatcagttggcttcaatcaattccaatcgtttgctgccaaatgcaacttctgctgctgctggcaaagcgttgtttgaatggttgcactctccgacgaaagatggc

SEQ ID NO: 93951 - DNA, 244 bp, Heterodera glycines
  SCN-specific regions: Sequence locations=1-244
aagtcgttttcgggccgtatctaaaaaagttgggaaggcattgtttctcgttgccggtggcccactgattgagcatcacatttcgcagctttgcgaagagttggaaaacctccacgaaatttttattgttggattgtacccggccgaagaatttgggaagtttatgtctgatggggagaaaaagtatcgagcgggggcaagtcgattaattcaagagaactgtccggtgggcactggcgggggg

SEQ ID NO: 93952 - DNA, 404 bp, Heterodera glycines
  SCN-specific regions: Sequence locations=1-404
tcctattcgtcccatttttgcccggatgttcgtctttttatttggcacctcctatttctccttgtgtctcctccgatatcgccaaaatctgcggtgaaccatccgttgcgcattatttcgagtgctgtggagacagtggcgcagattgttgcctcagactgaacacgtggtccattgtgctggtgtcgctgctcgccttttgcctggtcgcttgccttgtgctttgcttggtcaaatgcatttgcctttgctgctgctgaagtgactttttttgaaaagaaaggaacggacggaggagaaaaatgagcaaaacgaagttaaaatgccatgcgatttcctgtgaattttgttgtgatttgtacataacatatatgttattaatgtatatttgtaaatactgaata

SEQ ID NO: 93953 - DNA, 469 bp, Heterodera glycines
  misc_feature (467)..(468): n is a, c, g, or t
  SCN-specific regions: Sequence locations=1-9,31-469
acccattcagatttttcttgaattcaaaaatgacggaacgccatgtcttgtatgtgctgttgagtgccgatttgctcgacgtgttgcgctggccccttggcgcggtgttcacgcaaattgcacacgcggcaaccgcatgcatttggacgttccgcgaggacccggaggttgccgcttatatgaccgacatggacaacatgcacaaagtgacgctcaaggtgccagatgagaaaacgcttttggaacatgccaaacggttggctgacgaaggcattgggcacagagtttggcacgaggatggcatggctgtttgtattgcggtgaagccgatgccgaaacattagctgaagccattccttggcaatttgcctttgtacaaatgaaacttattcatgaatgatatctgtctgattgcttattatacttttttggtgaattttaaatatttggacaaaaaaatgaattanna

SEQ ID NO: 93954 - DNA, 718 bp, Heterodera glycines
  SCN-specific regions: Sequence locations=1-718
gaccctatttccataaaaataatggattttgaaaatgccaaagtcctcctaggggatgccgtcaatttggaccagaagggcgccaccgaccaggccattcccaaataccttgccggcattgacgcactgctgccatgtttaaatgattttgagggaccgaaaaaggacgcactgcgccaacagatcgagcggtacatgtcccgggtggagacgctccgaggccgcaaaatggtcaaggtggagttcatggagcagcgccggattgtggaggactctatcggccatagctacgagtcaatttttgccaaatgtttggacgacaaagtgaccgaagttcatgtctaatacccgtggctcgccaattaccaccaagtgagaagcggtggtcatcatttactggttggtcaatttggtcaagttctgtgagctgttggtgcgaaagtgtccaaatgtgcgccgaattttacttcagacgacacggcccaacggaccgtcggcgcaaatggacgaagcgctgggccaattgggcgacagtttacgcacaaaaaacattgtgttgacggtcaattacgcggacaatatgcacgacagggaaatacggttcaacaatggctgggttgtcaaaatgggccgagggttggacatcttacaaaatgtggacaagttctcgatcggatcccatgactaccatctgagggccgtgcaaagcaacactgat

SEQ ID NO: 93955 - DNA, 255 bp, Heterodera glycines
  misc_feature (4)..(4): n is a, c, g, or t
  SCN-specific regions: Sequence locations=1-190,212-234
gtanccccaatgatcgaacattaatgggttgttgtgccgaaggaccctttgatgggcggtgagtcttccgccgaggctaatgttctgattttgaaaagttgagcaagatacccactccaacgtgaacaaatgccaaagaaagacaaaacgaaagccaaagtaattaatgaagcaattaaagcaaatgacatttattctgtttcctctttatacggtctgaataaacaaatgtataaaaaaaaaaaaaaaaaaaaa

SEQ ID NO: 93956 - DNA, 636 bp, Heterodera glycines
  SCN-specific regions: Sequence locations=1-60,84-118,140-636
actgtcagaccgaatgagattgatgccattgaaacactcagtcctttgaattatgccaaccgagccaaaaacatcaaaaataaggttgttgcaaatcagaacaaaatcaacacactgctcacagcgccgccctccgtcgacattgccatatgggaggcgtggaacatggagttggacgcgcatctggggacgaacatgccggaaatacccgacccgatcattcaactgccctcgcttggcgcaccggacgacgtggaagcggtgatacgggcccgggaacagttcaccaaacagttggcacgtttccgtggatttgagaaggccgagcaacaaaacgtgaaacttttcgacgccaaattgcgccagcgtctgtgtgtggctgacattgaccgtgagcgcgtgctgtcgctggaggacgagttgggaagagttaaaacggaactcactgtgcatgcccgggagaatcgccagctgaagcgcaagtacgccgcactggagacgcgtacgcgagaatacgagacggaactcgaaaacgggcgggagcagatggaacgtgccaagcgctacattgaccaggagaagagaccggagaaggacgcacgtcgcacactgctcaaattggctgaaatgttcgag

SEQ ID NO: 93957 - DNA, 646 bp, Heterodera glycines
  misc_feature (429)..(429): n is a, c, g, or t
  SCN-specific regions: Sequence locations=1-25,73-262,322-646
ctcgccccaaagactcagtcaaatctcttcttcctcctcctcttcctcttcttcttcctctttctcctcttcacatccctcggcaattggggaacacaacgtggaccgatccatcgacgaattggaggaatttatcgtacaacaaatggccaccccagcaccgtacccaactgatggcaaatccttttacgatacgaacgaatgcgccgctgctgcaagtgccgtccctttgccccgtcgcttcgcttctctgtccgatttgtccccctctttttcctcctcctcctccccgtcgtcctcttctagcagttcgtcctcctctctcaactgcggcactttgggccggagaaagtcgcccgccccgcagacgccaaagccaaaaagaatggcccccggcgaatgggactatttgcgcgtgtacacggcacnaatcaaaacggacacggactacaaaacgttgcaagtgcccgcgggggtcagcacagaatgcgtcattcgccagttggtgttggacaaactgcgtctgtcgttgcgcgacctgaacctattccatttgttcatggaggtgcgaactccgcgcatggacggaacggaggcacgcaagattttggagttggaccgaatggcacgaccgctggatctccaa

SEQ ID NO: 93958 - DNA, 523 bp, Heterodera glycines
  misc_feature (2)..(2): n is a, c, g, or t
  SCN-specific regions: Sequence locations=1-523
cnccgtccacggttccgcacgaggtttatgtttcaaacattattcttattatggcctgcctttgttcggttcgaatcgatgagaatcaagaaaaagagggatttgcagccgttggttgcttgacaaccccattcggttgggaggggttggccatgtggtgcaaatagatgaggcacttattgcgcgtcgaaagtatcaccgggggcacagagtgcgcgaaatttggttgtttgggatgtatgacgtgcacaccaacattggagtggttcgcatcgtaccagacagatctcgtgctacactcttgccgataattgaagaatttgtggtgccagggtccattttttattccgatcaatgggccgcatacatgggtggcgcaattccagccatccctgtcatcccgccttatgtccaccattctgttaatcatacaatccactttgtggatcccttgaccggagcccatactaaccacgtggaatgtttttggaagaatctgaaaatgaagttcaaggccatgtcc

SEQ ID NO: 93959 - DNA, 316 bp, Heterodera glycines
  misc_feature (7)..(7): n is a, c, g, or t
  misc_feature (79)..(79): n is a, c, g, or t
  SCN-specific regions: Sequence locations=1-316
tatgagncggcttggtttgcttccctataagggcggtcatagtgacacagtcaccggtctcagtctgagtccggatggnaaccacgtgttgtccaattctatggattgtactgctcgcatttgggacattcgaccttatgcaagctcacaacgatgtgtgaagacattgactggacatcagcacaactgtgaaaagaaccttctccgttgatcttggtcaccagacggacaccgagtttcatgtggatcgagtgagcggttcgtgtacatttgggacggtggttgcagaaacattgattacaagtggggggggcat

SEQ ID NO: 93960 - DNA, 253 bp, Heterodera glycines
  SCN-specific regions: Sequence locations=1-230
atcaaaggtttcggaccgactttgtttcccatgcttttttcttctcatttgccagcctttgttttgtttcacaaagtacaaagccaatgaatgccccaggggcatttgtatgtttcccgtatccatcaaattggacatattccttgctgtattgttcgactgtacattcttaaacgtaacatgtaacattttgatagttactttacgattgataaattagtgttgctgccaaaaaaaaaaaaaaaaaaaaaaa

SEQ ID NO: 93961 - DNA, 439 bp, Heterodera glycines
  SCN-specific regions: Sequence locations=1-439
cttcgttcgacaaactgttgctttttgaccgtcagcagacggtgggcattgacagatcggcgtatttgcgggaggcacttcgccttccccaaagtgccgcaaaggtagctgtgtgcagggagacgggcgacgtggtcggcttatgtcaagcgcggcatttactcggcgatcggctcggcatcagtctgttctatgccaacagtgagtccatcgcctcggctcttctccgtgccgttctgctccaatttgcgggccccgatccctccgccaagttcgactcgttcatctacaaaactccgtccaccaacacggagtccatccgtctcttccgccaactcggccaaaatgggccggtcgaacgtcggcttttctacccgcaattctcgcgttattcgctgccttttcccggcaatcgcattttttcgatcggcgatgagca

SEQ ID NO: 93962 - DNA, 633 bp, Heterodera glycines
  misc_feature (628)..(628): n is a, c, g, or t
  SCN-specific regions: Sequence locations=1-171,199-395,418-436,458-633
tgtcataaacctcttttatttggcacagattggcattgcaatcctctcctgtgtccaacaaccatttgttcctgccctatcagcgcaatccgatgcccgagtttctgatgaaggggctgaacatcagtttgtccaccgacgatccgcttcaatttcacatcacaaaagaggcactgatggaggagtacagcatcgcccatcagttgtggaagttgagttcgtgtgacatgtgcgagatggctaggaacagcgttatccagtcaggatttgaggaccgggtgaaagtatattggttgggccccaactacaaggaggagggagtgctcggcaacgacgtggcacgcaccaatgtgcccgacattcgcgtctcattccgtcacgaggcgttggtcagcgaactgtacaatttgttcaaggcactgatgctgtgaatgaaaagcgggtgaaggaggacgacgatttgttttgttttcgttttttccaatttcaaattgcccaaaagacgagaagaaaagaagcgacacacaatacaatacaaaatagttaattatccattattcgatcgggttacatttttcgattttgcataccgatgtgttgttacaattacatataaacattgaaaaanaaaaa

SEQ ID NO: 93963 - DNA, 611 bp, Heterodera glycines
  SCN-specific regions: Sequence locations=1-16,39-306,330-455,477-611
attcatgagggcatatcaaactttctgattttgggctttgtacgcttcttagaaaaatacaccggacagaactttaccggaattggcccagccaactgccaacagattttgtctctaagcctttcgagtcgaaaaggagagctgaaacttggcggaagaatcgcagagcatatgcgtactccaccgttggtacgcccgattatatcgcccctgaggtatttcaaccgaatgggtacacaaaatcatgcgattggtggtcacttggcgttattatgctatcccccgttctgctcagagactccccaggagacatacagaaaagtgatgaattggcagcaaattctcgcttttccgcccgaaatacctatttcaaccgaagcaaaaaatacaataaaagggttctgttgcgaagttgacaagagactcggcaaccattcgggcattgaaagcatcaaacagtgccctttctttaagagggtcgactggcagaacataaggcttttgccggcccccattcgcatcgaagtgaagggaattgcggacacttccaacttcgaccactttggggattccgatttggccttgcccggcgttaaggaagttgcctctga

SEQ ID NO: 93964 - DNA, 349 bp, Heterodera glycines
  misc_feature (328)..(328): n is a, c, g, or t
  SCN-specific regions: Sequence locations=1-14,38-182,204-310
attcatcaaactaatcccaacatttccttttgttattctcgacccttacacaatgccgacttatttttgacactttcctttccgtttgtaagcgccttatctcttggattagttgtttagtccgcctttgttgttacgcctcaatttgaattttattcttggccttaacattgtatataccatcttattttcttttgtcccttccctaagcatcattagtccctcctcgtttcccatttttattgtttttttttctgccggtgcttccgtttattctcgtcaccgactttttcaatttctaatcacatgcataaaatacttaatttcnaaaaaaaatatttaaaaaaaa

SEQ ID NO: 93965 - DNA, 481 bp, Heterodera glycines
  SCN-specific regions: Sequence locations=1-481
tcctgctgagctgacaatgggtgcgccgggactcgtaattgacttgcgaatcgaaaagaaaggcacggaatatgaacagccaaagacgagggcattctcgggccagggaaacgaactcggcacaatcacgccgaacgtgggagggtcggcggacgttgtttttgttgatgcgccgccaaagcttgcggcagaggaaactgccaaattggtggaacaagctcaagccgaactgaaggaggatgacaatttgccaaccactcagcatcaaattcaaattccggacacggcacggaccatcgtagcgcgtcttaaccaagggcacacagtgtatcagctgcgcatttgcattgtcactgccgacgcgagtttgggctagcgtcccttgcgccttatgacttcataccccactcgaccgattgacgacgagggactcagcgtcaaagacgccggactgctcaatgcgacggtgctgggtaaattg

SEQ ID NO: 93966 - DNA, 641 bp, Heterodera glycines
  SCN-specific regions: Sequence locations=1-228,250-641
cgccttaagccaccatgccccgcctctcgctcgccgtgaccctcttcgccacggccctgctcgccgccctccttcttgcgcccaccgcagtcaacgcgcacagccgcctgctgagcccgcccacgcgctttggcggcttttgcgcgcgccgcgacgaagtgtgcccgccctgcggtttccgcgacaaggaccacgcaaagcccgagaacaccgtgtacgcccgcggccagcaggtgcccatggtgtggccgcgcaacaaccatgcgggcggattcgtgtcgttttcgatcgttccgttcaattggaagcagacgtttgaggagtttgacgccaacattttccaattcaactgcaacgagtcgggatgcaagtcaggatatcctgaagatttgttcggagaagatcccaagtggatgggcgagaacgaaaaccattgctcgagcaacttggagattcccgattacttgcccgacggccagtactcggtcaagtggcagtggtttgctgtcggcaactggtttggcgattacaaccgcggccacactgactactacggatgccacgacttcaccatccgcggcggccgtcccttcaaccccgcctcgcgcccggcctgcccgcgcttcatccccggcgacgcc

SEQ ID NO: 93967 - DNA, 652 bp, Heterodera glycines
  misc_feature (394)..(394): n is a, c, g, or t
  SCN-specific regions: Sequence locations=1-191,213-652
gtcctttaaagttctagtggataagttaatttactctgcaaaatcttcgatctttcagacgaggatgtcgcaaaggtaaaattcgcgttcgaaatctatgacgtagacggtattggtgcaattgacggcaccatgttgggagctctcctgagggcgctcaaccttaacccaactgagggtttcattgagaaattgggaggaaccaagaagaagggtgaaaagacaatctcattagaagaattcctgccaatctacagccaagtcaagaaagacaaggaccaaggagtgtacgaagatttcattgaatgtttgaaattatacgacaaggcagaaaacggacttatgtcatacgctgaattacatcacattctattgacccttggtgagaaattanaagagaaagaagttgacgaaatcttcaaggactgcatagaccccgaagatgatgaaggcatgatcccatatgttccattcttggcgagagtatgtgaaaagcccgttccaaaatcaattattcctgaataagctggatctcgacgccacaaattctacattctgagccacatcatcttgtcaataaaccaaacagcgagacaatgcgtgtcagcggagccgctactacaaatctgtacaaatgtatgatctgatgtat

SEQ ID NO: 93968 - DNA, 355 bp, Heterodera glycines
  SCN-specific regions: Sequence locations=1-26,119-314,339-355
ggcaatacaggaagctgaaagggaatggaggagaacggaggaaccgaggaggatgggagagggggaagaaaaggaagtgagagaaaatggaggaagcgaagagaaggcggaggaggagccgcaccgcctggacaagctcctcttttggttttacttcttccgcaaaatggtgcccgcgaggatatttcggatgaaaaaataatgtgccaaagtgcgttgtgcccttccctctgtttggcttagcccgtggcattatctcctctcctcttttgttctgtttttcactttttgttttgtcataaattatgttttcgaaaaaaaaaaaaaaaaaaaaaaaattttttttaaaaaaaaa

SEQ ID NO: 93969 - DNA, 788 bp, Heterodera glycines
  SCN-specific regions: Sequence locations=1-246,268-788
gtccaataaagataataatttcagctcaaatgttccttttcctccccttttgcttcgtttctttgctcttcgcattaatgtccaaaatgacaatggcatcctcaaacgctccacccgaactgctcccaatggagggccaacagtcgcgcattcgcattccgttgggcaccaaaatgttcaaattgaaatgccccgtcaaaatggacgaggaccaaagcggagaccaatcggaagaagcattgatcatcaaatggagcaaggatggggcaccgctgacaggcgacgaccatttccgcgtgctgtccaatgcggaaagggacttgcgcatccgaacaccgcaagtgaaggacagcgggaggtaccgctgcaccgcaattaatgagtggggacaccgcgtcgtcgacttcgaattggaagtgttcgacccgaacggaagtgtcggcgcacaaaagggcgcattagcggacggcggctcgtcgctgagcgaaaaagtcagtgcccccaaatggcgcgacccgtccactccccgtcagacaaagattcatttgactcccggcgccgccctgcacctccaatgcccgccatcggtcggcaaccctttgccccaagtgatttggacgagagagggcgtccccgtctcgttggaattgaccaacccaaacgcggcttcgttttcgctggacaaagtccctcccaccgactcggccacttattcttgcaaagtccaaaatcagctcggctccatccaagccgactttctcgtccaagtcggctcttccacctcccag

SEQ ID NO: 93970 - DNA, 289 bp, Heterodera glycines
  SCN-specific regions: Sequence locations=1-89,111-154,177-289
aaagactcacatcgttatcgggattgcctcagtgtgccctctgttggctatcatggacacaatcttcactataccgtctctgaactcttagatgagccaaatgaacagcattttgcgcgactgacctgaggcattccccagcaacacctactccgcctggactgacttgatggacgcgcaagtggccctgacgccgccgcctaatcctcgggataaccccttcaactccatcttccgagccatacgtcaactgccctgacactgccagtgcgctggcatcctacaccca

SEQ ID NO: 93971 - DNA, 250 bp, Heterodera glycines
  SCN-specific regions: Sequence locations=1-2,25-103,133-215
agtataaaagaatcaaagaaaaaccctaccttatcaccaatttcataagatcaatatcattgatgaccaactaccttaatagtcaagtctgaactagtgttagaaaaattaaaaaaaaaaagtaaaaaaatagaaggaataatttgagaaatcaagaaaaaaattggaataaaacatatccaaaactccaataaaccaaatcctaaattaagattaaagaaaaaattaaaaaaaaaaaaaaaaaaaaaaa

SEQ ID NO: 93972 - DNA, 668 bp, Heterodera glycines
  SCN-specific regions: Sequence locations=1-11,44-373,395-506,528-668
tgccattgctgaacaacaacaacaataacaacggcaataacaatcctgagaatgatgggggagagcacatgcaacagcctaagggactgttaagggttgccagtgcccgtgagggatgtgccgtcacaaccaagtcactgtcatcactgtccggcgccagttgcaaccgaagtccgtcattgtcgccgcgcagcggcggcgctggcgccgggcgttggcacacgcgccggaacacttgcgcaccgaccacaacgcaaatgccaatgttggccggcgcccacacaaaaaagggcgccatcggcgcaggcaataatggcacaatagccaccaacattctgtccggcagcagtggcgccggcggtccgacaccgctgacactgcaaataccgtcaattgccgaatgatcaatcggaacactacccgggcgggcggctgatcagactcactccaacgatcaccgcttattgatttattgattgatcacaaagttaatggttcagagccgaatgatgtttttgttttatttatacccttaggacacagtttttcatgcttacagtaatgctacttctactattactattccctcatcccctcacattgattttttgcccatagatatttgattgaccgaattgtttgtcctactgtaaccaaccgtatgccag

SEQ ID NO: 93973 - DNA, 469 bp, Heterodera glycines
  misc_feature (32)..(32): n is a, c, g, or t
  SCN-specific regions: Sequence locations=1-215,237-469
gtccgtgcatgagggatcgatatcaaggaatnggaccatgggatcttttaagacttacccatcgactacacaacttatgtccatcggatcgggcgcactggtcggatcaaagaaggagcatctacatcgttttttgatctcgcggaagatgttgagctggcgaaagaactcgttgaaggactccaaaaacaagaccaagaagtgccggattggcttaagctggtggctgaggggaaaatgccacttgacgagtcggaagcagccagcggtgcaaattcggtgccgatcgctgttcgcgttccgtcggaaactgttcctgacaccaattctttgccaactttttttactgttccgactgataatgtggctgcaaccggtgctaattcggtgccgcttggaacccgcgttcaagacgacggaaccccgaatggagaagcaaaggacccagccatccagaacaattctgctc

SEQ ID NO: 93974 - DNA, 713 bp, Heterodera glycines
  SCN-specific regions: Sequence locations=1-121,143-713
atctcttcagcagttttcgcctatattttatcattttgcacaatcttcccgaccatcgaatgctttttcgtgcgtcgacttcgattttgctaaaaaatcacagaaaatcgttgctgtccgctatttccaccacaatgcaagccaattcatcaaccgcttcttcggcttatctgatcaaccagcccaaatatgcattccttgccgaattgggcatccaacagcaaaacgatggggtgtttgacggcacatggaatgcgtcggggacggaagtcgactcattgtgtccagcgacgaacacaccaattgcgaaagtgcgattcggaacggcggaggattatgaacgtgtgatcaaagcatcgcgtgccgccagtgccatttggatagaaatgccggcgccaactcggggcgaaattgtgcgccaaattggcgattctcttcgcaaaaacattgacaatttgggcaaactggtttcactcgaaatgggcaaaattttgtcggaaggccgtggcgaagtgcaggagtttgttgacatcgccgattacgcaactggtctttctcgaatgttttccgggcgtattatgccatccgagcggaagaagcaccttttgcttgagcagtggaaccctctcggagtggtcggtgtcatcagtgcgttcaatttccctgccgccgtttacggttggaatgccgcgttggccctcgtctgtggcaat

SEQ ID NO: 93975 - DNA, 495 bp, Heterodera glycines
  SCN-specific regions: Sequence locations=1-128,152-197,219-386,408-495
atcctaaacgcccccgcggaagcaaatgagagaggaagacgacttcagcggaattgacagttggagtgtggtggggaaaaacaatagtatagtacgacagcggataatgagtgaattggagaatattgtgcccgatgattgccccctttttctgtgcaatttttgaatccctttttcttgtaaatcgttgacattcccaaaatatcccttgtttatatttaactgtttcccatctcttagtgtctgtattaaaatgccataattcgccgcccttttacttttttgttcattgtctgtttttcttcaacatgttcaatgtgttcccatttgaattttgttgtgtttaaattattctgtcttaattgtctttcgatgttttattccgattcttcttctgtctctcctttcattttcacatgtgtagaatctttcaaattgtctaaatgcttctttcccagattccaagccgattttgataattaattttacaaaata

SEQ ID NO: 93976 - DNA, 645 bp, Heterodera glycines
  SCN-specific regions: Sequence locations=1-71,106-414,436-645
ggttccatcaagtttcgcatttcattcccccaatgttttccatcgtcctcatacaatttttctcgtcgccgttttgctcacttttttctccctctttttgtcctccaccgacggggccatcgcgcgacgccaacacaacacgcagaaaaaagcaactgatccaaacagcagtgacgagtacgattatcgtgtggacgatgattacagtatcggcgtttttgttgacgcggtgccaatcgccaaaaatggggacgaaagtgccaaaacaccacagacaaatgaggacggaaaggcgtacaaacggacgaataggtacccgacgaaaaagctgcgcagattttttgttgaatcaaaagcgcggagggaatggtacgaatcactgttcagcagaacggcggagagacggcgaagataaaagagagagagacgggggacggagcagggactgtaatcagcgcaaaagcagtagccaatcaatgaccgtaaaatgcaatcaaccgatttactactggttgattacggtagccaagcgagggttcaattactcggctgaccagcagcaagagaccgatcagaggacgattcaatggttctgatcagtttaatgaatccatagttctcaaacggattgccataattctcccg

SEQ ID NO: 93977 - DNA, 543 bp, Heterodera glycines
  SCN-specific regions: Sequence locations=1-517,539-543
gctccttctccgcaaaatgtgtcgtctgtggggtcgcattcgctattgcgagggctgggaccccgttgaccaggcccaactcgcgctgaagtccttttccctgaaggatgtcaccgccgtcttcatccagttcgacccgttgcatggcgactccaaatcgttacgcgaattttggcatcgtctcactctgccacaagtgcgtgccacaaacccaaaaatgcaagtcaacgtgaagatgctctccgacggatgtcgtccccaatttgtcgccaacctccacgatggtcgccaggtggtgttcaaaacggacggctttcagctgcccgacctgttgatgcgtctgaaccgtctgctcggtctgcccgcggtgggactgcgcggtgagccggacgaggcactgcagcagcgaatccccgaagccaaaatggaggctcattttcgtgcgctggcaaagaaaagaaagccaatcgatttcctttcatgatttatttttgagaataaatcctcatttttgttgttatttataatttaaaaaaatgatta

SEQ ID NO: 93978 - DNA, 800 bp, Heterodera glycines
  SCN-specific regions: Sequence locations=1-137,160-277,299-444,466-800
accgttttgcatccgtggactactaaccaaccaacctctttcctttgatttgtcttttgtccgactgtttgtcggagctggccgtgctgttcagctgctgcaactgttgcttttgctcggcaccaacaccgcgtggtgttgttgggccgccgctgctgagcgcggcagacgcagtagaaaatgaacgtgtcaaccgctttttggccttgaaaattgccgagtctccgctgctcagcgcctcgttgtattcttggacaggacaacgcggcagttcagcctcagacgacgacgaagaagatggattcttgacaagggactttcagttattttgacaaatctacggattgccaatcaccttgctgaacccacaggcacaggacaccggcacacacgaatcccaatagtcagaatcaaacggaatagtgacctaaaaagtaagggcgattggcattttaaataaaacaacacaaagaggtgggttttgttgacaattctgcgatgccaaacgaatgttttataaaaatgatggccaacatattggatttggaattttgtaatgctttttccaatatctcgaccccaatttggacaaaagacaatatctgggaaatcgggattaaatgacaagcgctattccccatccccccttcgataccatctacaaacaataaatgtacctcattggacttgtcaatgtccgctgtggccccccaataaatgtgtatttgaccctccgaaatggcatgtctcaccgccgcgtttggcctacacgacttgcgcacagcgcgcgcatctgaccc

SEQ ID NO: 93979 - DNA, 734 bp, Heterodera glycines
  SCN-specific regions: Sequence locations=1-734
ggacccttatgagcgacgctcgtggaacatgttctccatccggcgcctttgcggcatggaaagacgatacaattccgatgggcgaattgaaagtcatttcccagattggaattggcagatttggagaggtgtacgaagcgtattattatgagccagctgtgataaagttcttcgacatgttccatgtggatgagcagaagaggctggagacattcaaacatgacacggcctgtttccaaaatgtccgccatgaaaacttggtgttcttccgtggcttctacacaatggagttgtgccggtttggcattgtcatggagctgatcggcgggcacactctttcacatatccttcacgaggagccgacgccgcacatgaacagatcggcgttggagttcaacgaaatcatggaatatgccaaacagatttgccagggtatgtcttatctgcacaccaagcacatcctccacaaggatttgcgttccaaaaatgtgttcgtcaacgagaggagaacagtcaaaatcaccgactttggtgtgttcaacttgaaacggctctcctttcccgcgaggagagattcgtttctcgtcccatcccattggctttcgtatgcagcgcctgaattggtccagattctgtcgcatacctttgaaccgtttcaattcaccgaggcatgcgatgtttattcattcggtacaatttgggttgagctgttgacgaatgcatttccattctcc

SEQ ID NO: 93980 - DNA, 462 bp, Heterodera glycines
  SCN-specific regions: Sequence locations=1-439
gtccatagaaggaaatttaccagtgagtgcgaaggtcaaggcgggctttcatggtgctacatttgcaacacggacggatgtaacaaaagttggaaaaattcaactttctcttccactactccgacgagtacttcgaccaccaccaataaattgtcctctacgcctctcgcggaaatcaaaaataaattgcaatgtttggcatggaatatttgcaatttgagcacgaaattgaagcagtcaaaggtttcgcgacggttttcaattggtcaaaactgcgaggaaatggccaaagactggggacagattgaagaagatgaaaaaatcggagatgaatacgaccaaagtgccgacgaagatggccaagtgtttttggcggattttttcgttgggcgaattaatgcaaagatttaattgattttctaacaaaaattccaatttgaaaaaaaaaaaaaaaaaaaaaaa

SEQ ID NO: 93981 - DNA, 577 bp, Heterodera glycines
  SCN-specific regions: Sequence locations=1-577
tccctaaaagagccaatgtttcgccgttgtccgtcgcttcgttcttataaagttcttcgtccgtccccctcccccttttctctcccttttgtcccttcttttcctttcgctgctttcagtcaattcgcacagttacgaatcgtcagaaatgagaattatggaggaaagaggcggaaagcgaatgttctaccagccctggtcgtttatgaagcggacgccgtccgtcgccaaagccaatgatttccaaaaacgccccgaagggcgacaatttctgctccgatggccttccgccgatcattttggaaaacggtcaactgtcgtcccattgatgcgattcggccgtcgaccagcggaaagggcggcccctctgattcggttcgggaaacgagcttatattcggacagatgccgcaccactgatcagattcggaaggagttcagaagagagaaaatgaagagaaaaaggaacgatgagaaaagaaaaatggagagacggacaaacagacagagaaagttggcgattgatcacccaaagatttacacagaacatttggaaaagataacggagtgacacaaaa

SEQ ID NO: 93982 - DNA, 473 bp, Heterodera glycines
  SCN-specific regions: Sequence locations=1-233,257-451,472-473
tcgtaagaacttgccgagctggagcagtacatgaagcaggacctttaaagaaggccccactatcaattctactctcgtgccatgcgtgtccgggcatatcagcaatttttgtcaccgtacaaaacggtcggtcttgatgtcatggccaaatgctttggggtcagcaaagagttcatcgacaaggaactgttcatgttcatctccttgggtgcgttgaagtgtcgcattgacacggtgaaagatgtggtggaaatggggcaggccgacaacaaattctaccagtacaaaaagttgcttcatgacggggacattctgttgaatcgtgtgcagaaattatcgcgggttatcaatgtgtgaaatgaattggaaaggatacgatttgctaaaaatgatttttcttttttgttatgtgtgattaaatatagaccaataaaaaggattgtcagcggttaaaaaaaaaaaaaaaaaaaaca

SEQ ID NO: 93983 - DNA, 730 bp, Heterodera glycines
  SCN-specific regions: Sequence locations=1-518,540-730
gttattatcggcggaatacgcgcgcattgccaacagctttggacctttgtttgaggagctgagcgaaaagacgggactgaacattcctaacttggaaattctgcaaaaagtcaccgatgccattgtcacgagggcaaatctgcccgcttttctgcctctgcctcaatgggcttcttccgatgcttacatcgacaaaatcgtccaaaaacggctggaattacacgagcaattgattgatttgtttttggatccgctcggaggttggcactttgatcagctgatcgggcggatggacgacgtggtgaacaaccgaactcagcaaaaggcagccttttattctgcgcatgacacgaacattttgacattgggccgttacttggaaatttcgccgatcaatgactcattcttcggctatgccagtttcatcgccttcgagctgtaccaggacagcgaggaatactttgttgagatgaagtcccacccccaactcaatggcactctctcacgcctcgtcattccgcactgtgcccacccgtgcccattctccgtcttccgtaccctccgtccccgcattccaccggccaatggatgtcccgctgcgttggcatttcttccgacgattgttccctttacgggtcaatttcgggagtactcatcgttttgatgatacttttggttgcgctttttggttctgctctttggtcatgccgaaattacaaaaagaaatgtg

SEQ ID NO: 93984 - DNA, 202 bp, Heterodera glycines
  SCN-specific regions: Sequence locations=1-202
tttgcaaaaggaactttccgaaatgcgtgggaacaattcggacgctgttcgtgttcttgaggttgatgagtctaatttgcttcactggagccttatgctttatacggaccgtgaaccatacaacaaaggtgctttacgcgtgaatgttgatggtccaaatgagtacacattgaacacgccgtacgtgacattcggaacaaaa

SEQ ID NO: 93985 - DNA, 207 bp, Heterodera glycines
  SCN-specific regions: Sequence locations=1-207
gtcaatagatgtcaatgaccaaataacggcaaaatctgtgcatactactagcaatgacgacgcgttgttaaccgacatttttacttgtttgccggatagcaaccaaaagaatggcaatgaggggggcactgggaatggtctcgtggacttgttcaccttagcccctgctaaccaaccgtcttcacagcttgttgaccaacccttcga

SEQ ID NO: 93986 - DNA, 466 bp, Heterodera glycines
  SCN-specific regions: Sequence locations=1-337,359-466
ttcggcccaaccgctcaatgttttgtcggacattgacaataagttgcatgagaacaatgcgttcacctatttgctgggcgaaattgagaccaaaactggcctcatacgtcttcacgtctttggagccttggacgacctttacatgctttatcttctgttctgacgatggggtcatctggggtgtaacatcaccggctttctctacccagcttacatctcaataaaagcgattgatagtcgccagaaggaggacgacacccaatggcttacctactgggtggcttttgcgctgcttaatgttgtggaattcttctccaacaccattgtgtactacttccctttctattggatgatgaagtgtgctctgctgatgtggctgaacttgcccagcactttgagtggtccgctgttgtacacgcgcatcattcgtccgttccatcttcgactgcacaagaacattgacagc

SEQ ID NO: 93987 - DNA, 679 bp, Heterodera glycines
  SCN-specific regions: Sequence locations=1-43,65-590,612-679
gtcctacggactctgatggacgacccggtcggcaccgacttctccttggaagaatatcccccttcaacaacttttcattggaatggaatttctgctaaatgaccaaaatggaaagacaagtaaggttgcctgggaccaacttgctaaaggcgtcaaacggctgtttttctgtgccaaatggtgtccaccgagcaaacaaatgcttggccaactcgtcgaagtttacccaaaaattaaatcggatcatcctcattttgaaataatattttgctcttctgatcgttcggaagaatcattcaacgaacatttttcgctaatgccttggcttgcgtttccatatggtgacgaaaaactcgttcaaaaaattgcgaaggcttacgacatttgcggcattccttcatttattctcgtcgatgagaacttttcactgctaacgcgaaacgggcgaagcgtttgtttgtcggacccccacggatatccctggagaagaaaggcactctacgaactcactgagcatactgtccaccgcttatcggaaatgccttcgctcattctcttcacggaagggtcggccgaggacatcgaattttcttgccaaattctcagtccttgtgccgagtcggttttcactcaacagaatgagtcaccgcaaatcgccgcctctttgcctgccaaatta

SEQ ID NO: 93988 - DNA, 444 bp, Heterodera glycines
  SCN-specific regions: Sequence locations=1-444
ctccgttcggacggtttgcggatgcgcacacactttcgctgccgtctcaccatcgccacacggcgtaaccaggactatcaggtgcaacgtatgatgagttcgtacaccgccacctgcttttggctgtacggaaacaacattcaagacggtttgctgttgcaatgggtggagacggcgatgggctgggagaagttcaagtttctgttcatgcagcattttcggatcaacgccgaggtggagcggggtttacaggacaaggacttcgacctgctccagtataaaatccaatgcaatgactgttcccctccttcgtccacatttagtggagatcgcaaaatcaccttcaaaaacattctgtgtccccatttgcgttacgaatgtggctcaacgaatgtccgcttcagtgtgtggcgtggactgctcgaactgctccaactctttcag

SEQ ID NO: 93989 - DNA, 517 bp, Heterodera glycines
  SCN-specific regions: Sequence locations=1-517
catcagccgacacctcggacgaggggatcacattgtccgcgaacagaacggcgaccactacaagaaccgccaccaccagaacttgactcatcacacagatggcatgaacacagacagttgtgtacatgacgcaataatgtcacacctcctcgtccgctactctctcccacactaagaactccacaaaagtaccatctcgatcaacattcatgataaagatggtgaccgatgtgtcacagcccaagtctcagtcaaatactgcaccgatactttgcatcagcacaacgacgatctcatacatataaatctcccctcgggcgccaagaaggccgtcaagtcggcttgacgtggcaccgctgacattgttgctcctagagggagcattgatcaaaccatgcgcaaagctggttcagcctaccaccacagcaaagaccctcgtaacccccgactcaatacccttggagcgcatctgaatttcgcgaactgtccccatagcgaagagaaccataaccatctc

SEQ ID NO: 93990 - DNA, 538 bp, Heterodera glycines
  SCN-specific regions: Sequence locations=1-4,26-46,69-117,140-438,461- 538
ttcccttaaaaatgtccaattcttttcgaattctttccttattccgttcgagggttctgcttctctttgttcctgagacttcacgagctctctattttcacatcgctgagactgagaaaacatgtttcattgaggaaattccggacgagacaatgtggcgcccaattgcgcgttcatttggacatccaagtcggagaacatgcccaggactacgagcaggtggcagccaaagacaaattgaacgaacttcaattgcgtgtgcggcaattgttggaccaagtggaacaaatcaccaaagagcagaattaccagcgctatcgcgaagagcgtttccgacagactagcgaaagtaccaacagtcgcgtgctttggtggtccgtcggacaaacgattgtcctccttttgaccggtgcttggcaaatgcgccacttgaagggcttttttgaggccaaaaagcttgtctgaatcgatgcttttttcctggcagatatttatttgtctccgaattgttgttgtgtatgtactcttttttgcctta

SEQ ID NO: 93991 - DNA, 283 bp, Heterodera glycines
  SCN-specific regions: Sequence locations=1-20,42-283
taatctttctttgccaatggttttgcttgctttttattccatcaacagcaaacttttgattgtgtcatgccaacaaagttcgaacttttcggaatgcggcatttccgacttcgaacctcaattggccaatgtgtcaaaaatggcaatcggcacaaatcatgtgtataaagggccagaaggtggggatgaacaggcacctccatggatcgtccgactgatttttgggaaatcgtatttgcaacgaaacaatatcggtccccgacatattttgaacggattgcat

SEQ ID NO: 93992 - DNA, 144 bp, Heterodera glycines
  SCN-specific regions: Sequence locations=1-144
gtcttaagtgttgacgaaatacgaggccgccaccatcgacgatcatagaggagagggaagattgattgattgtctgccagtgatttttatgggtttctgcgcttgaattttttccatttgaacgtcaatttcgtcagtaaagca

SEQ ID NO: 93993 - DNA, 197 bp, Heterodera glycines
  SCN-specific regions: Sequence locations=1-197
gtacattccatgcagcaacagcggcagactttgactcactcaaatctacgagtggcgacggccatttaccgcactgctttggatgttgtgcaaaacatcagcagaattctcgacagcacggcgaacaccgcaacttcccaacaacagtacaacattgtccctggtgattgtgtcgttgcctctgttcaaactctaat

SEQ ID NO: 93994 - DNA, 306 bp, Heterodera glycines
  SCN-specific regions: Sequence locations=1-306
ctcattctattgatgtctttggataaaattttgaaaagcgatgaccagccttacatttctccggtgattaacattcgccaatttctggccgatgcttctgctcaaatggatcgactgaggcaatattttgacgacattccctcagcctcggctgctgccgattgttctgcagttgaacaatcgacttcttctaatgcgtcggacccccgcaaaaatttccttaaatttgtgatggaccgcggcttttccacggaagacgcggccaaggccattgcaagcggagatggagcgttggccaaaatgttc

SEQ ID NO: 93995 - DNA, 637 bp, Heterodera glycines
  SCN-specific regions: Sequence locations=1-250,273-320,342-637
ctccgtaacgctaagaaggacggaccaaccaaaacattcgcattccttcaccggccaattatttgcacagttctcgcaatttttgagaatggacaccaaaacgggcggtactgaaaatgcagcacaattttggcttgcttcgagtagcgacgaagtggcgccgtcgagcaaaaaagtgattccgccgggcacaaaagtgtttttcagatgggtcaatcggaccgatgtttgggcgtcgtccgccgaaactcacaaaaagttgctgaggcacatgcagcagaacggcagaagggacgaggcgcggtcggactcaaatgagcacggcatggcgccctcgcccgatggcgtcgatttctttgagccgtccctccactcaaatgccgatggccttttcttcgccgtcatcgttctcctctctctgatcggcctcgttttggtctttttgctcggctattttctcgtccgatttttccaaggcggcgatgacgacgaaaattccctgcggcgcgaggagaaaagcccgaagcatcggcacgagttgcgagtggtgctggtgccgaagaacggacgccgaaagtcgtcgcttccgtccgcactgatccatccttttgggcttggcgacaaaaagcatttgatc

SEQ ID NO: 93996 - DNA, 340 bp, Heterodera glycines
  SCN-specific regions: Sequence locations=1-90,112-232,254-340
gtgaagtgtgtaggtcgttgttcgatcacgagttctcacaacagtgtcaaggaatgtgctcccgccctgcccaccacaggcacattccacatgggtttctttttcttcttcgaacagagtgtggatgcaagtggcgcaagggagcgaagtgatgagtatgccacgcaagcaccccgatctgacgcgtccactccagcattatttctttggttttcaactgttcataaacaggaggaaacaacaggtagtggagggttttttcccccgttttgaacgggttttttgtccctataaaaccacacctcgtaattaggcaagcaatataagagatagcacattc

SEQ ID NO: 93997 - DNA, 677 bp, Heterodera glycines
  SCN-specific regions: Sequence locations=1-97,119-337,359-546,568-677
cctcttttgaatttcatctccgctccgatggcgcgtcgggtgctgtcggggacgtattttattccgcgggtgtgcgtcgacagaagggggacagtgcgcgagtgtttcgcgccccaaagattctcagagggaccggtgcccattcccaatttggcgctgcgctgacgcgactcggaaatgtcgacaatgacgcggaagggacacaggatttcgctgtcggtgcgcctcagtccgactctggccaaggatcggtgttcatttatttcggagacaagtgggacgctttctcgactgaacctgcccaggaaattcatgcgagtgtgctcaatgggagaatctatggccaaaatttaactttcttcggatcggcacttgccggcggcgtggacatggacggggacggatacgtcgaattgggagtgggagcccatcagtcggacattgtcgcgttgtttcgtgcccgaccgattgtcgatattcaattggcacactttttcccgcaaaaacagattaaaattgacgcagataacacttgttcaccctctgcccacagttgtttttctttgttcacttctctccgccttttgcctcggaatgattcgtctcgccttttgtctcgccatttcgctgataataagccacagcagccctttctgtgccgactttcagccattccc

SEQ ID NO: 93998 - DNA, 223 bp, Heterodera glycines
  SCN-specific regions: Sequence locations=1-223
tccgatggcatccgctgcactcggtttttcaaattttgtgaatggtgccctcatccgacaccctttcgttgtgctgcggcgccagtgacaagtgcatgaccacgcgacatgcaaacatttgacgcccattagtctttttgcggtgtggtcaactggccgggaaaaatgtacttttttcctttggaaaggcgccattggcacggcgttcctttgggtggtttcc

SEQ ID NO: 93999 - DNA, 350 bp, Heterodera glycines
  misc_feature (329)..(329): n is a, c, g, or t
  misc_feature (331)..(331): n is a, c, g, or t
  SCN-specific regions: Sequence locations=1-44,66-350
gtgcctcaaagtaatcttgatatggtggcatcgtttctttcgaactttgaggggttccatgtgagcgccaacgcggcagggcatcgggcaaacgatgttgagacgagcgaagcgattgtccgtcgttctgacgcacagattgagcgactccgtcagcttgagatgcgtttcaacactttcatcgaagatttggagaaagtgcgcaaccacggcgccgaatgagaacgaagtgcagcagtaaattgacggaggatgaatttgttaaattgattctcaattgttcgatgaatcataatgtatttttgctttcaacgtaaagagcggatacnanaaaaaaaaaaattaaaaaa

SEQ ID NO: 94000 - DNA, 690 bp, Heterodera glycines
  SCN-specific regions: Sequence locations=1-312,334-690
tggacacaattcaatgacaatacctgaaaattggattactgtgtacatcgtcttcgcccagttggcattgcccagttgatccccatcggatttttttatggacgcataaatacagggagggaccctggcttatacattcatttcttctcaattaaacctgtacatagagttgcctaaattgttattcacttacttacatatcaacacttcctgggtgactaactaatgccagcagaagcacagatttgtgatgttggaaaagaattttccggtgacatcggcaggccaaatttcggaataattcagagacaaaacattgtacagcaaaatgaccattaaaattggaagtgaactcatccaaaaggacaacaacggacaaaaagcagcaaaaaagggaaaaaacaaaaaggcgaaaaatgaaggaccactccaaagtgctgaactttgtccaccgacgaacatggccaccaaacccgagccaatcccggatgacaaaagcggtagggccaaaatggccgtcaattgcgcaccaattcggagtgacaaaattccaccaaccaacaaatccaaatcggccaaatgtgcgaacaacgtaagccgatcgaaagcaaaaagcgggaggaagtggacgaaggcggtggcttcgaatgggaaaaatgcagcgaacgaaagcggcacagagcttggcga

SEQ ID NO: 94001 - DNA, 628 bp, Heterodera glycines
  SCN-specific regions: Sequence locations=1-317,339-628
cctttttacttttctgcttttcggcgctgctttttctgctgaacgatttaagccacaagcgcagcaaaaggagcagcccggccccaaactgatcgatgagacgacgcggtggagcaaatgcaagacggatcagaacctaaccatttacgactttgaggtggaaacattggaaggcgacttcaccaatttggagaagttcaaaggacaggcccttctggtgataaacgtggccactttttgcgcgtacactcagcagtacattgacttcaatccgctgattgagaagaacctggccaatggcaaccaattctccattttggcattcccctgcaatcagttttatctgcaggagccggccgagaaccacgagataatgaacgggattacccatgtgaggcccggcacgggtggaagcgcaccgcgactgcactctcggcaagtggggtcaacggcgcaacagcaccgctgacgaatccttaagatggtgcctcaaacggtattcaatcggaaagagggaggactgatgtacacccgatcagacccaacaacttccatggaacttcaaaaatttctcctccaatccaaagggcgcccggctttccgtttccatccaaccgggtggccccac

SEQ ID NO: 94002 - DNA, 841 bp, Heterodera glycines
  SCN-specific regions: Sequence locations=1-12,41-223,263-532,554 -705,770-819
gtccaataaagattttcttgtttatttttatttgaatattagcgccgctgagacgacaaaaccaatttccgccctgtcaatagcctaaatggggtgcatccacagtgtgagcgacaaaaatgcgaaggcaaggagcaggcaaattgacgaacagcttaaggcggaccatgacagggcacagagggaggtcaaactgttgctgttgggtgcgggcgagtcgggcaaaagcacaattgtcaagcagatgaagatcatccacgagacgggctacagcgacgaggagcgcaaggcgtaccgaccagtcgtttactcaaacaccatccaatccatgaatgccattctgagggcaatggttcggctgaaaatcaacttttccactccgtccagaaaggaggagtttgcgcagtttgttcaacttgcacaaacgacagaagacggtgaactgccattggagttggcctccgtgatgaaacatttgtgggccgacacaggcgtccaggagtgctttgagcgctcgcgtgagtaccaactgaacgactcggctgcctactacttgaactcgttggaccgggttgcacagcccggctatgtgccgacgcaggacgacgtactccgcacacgggtcaaaacgacgggcattgtggagacgcatttcacttataaggatctcaatttcaaaatgttcgacgtcggagggcagagaagtgagcggaagaagtggattcactgctttgagggcgtcacggcgatcattttctgtgtggcactctccgaatatgacatggtgttggcggaggatgacgaaatgaatcggatgattgaaagcatgaagctgttcgac

SEQ ID NO: 94003 - DNA, 394 bp, Heterodera glycines
  SCN-specific regions: Sequence locations=1-394
tccgttaaagtgctaattctcacataaaatgtccataaaagaacttcattaatgtcgtctctatcaaatgaatgtgcaataatgtccgctaatgttcacatgaagtgtaattgatcgaatctccgataaatgaaaaagtcgccgcggcttccgttctcacggccgactgataaatggcgaattgcaatgaaaattatcggattgatctttgagctttgaaatgggcactaattagccgaacatggactcaccctaaaaaaataactcaaataggctcaaaaatcattaatttggccgaaatttaagcgatcagagtaaaaataatttctcattcgacttttgaattttctcttgcacaattggcagtcattttaacttagtccctagaaatttt

SEQ ID NO: 94004 - DNA, 340 bp, Heterodera glycines
  SCN-specific regions: Sequence locations=1-340
ggccaaatatttggaggagccatgcattgcggtcaatgaacgggacgaacccatcggcactgtgtcaaaaagggaatgccatgcaaaaccaattctccgccgcgcgttgagtgtgttcatgttcgatgcggacaaccgactcattttgctttataggtcgcagacaaaaatcacattccccgggctgtggacgaacacatgttgcagccacccccattttgtggacgaggaatgcgctggggaggagggcatcagacgggcggcccaacgcaaggtgaaccacgaacttggcattgatgtagacctggagcacatgcacgtgatggggcggctcatttac

SEQ ID NO: 94005 - DNA, 549 bp, Heterodera glycines
  SCN-specific regions: Sequence locations=1-249,273-549
atccgattccattgtgggcgtttggtcgttttctcgttcactttcgctagttatgcactttatcatgcttcacggaagacgcttagcggagtaaaatcgtcactttcggatgattggatcaatggaacagatcacccgccattttttcacgattcgaagagtgcacaaactttccttggctcgttggattcccttttcatgttttgctatgccattgctctcgtcttctgggggtggctcggcgaccggctcaaaatcaactcgcttatggtcgtcgcatttggaatggttggctcggcattgacactgactgctttcggttcattccgttttggttcaatttttactccgtcccttggtaccttttcacttacgctcttttcgggcgtgtcccagcgtgcggttggcccaacgaagtcccaattatgggctattggttttccgaaaaccaaccgcgggtttatcatgggaatgtgggcaacttgccaaccattcggggataatcttggtgctttggtcaattccttccgtcttcccatggggtatgat

SEQ ID NO: 94006 - DNA, 181 bp, Heterodera glycines
  misc_feature (160)..(161): n is a, c, g, or t
  SCN-specific regions: Sequence locations=1-130,152-161
atccgttggggaattgcgaaagagaatggcgaaactgcgcgaaactggcattgaatatgagttcgactttgagaagaaatacaacgagtttttaaattctcaaaataccgagtgatttttgcctccgttgttttatttttttataaattttgttggttcnnaaaaaaaaaaaaaaaaaaaa

SEQ ID NO: 94007 - DNA, 686 bp, Heterodera glycines
  SCN-specific regions: Sequence locations=1-301,323-686
acgcatttctaaaaatgatgatgttccaattgcaaaatgcgctctgttgtcaatgttgccaaaaccgaaaaaggaaggaggaaacggaggcaaaatgcttccggcaaagaaactgttaccaatttcaataacaacagtacagccaaaacagacgacaggaaaacaggcgtggaaaaatgatgtgttggatgatgacgaagaatttgacacaaaattggccgagaagtcggcaaaacgaattggcaacgaagagacggacgacgactcctcgggagccgaggagggctcaactcggccaacaaaacattcttttgacgaacaaagcgcccagaaacaacttggtaaatcggttgctcaaataacgcttaatcgaccgcttggaattgattacggggacagtgacagcagtgaagacgaagcgaatgacaacaatgagacggacggtgaaatggattcgcgggcgaaagacttttttggacttctctcaacttctccggttgaaaagcgtgcaaaaatggacgaccaattcaatgctgaaccccagcttttcattgaagatgttgaaccagggccgtccaggccccctaatcatcaaattgttggcatgggacgggcagaaggaaatgaagggccgatcaagaatgtccgagccatttctgacgagcaagcccatcggctgatctacg

SEQ ID NO: 94008 - DNA, 807 bp, Heterodera glycines
  SCN-specific regions: Sequence locations=1-410,432-548,570-807
gtctatataaggtaatttggaatggattcttcaattgcattgacctaggagaatgaacgtcattttcgaaatcctttccttgaaaatgtggctgatggtgctcgagctgttagcagggaatggcttttgcaaaaactcgaaactctgacagagcgaattgcgtcacgaaaaattcgagcggaagagaatggaaaagttggtccttatgttggcccttctggaattgcttattctctcattaaagcgtcaagaaaactgaaccaatctcaaagcaatttgagcgattacatccggacacttcttgcgactgaatctgattatgatgcaaaaaaaacttctgattcgcataaatgtcgttatttgacgggatcgttgggttttttcactgttcgggcgatcgccgatttttacttcaaaaatgaaacggatgtctcttccctttcggcgcattttcgcaaattgcttccgaccgttctgagttctaatatcgaagaatttgaaatgttgaacggacgtgcagggtttcttgcatcactgcttgaacttcgcacacattttggccaacaactgctttccgacagtgaagttcgtcaagtgttgggtttcatggtcatttccggtaaaaattactccggaaaatgcaactctaccgccaagcttatgtataaatggcatgacaaagaatacctcggggcggcgcacggcgtcagcggaatttaccaaatgatgttgagcttctggaacttgcttgatgcctctgcgaagtcggacttaacgcaaagcgtcgattggttgatgagcacacaa

SEQ ID NO: 94009 - DNA, 816 bp, Heterodera glycines
  SCN-specific regions: Sequence locations=1-70,93-126,152-545,567-816
cacttattaataaaaaatggtgaaaagtgttgtgagtttgttaccaagttacaaaatttcatcgccgtcaaccacttcaaacacaactccatcaacaaattcatctgacgacagttgtgacaatgaacgacaacagcaacaacaacaatcggatgacataaagcgagtgaatggcgatatgaaaagcctacggaatgccgcatatggagagaaaacaatgttggccagaagtgaacagggcagcgtgtggaaatcaattgccacggacgaggatggcacaacaaggaatgtgacaataaaattgcttcgtgcaccgtttcattcacccggcacagccaaatacacattgcgcgaagtggcactgctctccacactgaatcatccgaatttaattgctctttacgatgtccgtttgccacccaaattaaagccgttgaaaaaatttgatgatttacacttggtgacggaatattttggcaaaaatttgcgcgaaagaattgtggaaaagttgaaaaatggcacgctgtggacgcaccaagaattgtcctactgtatcattcaaattttgtgcggtgtcaatttcttacacaattctggcattgtgcatcgggatttaaaaccgactaatgttgtaatgaatgagcgtggtaatttgaaaattttggactacggtattgccagagatattgtgccagaaaatctgacaaccgaagcgggaacaccaatttaccgagcaccagaaatctacttgggcattgatagttacgacaaaaaagtcgatctttggtccgttggttgcatttttgtcgaattgat

SEQ ID NO: 94010 - DNA, 594 bp, Heterodera glycines
  SCN-specific regions: Sequence locations=1-96,119-136,160-376,398-594
catcgtacaggcggagctcgacgacagtttttcactaatgcacctgtctgttggaaatcactcggatgggccgtgccggcgttgtgttgagcagtggagctgaagacatgctgcagcttcgtggaccatttgatgtctcaaatttgtgctctctctttgggttgacaccaaagtgcggacgtcgctttgtctcgagcaatgccctctccgttcttttgcgttcccaaacgcgtcgtcacacagtcaaaggtgcaattcatcaggtcgaccttgccttttctcctcaagttgcgtcgacttcgaataattcccttcttcccaacaaaaacattactgaacaacttgcgacaattgaggaatttgcaattgaaatgtctgctgcacaaatggaagtcaaatgccccgccgaggagagagaaaatgaacgcggagaaaaagacgaaaaaaggccgaaacagaaaaaaagaaagctggaagaagaggtggaccgggaacatggaacaggacgaggagacccacccacgaattttgaaaatcttatggagttgttcgcataaaatctttgttactgttgttaataaaattcctaaaaaa

SEQ ID NO: 94011 - DNA, 572 bp, Heterodera glycines
  SCN-specific regions: Sequence locations=1-33,55-97,119-229,251-572
caccatgagaccttaaaatataagccttaatgattagtttgtttgctcttttttgcatttaaaattcactgatggatgatgaaaacgaaccgcaagaatctgaggagacagcgatggacaccgaagacgacgaattgcccattgtgcgtcttctgatcgcatcggacatccatgccgggttcgcagagaacaaagagcatatcagcaacgattcattcgaaacattccgcgaagtgctcaagattggggtcgactcgaaggtggactttgtccttttggggggtgaccttttccatgagaatcacccgagccgtgaaacgcaactgaaggtggtccgtctgctacgaaaacactgtttccgcgagggtccactttggcttgaattcctttccgatccgacccgtcatttccaacacagcaattttcccggtcgcccattatttgggacgtgaatcttcacgtggacctgccccatttttccaatcccacggaaaccatgacgattttgttccgaaaaaggtctttctgcccttgaactgctcccacaaaggccgggctcattaaatttgttt

SEQ ID NO: 94012 - DNA, 833 bp, Heterodera glycines
  SCN-specific regions: Sequence locations=1-271,301-301,324-833
gatcgtaaataacaaaatggagaggaacagagaaaatttgccactttgtttcctcactcaaaaaggacggaatcgaaatttcagagagtgccaccgatactttgttcgtgagtaacagcagtcatttggtgggcgtccccttcgagagtctcgagttgcttttccgtcgttttgacctgcactgtgccttcaccgtttacccggccaacaaatcctactcattggtccacttttccgaagtgaatttggcgatcgctgcgcgcaatgctctcaatggcaccaaacccaaagactttcccagtgaaaatgctgcacaaattcatttgttcttcgtcaggcaaaaagcggcaaaccgttcgccgccagcggcattgccaaacggcctgcaaatagtgccggatttcatttcgacgcaacacgagtccgaactcgagcaatttgtggccaattgtctagcagaaaggacaaacattcaggaattgaaaaatcgacatgttttccattttgggtacgtgttcaattacaatgaaaacaatgcgacggacgaagcgcctcaaattccgcctatttttgaccgaattattgacgaaatttgctccagttttgactgccaatcagccgaaattcgaccgaatcaaatcactgtgaatgtttatgagcctggccatggcatccctttgcatttggacgcccattccgcctttgaggagcccatttactcgctgagtttgctgtccgacgttgtgatggaattccgcgactgcgccaacagtgcccggcgcgcctctgcgcatttgcccaggcgtagcattctgtcgctgcgcggcgatgtc

SEQ ID NO: 94013 - DNA, 79 bp, Heterodera glycines
  misc_feature (57)..(57): n is a, c, g, or t
  SCN-specific regions: Sequence locations=1-58
ggccgtaaaagcaaatatgaataaacgacgaactgctgctgatgactaacaaattcngaaaaaaaaaaaaaaaaaaaaa

SEQ ID NO: 94014 - DNA, 262 bp, Heterodera glycines
  SCN-specific regions: Sequence locations=1-262
cgagccggtgctcaccgatactgcactcggcgtcgcaggctctgcggagcgtgccaaacaattagctgcctgcattcctaagtcatgcattccaatggagctcgccaacgaagctgaccccgagatccattatcgcacaactgggcccgacatttggcagccaactcatggtaaggttgatgcatgcatctatggcattggctccaggacgacggtctatggcgtacgacgctttctgcgtgatatgaatccggacatagac

SEQ ID NO: 94015 - DNA, 136 bp, Heterodera glycines
  misc_feature (114)..(114): n is a, c, g, or t
  SCN-specific regions: Sequence locations=1-112
gacctctaatgcttattctttgtttctgtccactttctatgtttactgttatctgaatacacttttacccttttaaattattttgagtgttttcccataaaagtccgctgctanaaaaaaaaaaaaaaaaaaaaaa

SEQ ID NO: 94016 - DNA, 449 bp, Heterodera glycines
  SCN-specific regions: Sequence locations=1-172,194-425
tgccttactcgtcgaaaagggaggaacgcagcgggtgtttaccttcgaagaggccaaggataagaattcgagtgccttgtgcgattacatgtgcgacatggtcacattcacggaaaagggcaagccgcaaatccaagtggcaccgcaagaaatggagacggagggacagcatgaggaagaggaggagaaagtgttggaacggacccatgacgacgacgggaaactgaacttcgacgattaaaagggcagagacataatttgagaagtttgagacggcactttacttcattcctcacggattttactcaatgatatattatcttcaatgtttgtttgtagccccacccaatgaaagtgaactcacataaaaccgaatttggaataaaaatgaattttgatttcattggaataaaacggctcccggtaaaaaaaaaaaaaaaaaaaaaaaa

SEQ ID NO: 94017 - DNA, 735 bp, Heterodera glycines
  SCN-specific regions: Sequence locations=1-267,289-438,460-714
atccttttaaaatttgattgtctgccattgtctcgccccctctccctcagtgtttcttcgccctcctttctctcgccgtgtgttaccgcgtcggccctccgtcggaccttcgcactttgaatttgctcgtttggctcttgcgactgagttcactttccgcactttactttttcagtttgaatcgtttccgtgccattgtctccgtcatttttctgctgattttctcaatttggtgtaattatcggagagaaattcgttcttttgcaataattacacaaaataagataagcacttttatttatggcccccagccgagggaatttttaacggagtcggaataccgcgaggaggctcggatttacactcaattggaattggacaaacttcgccagcacattcagtctcgacaagtgtgtgacacgctgagactcatttatcaacttcacactccgaatagaacatcaagctttatcgcgggtaatgctgaacatatttcgccggaggaaagaaggagtcactgcgaattgttcggcttttccgaagcccaacgaaacggcgacgacgaaacggacgaaataacggatgaatacgaaaatgatgaatacataacggatgacgacgaatgacggagaagggacacttaacacacttttgttatccgattaatataatatttatgtttttttcactttacaacaaaagttgccattaattccaaaataaacacttcaaaaa

SEQ ID NO: 94018 - DNA, 669 bp, Heterodera glycines
  SCN-specific regions: Sequence locations=1-383,405-439,469-669
ccgacggacgacccgaaaaatcgtgctaaaatactcaccgagaaattcgaaatggacgcgaccgactcgcgcaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcacggtggcgggggccaatcattcccacggcgcgtcgtgttttctacgcttccgtggtgaccggcaaaacctccctgcttgaacctgtctatcttcgtggagatccattgccccaagcgggtggtggtgggatttacggaatgccgaaaccgccgccctggggtcctccttggaggaaaaataaaatgctgggaaccccgatgttatcggcaagggaatttggccggcaaacaaacattcgggatcaccggctggtttgcgccccacaccgggggggcaagggtttcgccaatgggtgtcgaacattttcaagtcttccccgggatccccttgatggacttctcccccccgggcagggtgccctgaaactcaaaacaaaaagggttgagggggggg

SEQ ID NO: 94019 - DNA, 779 bp, Heterodera glycines
  SCN-specific regions: Sequence locations=1-341,363-564,586-779
gctcgaacagcagtgaccaccaaaatgaggaggaggattcgaaagggacaaagtcgaaaagcggcgactcgtttccgccgcgccattcccacacttttatcggttcgaccttcgccatttggtcactgattttcctgctgttcgccacttttgcctctctgcagtactatttgcccaaggccgcttcctcttgcctttgcccggccgctgaatttgggcgactgaccgcccaaagagcgtacaacgacagcagttttgggaatcccaagattttgcccgacggtcgaatcgaatacgaattggcggtggtttccgatttggaccatgacagcaaaatggaggacagaaaggagacgtggcgtagttttttccgcaggggtcgcctcctcttccgccccgacattccttccgtgcaagtccaatgggccaaggacaagcaggacaacacactgtactcgcagctttcgtccggaggacgcgcgatggaactgtccgaactctgcgtttacgacggacatttgctcaccgtggacgaccggacgggtattgtgtacagaatggacaatttcaaagacatggtcccctgggtgctgctgaatgatgggcccggcaatgccaccaaagggttcaaaggcgaatggatgagcgtacggcacaatttgctttatgtgggcggattgggcaaagaatggacatcggtcaccggagaattcattaattacaatccgatgtatgtgaaggtgatcaatccctacggcgaagtgttgcacgtcgactgg

SEQ ID NO: 94020 - DNA, 235 bp, Heterodera glycines
  SCN-specific regions: Sequence locations=1-123,148-157,179-235
gtcctttcttgtccttttgtaattagcctgttcgtaaatccgttctcaatggcctctcttttgtcgcgggtgctttacgtcacttcgatcttcttcgtctttttgtacctcctggtgcctgcactgtttttcttcttccccacttttatgcagcacattttcttccttcattttgtttgctttccattcgtcgattaccacaacaatctgcgcgacgtggtcagaaatcacccgt

SEQ ID NO: 94021 - DNA, 477 bp, Heterodera glycines
  SCN-specific regions: Sequence locations=1-222,313-477
ttccgtaaaaacttccttcactcattctttctcccccttttttcccttcttttttcagtcccttaaaatgttccgatcgcccgcacttttcgcgatgtttcttctgctgctgattgtttttcagctgtttggggttggaattgtgcaggggtcgaagcgaagcaaaggccgcgcacggacaaaagaaagcgaaggcatttcgaatcgggggaaagaatcggcaaaagaaaaagtggacgaattggagggcaaaaaaacgcagaaaaaggaagaggaggagcaaaaggaggagaaggaaaaggcaaaaaaggaccaattgacgggagagggaattggaatggcaccgacggggggacgaagagcacatcgagaaggaggagaagtgaatgaacaccgcgaggatggccaagggactgtcactttgagaagggcacccggcgaattgggggaaatgggcacgaagaaaaagcaccgcga

SEQ ID NO: 94022 - DNA, 438 bp, Heterodera glycines
  misc_feature (412)..(413): n is a, c, g, or t
  SCN-specific regions: Sequence locations=1-1,24-215,237-413
tctttcaagagatttactgacttcaagcccccgggagtctatttcttaaagcccccccccccggaatatggactttatttcagggggaggtgttctaattcagggttttaatcaaggctgtagtggcacccaggatcaacccgtggttttgtcaggcgtacatcttaacttaagcaaatattcaaaatggctgatgttttgttggcatttgttctccaaactgcactcatcgcagcggaggcgcaacttagtttcagcgcgtgcgttccttctctgcgcgaccgagaaacagtgaatgccaaaccaattcagaacatatacaaaacatggcaagatgccgcagggtgtccatgcgtgacaatgattatgtgaaggaagaaagaaacaattaataaattaggatggatttccnnaaaaaaaaaaaaaaaaaaaaaaaaa

SEQ ID NO: 94023 - DNA, 320 bp, Heterodera glycines
  SCN-specific regions: Sequence locations=1-320
ctccatcaaagtcaaccagcagatgatgacgccacaaatgggcctctttaaagcaattccctccaaacgcacctgcaacaccagcgacaccccaaatgtcgcagtcaattgggacgccattgtccgtgcacaacattcaacaacccggttctgttcaacctcaacagcccggttctgttggtatggttgccacccctgcggctccgtattctgttggtgcgtcgactaccggtggtccggcctcaaatcaaccgattgccggcccacattccaaccctccggcggcacaacaagcgacacagacgcagccaatcggcgga

SEQ ID NO: 94024 - DNA, 764 bp, Heterodera glycines
  SCN-specific regions: Sequence locations=1-764
gttcttcaagcttcgcgttccccgtttgaagattggaatgttccgttaacattttgcaaataactgttttctccgcttccacctttattggaatctcaatcagcccaaacaatatgaagaactgcgtattatacgtgtgtcgaacgaatacaccgacgaactgtttacaaatgctgcgaatgctgttggtcttcagttggatgagttgcttgcctgcattcctgagagtctgataatgtacgtgaacccaggcgaagtgttctactgtcttggtgactattcgcctccggtgcctgtctgggtcgggtcagtctgtgcggatctcaagtacaacgagacgtccaatgtcacttttccgcctccgccaattccctcgtccattttgcccactcataccatccaaccgcttattccgcgtgccattggcggtgtctctgctacggtcgactttagtgttgtaaactatcgcattcagttgtcgttagtgcatccgcgtgagcttggctacgctaccaatccgtcgagtgattttgtgatgttccgttacgttgtccccggcactccgaattacaccgtcgaatcttttgcatcaactcgattcggctcgtatcgtaagcgtccggactacgaatttgtcacccatcttcaacgttcgctgttgctgatgaacatgaacatccattcgtgctcggatgagagcacttaatatttttgaagcgtaacctttgatgataggtctgtttgtcgaaatgttattgtatttt

SEQ ID NO: 94025 - DNA, 735 bp, Heterodera glycines
  SCN-specific regions: Sequence locations=1-735
gtcaatcaactcattgaggacaaacagatggagatggtctacgcttcgttggcagtcgaaggcacgagttggacaagtgaggacaacattcctgtgcaagttgtgaacacgctaatcggccaattcgacagaactcactgtcggaatagttcacgattggctagaacattgagcccaaattccggcgttagttcattcatgtcatatacgacttcctataaagacacgggcctgactgggttatttttctgtgccgagccggacgcattgttcaatttggcccagtccgtatgcaaggaatggcggcaactttgtgaagaggtggacgtggacgagttggaacgtgccaaacggtctcttctcaccaattctcttctgatgttggatggttctacgcctatttgcgaggatattggaagacaattgctgtgttttgatcggcgcatttcaacagaggaattggaagagaaaataaattcaataacaccagacaccatacggagcatcggacgtcgctattttgtcaacaaaccttttgcctacgtgatcattggaaagacatccaactggccaaatcccaggaaaattcagaagtggttgagctggtgacctgttcatactttgtcataaatttatgatgttttgatttgataattttaccatttttgttttgcttttattttgaaatattatttttatggtagaacaagcaaattacaacaatgattttgctct

SEQ ID NO: 94026 - DNA, 683 bp, Heterodera glycines
  SCN-specific regions: Sequence locations=1-503,527-683
gttcgatcaaagtttgtgcattatttctcagacttaattggcagccatccttcatcaatgggtgttctccgttttacacttcgaaatgctggcaaaatcactttggtcgcactggcggtgaaagttgcggcggacaacggcgtgtggtccctaaactcggaggagggcgcctcactgttcgccaatttccgctccaccgttttgcccggcactattgtatacagggaagagttgccgtcggcggacaacgcgtgccgttccatcggtgcggcatggaatcgcaatgtgaactgtgcctttggcgcgcttcgttccgcgacgcattcggcgcgcgaatcggtgcaaaaaatggctgccgaagcgatggcattttttgacgacgacgaggaaaacaaaagcagcagagggaggagaacggcagcagaacagcgccaatgatgagaaatgagaggaggacaaaatgaattgaatctgttttaatatcattgtgcatttgctaagggtgctctcttctctcagtctctctgattttgggccgaacgaacaaacactcagttaattattaagtgtacacaccaggaatgccatttcgaggccctggaaattccgaaaatcgaaattcctacctcaaaaattttaatggaaatcggaattcagaccacaaaaatatcaaatcggaaaaa

SEQ ID NO: 94027 - DNA, 487 bp, Heterodera glycines
  SCN-specific regions: Sequence locations=1-487
aatccttagagtttggacggacgacatgtcatcgccggccattggcacttcaattttggagcacccacgtgaagagagtggggcaggcgcttcgatggtcgttcgagtgaccactcaacaccaagaagtgttctactcatcatctccaggccgtaacagaaaggcacagccgataccgagaagacaaaagccaacgaatcaccagcctattgtgacggaaatttctgatgacagtgccgaagaacaactcgaaacagtgccaaatgtacgtcgaagtgacctctgcacagacgatgctgagtttttccggaacaacgatgaacaattggaagacgattttgttggggactttgggcgaatcaacacgaacaattatcagcagccatttcgacggcgcagaagagaggcgacttcggcaattcgcaacaaatacaaataaagaacagaagattaattggataattatttaaatcaactttttgtgttt

SEQ ID NO: 94028 - DNA, 484 bp, Heterodera glycines
  SCN-specific regions: Sequence locations=1-484
gcattatggcggttcaaaatccgacacagcagcagcaaacaccgtaggccgtctctgttgcagaaattgccaatggcgttgaggaggttcatggccaaatctttgaagtcgctccccgatatgtgaatctgtcatatatcggcgaaggagcctatgggatggttgtatcagcactcgacacagtcaccagggagcgagtcgcaatcaagaaaatatctccatttgaacaccaaacattttgtcagaggacgctccgcgaaatcaaaattctgtcacgattcaaacatgaaaatattatcaacatacaagcaataattcgggcgccaagcattgagctgatgaaagacatttacatcgtccaatgtctgatggagacggatttgtacaaattgctgaaaacccagcgcctttccaacgaccacatctgttactttctctatcaaattctgcgcgggcttaagtacattcattccgcaaatgtgct

SEQ ID NO: 94029 - DNA, 283 bp, Heterodera glycines
  misc_feature (185)..(185): n is a, c, g, or t
  misc_feature (243)..(243): n is a, c, g, or t
  SCN-specific regions: Sequence locations=25-27,49-64,115-283
catggtcggtttcgcgcccctcacgtcccgcggctcgcaacaataccgtgccctcacggtccccgagctcacgcagcaaatgtttgacgccaagaacatgatggccgcctcggacccgcgtcacggtcggtacctcacggtcgcttgcatgttccgtggccgcatggtcatgaaggagggtgacnagcagatgctccatgtccaaaaccagaactcgtcctactttgtcgagggggatcccancaacgtcaagaccgccctgtgcgataattccgcccaaggg

SEQ ID NO: 94030 - DNA, 235 bp, Heterodera glycines
  SCN-specific regions: Sequence locations=1-235
gtgggacaaggcgtgtcttctcacgcggttggtcgcctcgtcagtgcgactgtccgaagcggcgggcggaattattaaggacataatgaaaagtggcgacctgaaaattgtgaaccaagaacaaacaggacaaatgaaggattttgcaaccgaggccgatcgttcaacttcaattttgcattgacggtcactgcgtggcgaattcggcgaaaatcttacaatatttggcgaggag

SEQ ID NO: 94031 - DNA, 691 bp, Heterodera glycines
  SCN-specific regions: Sequence locations=1-29,51-462,484-648,683-691
gtccctaagaggacgccatccaaaagatttggctttggcagaaacctgtccacggctttcggggccccgatttggtggagagtaatcaccgaatgctaatcaacggcgaattgcactgtcgtgcgctatggcgcgcgcaaatgcaatgggcgaaaagtgtgcacgcttatctgttcgaccagacgattgtgctgtgccgaagggacgtgctgaggaggcaccaattggtgtttaaggagagaatggcactgaacggagtcactgtgcaggagctgcacgacggaaaagagccgatcaccggcgcttcccttaggaacgcgttcaaagtgtccagccaggcccgcgactacgtgttcagctgtcccgacgcggccacaaaaggcctttggttggaggcgcttcgcgaaaggccgcggccacaaccgccgacgccggcagaacgacgtttggcaatgctaatgtgaagaagcaaaggaagaaaagcagcaaataaatgaagaccgaaccgaacgaaccaaaaacaacgaaaaccgacggagggatttgaattaatcggagagattaatcgaattcattcgcatttcattttttattttatgcgctttcattcgcctcgcctttcattctttttgagtccattcctgtgaacaaaaacagacatttttatttttgccaataaaatttctttttc

SEQ ID NO: 94032 - DNA, 751 bp, Heterodera glycines
  SCN-specific regions: Sequence locations=1-207,229-751
accttaatatttgctgtcacaactcgcaaaatgcgctttccgcccttgcaatcaaatgtcttttattgttatcatcatccatttttacattgggatttgccgaattgaacgatgtttgtggagaaggacgggacaaaggaaatgatggctgtggcacgccagcaggaggtcgacgtttttactacgacacaatcacaaaacggtgtcaaccatttgcatacgaaggctgtggcgggaatggcaaccgatttgattcattggcacaatgcaggcagaaatgtgccaactttgagtcggcggcacaaggcagttcaacaggcgatgaaggacaacatcattcaatggttttgccagtcccaaagtgttctggtggtgttcgcgcagcggtgaacgctgatgcacgagtgattgaatgtgccggcactgacaaatgcccggacggctacacatgtgttggcaataaaaactgttgtccagcgtcgaaagaaattgtctgcggtattgaatatgatacgggacgatacgccttccaggggtcgcatacgccgcgttacttctacaagaaagacattgacaattgccttctgttcacttattacggtgcactcggaaatggcaacaatttcgagacatacaatgaatgcatcaaatactgcaagaagacttaataatttatgtagttataaatatttcatgatgtgaagtcaattggcgttgagaaaaaaattatgtcatttcataaaaatgatcc

SEQ ID NO: 94033 - DNA, 478 bp, Heterodera glycines
  SCN-specific regions: Sequence locations=1-478
tgagggtggcctccaaaactgggagtgtacggacgacttgtgcaattttctactcgacaataatcagaccatgagcggagttgacattttggagttgggctgtggcgccgctttgcctaccaatgtggcgctgtcaatgcgcgccgattcaatctgcgtccaggattaccatgctttggtgggcaaatgtctcaccacaaggaatttcgaattacatggccatagaatggacggcggaaaatgcgcttttatgaacggacgatggggcggagaaactctggggaaaagcgggcagaacaagctcggactgataagcgctcgcgaaaccatttacgaccaggcgactgactcggcacgacgcgaagcaatggactcccttttggccgacgagggaaaaattcatttggctgccaaaccgcattattttcggcgttcggacgaagtgtgtagagattcgtttgaattcgtccgctcgcga

SEQ ID NO: 94034 - DNA, 546 bp, Heterodera glycines
  SCN-specific regions: Sequence locations=1-464,498-546
gtctttggaggaagcgcaccgccaggacagagaacgcattcgctcctatgatgcaaagagaagtgacaaaagtggcggaagcgcagggacagacgggcgaaaggcagacacttttcataacggcagtgtccatgctgcgtgactcggaatgttacgacccaacggtttttgctgcggggacttcgcctgccaaaaagcaccaaacgccctcactcgcccaaattcagcagaaattcagttatttggtgaacaccaccaaaaatagacatgcaatggaggcacacactcttggcgaaaaccataagtccgaatggaacagagcactgcgaaaaattgcgcgtgaaaatgaacggcagcaaatgttgaaaggggtggcaaacggaaaacagcgactcgtccaacttccgttggaatgctgcactgaatcggtggtccccgttgttaaattggtcgatattcctctcatttcatttcaaaatgattaacaacaaagcctataaaatgccaaaatgcaattcagattgtctatatgtgaaaataaatttg

SEQ ID NO: 94035 - DNA, 799 bp, Heterodera glycines
  SCN-specific regions: Sequence locations=1-17,40-274,296-799
gtccctaattgcaattgccaaaaacaacagaaacaaagggaacgcttcacagagtgggccaactgagagaaaggccttcgggggaaggggtcgggactgagttggcccgggggggaggcggcgaattggccgatttgctgagagaacatccaacagaccgggaacagttggttttggcgtggcgtttgcccccggggagtgaccctttggcaaccgaacttttggaaagcgttgctctgattgtatttacgaacagcgaaaagtacgaagggcggaaaatttggcagaaaggcacagcgaaaaagcggacgaagcgttgggtttcctcacaacggacgaattcggcgtcaaaagcaaacgacgacgacgacgcaacggacaattcgagcaaacggcgaaggcaccgaacacaccgcaaaatggcggaaagcgaacagcgccagcagtgccggaggacggcactgtacgtggacttcagggagctgaactgggacgattggatcatagcgccaaccggctacgaagcctaccaatgccgtggccgttgtgcccatccattgccggccaaactgaacactaccaaccatgccatcgtccagtcgctcatccactcaattgacccccactccgtgtcggccccgagttgcgtgcccgttcagatgagtgccatttccatcctttacaaggacattaacaatgtgattgtcgtgaagacttatgcggatatgcgcgtggattcttgcggatgccattgaatggccaacacggcgcgccgcttcgtttacctctgtcaaattcg

SEQ ID NO: 94036 - DNA, 704 bp, Heterodera glycines
  SCN-specific regions: Sequence locations=1-704
gccgatcaaaccgacgtttttggggttgcttcgtcaagcattggaaagccaatcagagttgaacttgggacagggagcagaaaaacaattatttccggcaatttactaacgacagacccggagagcggctcaatagttttggtagagaagcgtcagcaaaataaaacatcggatcaggggaagtgcagccaacgattcattctgattcccggcagttctgttcactctgccaaattggatggacaattggaggaagggacgaagagtaatgccgaactgcgcgagaaggcggacggaattgagtcgggggacgaagcgacaatcgaaagccatggaaaaagaaccctgtccgaaactgtgagaatctttgacgaattcgcactttcgaggcgcctttgtctgattgatgcactaaacaaatatggcatcaaattcagcgaaaagccacatgttttagtacaaaatattgacaatggacagactgagggacaaatgccatcgacggtaatttctctgcagagcggcggcatcaaaatctatccgccgtacggaaagaatgatataatcggcggtggttcaattgtagtcaaagaattgttgcacaaactctccacagaaaatgtttttgatgagtgaatcagccgaaagacaaaaaaaacaaatcaaattctaacattgttctgcgttaatttttcaatatcact

SEQ ID NO: 94037 - DNA, 504 bp, Heterodera glycines
  SCN-specific regions: Sequence locations=1-358,382-422,473-504
gcgcttcagccgcactcacactgtctcgaagaaacctgctggccccgctgagcgtcgttctcctcccggcggagccagccgcgctcgcactgtctcgaagacatctgccagccccgctgagcgtcgttctcctcccggcggagccagccgcgctcgcactgtctcggagaaatccgccagccccgctgagcgtcgttctcctcccggcggagccagccgcgctcgcactgtctcgaagaaatctgctggccccgccgcacgtcgttcttctcccggcgataccagccgcgctcgcactgtctcgaagacatctgccgtcaccgccgaaagcagtacttctcgcttctcgctgcctcagttatttggaaagaaaaagaaaagcggcaagggaaaaccgaaaccgcaatagaaagtggacgggtcaaaagatggaagcaaaaagaacaaattggaaaaaatttgatggaaaattgtttttttagcttatatacacaataaagactt

SEQ ID NO: 94038 - DNA, 428 bp, Heterodera glycines
  SCN-specific regions: Sequence locations=1-299,321-428
gacactacaagatggtgcagcgtttggtttaccgacgacgtctgtcgtacaacaccaaaagtaaccggaggagagttgtaagaactcctggtggtcgtcttgtataccagtacctgaagaaacctggcaagatccccagatgtggacagtgcaaggacacactccgtggcatccagcctgccaggcccatggagcgttcccgtatgcccaagcgattgaagactgttaggcgtgcttatggtggagttctctgccataagtgtgtgaaagagaggatcgttcgagctttcctaattgaagaacagaagatagttgtcaaggttctgaaggcacagaaggcagcagtcaaaactaaagcacccaagaagtaacctgttaattttcgtaatataaaaaatttaaaaacgaaagaaaaaaaaagaaaaaaa

SEQ ID NO: 94039 - DNA, 717 bp, Heterodera glycines
  SCN-specific regions: Sequence locations=1-49,74-717
gagctttaggggacgcaaatggagaaggagatgatgaacgagggcgtgatggaagaagaggcgagggaggggaggagtcggcgacggaaattcggccttgttcttccatcggatttcaaaacaacagcatcatcagcagacttcgtcaaagtgcacgacgaaaagtgccaccgcagaacacccaaattcagtccgactttcccaccgacgatggcgaggcgcaggaaactccgacagaaactctctgtggagtgaatgtcagaacacttttggtcccaaacacaaacagaccaccggacaatataagcattgtttcttctgacctaagcgaattcgaaagtttgggtgctcttggcttctcattgggcagttggcggaaaagcagcagcagaagttaccagcgaaaggccatcaccagctcggctttggctgtcgctgcagctgccacggcttcggctgaaattgacaaagtcggcgcggcacatcgcccggtggggaacagttcgtcattgggcactctcacagcctcttctccaacggttctccagtcttcgccaaaattgggcttttccaatcttttgccgcgtcgcccttcgacttcgcccgaggcgaagaaagataaaagcgcaatcgaaaaagccatcggcgacactttcgatgaatccaaagacagtttaatgagtcggacggaggacgaaacggcggcggaacaaaggc

SEQ ID NO: 94040 - DNA, 504 bp, Heterodera glycines
  SCN-specific regions: Sequence locations=1-454,476-504
agccgttcttgcggagtcggccccaacactttccgtccatcgaacgttcggttgaatggtgtgtgaagagcaaaacgacgtccaatttgagagcagcgaaagtgtcgatgccctgccgactgaaaaaagtgaaagacaactcaaatggcgaggtttttcaatggcgtaccaatttggcacggaccgagccccactggcaagggtggttcagcggactgtccaaactctttttgcaatgtgagccggtcaaagtactgattttggcgaatgtcgacagattggacaaggaattgatgacgggacaaatgcgtggccaatttcaactcgaagttctgcccaaagttgggcatgccgtccacgaagactctcccgaattagtggcaaaaattttcgttacgctggtgaagcgttacaatgtcatatttcaaaaatatttgtaagcgaaggatttcctatttgtgcaacaaattcttttgtactttttttcactgaataataaattat

SEQ ID NO: 94041 - DNA, 807 bp, Heterodera glycines
  SCN-specific regions: Sequence locations=1-529,561-769,796-807
gccctataaagcatctttatatgacaatggattatccttcatcgcactgattgtggggaagaaattaatccgttgcttatacgaaaacatactaaactgatcagaacgtgtctggacgttttgccgagtgattatgcagttttccacagcacaaagcccacaattctcttcttcatgctctctgggatggacgtgcttggcaaattggacgcgtccattgaccggccgcgacaaatcgaaatggccgattgggtctacgcacttcaattaccacggggcaatggatgtctttcgccctcccgtcgttgcggtggcttccgcggctgcgtcctttccgtcccttccgccggcctttgtccctacgagtcggcccatctcgcccaaacgtacacctccctctgcattctgctcattctcggcgatgacttttcccgtttggatcgtcgcgccattctccgcgcagtcgccgattcgcaaggggcggatggaagcttttttgacggcgatcgaagcaatgaaaacgatatgcgctttctatattgtgcctgtgctatttgttaccttctcgacgatttctcgccaattaacattccctctctgttggactttgtccgtcgttccgtcagttacgacggtggcattgcccaagggccgtccctcgaaagccatggcgggtccactttctgtgccgtctccgccctgttgctgaccggccacctttgggacggctccgtgttggacagtgccaaaatggaacggctgataaagtgggcactgatgaagcaggaggagggcttccacggccga

SEQ ID NO: 94042 - DNA, 695 bp, Heterodera glycines
  SCN-specific regions: Sequence locations=1-8,34-336,358-695
gtcctagacgaattcggcacgagggtccatttaaggactatggtcctatataggagacaataaagcgttctttttctgcgacggccaatggcataattggcggtgtttctccgcgttccgttctcggttcaccggcttcgtcgaagggttctttgggtggatggatacacccgcccgcttgtcttatcaatgcccgggttgaatatgtcgtcaaaatgcttggtcaaacggaagtgccggcgccgagagggaccaaaatcgttgaggatgccattcacgccatccgctttcacttacaaatcgaacgggggaaaacgggacattcaggcgcaaaacaaaggatggttgttctgcaaatcagcgttaattgtgtgaacgttctcgacgcgaaaagccgggcgatcatcgtcaagcaccatctcagtcgaatttcattctgtgccgatgaccgacaggacaaacggttgttctcgtacatcgccaagaacgagcaagggaagtaccaatgctttgtgtttttgagcgacaaaatggccgaaaatatcacattgactgttggagaagcgttcgacttggcctatgagaaacaagtcaaaaaacgggggaaagaattggcgaaccaaaagcacgaacttcttttacggaagaaaattgctgaactggaggaggaaaatcggcagctgaaacaccgtctc

SEQ ID NO: 94043 - DNA, 126 bp, Heterodera glycines
  SCN-specific regions: Sequence locations=1-104
ctcgattaataatggacataagctcatcaaaaaaaacagtttaacctttgacggaatcctgttttatttatgttttcgttgtttttgatgacattctttgcgacaaaaaaaaaaaaaaaaaaaaaa

SEQ ID NO: 94044 - DNA, 441 bp, Heterodera glycines
  SCN-specific regions: Sequence locations=1-303,326-348,370-413,437-441
atcctaagagtgcccatttgggccgactgagaacgtttggcgccttgctgggcgacgaggtgcaggaccaaaatctgatgttggaccgcattcaaaagaagacggagcgcaacgacggcgtcatccgctcgcaggaggaccaaatgcggaagttgctcggctaatggatgaccaattaacacgcctaattaatgaacgaatgagtaatgtgatggtgttgatctatggcactgtgccgactgaccaatttaagacgaaatttgacttttgacgaccccccaaattaattggtattattgataatgatgattgatgatggatgattaattgtttcgttgattgtcccaatttctctctcttttttctaccgctgccaccgctcactgacctttgtatttaatcggttaaatgaataaacgatagaaaatcaaaaacaggaaa

SEQ ID NO: 94045 - DNA, 142 bp, Heterodera glycines
  SCN-specific regions: Sequence locations=1-142
attgctgagaacccagcgcctttcgaacgaccacatctgatagattctctatcaaattctgcgcgggcttaaggacattcgttccgcaaatgagatgcatcgcgacctgaagccgagcaagctgttgctgaacacaacttgc

SEQ ID NO: 94046 - DNA, 476 bp, Heterodera glycines
  SCN-specific regions: Sequence locations=1-476
accctagagattagtcgtgacgagttggagcacgacttgcactctgccgggtttgccgtcatttcgtgtccgctgaagccggacagtaagcaagtgattgccgaaattgcggacgcgtcgcaccgggttgtgatgatcaccggtgacaatgtgctgactgccatccacgtggcggtcgttcttcggttcatccgtcgcagtcgaatcgcactgattttggacgacacgcggccaattgttactaatggtgaacaacaacatcagcaacagtcggcctccactgaactgcttcaatccgacgacgaagacgagcgcaacgacaaccgccgatggatttggcggtcgtcccaggacgcgggcaaatccgtcgctttgtccacggaggcgcttattggcagccatctgcgacatgggcaccacaaattcgagctgtgcatcaccggagcagcctttgaacacttgatggactcgctgaa

SEQ ID NO: 94047 - DNA, 406 bp, Heterodera glycines
  SCN-specific regions: Sequence locations=1-352,374-378
tgcgtggaagaagaccgaattcgcgatcacttcacgtggtgtgcgtagagagtagccgtctggctcagcagacgggatgaaagttttcgacacgattgccaatcacttcgtgttgtctccatgtattattgcggtctcttccccgaataaccatgcgatgacaatgggtggaggaagcgattggctggcaatttgatgatcagtggaatcaaattgaaattcaaatcgatagtcagagtgaaatcggggatgggcttctcaacgaaactaccgacccaagtgatcagcaggaatgaatgagtgatttgctgagaaatgatcggttatggaactgggaattgacgtgaaatgttgaactttgttgaaaattgaattttcaaaaaaaaaaaaaaaaaaaaaaaaaaaa

SEQ ID NO: 94048 - DNA, 571 bp, Heterodera glycines
  SCN-specific regions: Sequence locations=1-571
tgaacacctctccgggattgcggtcaccggtacgcgctactcactccagtgcaatggggtgcaccgggtccgggcgaccgaccacacccagactttcccccgcatggagggcaacggaccctccactgctgatttgtcccccattctccccaatcaaactcttgtgcagtagacaccgactcccgtgcccgattcgacggctaatggcggcccgctgttggactatgtccacggcgtgtacaccgactgcggggacggacctctcacctctccctgtgaattggccgttccctatcacacctgcgacgcagacatggatcaggccgtgatgtacaaccctgatggcgactttctcaacgtgccccattacagtattattcacatccacactgcaatggacgtaattagcgtgggaccgcagaaaatcgacaacatctctcagggcgtccccctctccgacgacgcttccatgccgagccatcggtaccatctcgaagttatgacgaacattttcaacttcctgaatttggccccaccggtgacaacggaattggtcatgcctataggtttc

SEQ ID NO: 94049 - DNA, 483 bp, Heterodera glycines
  SCN-specific regions: Sequence locations=1-441
aaccaatgaccgactatgaccagttgaccaccgtctacgcgggcgacaaacacctgattgagctgaaagtgaaggcgaacacgcgcattggttggcaatacctcaccgaggaggaggacatcggttttgcggtgtacttcgacccctcgggcaatgccaacaatctgacggagatggactgcgtttttccttacattcgattggaatgttcccaagtgcccatttcgggttccctcctttgtgagcagtcgggccgatacataatcgaattcgacaactattactcgtggttctctgctaaacaattgcggtataacatcgaaatcgatgacaggggaatcggacaatgaaaaagcggacgaataagcgacagaagttgacagtgagaagcatagtaacacaaagaacaccataataataacaaggacgacgattatcaaattccagccaaatatttcattcgaataaattttatttataaaa

SEQ ID NO: 94050 - DNA, 717 bp, Heterodera glycines
  SCN-specific regions: Sequence locations=1-86,136-503,525-717
tcgttaaatgtcttttgtccctccttccgacggagacggcctctttacgagatgcccgcttttttagcggccgaagggaccttaacaaaaattgaaaaaatagtttaatttcaatatcaaaatataaaattatttgttcgtgaaactaaaaatcgcacattttcagcgacttttttggcgttctgtccgattgccgtgggcaggcgacttgcgctcgaagaccgactttcggcaggtccaattcggcctctcgactaacaatttaatctcatttacaaaatcattaattgtccccacccaatccctttctgcgctttgtctttcgtccatttgtccctttgtcgacactttgtcctgacactttggtaacactcctccaaaactgtcctgcattatttattattcgggactattctttttcatttacactttttgcctttgttggcgattcgctgccgcgcctccgactgagcggacgacgggtcgaagaagtggcgacggaaaatcataaaatcagtgagagacaattaattaacaattaattaacgaaagggggcggggacagaccgctcgcatttggctggggaagccgagagagagcggtcaaattgagtacggaaggcggcgcggcggacggaggcctttgcctttggggagggcgaagcgaatcagaagacggcccgatcaaaagcagcataattaattaatgcaatttgt

SEQ ID NO: 94051 - DNA, 466 bp, Heterodera glycines
  misc_feature (446)..(448): n is a, c, g, or t
  SCN-specific regions: Sequence locations=1-102,125-386
gacccttaaagcaccggctgagcaattaagagaggcaacagacgcttatatggctcggtggccaaagctgtggaggccaaatatcaccagcgtgaggagcagaaggtcaagcagtaccaggaagaacgagaggaatgggagcgaaggatggcggagacgagacgcaaatttgagacggaacgccacaattttgagcaaaaaatgcgcatgaaaagggaacaacagacggaggaattggcacaaatggaacaacaaatggacgaacagagtcaaaaacattgccgagagcgagaacaacaacagcaacgataattaataaaataatggcaaatttgatacttacaaaacaaatacaactaattaaataatggctaattggttgatggaataatttttacaatattattcatctattttaataaaataaataaaactatttttttgcnnnaaaaaaaaaaaaaaaaaa

SEQ ID NO: 94052 - DNA, 788 bp, Heterodera glycines
  SCN-specific regions: Sequence locations=1-251,318-788
ccccctttgagtttgatcaattcggctaatccacccatcttcgcctcctccaccgttttcttttccgcttccaatccgtccgcttccgtcttctctccgtcgttgttccgactgttcaacgcctactctcttctcgtgatgaccatggacgtgctgccctcctgctccgcgccccacgacacgaacttcatgagccaattaatcgagaagttggccgccgcttccattctctccagcgccggttcgctgtgctcctccacatccgcttcctcctcctccgttccttcctcttccactcatcccccgtcgcccccaccgtcgggcgcggcacgaaatttcaatcagcttagcggcgcccgctcaaagcgattcgactcggctgctgccgttcccggcgagttccactcggtgcagaatgcaatcgccgtcgctgtgctggtgcggctccaccagtggtgctgccggctgttctggctcaccattgtgtgcctgatgagctattacagtgatcagcagcaaaatcagaggatgagcagtggcggaaacgccgaaaatggggacaaatccgcggatgacggaggggcggcagagcgacagcggaggacattccgcgaagtgcgcaaaagcattgtgcaagcgacgcaacggcacggctccaaaaaggtcaccgacttggaaatgcagctgctccgccacttgacctgcccgcagacggccgttctgcgcccgctgcgtcctttccaccacaaaaagcggcacttcctctcccggcccccgtcgccccaact

SEQ ID NO: 94053 - DNA, 517 bp, Heterodera glycines
  SCN-specific regions: Sequence locations=1-517
gtcaatgtgtgttctatgacggttccttccctttgctgctgcaccaccttcgtctgctgtcgtccgatgcgattgtgtcaaattcggacgaagcgtcgacaagtgacaaacagcaaaaggaaagcaaaaacggaggaacaccgacgtacgtggtcaaaatgttcagggacgaaattactatcaatttttattccgtccaacacattgtgatcgttgaatggatgtcaaaccccgtgaatgatttatttgccgatgcgacactttcggccattcttcacgcccaaaccaaccctatcctcgataaaaatgttccgaaggatttcggtgcgaaagcacagcaaattgagcaaaatttggaatcgattttggttgggacactgtgcgaattatgcggtgacaaaagttttgtggaagtgaaagaggaggaaaaccaaggggaaaaggacgcagcagcggaggaaagcgacaaaaaagaggggaagagacggagagtgattcaattggagttggacgggaa

SEQ ID NO: 94054 - DNA, 730 bp, Heterodera glycines
  SCN-specific regions: Sequence locations=1-730
catcctatttctgttcaatgtcttcgtttttcatgcatcaccacctgaagcggtcgcaccaacaagcggccgccgtcactttggcggacattcgctggatggaaccgatggccgcgactgaaagtgccgctacttcaacaccggcaaagcggctgttggcacgactcggcacaaccagagtgggccgctacgttcaacagttggccatcgattacgcagcttccttccgcgacatcgtcgttggaatgcgtcagcgaccgctgcgagtgcgtttaaatatgtttccgactgtcagggtcacggacatgcaattcattcgatcctctaatggccgtcgcttgcggcgccgccttggcttcgcttgtgttcactttaaaatccaatccggacgaaattgcgctgcgcgcgcgtttggctcagttgcgtcagcaaatggtgctcatcccggcgtccattcacagcactcgtgccggtgaatacatttgactgggggacaaaacgattattctggaaggggctcggcagttcacgaacggctcgagcagtacaccgtcctgttgaatgggaatcggcttgaactcgtcgactttttgctcttctctgtgctcgttgagcgtccgtttgacaaaaagaatgacttttacgctgcccacgacaaaacattgcgtggatggccgtggacggagctgtggcggaacgcgtgggacatcggcgcgttcggccgtttctg

SEQ ID NO: 94055 - DNA, 291 bp, Heterodera glycines
  SCN-specific regions: Sequence locations=1-107,129-291
caccatgatactaacaaataagcttggatttatctgcaaatcatccatgaaattaaaaatgcaattctttgttggctccaagctcccattggcctttctgctgctgcttttgttgtcttttgtgttttccaatgccaaaaaccaaaaggccgttcatagtgccggcggcacttgtaaaaggggaagaattcactgcaacggaaagtgccacaaaaaatgcacgaaaaattcgcagtgttttcacaagttgcgctgcaaaccgtgccgaggcaccaaagggcgccacgcgtg

SEQ ID NO: 94056 - DNA, 433 bp, Heterodera glycines
  SCN-specific regions: Sequence locations=1-339,361-433
gtcagccatgagatttcttacacaacaaaaagcgatagacatctacggggagctgttcggctcgcgacgcttcagccagcaccaactgatggaattggcagggatggcctgtgcgcaaacaatctgcgaaacgatcgacccggggaacgttctcattaagtcgcggtctgggaatactcgcctgtatggactcggttgtgcgcgacgcttccagcatgttggattttcgcctacgattctctggcctgaaccatcactcgatgatctgatgcaacgatagatgcttcaagtggaacgccacggcattccctgcaaccaatcattccatgaccccagttctattgagaagttcaccttcctcgttgacgcactcgtcggagttaggtttcgtccctcaacccggggagcaggcgagaccattttcaagcagatg

SEQ ID NO: 94057 - DNA, 743 bp, Heterodera glycines
  SCN-specific regions: Sequence locations=1-232,255-743
cacgttcttaaagacccaacctattatcccgacgggataaaaacttctctgaagtgcgatggttcccgtcaaatccgccaaggaatatgaccgtcaacttgacgtagcagtgcttttttccgaatgtttgactagggctatcaaaatgggctacatcaccaaggaacaaattgatgattgtgacccgaacgtgatcatttctttgccaaggcttgccattgtttggggcctccttttttatcctggcggtgcccttaatgttaatgtgcccaaagaagacatatctgaaatgtttcggcatttccacaaagtgctcattcttgtccgtaaccttcttcaaactctcgaacccagtgaactttccaaactcgagcaaaaattggttggcgaacacgacggacttggcgaatcttgctcatcagtgcgtgccttggaacaacaaattgagcctttctcgggacgatcgttgaatcgtcatgagcagcagaaactcattgaaaaatatgaatatgggccgaatgatttttctgactctatttctcttatgagaaattctcaccgcaacgcacctttaatttcaattccatgcactgattatgaaacagacagaaaggaaaattcaattgatcgctttgcatatggaacttctgaaaatctgatccatcgtctgtttgtttgcattgcaagcattgctgatcaattgcagtcaaattattccgctgatatacgaaaagtgctcaaaa

SEQ ID NO: 94058 - DNA, 458 bp, Heterodera glycines
  misc_feature (436)..(438): n is a, c, g, or t
  SCN-specific regions: Sequence locations=1-161,194-348,370-438
gtccattaagatagcgacgatttgcgcctttatttttccattcccctagaagatggccaactgttcccattcgtttcattgtgtgactctgatgacaaaattgagacaaactttgggcccaatttcatggccatcattccgaagacgttcaaaattgtgccaacaaatcatgaaattgttttccgcactccgtcgatgaacaaaagtccgtcttcaaatcctgaaaatgttttacgcactccgacgaccagcagcattatttcgccgataattcttgcttcatttgtcatgcttatgtgttggctttttctaatttttattttttttagaattgtaatgtaattttgcacacttttcttctaccattctcgattctccattttatgtaatattacggcatttttttttgttaaataataaagtgatcgatcgaccnnnaaaaaaaaaaaaaaaaaaaa

SEQ ID NO: 94059 - DNA, 801 bp, Heterodera glycines
  SCN-specific regions: Sequence locations=1-79,101-801
ttccctaacatctttctccgtctgtccgttgtccattcccacccaccttcaaagcctccccccgaaaaaagtccatttgtcccatttctctttctttcccacaaaatgcttttttccatcatttccttcatcattttcttttattcggtttcctctgatcagcaacaaaatgtgtcaccgttgcgcaatgtacgggcacattacgacgccaaaatggacacaattttggtggattgggaatggagtgaaattggacggaaggaaattgaggattacaaattgtttgtccactacaaagtgtcgaatcagcacagacacagagggctcaatgaatggcatcgcgtgtcatccgaagacgactctctcggggcaaagattccgttgggccaagcgttgaacaatggcgacgaaatcactgttcaggtatttgctgaacccattgaacggggctttgcaactgaacagagcgatccgctggtaatttggatagcgagaaagtcgcaggacaaaggcaatgaaagcggagaaaattcggagaatggcgcgatttccatggctgatgagcttcttccgccgtacaatttcaccgccaacattctcagtcccggcaaagtgcgtctcgagtggagaacgcctccgctgccctcgccttcgtccgtccctttttacattgtgaatgtccgtcagctaagggccaatacaggggatcgcttccctccccaaacacttcgcgtcgatggcactcattttttgctcggcaatttggtcgctggagaaaactttgaggtcacaattcggaac

SEQ ID NO: 94060 - DNA, 661 bp, Heterodera glycines
  SCN-specific regions: Sequence locations=1-661
ccccttaagtgatgataatcattcgctgtttttcaattgtttcttcaagtggttcgtttgctagttgttttcaatgctcgaccatttccagcaggcgtttcttctgccaccaaaggcgggcaaaggtttcgactccgtgtccccctccccccgatccttcggcggaatttcgtgttgttccaacttcgtcagttataccgcccatctcgggcacggaaaatccgtcgcttggcagaggcgaggcgcggcggatttcatcgctgatcaccgacaatttccgtgccgacgtcgtcgctcgtcgctaccgtttggaccgccttcggccgtccgattggctgctcgtctacaattaccgggtcggctcatggcttttcacggtcggccgttatgcgtttgcccttctctgcgtgatatttttaattgccgtcgatgatttcgtgcgcgtgggcggcggcaaattcacactccaaaagctcagagtgacacacaacgaactgattaggcttggcatcgttggcaaattcttttgtgccattgctttgctcatttttttcctgctgctgcgcgtccggtcgctgtttttgctccgaatgtatgtgcacagaaaggagccgaaccgaatttgtgcgaccattgcgaagggagtgttctccaaaaaatt

SEQ ID NO: 94061 - DNA, 754 bp, Heterodera glycines
  SCN-specific regions: Sequence locations=1-612,634-754
ggcggcgacaaccgcttggatttcgattggttcgcctaatgacctcaacgaagagcacttccctgatgaatatgagccccccgatgtgccgaattatggcgcgaaagtcaaagtgtgctatgcccgagtctgacttgctgacaaggaaatcagtcgcgcaagacgactacgactaactcccagcgctcaggacaccagactctttccagactacgaagtgcccggagtgatccacgacctaggccccgaagcacctcccggagagtacgactcccaagtcgcccacttagtcattgaatgggcctctgattagatgtgccaacatggctatgctgactatggggcagtgccccatttgccacttcttgccgagattcccgacactttggcaatgcatgtcgcgacgagtcttcccgccagcgcttcttgggcactctcagctagtgtgcatgcccaacctgtcgttgaggacatcaccagcacttgaggatgctgctccattttcactgctgccgctggtggacttggactttggatcctgacgttggcctaagcttttcttaccgcgggactggataacacaatcaaactgattgttgctgcctctatcgatgagagactttgcctcactgaacatcatgtaccagactttctagtgcattgtgacgattcggagtctttcgaatatatcttcctgcgaaccttggctcgtcttaccaatggccttcacattgtgttcgatttcgtcacttcc

SEQ ID NO: 94062 - DNA, 798 bp, Heterodera glycines
  SCN-specific regions: Sequence locations=1-11,33-315,337-798
ggactttaaacatctgcagatgaattatgctgcctttcccttaggctgtggataactaccgtccccaagtggcattcgtttgtcatggtgaaagttcgaccggagtcgtccatcccttggagcgttttggcgatatttgcaatgcatagtaagtaatttcatgtcaaactatcaaatctctaaaaccatttacgtgtatccacactttccaatctgtcccccttagtgacgttcttttcctcgtggacaccgtcgcctccatttgtggtgcccctttccatgccgatgcgctgaaagtttctcccttttttcgaattttcttgcatttttatatttgaaaggttgattgtgtgtatgccgcaactcaaaaagtgttaaactgcccgcccgggttggctcccatttcattcagcgaaaaagcactgtaaaaattagtcatattaaggaaaaaaagtttaattcagggagaaaataacgaagcggaaaacgcgagtgccctcattttatttcgacgcgttagagttgggcaattattggggctgtttcgacgagccgaggaggttgcaatttttattgcaaaatgcaaacaaaaaacggaaaatttgaggacgtttaataaaccattcaatttatagataccatcacacggcgcccatttcgttggtttatgcgctacgcgaaggtctttcagcagttgcccaggaaggaattgggcacatggtaaaccgacacaaaatcaatgcaaaacttttgtatgacgcttttgaccaattgggactggaattgtttgtccaaaaa

SEQ ID NO: 94063 - DNA, 322 bp, Heterodera glycines
  SCN-specific regions: Sequence locations=1-151,174-322
ttgcagtcatgagtttctgttcatttgtgatcctttcatggtcaatggtcagtcggccgtcgatttatttacttcagtgatgggtcggtccatcagccttttattgaaaacgttggaagaaaaaattgctgccaatttcgatgcgatttcgctttttctgtgcatttgtttctgcgcgaaatttcgcgaaatgatggccgaccgtgccgttgtggtcatcaatggttattgagatgctttggtcggtttcttatgggctcgggtggatgccgtgatgactggccacagtgacagcgtaagggcgattgatgtgcgcaaagtg

SEQ ID NO: 94064 - DNA, 628 bp, Heterodera glycines
  misc_feature (514)..(514): n is a, c, g, or t
  SCN-specific regions: Sequence locations=1-628
cttggccagcccaattcaggcgattagcgtgtcgctctgcggcgagttgggatggatgctctacatcccgaacgaactcgatttaaacgcctatcaacacctggtggacttgggggtctagtaccgtctccagcattgtggctgttacgctcttccacacttgctactcgagacattctccgtatattgtggaccaaacatttacaccatgactacgcctgtcaaatgccgccggctattctgggcggacttttcatgacaatttatcagccacgacgcgctgaccaggcaattggaactcgggggcagctcacggtttgtccaactgccggtggaacgctctgacttggacaggcacccttggccgcaccgtgacgagcccctctaccgagatgggacattgttcaggtggaccaccacggccgcgtacagattctcactgtaatgtgctgcttgcttgacgctacgtgctttaacgagactactccgtgtcacctccgattactctcctgcngctgctcgtgcgacattgcagctggccgtgacgcgattcccgggccagatctgtttgcactcaccctcattgccagtgatctcttccgatcatccactgccctacctaccgact

SEQ ID NO: 94065 - DNA, 272 bp, Heterodera glycines
  misc_feature (110)..(110): n is a, c, g, or t
  misc_feature (152)..(152): n is a, c, g, or t
  misc_feature (170)..(170): n is a, c, g, or t
  SCN-specific regions: Sequence locations=1-272
gttccatgtgtaataattttcaacgcattggcttttcgattcgcggccttaatgaatcggcgaagaaacgaataaacaccccattgatggggtcacttaccgccggccgntcaactttggacattctccggctttgtcagccggacatccanggtggtgagcgggggccntttcggatggttgcggggtggctaaacgtgggacagtttttattcgacgggcaacttccgggagttgtttggggcctaaggcacgaacattccgccgccgct

SEQ ID NO: 94066 - DNA, 709 bp, Heterodera glycines
  SCN-specific regions: Sequence locations=1-92,129-191,214-233,257 -376,407-449,474-684,706-709
atgccataaaagagttaattaataataattattccgcaaattttaaccacacctattaaatcgttcatttcaaatgaattctgcgggcggcgatgaaaggaaaaatgacaagatgaaaggcgaaaaagcggaagggaaagacggaaaagggacggcgagagagcatgtggaagaggcgaagacaggcgagaaagatgacgaggaagacgacgatgtggtcgtaattggcgaatgggagggagggagagaaagagatactctctccaccgccagcgatcgttccccggccgtccctcataaggcgctttatccatcgcttccgtccgattcgtccgcttcccaaatggaccctcctccgcagtatggtcatcctcaagctcagcaacaacagcagcagcagtccacgtggttctctcctgcttcctttctcggctcttccaccaattcgcctccctccgccgccaatggcaccgatcaatcggtgccgtccgcctcggccagtgcccagcgattgctgaccgaactccgtcagagatatcagccgtggtccgtgttcttcaagtgcgccaagttcggttttcctcccggcgtggcagcgattggaccgcgcgtcaaacgcaatttggcgacatttaccaccaattacctgtgtcttttcgcccttctccttctttactgcgtgctcacttctctgctgatgctgctcagt

SEQ ID NO: 94067 - DNA, 281 bp, Heterodera glycines
  misc_feature (254)..(254): n is a, c, g, or t
  SCN-specific regions: Sequence locations=1-211,234-254
actccttgaaatcattatcagtgccaaatattaaggcaagaaaaacctaagatgagatggaggattcataaaactgtcgaatgtttgtaaacatcggactgatgatgcctaaatgaaattgtttggtggtcgccaatcggtccttggaatgttggaatgccgcatagaaaagcagggagaaatgggaacgaaacgaatgttgaaaagcacaggctcttttgtttgttcattttaacaaattttccacttcaccnaaaaaaaaaaaaaaaaaaaaaaaaaaa

SEQ ID NO: 94068 - DNA, 779 bp, Heterodera glycines
  SCN-specific regions: Sequence locations=1-545,567-779
atcatagagggcacgctcatgatccctgcctgctctgcgcacctgatagtggaccctctagattgactgcctgaccggacaccatcatggctcacgctgcttcgtccctcgtctccgcgtccgcaaagtatgcccgccggctcctgcacattgtcctctacggcacggccatgggcgccattgccctcaccagcaatgtggtccaagtcgtcaccttgctgctgtacccgttctcccgctcgtcggtggcccgcatcaacgcaaagatctgtgaggtgatttggcgtacaattgattttgccatggagcgtcacaataaggcccaaatcactttctctggcgacatcaactcgattcccgtcaacgagcagcccgtgctgctgtcgcaaaacccgcaactcaacgccatcgagtcggccattgtcatcagcaaccactgtgctgcgatggactgggcgctcatcaacgccgtggccatgcgccgcggcatgttggcgcactgcaaatactttgtgaaggcgagcatgcaatgggtcccgttctttgggcccggcatgcgcctcgcaggcttcccttatctgtcacgcaactgggccgccgacaacaagaaaatcgaagccgtattccacgggctcaaatccgacaaacttccctgctggctcatctccgtcctcgaaaggactcgcagtcagcccagaaaacttgccgaagcgaaagctgtctctcgcttcaaaaaactgcccagggtcaacaattgcatgaacccccgcaagaaggct

SEQ ID NO: 94069 - DNA, 729 bp, Heterodera glycines
  SCN-specific regions: Sequence locations=1-273,295-729
cgtcccttatgcgaacaccaacaattgctggacaaactgaagagggacctagcggaactcgaggcagaagcaggcggcgaagtgcaaaaggaaacggcggcgacaaaatcgggcactgtttcacccgaaaagaatgccgaaatggatgtccaagatgcactacgacgtaaaactcgaaaacgtgcagccaccgcttcatcgtccgtttcgtctgcgtcttcaccaactcgttctccaaagaggtccaatgccatggacacgtgcgaccgaatggaagcttcctcctcccatcggacagatgagtcccctccagccattaacctaaacgagtccaactcgctttcgcaccgccatttggctgaagaggccaatgcttcggttgcaggcgattcagcgacagagtccacaacaacagcagcggcggcacttttggtcaaaaagggacggaggagagagttggacggactgctgaagatggactttggcaaacactcgcccttccagacttcggacccggacaaatacgcgcaggaagtgctcatcgaggcgcgtcagcagcagcgcactttggcattggcacaagaggagcaacggaatgcgcgtcggagcgtggagagttcctgcggcggttcagcgacggggaaaagcagcaagcgcgacaaatacgcaaaaaagcctttttcgccgcccgtctcgccactgcccgagtcacgtgccgcttcagtacgg

SEQ ID NO: 94070 - DNA, 487 bp, Heterodera glycines
  SCN-specific regions: Sequence locations=1-487
gtcccattaagattgtcctcagtttgtctttttcatccttttgacctctttttgtcatttccgatgtctcttaatccatcggctgaccctttggctggcatttatcagaaagaactcactgaatacgacttgaatcgattgccgcatactctgaaaaagggggaggatgatcagttgctgaagcggtccgatttgattgatacgctcaacacggaattttcatgtccaatttgcttggatttgctgaaaaacactatggtcacggaatgtcttcaccgtttctgttccgaatgcatcaaaaaatgcatttacaagggaaatagggaatgtccgacttgtcgaaagaaaatcatttccaaacgcaatctccgagccgacccaaacatggacaaattgatcgacaaaatttggcctgatcgtgagcagtacgaagcgttgcaacgcgagaaggcgcaaaaatggagcaaacatttcgatgttgtcgcat

SEQ ID NO: 94071 - DNA, 728 bp, Heterodera glycines
  SCN-specific regions: Sequence locations=1-704,726-728
gttcctggcgacaaaacgccgttcgctgtccgcggcgacatcttccagccgattggaggacggaaaactcagtacgagtggatcgatgcaaagcattggagaagaagaagcggaaaaggaaagcgatcatcagaggacggaggaagcgaacaacgaaaatggcaaaaacaacggggggacaaaggccgaaccgatacgaaggcacaacacactgagcaaaacattagctgtcgtcttggagagggacggcaaattgtcagtggcacattgagtgaaagcgatgttagcactgacaactgagtcccctcccctcccccgtcgccatcgctttaatttaagtttagtcattttccgatgcctttttaaagagtgaatttgtcaattgtttgttgtttcgccatcatatctctgttttgtttgtttgttttgtgcttttcctccgatcacttttctcttccccaatcgaatgaatgctcaaatccgtccccccctccctatttcctaatcattcgtcgtcacttcgttaggtttttctcccccccccccaaatccgtcgccccttttccctccgtccgttttccgtgcgtttgccttctcatcagtcaatcattcgctttactcaatcattcaatcattgatcaaatttctcatttctgtttaaccgataactttttgtgcaaaatgaattattttgaatgctgcaataaaaaagaataaattaaaaattt

SEQ ID NO: 94072 - DNA, 289 bp, Heterodera glycines
  SCN-specific regions: Sequence locations=1-289
ttttcgatctctggtgctttaccgtcacttctttgatatagacgaagatcacgtttttgcccgcttgctgcacagtgctatgcctgcgcagacgggcaatttcatctcccaatttgtgcggccgtacctctaattgaggggaccattttggtggactgtttgcctcgtgttttcgattgcgactgatggctatctggcactattcttgcatacatacagctccgacgatgtgcttatcgactacttcagctatgtcactgttgccactttcctcgagtacggttacctg

SEQ ID NO: 94073 - DNA, 662 bp, Heterodera glycines
  SCN-specific regions: Sequence locations=1-88,114-423,445-662
atcttttatgaacaaaagaagtgaagttttacgattataccgacctataattcgcctttcaaaggattgggtggcccaagaaccgacgaacacaaacgaagaacaaaaatacatcagagaagaggcccaaaaagggttcaaagcgtacaaaaacgagaaggaccctgaaaagattagtgaattgctgaaggaagccgaaaagcgtctggaaatcgcctgtcattaccaaattccctacgaccgtcccttttatttgcctcctcgttcttccttcgatgtcgactcatcttccaagtcggccaaacagcggactcttcaccgctctccgatctcttccaaattccttccgtccgccgcttctcgcggaaactcttccgactgaactcactgaaaatgtcactttccgtgcgtttctttcctccttttttgcttcttcgccgatcaccgtagaaaaacttgacaaatttttgaaacaaatgcaacaattcccgaatttggacgcgttggtcttccgttctccggcgagtgttcgcttcccgccaaagagtgaatggttcagggcacttctgaagcgactgattgccaggatgaatgagttccaatttgatccgagtgatgttctttatgagtcgctttgtgcttcgatggcttccgactcagaa

SEQ ID NO: 94074 - DNA, 485 bp, Heterodera glycines
  SCN-specific regions: Sequence locations=1-133,155-485
gtccatttaagaaaagtgataataaacaacaaaaaacatcttatttattttaattgacgtatttttttcttgtcttatcaaatgacaaatcatccgaaaaaaactcagcgaattcagcggaaaataataaacgctttttctctcttttcgtccgccgattccttttggccttccgttttcgcattttcctcccgtgccgaagttggcctcaaatttgcccaactcagcaaacatttcgacgctttgacagacaaacacttgactgtcactgaatgttttttgggcattttgcacattcgacggtcggaaaaaggcgaaggcgcggaaattgtcaaattcgacgaagacgggcaaaaagtgctgcccattccgcagaacgaactgccggaccgcgtcatcggattcagacgcctctcaattggcttcgtcgatcattctgtgcttgcatttctccgtcttattcaccgtctcatcgacaacgaatc

SEQ ID NO: 94075 - DNA, 688 bp, Heterodera glycines
  SCN-specific regions: Sequence locations=1-688
gccccttaagaaggactggaatttgttctacaacgaatatttggggctgagtagcgaggagcggcagctaattcattcgatgggtctttctgaggctgttcttatccgtcacattcactcgcaccaccaacaaaaggacccgagcaaagggatgcgaatttacgttgtgtttatgcttcgtcaaatttggaatcagaagcccttgtgggaggtggcgcgttatttcggcgtcccccggggttggcttcagtccgttttgcagtccgccgtctgtcagtcgagctcaatcgttcgttttgcggagcgaacgcccgacctttgggcgttgcgttcgctgctgccggaaatggtcaggcgtctctgcgaatgctcccgccaggaattgattccgttgcttcgcattgaatgtgtgaaaattggacgcgctcgtcaactttacgagaacggatttcgcactgtcggatcgatatcgaaagcggagccatgccaactgatcaaagcgctggaggggaaactgagttgctggcagtgcagacgaatgatcagcagtgctaaggcaatcatccgcgaccaaatagcagaaaaagcgatggaattggaggaattgggagctgacggactgctcgcttttccacctaccttttcgcttgatcaccaaacggaccaacgacagaattacgagtcggcc

SEQ ID NO: 94076 - DNA, 712 bp, Heterodera glycines
  SCN-specific regions: Sequence locations=1-203,226-296,320-712
gttcgatctgagttaatttgaaactttgaagtgaacactttgcacccttcaaagttaattgtcaaaataacagtcaaaaagaatgtctgctgctccgacagcgcattatgcttacaatgctggcgacccaaatgttcagggcgcaacatcgtttgacccacagctggcacagaaacaatatgaggcatggcagcagtattatgcacagactggggctggacaacaaccggtgcagaacattcaacaacataccggacaagaggttggtgggacatataaagcctattttgaccagccggtccccggcacggtgccgcccgctgctgcgcctcaaccgctcgccagtgcttatgttggccgtcccgcttcgaatgcgcctgtctttccaccgcctcaaccaccgcaagtgcaacaaatggccgccccagttggtggagcatgggccgccagtggaggccctccccaacagcgcggaccaccagcgccattgaattcgttcatgggcgggccaccgccgtacgggcaacaaacgccgcgcggtgggggctttcaacgcggcgggggcagtcaaagtcgctggagcagcggtgggagtgaacggcaattcagcagaaggtgaaaactgcgcaaaaatttggggaattgagtgataaaaatagaccaaacgagtacaattatatgttggtctatttaatttctctaagttacaaag

SEQ ID NO: 94077 - DNA, 826 bp, Heterodera glycines
  SCN-specific regions: Sequence locations=1-49,71-366,388-826
cttccgtagattatgccttcccaacaaaaccggtcattctgatgccgtcttcggtgtttggacaaaattcgctcaaattaggcccgggctgcccattctttgaccagtgctttttcacctatcaacgtcgcgcattggcccacgcggacgccgtcctctatcacgttccggacatcaaatggacttcagacgaacgcccggactttccggaacaaatgttgctgccggccaatgtgaggaacgtttttctcacccaagagaatccgagtgcgctaagagattatcaccacgcggaaaagctcagaaagctcccaactttttccattggacattgacttatttgcgttcctccgattttgtgatgccttacggtggcttttggatttctcccgaggaaacacttcgtctcggcttttcgcccgtccgtctgcccactgatcgcactaccattttgaaggacaaaattgtgaggggcgccgtttggtttgtgtccaattgtcgcaccgagtcaaagcgtgaattggcggtggacgcactttccaagcatatgctcataaacattggcggcaaatgtgccaaaactgagcagggcaaaaaactttgtccacgcaatgcgacttcctgtgaccacgtgttttccgcccattactttttcatcgctgccgaaaatgacatttgcaaggattatgtgactgaaaagtattgggaccgttaccgtcttccctccgtgccgattgtaatgagaaaacacatttatgaaggcatcgttcccaacaattcgttcattgccatggaccaattcgactcacccaaagcaatggctgac

SEQ ID NO: 94078 - DNA, 761 bp, Heterodera glycines
  SCN-specific regions: Sequence locations=1-194,217-497,520-761
gcgcccttcttttcccccgccattttccccgttttgctgtcgttgtcgtctgctttccctcttcaactaattgcatactttttgttggtgccattggggatggcagtaggcaaatttttgtgccgttaattcaacaaacgaatgacaccaaaaatgggactcggtaggggagacaaatggttggcaggcaccacaatgtgcaattggagacaaaggtcgtccacgcgggtcggctttggtggagcggaagatgaagacggaagatgtggagaaatgcccaccactcagtatttgtacccccggggggaatttctcgctcgcccagtgccacgcccacccaaatttgaaaaagccacccccaccccatttacgccgcccatgcaaagcccacccccaaggattttgggcgctctcgtgcatacctctaatacagagatatttatttgcattttgaatacataaaaaaggaaacgaggttgttagagcacatagacgggaggacaaaattttgccttttgggcaacagcgatgactcaccaccacatgaccgaccattcattggcattcattagccgccgcctgggacaatggcacaaacgaaacggagtggattttaacgcgaaatgcattcggagaatgctcttagagtaaatttcttaaaagcagaaagggactcgaaattatgagttttgtcccgacactcatactccaaacttgacaattgggtgaataaattcgagaactttttcttattaatcgac

SEQ ID NO: 94079 - DNA, 315 bp, Heterodera glycines
  SCN-specific regions: Sequence locations=1-42,64-315
aatcgtcttgctgtatcagcaccttcattgttttgtccactccattcatttatttgtgtatgtgttttttttttgtcaaggttgagaagctagccagagaaagcttcttcttccttggagagtctttcccacacgattcagaaagctttggtgcattccaagacacattaacaatccagaagcctatgctagtctccagaccaatctcctatgtctttaatctccatccgccttctgacatccagtttggtaactacacctctcttcttcgcaaatctcttcacaacaaatgatctcttggtgaaaaaaaaaaaa

SEQ ID NO: 94080 - DNA, 801 bp, Heterodera glycines
  SCN-specific regions: Sequence locations=1-772,794-801
ctctgttcccccgtcctcccaatggtcgtccctctccaatccattctccccgccattatttccgtcgcttattatctgttcgtgttcttttttgccgaagtcagtcgcaagttggtcgacctgagtctgaagaagtcttcgctcgtccacctgttcctcatcgaactgattgccactgctcaaatgtgcacttgcgtttatgagaatgccatcatcatcaaacattacggtccttccggcttcttcctcgtcgtcacttttctccaaatcgccggtgcctttttcaaccgcggcgctttcgtttctccgctcgctcccattgaactgtttttgcgcggaaaaatggacaccgaaaagtttttggcaattttgctgtcgcaaactttgggcggttactcggcatttcgactagccaattccctctggtattactcgcaatcgtactcgacggatcaccaccaattttacgacagtctcccgtgcgctctctcttacaaagtgcctttctattgtgcccttctgttcgagctgttcggctcctttttcctccgttttctcctccaccgtttccccctctcttcccggcatttcttcgctccgccgacaatcgccgctttcctttccttcgcactcactttcatcggtgttcctggccttaatcccgtggtcacttcctcgaggcttcaaggttgtcccggcttggacttgcaatggttcattatgacttattggtgttgtccggtggtcggttggcttttggcctcaaaattggacaaaacgccgacaaaacagaagaaaaaa

SEQ ID NO: 94081 - DNA, 414 bp, Heterodera glycines
  SCN-specific regions: Sequence locations=1-414
aatcatattgtgcttttcgagcttcgatggaatgcgttgaagtcctaattttattattcggaaaagctcgggagatggcagaatgccaagaaattcgccagattttgccgaaaagtttgaccagcacggaactttacaaccacatttttgagaagattttccccgctttaatgccaattcgaaattcgtgtattttgacagtgaatcatcgctattgttttgaaggaagagacgccctcggagggacagaaaatcgcatcgaattggaagaaaactccgaaattgcgataattcccccaatatcaggcggatgaaaaagcatcagctgggtaacaactgctgattggacaggccgacttttgcggattaagtaaattgaaataaatttttagaccagaaaagaaaaaaaaatga

SEQ ID NO: 94082 - DNA, 639 bp, Heterodera glycines
  SCN-specific regions: Sequence locations=1-47,69-213,282-293,325 -454,520-639
acctttagtgggattggcgaatccgagcgccttttggtgtcccttcggggcatcgtttgcaacggcggacacttccacagagacaacgtagacatgcgcagttgaaacacagcgccagtgacgcattgaccatggactacggcttgggacgcatacgccgaagacggtccaattatggagcgatgtcaccgacgaagagtgtccaggaggtacaacccgtggcattgtcttggcacggtctcaccgctgtccatgccaaatcgggacggaaaattcttgacaatgtgtccggtatggccgacgcgggccaactcgtggcactgatgggcgccagcggggcgggtaaaacaacgctgctgaacacgttactcaaccgaaatctgaagagtctgagcgtggagggccaagtgctggtcaacggacattccctgggccggtccatcacttacgtcagcgggtacgtgcaacaggacgacttgttcatgggcacgctgacggtgaaggagcatctgatggcgcaggcacagcttcgcatggtcggacacacaaacggacgatgcgcagacgcgtcaatgagatcattgatgagcttggcctgcaagagtgtcgccatgcgcgcattggattcagtggggtcaa

SEQ ID NO: 94083 - DNA, 319 bp, Heterodera glycines
  SCN-specific regions: Sequence locations=1-319
gaaggcatgcctcattttgcaaggtcacctttttgagtctaacggaatacttcggcggattggcaatttaatggcggatttgtttcgtggccccacagtggagtacttacggcttcaaggcaccgaattgataatttcattgacagcaccttcctaagagcggattaaattcataccttactgagcatctctaaagaaggacatggaatctgcgaccccaaaaatagaattggttgacatgggaccgaatattgacttcaaaatcgacaggacgatattggcaagcgattcgctcttcataactgcactcagaaaaccc

SEQ ID NO: 94084 - DNA, 346 bp, Heterodera glycines
  SCN-specific regions: Sequence locations=1-134,158-309,331-346
tcgagatgtatgtgaagccgcgcgtcgatagtaccgacaaagcattttgctggagtcgcatagactttgataaattggagacttttcttcggcggaaactcggcttatcttttgaatcatttagcaaaatgacttttggtgcctttgaaaaatggaatattttcatccaacaaaataagcagagataccaaatgagaataactgaatttgcccgaccaaacgactcatttggaggtattttggggttaaacccaattccgaagcaaggggaaagaattcgacgagcactcggagccataaaagatccaaaggaggaaggcagaagaaaagaaactaaaagtaaaaa

SEQ ID NO: 94085 - DNA, 336 bp, Heterodera glycines
  SCN-specific regions: Sequence locations=1-235,261-336
gtctctttaaaggttattcatttaaccaacaagtgatcaaactcaaccttataagaaaatagcaacagtgttaacttcgttttccaactcaagcagaacagatgatgatcgcccgtgcctatctgaacgggttggagcagtccccgcaccatttgctgaactcttctgacacggcgtccgccattccgtcctcctccaacgacggctcctcctctctatcgtccacgctgaaggatgcctcgtcctcctcttcgtcctccgcgcacactttcgacaactcttccgccgctcttcagtcacttccattccctccgaattggtccccccgctgaactg

SEQ ID NO: 94086 - DNA, 208 bp, Heterodera glycines
  SCN-specific regions: Sequence locations=1-208
tccgggtgcctacatcaaatttgaggacgagcgcggtgtggaggttgaccaacctttgaccaccaccgcgtttctggaccgagcgctggtctgcattccgccacacacaaatgccattcccgacgaggagacaccgctgcaaaccggcatcaccgctttgcccggccaacggcaactgccgccgcacatgaccaaccaactgcatgac

SEQ ID NO: 94087 - DNA, 559 bp, Heterodera glycines
  SCN-specific regions: Sequence locations=1-53,76-84,106-341,363-559
gtcaattaagatggtttaatataaaaattgaatcatgatcaacaccattttcattgtaaattcttctcatgatgttatattggaaaagcactacaaatccgtcatccatcgttcaatttgcgattatttttttgatgtccaaaaacaatcaccaaatgccgaaaacattcctccggtcattgcggcaccgcaccattacctttacattgtccaccacaacagcctgtatttcatagcaatttgcgtcacagaaactcctccattaatggttattgaggttctgcacaggataattgctattttcaccgaatattttgacgaatgttcggactctgcgattaaagaaaatattgtcattgtttttgagttgctcgacgaaatcctcgattatggttacccattgtgcacagagttaaatgtgctgcaggatatgatccaacctccgaatttttttcgttcctttaaaaaccaagttacaggacggacaaacatttcagaaatcctaccaacagggccattatcaaatgtttcatggagaagagcttctgtaaattttgca

SEQ ID NO: 94088 - DNA, 483 bp, Heterodera glycines
  misc_feature (457)..(459): n is a, c, g, or t
  misc_feature (461)..(461): n is a, c, g, or t
  misc_feature (463)..(464): n is a, c, g, or t
  SCN-specific regions: Sequence locations=1-459
gagactttctctgtgccatcgcttctgccagctacaccgttcacttctattttcacgtttccagaacatcaattgttgagccatttgaattgttgctgaacgaacggacgaccaacgaaaagttgacactgatgaaggaaggaggagccaattttggccgaaattgttggtggacgatgaagcggtgcccaattgttggggagggggcagcggctcaattggaagacgacgacggaggaattaattgggacgacaaattgaacaatgtccaaattaatatgtgggctcccaaaaattgcattggcccattgtcttcgccaccagcagcggaagaagaagaagcgagcgggtcaatgcgaagaaaaaaggcgtctgatgagtgcgcggaagtgaattaattatatttgagaaatgctcgatcatctcaccaattgcaaatgaaatttgattgctctcnnnanannaaaaaaaaaaaaaaaaaaa

SEQ ID NO: 94089 - DNA, 837 bp, Heterodera glycines
  SCN-specific regions: Sequence locations=1-527,549-837
gtccatttaagttgacaaacagttgcatcactttgtaaaactctgctccgatgagtccattcaatcgcagaatcagcgccaactcagcttacaacaaaagtcgtcatcaattcacaaatcaaatacgaatgcatcagtgatttactctaataagaaaggtccaattccgtcagtgctgaaccgtctgtgtcgagtggtggtactgctggagggtttccgcttaatggggatccgtccgactttggcgcggcaatgcccgcaacaaattccccacagtcatcaaatctggcggaaaaagcaacggactctctgctcaacgggctgcagaacactccggctgtgacttacgaggatttaactgtcgcgactgacggattcagtcccaacaaaatcgtcggcaggggcggctacggcgtggtctatcgcggagtgtggaaacacacgccggtggccatcaaacgaattcaggggaagtgcggaagtgacgaaaggcagcaaagggagcgaattcgtcagagtttacaagaattgaagactttggcaaagtttcgacatgacaacgttctctcactgtatggttattcgctggacgggcccgagccttgccttgtgtaccaattcatgtccaatggtacgcttgaggaccgtttgctatgccggaatgggacggagccactcggttgggccaaaaagctgttcatttgcgggggcgtttgtcgcggcctgcactttctgcacaccatcaaccaaatgccaatcattcacggcgacgttaaatccgctaacattctgctggacaagcattttgagccaaaacttggcgattttgggctcagc

SEQ ID NO: 94090 - DNA, 700 bp, Heterodera glycines
  SCN-specific regions: Sequence locations=1-111,140-700
cgctgccacgctcttggaccccaagcacgccgccaagctcgcaaagaaggaggccaagaaggccgaaaaggatgccaagaaagctgacaagaaggccgacaagcctgccgagcagcccgctgctgctgctgctccggccaaggagtccaagcccgcttcgcccgccgccgcccccaaggcggatgccccggcttctggcgttgcccccgacaccgacccgacccgcctcgacctgcgcgtgggctacatcatctctgcggaaaagcacccggacgccgagtcgttgtatgttgaaaagatcgactgtggcgaggacgagccgcgcaccgtcatctctggcctggtcaaccacattcccattgaccaaatgcagggtcgcccctgcgtggtgctgtgcaacttgaagcccgtcaagatgcgcggcatcatgtcgcacgccatggtcatgtgcgcgacgagcgccgaggggaaggtcgatgtgttgtcgccgcccgagggcagcaagccgggcgatttgattgcgtacgagggtattgagggcggcgccgggcccgatgcgcagctgaatcccaagaagaaggtctttgagtcgattcagcccgggttgttcaccaatgacgagttggccgctgggtttatcaagcacgacggtaccttctgcaagatgcatgtgggtggcaaccccgttttggcccagtcg

SEQ ID NO: 94091 - DNA, 544 bp, Heterodera glycines
  misc_feature (502)..(502): n is a, c, g, or t
  SCN-specific regions: Sequence locations=1-176,208-544
gcatgagattgttttcactgcccaaatgccccatatgcgtgacggcgtccaattggaatattcgcccctttatcaatttctcattggctttttggacttggaatttgagttcagacccgaaacaacgtctttttcggaagacattctgatggaatgcgacgttcgaatggcattttggcgccgggggggcccacccgccgcgggcggagaatgggtcgaattggtccggtcgacggtccgccgggcgttgcaatgtttggtcaaccccgacaaagctcgtctcggcttctccttcgactgttccctgttggatttgtttcacttcggctctctcccccacccgcaatatttgttgaacattcgaatccccgccaaccgaactttgtgccttctcagcaacaacaaaggccccaattgcgccttccccgggcccctccacgagcttcgcctcattgaaattcaccaaaatggcggattcactttggtttggctgtggcttaanagtgccctttcgcccgtccttttgtccgtcctcttttggttc

SEQ ID NO: 94092 - DNA, 418 bp, Heterodera glycines
  SCN-specific regions: Sequence locations=1-418
attggtgctggaactgatggagggcggctctctgagtgaattaattctcccagccaaaagcatcgcttatcagaattgtcatgtgattaattggactttccaagtggccaaagcattggaatatttgcacaagtttagtttcatccatcgggacggcgaaccctccaatatgtggctgtctcttgattatgtcgtcctgaaacttggcgacttcggcacaatcgctaaccatcggacggacatgaccaccacttgtggcccggccgcatggatggcacccgaagtgcccacaggggagagttacgactttcggggtgacggtttctctcttgggagtctgtctctgagaaatgctcgcgccaagtccgccattcgccgacgctcccgaactaagttccttgaccgcgttctgggacgt

SEQ ID NO: 94093 - DNA, 442 bp, Heterodera glycines
  SCN-specific regions: Sequence locations=1-37,59-256,278-364,398-442
cgacactatcatgtctgctgtcgaggctgttcaaactttcggtcgcaagaagaccgccaccgctgtggcccactgcaagcgcggcaagggcatgctccgcatcaacggctcgcccattgacctcgtccagcccgagatcctccgctacaaggtctacgagcccatccttgttgtcggcaaggagcgtttcgctgacgtcgacatccgtgtccgcgtctctggtggtggtcaagtgtcgcaaatctacgccatccgtcaggctattgccaaggctattgttgccttctacgccaagttcgttgacgaaggctccaagaacgagctccgcaagatgcttgtcgactacgaccgtaccctcctcgttgccgatccccgtcgctgcgagcccaagaaagtttgcgggtaaagggtgcccgcgctcgtttcccagaagtcgtaccgt

SEQ ID NO: 94094 - DNA, 745 bp, Heterodera glycines
  SCN-specific regions: Sequence locations=1-311,333-745
cgggaatgcctcagtgtgctctttgttctctaaaagcgccacaggagatgctctgacatctctgtactcggatatgaggccaatgatcaccagagtgcgcgacgaagttgaggccttccgcatcaacaccaaatcggactgtactgacatgatggacgtgcaaatggccaagacggcgccactaaaaatcctggataacccctacgactccatcttctgtgccaaatgtaaactgcttggacactgccagtgcgctggtctccaatgaccaagctgtcaccctggtacgccctgctccgtgggaccgcctggacagccctgacagtctggaggcgcaagaaccccggacaggctggacagtctggccaacccgctcgctcattgccctgcccagaacatactctgtccactttgacctgctggcccgttcggacgctgcggaagacacggacaggccggacaacatggagcctctggacaacctggtactctcaatggaggaggaggatctggaacgactggtgtgttgggaccccaaggacaacctgtacagcaaggacgctccggattcgctggctaacccggacagcgtggagtgaatggaattgtctcacaacaaattcctataccgaatggatcgcctggagcgtctgaccagaatgcaaactccggaagccaaggactcccaggatagccggggagacacggaccgtccggatctcgtggcgcgccggacagatcggcc

SEQ ID NO: 94095 - DNA, 810 bp, Heterodera glycines
  SCN-specific regions: Sequence locations=1-304,332-810
gcatcttcccaatatgccggcactgtgccgctgtcgaccggcacactgccaccatcgtcatcaacgtcatcgatgacggcggcagaggcgacgacaacggcacttcccacctccgctgatctgtcccgttcggcgtctgctgtggaaatgttcccgcgcagacatcggcgtgccgtttccgtaaatgaatgcctcttccaacaacagcaacaaggacagttcaaccaaaggtcgctgctggacgaaacgccgtcgtcctcctgcctcgggtcgccctgctcttccgccagtctgccagcccattttcccgctgctgctgttgctgccacctcaacagtgctgaagagtgatcagatcagtcccatcgcccgcttcgcgttcagtgatctggtgatcactgtgttgcgtttggatttctacaggacaggcgacccggaagcgatcaaattttgcaaacactcattggacattttgctgaaatggggtgaactgccggcaaaaacccagcaatcgttgcggcatcgaatcgaagagaaccatcctttcaatgaagacatcggcgcattgataactgccgtcaagttggaccccgaattgtgccagccccaaggactgctccatctgctcggctcgctgctcctttgtgttctcgttgacggcgactacgacgcgcgtttccgggtgctgctacggcacatttccgcactgcttggcatccactgggacttatttgaggagttcgagtcaacgctttgtgatcggctgatcgaccaatacaatgaaacagttgacaatcaaaaggtgcgcgag

SEQ ID NO: 94096 - DNA, 386 bp, Heterodera glycines
  SCN-specific regions: Sequence locations=1-138,161-190,213-307,329-344
gaggcattacacataaactgatcaatgggactcatttggccaaatcctttataatgagaaaccgactgatcagctggtgaatgctgtgccgggtgatcgttttcccactgtcttttgcgtctttcgctttcataaaatgccaattccctctccccttcccatttctcacatttctgtgctttctttgctgttctttctcatttcacttttttcgctcattcgtttccaatcattccttttttgactcaatgattgatcaaatgtcctttaaatcaatcgaaacattccttctaattttaaatttaaattgttccaattacaaatgaattaatatccatctgaattttaaataaatacttaatatttaaaaaaaaaaaaaaaaaaaa

SEQ ID NO: 94097 - DNA, 310 bp, Heterodera glycines
  SCN-specific regions: Sequence locations=1-310
acagcatatgggcggcagaaaatattactcatgtctaagatgcacccacgtacctcaccaactgaatcggagttgatttacacaccccttcacaggtgcaaccggacaggcgtatatcttcacaaacatcgcgaatatcatcatggctacagtctagtcgcctttcatgatcactggacagcatatattccgctacatgctttgtaaaatttgcaacagatagcttggctggatgtacgaatttgcccatcagcaacaacccttatacaaccaaagactagacacttatagagcgctgattgctaaccca

SEQ ID NO: 94098 - DNA, 800 bp, Heterodera glycines
  SCN-specific regions: Sequence locations=1-440,462-800
gtccattaaagcaaaaaaaaatgctcacgaggagccaaattgatctcgctgccgcgaagcggctttttcccccgtcagtcccgtcgcttagcaccgttccgcacgccacggttgtgccgcgtgacatgcgcgaggtgcagccgcaaacagcaggccaagtgatcccggccaatgaattgacacgtgccatcaatgaccatctcaaaatccaagtattgatcagtagtttccagactcgtggccacaacattgccaatttggacccgctgggcatcaacagtgcggacttggatgacacaatcccgcccgaagtgcggaagatgttctccttcactgaggaggacatggaccgcgaattctcgttgccacccaccacattcatcgggggcgaacgcgccacattgtcgttgcccgaaatttacaaacgacttaagaaaatctattgccatcacattggcgttgagtacatgcatttgacaaacgacgagcagcaggattggatccgaaaccattttgaggcgcccgaagtcacagaattaccaccggagcagaaaaaagtgcttttcaaacggttgatccgctccacaaaatttgaggactttttggccaagaaatggcccagaaaaacgcgtttcggtctcgagggttgcgaagtgttggtgccggccatcgaacaggtcatcgactgctcgcacgagctcggtgttaactccattgtccttggcatgccgcatcgtggtcgtctgaatgtgttcgccaatgtgtgccagcaaccggtgagcaccgttttgggcctgttc

SEQ ID NO: 94099 - DNA, 445 bp, Heterodera glycines
  misc_feature (337)..(337): n is a, c, g, or t
  misc_feature (423)..(423): n is a, c, g, or t
  SCN-specific regions: Sequence locations=1-2,60-272,294-316,341 -356,378-379,401-445
acacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgngagggaaagctgcgggggcgggtggggaaaaaagaaataagcagccaaagaagaaaggaaggatgccgacaaagattaattatctntaattagtaaatgatccattcg

SEQ ID NO: 94100 - DNA, 215 bp, Heterodera glycines
  SCN-specific regions: Sequence locations=1-101,123-215
agacaatcgaagggacgaacggacagttcaaagccgacaacgcgcagcttacgaccgattaatgtgtatgttcgccactcagcaaaggcccgattcgtgcggattttttgaaaaagaatggaaaaatgaatggaattgtgaaaagtcgtcaccaaaatgtttaatgccagcccaaattaatgtgaataaagcatttaattttgaaaaaaaaaaaa

SEQ ID NO: 94101 - DNA, 448 bp, Heterodera glycines
  SCN-specific regions: Sequence locations=1-160,182-448
tgttgctttgtccatcattgatggcatgtccaattagcagcaactgggcacttcggtcggtctccccgggcatggccctttgcaaatgacggcacaaccccagcagcagtgccctgcttctgccgaagccgtggagttgaagtatctgcgcaggatgctggaggggtaccagcattttctgtccttgcgaaaggccagttacaccctcgtggatggttttccgctcagtcgccgtgacaatgaagactgcccccagagcaactttggcacctccaaaaagatttgcaaaattgaggcaagtctgatcatggacattgtggagaatttcttccacccattcggacaattaccagcggaagataagcgcaaaatgttcgacactttctactgcttgttttcaaatgccgaacgcgcgtttcggacctataaaatgtttggagctgaagac

SEQ ID NO: 94102 - DNA, 509 bp, Heterodera glycines
  SCN-specific regions: Sequence locations=1-509
ggtccaacaacaatgtcggataaattattcaaaaacattggatcaaagggcacaaaagttaaatgaattgatcatccaatggttgtcaagaaatgggagctactatgaatttacgacaaaagacaatttctttctgattgccaattttcgtgattttcttgacactgcaaaacgccatgaacagacgggaacaagcataaaagcgtgggaagcatcattcataggccaattcttgaatggattttcgaggacaagaaaaaatggcaatttgtttaaacggttacgactggttgatcaacgaatgatcagcatgatcgacgaattctgtgagatcagtgtcgactttttgatatcgaaccaaaatgtggcggccgaaacagcgaagactaatgaacccgaaaaattttgtgccttttggcctaaagtcaaagaaaatgcgtccaaattcactcaaattgacattgccatggacgcatttaacaagtggattaacacatcggatctgctca

SEQ ID NO: 94103 - DNA, 445 bp, Heterodera glycines
  SCN-specific regions: Sequence locations=1-445
tgactcttcgggcaaagcgggatttgagcaacttgagggagatgaccagaagttactcaactattatcaaattctgagtgtgattcttgactttcagattcggcttattgtcgatcccttcttgtttaaagagggcgaccgttttctgcgtgctgtcaatgcttgccactgttgtaccaccagacgcggaattttccataacatccaaaataactttctggtgtgtgccaacgagtaacatctccttcgtatcatttcaatgcaatatgctggccatgttgtaccaacgctggaactgctaatacccggaggcaacgccatttaatcgaaagttccgatttccccctattaccgtcttggctgattgactttatgtcctacccaattgccaattactgttcttgcgagtgctcatatccgaatgtccaacatcctgcaaaagccc

SEQ ID NO: 94104 - DNA, 391 bp, Heterodera glycines
  SCN-specific regions: Sequence locations=1-227,249-294,316-391
cgcatcacatttttttcgttatgaccctccgccaatcaatgataaaatgcaacaaaaacacatatcgtgaaagagtgggaaatgagcagaacacaaaacacgcgctacacaaaacgacggacggcacagaagcgaaaggcgcgcgtgccgcccgagtgcgttcagctcccgtacagcacggcgttgatctcgcccatgatgtacacctcgcgcccgttgtacctcctggacaggtccttctccaactgaatgaaagggacgcaaaaattactacagattttggtatacaaattaaaaatgcaataaattaattaattccccgcaaaaatgtcatcaattttatttgagtattttttatttctttttgtttaataaatgcactttgtaatat

SEQ ID NO: 94105 - DNA, 96 bp, Heterodera glycines
  SCN-specific regions: Sequence locations=1-33,56-96
agaatatgtggccaattaatcaatttgtgttgtatattattaattttaagcatttttaaaacaagcataaatatttgtggagaaaaaaaaaaaaaa

SEQ ID NO: 94106 - DNA, 459 bp, Heterodera glycines
  SCN-specific regions: Sequence locations=1-339,361-364,388-424,446-459
aaatgaccgaaattttgttggaggtttgtgtcgatgacgcggacggacttttggcagcgattcggggcggtgccgaccgagtcgaactttgttctgcgcttgaggttggcggattgacaccgacgccgggcctaattgaattggctcgctctctcaacggttctgtgccggtgttcgccatggtcagaccccgcgcgggcgatttctcatattccgatagggaatttgattccatgcgaaaggacattgaatgtgttgccaaagctcgattggcaggcattgtttttggtgccaatcattgcgatgggacattggataggcacagattggaaattatggcaaaaatggcaaaggtttaatgtccaaaattattttagattttagaaatgcaattttaattcacaattgtgtgtttttttatcattttcaaataaaattattatttgatacttacaaatg

SEQ ID NO: 94107 - DNA, 424 bp, Heterodera glycines
  SCN-specific regions: Sequence locations=1-114,137-397,419-424
cgcttttcccgaggacaaaattcatgaagcaaacggaaagaattgtgaaagtgtatttgaaactgaaggacaatcccggcggggggtggggcccactcatccaaaaaatgtttggcgaaatgattttggccaagaaattgggaaagggcgacggcgcgtcattgcgcgccaattgccaattggcactcgaactgatcggagaaggggacggtgccaccgaagcaatggtcgatcagttggccaaggcgaagccgtacagcaacttttggactctgacgaaacgaacgacaaaagcgattttgtgccttttaaaaggcaatggcacggaaagtgagcgacaacggagcaccgaagacattctgagaatgctgaagacatttgcggaggacggtgaatcattgaaaatggtgcaaaaaggaaaggg

SEQ ID NO: 94108 - DNA, 340 bp, Heterodera glycines
  misc_feature (322)..(322): n is a, c, g, or t
  SCN-specific regions: Sequence locations=1-16,39-60,102-233,276-305
cttccattttcctgtgttctaaaccttcatcaattaaaaacaatgcctttcctccgctcgcttcttcttccttccgttttgcttcttcttcttctgcttctgtccgtgtctctttgctccgctgcgtatgaagcgccaattcgattggtttggcaattcgatgggtgcgcgtggcgccggcttcggaggcggatgggtgttcggcagaagatgaaccgttaaaggcgccaaccaattaataaaataataatgcacaataataataatatttatttcatttgcccccgattccccattttcaaatgaataaattatatattcnaaaaaaaaataaaaaaaa

SEQ ID NO: 94109 - DNA, 488 bp, Heterodera glycines
  SCN-specific regions: Sequence locations=1-488
ttggtgtgtatgcagctgattccgagtcatacaaagtgttctcgcctctttttgaccctgtcatcgacgaatatcacggcgggtttggacccaaacaaaagcatccgccttcaaactttggcgaggaccgattgggcgaattgaaggacttggacccagatgggaaatacattctttctaccaggattcgctgcggtcgttctttgcttggctatcctttcaatccgttgttaatgcgtgacgattatttggtcatgcaacaaaaggttcgaatggctctcgagaatttggaagatgaccctgaaatcgggggaacttattatccactccaaggaatgacgaacgaacccagaaacaactcatcgccgatcatttccttttcaaggaaggcgaccgtttttttggagggcccaaattcaaaccacttttggcctgcaggaagggacattttcccaagtgctaaaaacacccttctgccgcgggccaat

SEQ ID NO: 94110 - DNA, 513 bp, Heterodera glycines
  SCN-specific regions: Sequence locations=1-41,63-101,123-427,449-513
tcctcctcccgtatattacataaatttgtgtctctgcgggtggctaaattttatcactcagctgttgaaaagctcaaaacttcatatgcaaatgcacgccgaagcacttcctgggaagctgtgaagaccgcggcttctattgctcgtggatttcgtgacccttgtcttgatcagtttttggctgcacttgaggatactttgggcaccggacgtcctgccacttacacatttgagaaaatcagcaaagaacgcgtcggcaccggtctcactcacacacagggcggcagcgaaaccaaccgcactcacactgtctcgaagacatctgccggccccgccgcacgtcgttcttctcgcttctctctgcctcagttgtttggaacgaaaaagaaaggcggcaagggaaaaccgaaatagaaaagtggaacgggtcaaatgatggaagcaaaaagaacaaatttgatggaaaattgagatgtgttttttatccaatttttttttttgctcctatacata

SEQ ID NO: 94111 - DNA, 82 bp, Heterodera glycines
  misc_feature (76)..(77): n is a, c, g, or t
  SCN-specific regions: Sequence locations=1-82
ccatcccaaaaacttcaaattttccgcacaaattacggtattttttattggtaaaaaaaaaatattttacaactcnnaaaaa

SEQ ID NO: 94112 - DNA, 503 bp, Heterodera glycines
  SCN-specific regions: Sequence locations=1-476,498-503
ccccaccctctctctctctcatccaccttttgatgaaaacaacgggctgtttcgctctattgcaatcattaatcaacaatatgagagataagtcgataaaatagtaaacagctccgaataagaaagtttgattaaagggaccttggcattaaaagggatattggaaatgaatttttgtacgtcagtaaggtgcagctttacgtttgttttccaatgaggtaccggaattccatttgcgaaaaattatggctttcgtgacgcgaataggtcacatccaccattcacatcctgattttttggactaatctccgatgtgcccacctccacttctccatttctttgcctatgaagccattctctctcctggttcattttttccgtttcgtcatttagcccaatttctgcttcatctcctgtaaattgcactgttctgtctcccttataaaggtgcgtaatctacttctgcttcgttagacttacccctctctttttcctcttttcgg

SEQ ID NO: 94113 - DNA, 550 bp, Heterodera glycines
  SCN-specific regions: Sequence locations=1-550
tgggccgtcgtacgaaatgcttttccgtttaacaacgacaaatagaagcaaatctgctccttttctggccaaaataccgacaaaaactttgaaaagggaagtcgcaaacgaagcaaaaacggttcggtcttttggggaacaaattgaaatatcaaaggaaattaacacattgaaagaataattcaacaaatgatgacgagaggaaggaggaggagcaattcgcatctctgaaaaacgttggcatacaatcgcatcgacaagcgcaccttttgcttcaacaaaagtgcaacaaaacggggtggacaacaatcattctctgtctgaaaacagccttcgtcttcttctcccgtggattcccaaaaacttttcaacgccaaatggcttttgaaactcggaacaatgcggaaatttccggggcaatttccctttcccccaaaaaaaaaaaattccggaaaattttttgaaaaaattggttttgaaaaggagagaaataaaacgaaacccccaaaaaaaaaaaacccatttcccccccgagttttagagataaccc

SEQ ID NO: 94114 - DNA, 288 bp, Heterodera glycines
  SCN-specific regions: Sequence locations=1-99,121-288
aataagaggaacgacggaagccatcagagaagggaaatgatgccaaaattggaatttggggcggggaattgcgattggttgccatagtgattagcaccaaaaatgttttggattattatggtattttagctaccatttgcttttgtctccttttttggtcgcccatttgtccgtccatccgacagataattccctttgtcatctttccgcgtcaaattccctggcattcggcttcccgccggtgcttttaaagtgcgcttcgcccctccgcccattcattccaccgtg

SEQ ID NO: 94115 - DNA, 503 bp, Heterodera glycines
  SCN-specific regions: Sequence locations=1-90,113-166,203-503
ggtcctcaagtatattcgataaaaataattccttttaggacgatccacggattgatttacaatgtctgttctgttctgtccggtcactcattttgccattttaccgatttttaaggcattgaaacttttcatggaagagaatcagaagttgttcgacctgtgcgtacagaacttcaacaaacagaaggagcaggagcaactgaagcagcagaacaaccgcagacggtgggaactgctcgaaaaagcggccatggaaaacgcacgcgcaattcgacagcaacagacggacggagaggcggagccgtactcaattggcgagggagagaagaagccaaagtgaaacggtggcgaccaattgatgattctgtacaaataaacccccgggaaagaacggaatgtaccgcttcaacatcacttacacacactgagaatttccaaatttctatgccacgccccccccccctttcacctcacacttaaccctaatttacttctcacatttt

SEQ ID NO: 94116 - DNA, 540 bp, Heterodera glycines
  SCN-specific regions: Sequence locations=1-540
caacaatacggttccatttccgctgcccgagcgtccgttgccgagaaaaattcgcttccaagccttggaaatattgtacatcgaccactctgtcatcgaatttctgcgtgccaacaagcaaattttcgacaacaaaggcaccaacttggtgttcaaattgtcatcgtatttgtccggaaaagaagacggcagaaccatttggcaatttttgtgccgcgaaatttggcccatttttacgccgaacatccgtcagttgggcttctacaacggtgaccatctcgtcaatttgcgtcgtctcatttcgcccacaattctcaccgacctcaaccagctgaatccgcttgattccggtgaactgtttcccgctggtgttgctgacgatggaccgaacgcaactgctgggcaagcactcaccaaatggttgcacacgcctaccgtcgatggacagccgaaggaattgtattgcagtgatcatgtttggggcttcaaattcgactggatcaaaacgttcaaagaggaatttctccgttccaccactcc

SEQ ID NO: 94117 - DNA, 394 bp, Heterodera glycines
  SCN-specific regions: Sequence locations=1-145,167-201,223-394
gctgatggactccatgaaccacggatacacagacacggaaaaaaaggagtttatggagacgattatgaatattctccgggacgtcgccatattacaaaaggtggacatcggtgacagaagcgcgtgggacgtgcaggagcggttgtcagtcccccagcagagaaacggaactgactgcggcatttttgcgctgcttttcgcacaatattcgctggagaggcgccaattggaattcggacagtgccatattccgtactttcgacgacggatatgccacgacataatctctgtgattctccatgatcaaaagtctccggttaacagaagcgacgaaactgtcgtacagtgcccatttgctttgtgaattttttgctcaaatgcctttattattgtt

SEQ ID NO: 94118 - DNA, 224 bp, Heterodera glycines
  SCN-specific regions: Sequence locations=1-86,109-148,170-194,221-224
aaaaagagatcacccgcgagggcaaagtggccaagattttgaccgaagaagaaattcagcgcgaaatggcggacacctactgaagaaacgaaagaatgaatgaatggacgaaagtgatcggaatgttggatcggagatacagaaatcaaaacaaaatatgtaaacatttggcgccattttgagcaataaattggttttatttttaaaaaataaaaaaaaacaaa

SEQ ID NO: 94119 - DNA, 509 bp, Heterodera glycines
  SCN-specific regions: Sequence locations=1-42,64-155,179-223,253-509
aacttcacaatcgtcagatttaccctccaataaatgtacttccatcgctgtcgcgtctgatgaaatcggccattggcgagggaatgacccgtgccgatcattcggatgtgtccaaccaactttacgcatgttatgccattggtaaagacgtgcaagcaatgaaagcggtggttggagaggaggcactgtcgccggatgatttgctctatttggagtttctcacgaaatttgaaaagaatttcatttcacaagggaattatgaaaaccggacggtgttcgactcactcgacattggttggcagctgttgcgcatttttccaagagaaatgttgaagcgaattccagcgaaaacattggataaatattacccaaggggaggcactggggcgaggaacgaatgagcgaagagttgttaattagtctgacagatatccacttaaagattccataattattcacttgtgtgatttacgttatgtcattgactggatttttgcatatttgcggat

SEQ ID NO: 94120 - DNA, 50 bp, Heterodera glycines
  SCN-specific regions: Sequence locations=1-50
aagcaacactcacaaaaacacatgcgcacacactcattaacacaatgtac

SEQ ID NO: 94121 - DNA, 233 bp, Heterodera glycines
  SCN-specific regions: Sequence locations=1-28,59-100,145-233
ccaaattaaatgcaattttgaaacgaactttatttttaaatttattttaataattaaacatttacatagcccaatccatgaaatttaactgaacattttcatttttaataaatttatttgaaatagaatatttattcatttaaaggattcgttcgtttatatgcaattagcagtcagtgtataaaatgaagtgaaagcataatttaaataaattcattttctcgggagaaaaa

SEQ ID NO: 94122 - DNA, 530 bp, Heterodera glycines
  SCN-specific regions: Sequence locations=1-107,131-530
ttcatcagcacaatgaaacgaaattcattgaatgtgacgagcacagtgaggaatgaaaattcgggggaagacgaaagcggggacggagaaacgggggagaaaacggcggggacagaggaaaagcgaccgacagaacgagggccaaagtgcagacaaagaaagcgggggagacacctgtaagtgcaacccgcagcagaacagaagagaccaaagaggaggcgccaacgcctgctccgatggatgttgtgcttctgttggacggatcctcgtcaattacggaaagagtgtttaaggaccaaatgttgcaattctgtcgcgagtttgccaaacaaatgggcgtgtcgcgaaaaggcaatcatttggcattggtccaattcgccggccattgccgcacagaactcggactgactgattattttaatgcaaagaagctcgaaaatgccatttcaatggtccgttatttaaacggggggacacggcttggtggagcacttctctacacgcagaaaaaagtgatggcttcggctaga

SEQ ID NO: 94123 - DNA, 303 bp, Heterodera glycines
  misc_feature (262)..(263): n is a, c, g, or t
  SCN-specific regions: Sequence locations=1-58,80-139,179-255
aggctttggagaacgacgggaaatatggaaacgaaaggaattggccacggaaggactgagtgaagaagaaatagagaaggcaattgagcaatgggagaacggcggaagaaaaatagtgaaagctcacaatcaacacgaggcagaagaaagccaaaaggggagaacaaaagagtgaaaaccaacacaagagaatgaccttgaagaatgccgcatttattctttaatgtcctcataatcagcaataaaactagttggaaaatannaaaaaaaaaaaaaaaaaaaaaaaaaaaaaaaaaaaaaaaa

SEQ ID NO: 94124 - DNA, 237 bp, Heterodera glycines
  misc_feature (193)..(196): n is a, c, g, or t
  SCN-specific regions: Sequence locations=1-191
ttccaatcactgggattcaagctcagcaaatttattcagcatttttcttatggcataagttgttaacatttcctcatcttccttgtttatttcaattttcttacgacacaacatttctcaacattcatttttacaactttttcaaactaattctcattcattcaactgtatatcataaacgaaatttcattannnnaaaaaaaaaaaaaaaaaaaaaaaaaaaaaaaaaaaaaaaaa

SEQ ID NO: 94125 - DNA, 85 bp, Heterodera glycines
  SCN-specific regions: Sequence locations=1-65
tcgttgttggacggaccgacgtcggtcctccagcctaattataattaatggtgttgaaattacataaaaaaaaaaaaaaaaaaaa

SEQ ID NO: 94126 - DNA, 208 bp, Heterodera glycines
  SCN-specific regions: Sequence locations=1-208
ggaagaaatcgcacgaaaaattggaaaaaaccgtcgaccctccggcgacgtcgtcgtcctttcgcttcattggggcggcaattggggctacgaaatatcgaagacggagagagactttgctcatcagctgatcgacagagggacggtggacattttgtgcgggcactcatcaatccaccccaaagccattgaggtgtataaagggaaa

SEQ ID NO: 94127 - DNA, 536 bp, Heterodera glycines
  SCN-specific regions: Sequence locations=1-536
gccgcttcgtctgcgcagcaggaattggtggcccaggggcgagtggccgacccgggcccagcaaatggcagcgaagagcagcaatggactgcaggtttggtctccgccgctaaactcgtcgccgctgcgactaaccaactttgtgaagctgccaacggattggttcaaggccattcgacggaggaaaagctaatcgcagcggcgaaacaggttgcttcttccaccgcccatctgttggtagcgtgcaaagtcaaatgcgacttgaacagccgagcaatgcaacgactccaaagtgccggtcatgcggttaaaacggcaacagaacatttggtgaacgcggctcggcaagcgattacgcaagaggactgtcgcgggttggtcatctcggaaaagattgtcacgggcattacacaaatgatggacgcgcacgaagaagtgctgagaaaggaacgcgaattgaaagaggcgagaaaccgactggcgcagctgaacaggtctcggtatgaaaagtcgccggagccctcgccagaaaagca

SEQ ID NO: 94128 - DNA, 507 bp, Heterodera glycines
  SCN-specific regions: Sequence locations=1-178,211-507
ttgaccaaggagaattacgtcgagatggaatcaaaggtcaaagcggtcttcgagcagctgaagggcgatgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctgactgactttctgtcctaccaacttgggaacgactgttcgcgcgagtgtgcatatccgacttccgaagatcagcgcaaaacccgacttcaagtccatctgcgacggcctgaaattgcaagtccgcgggattcacggcgaacattccgagagcgctggcggcgtttacgacatcagcaacaaggcc

SEQ ID NO: 94129 - DNA, 538 bp, Heterodera glycines
  SCN-specific regions: Sequence locations=1-538
ttttaactttgagaggcgagggatatgcgtcaattcggaaaattcgtcccaccaccgctggcattccgacaatgtgccatcctcacacttcgctgtccaaccgatgctatgagcgcggactgatgaaaagtgcgccggaagcgtaagaaacggacgaatcggacattgaacggcacttatttgattgagcatatttgaggaagcgcaattcggccgtgtgattattcatttgtcggaggtactcggcagcctgcaacataacacagattggattccgtccacaaatagtgttttgactcttcttgaggtactcgttgaaaatggttgggtcgagcgtggcaatcgcgttcattccctgctggtcaaggttggcaatttgttcatggattggccgtccgctgttcgattcaatgggcgtgtaacgaaatcgctggccccaatggcaaaagtctgatgagatgacgaaaagattgttgggatcggaaatgtaatgggcaaagatgcggccataaaattgctgacgtgaagtgcttaacga

SEQ ID NO: 94130 - DNA, 202 bp, Heterodera glycines
  misc_feature (154)..(154): n is a, c, g, or t
  SCN-specific regions: Sequence locations=1-152
aaagcgaacgaaaaagtaccacataagaaagttctgtgcgcgttgcagtggtggcagaatggggcgggcatttgcctggggggttgttgtgatcgctaactaacaaatttgtcattgtattcccagcggaattgacggtaaatttcttgattanaaaaaaaaaaataaaaaaaaaaaaaaaaaaaaaaaaaaaaaaaaaaaa

SEQ ID NO: 94131 - DNA, 368 bp, Heterodera glycines
  SCN-specific regions: Sequence locations=28-312
tatctatttattattcatttattaatttctgtatctaattgggcttaggaacaattttactgcgctttggcctccgttatgtatttgataggctcagtgttcgccgttttgaacatgctcaaggcaatattcgcccctctgtggttttttcatttgtttgtaacttttgccggttttggcctctacgcattcgacttttggacacgttggaaacgggacagtcagttgaggaaggagcaccagcagaaccaatccgtctatatcacttgaccaatcaaacgcacactttgcatacattcgcaattttcccacattttttaaatttttgtttagaaaatatttttgaataaattattatttttttaaaa

SEQ ID NO: 94132 - DNA, 260 bp, Heterodera glycines
  SCN-specific regions: Sequence locations=1-11,35-260
ataaatgaccaccccgtcccctttccccgtttattgtctcaatttcacacaatggttctcttaatccgttgaagaagcgccattaacaaagccgtttgaataaaaggacatcgctaaagcccccatatagcgccataacacccacaaaatccaatctcaacatcaaattccccgtgatgatttatttaatgaattccgatggttggttgattaattgatcattcttaatgtgtttgaaatgaataaaggtgtcatgttgc

SEQ ID NO: 94133 - DNA, 67 bp, Heterodera glycines
  SCN-specific regions: Sequence locations=1-26,55-67
tcacaaatgttgtttcaatccttctctttatataaattattatgttaaattaaagaagctttttgca

SEQ ID NO: 94134 - DNA, 439 bp, Heterodera glycines
  SCN-specific regions: Sequence locations=1-293,315-439
catcagagaaggagaaaaaggtatccaaaagtacaacagaagaaagctctagtattcattgctacggaggaaaccctaagtttaaggaccaaccagaagaatgggcaaacagtgtatgcaaggactggaccacatggcaaattatcgagattccagagttccgctttacgtatgagtatctcgacgagccgttcagatcatggttcaagtatcaattttacccagattccatagatgttgttaagtatgttgacgatgaatactttgaaaagtatgaagggcaaacacaagatggtaaaagacatggagaaggagtgctgacatggaaaaatggagatgtctacaaaggaccgttcaaggatgaccttgctcatggaaaattcaaattacaccgcaatgataatcataagttcaaactggaattcattaaaggtatgcc

SEQ ID NO: 94135 - DNA, 371 bp, Heterodera glycines
  SCN-specific regions: Sequence locations=1-220,250-371
gccccgtacggctacacgccgttttgcgacagtcgcaagtccatggacggctttcggttctggcggagcggctactgggcccagcatttggcgggccgcaaataccacatcagtgctctttacgtggtggatttggtcaaatttcgccaaattgccgccggcgatcgtctccgtggccaataccaagggctcagctccgacccgacactcgttgtcaaacctggaccaggatttgcccaacaacatgattcaccaagtgcgcatccactcgctgccccacgaatggctgtggtgcgagacgtggtgtgacgacgtgtccaaggacagtgcgaagaccattgatctttgcaacaatccgctgaccaaggagc

SEQ ID NO: 94136 - DNA, 545 bp, Heterodera glycines
  SCN-specific regions: Sequence locations=1-545
atgcagcgttttgacactcgcagtcccttcgttggcgttgtgtttgttgaaggtcaattcaaagagccgcgctgtcgttccgcgtttgtcgatgagagtgccattggacgcggggcggcacggaatgcgcaaatccgactgtcctttggcacgtgcggcataaagcacacaaaaagggtcatttaaagtggacaataaacaaattagctgttttggttttattattatttttttttgtcaattttagaatttaggaggattatccccggggcgttttcctcagtatgcgtttggtggtcgcctttcatgcccaatacctctccaaattggacagggtttacgatttgcgatgcttttacatggaaatggagcacgagttggagaagccattcacagtcagaatggatcctccgacaatgcacagcaaacaaattcagatgcctaattgtcgctatgaagtgttaagcgaagggcctcacggtccgcccgtttattacgcaacggttggccaaatgatttatcacaaatggacttgcgaagcgaat

SEQ ID NO: 94137 - DNA, 394 bp, Heterodera glycines
  SCN-specific regions: Sequence locations=1-32,65-394
ccacagaaacaactgctcactgtgccgggcaccaataacaacaacaataacagcaacaacaacagtgccatcgtcggcttcgtcggcgatgccaacggcgaccatccgccgctgagtctggagaacaacacattcttcccgcggcgcagaagtggctgttcgtcctcaaagcgccgtcggcgtgagcgaccgttcgccgtctttggcagggccatgcgacggttgcgccatctcttcggctccggcgtggacctgtccaaacgagtggacattgtgtcccgggtcgcttttcctacgctttacctcgcatttctctgtttttattacgttcgcttcgttttgtttcaatccgaagagtgggaaacgatgggcggcgcaaagaaactttgaattg

SEQ ID NO: 94138 - DNA, 298 bp, Heterodera glycines
  SCN-specific regions: Sequence locations=1-87,109-111,134-298
aataaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgtaataaatatttgtcaccgggacattgtttgaaggttacggtaggggaaaatttggtactaaaaatcgtttcaccgggaaacgggaattggtccaccggggacttttgaaaacaaaatctgtcaaggggttggcccaccggaaattaaaa

SEQ ID NO: 94139 - DNA, 536 bp, Heterodera glycines
  SCN-specific regions: Sequence locations=1-536
agaatggcaccgccaggggggcaaattgctttgtccagcgtggtcgccgtcccccgacaaacgtacatgaattgatcgcatgcagcggacgcaacgaacggaaagtcaccgggacaatcgtccacggtcaaaagcaaatcggtgcactccaaaacggatgagtgaggacggagagagcggagggcacgcgagaagaaagtggcgatggaagggtcattcatggccaaaaggtcgagcgaataatgcgcacgcaaaagttcacgcggagtgggaggggattagcaatgcgccaggcgaacggaggcgtaactcaatgatagaggcgaaatagtcatctcttagggcaccgatggaagaaaagggccaaaaaagaatggcaccgccaggggggcaaattgctttgtccagcgtggtcgccgtcccccgacaaacgtagcgaattgtcgcatgagcggacgcaacgaacggaaagtcaccgggacaatcgtccacggtcaaaagcaaatcggtgcagtccaaaacggatgagtgaggac

SEQ ID NO: 94140 - DNA, 475 bp, Heterodera glycines
  SCN-specific regions: Sequence locations=1-286,308-475
tttagtttctgcagttacttatactccggtaagcaacggatttagtattaccgcatctccatctaccagcggacaaacctgttttacagttcatagtgccgaaagtggttgggcagcaatcggagttggaagtggttcaatgtcaggagcagatatctatttaggttggaagagctcgcaaggtgcaatatctgttggaaatttcgaaggttccgggcatgttcaaccttctgccaattcggttcaaaatgcccaacaagtcactttattggagacttcaccaagttgggccaaactttccttttcattctgccggcctacagcaatttcgtcaaatggcaaatcaatcacttcggaccagagctatatttatgcatcatctccggatcaaccatctggaagctctcctagcaatttgagattcagccaacatgcaggaacgtatggtagttttgccattgactttacgagcacg

SEQ ID NO: 94141 - DNA, 478 bp, Heterodera glycines
  SCN-specific regions: Sequence locations=1-478
acgaactgaagacgaagcagtgatcggtggacagacaaaagtgccatggcaagcggatgttcagaacagcgaaagggaggagactgaaaagaatgccggagcaaatgttatcgaaggagtgccaaaaggattttttgacgacgaacaaatgaacagcagagtccgtgaaaccattgaaaaacagaagaaaattaccagtgaaattgaccgattttacaaagaggtcgaagaattggaggttcagcgagaagatgaacgcgaggaattgaatgaacagtcggcactccgttcggacatcgaaatgattgacgagcaaatcgaacggtggaaaatggttaacgaactcgagaagaaaaaggaaaacattgtcgagtcggtggcaaccaaatttgagcaaaagccgaactttgaccctgtggaaatgtctgatgacgatgattccgatattgttgattttgataggataagttggagaaca

SEQ ID NO: 94142 - DNA, 425 bp, Heterodera glycines
  SCN-specific regions: Sequence locations=1-234,256-425
cgaagctttgatgaagttcaaactcggcactctcccactttttctgctatttagtgaatgtttggcggtgatacctttgagcttatcgaccgaacgatttttggacaactttgaaaagatggggaaacgaagcgaagtcgaatacgaccaattcatcaagggaaccggcattccgatgatcggctttggcaagagggacaccgagttcgacccggcgaccattccgatgatgggcttcgggaaaagagggacgggcaggccattccgaaacaatgccatggagacgaagttgcaactttggagaatggggctgctgggataaaatgaaaacactcatcagcccatccaaatgatcgaatgctttgaacataaataaattacaataaagttaaacaaaaaaatgctaataaaaaggaggtcaaaaa

SEQ ID NO: 94143 - DNA, 545 bp, Heterodera glycines
  SCN-specific regions: Sequence locations=1-545
atatccaatccaacaattttaaatggcagctgcctccaaatccaaatatttcgagttggtctccggcttctacaaaagttatgcagcgatgcaaaattttcagagaactgctgccaaatgccgagttgtggacgtagacgaaggccgagtgaaagtcgaaatggaagtgcaggaagagcacacgaacacttttggcactttgcacggcggactgaccgcgacattggtggacattgtgacaacgactgctttgtgcgcgacacggcgcgggtcggccggtgtcagcgtggatttgactgtaaattatttggcaccagcaaaaattggttaggtgacaccattctgattgatgcatttgtgaaccggagaggccaaacaatgggtttcacaggggccgacatcttccggaagagtgacggcctaaaaatagccaccgcattgcacacgaaggcattcccaagagaagtctccgaagcccaggaaaagtgacggaatgaaaaaaatggtcaaaatgtcatttaacatcaattaaattgttaacgaga

SEQ ID NO: 94144 - DNA, 465 bp, Heterodera glycines
  SCN-specific regions: Sequence locations=1-376,399-417
tttgccgtctttcctctgcccatttcatttggcccttcgcccgttcacttttggctcaattgcgtccgcccaatttcgcctctgtccagagtatggacacttcgccaaacgcacattggccaagcggaggaattggcacagctcagaacaatgggcgaacaaatgttttgtcaagagggaatggccacggaattgggcggaaaattggaactcacagtgcgaactgtgcaccaaagccgacaatacacctccagtgacattttacaatcgcttaaatacaacgcaatgatgcgacggattgggatcagtgagcaattgcagtgtcgcattgccaaagtgttggaggagttcgatcgggtgaagcgacagctgatcaaagtgcggaagggtcgaagcattgccaacgcataaaaaaggaaatttattttaaattttgctattaaataaataattttttttaaaaaa

SEQ ID NO: 94145 - DNA, 81 bp, Heterodera glycines
  SCN-specific regions: Sequence locations=1-31
gcaaagacatggccaataccaaacaaattgtaagaaaaccaaaaaaaaaataaaacaaataaatgcgaaaaaaaaaaaaaa

SEQ ID NO: 94146 - DNA, 542 bp, Heterodera glycines
  SCN-specific regions: Sequence locations=1-542
agatgataaatttctggcataattattgcatttttttatctcgaatagacatttactcatcttggctgaaatgcacgaccgtaacatttttaaactttgcccgcctaattatgaactccttgcaaggaaataccacgatttcagagtcaaatgttttattggggcgggtggaaaggtttgtgtgaatttcgcagatgctgagtccgtgcgtttgttgtcccaaattttgctgattgaatacttccaattgaatgtccaacttccaattggtcatctcgtgccgcgcgtccctcagcgattaaattacattttattagtggaggatttgatttgcaaaaataacttcgatacttccaacgtttgggggtttgacattggtactaatctctctctgactcggataacttaataatttctgggacgggtgcttcgtgcatatttccgcttttgggggcacgtctcaatggatggaattttgtggcgacagaagtggacgcgaattcattcgcttacgcagcacagaacgtcgaccgaaacaattt

SEQ ID NO: 94147 - DNA, 115 bp, Heterodera glycines
  SCN-specific regions: Sequence locations=1-52,76-115
atcaaattcaatgaaaactattaaaaattaattgaataaatagtcctgtgccataatttttatatttttatttttgcaattttatcaacaaatttgtgaaaaaaaaaaaaaaaaa

SEQ ID NO: 94148 - DNA, 285 bp, Heterodera glycines
  misc_feature (240)..(243): n is a, c, g, or t
  SCN-specific regions: Sequence locations=1-46,68-243
ttgtactgagttcggccaaaaaacgtgtaattcccccccccctcctctcacatttatttcattttccaccgcactttttattttattttatttgtcccccccttcactgaatgccattccttccttttcctttttttcccttttttcgcacttccgccgatttgtttcattcactgctcattcattcattgtcagctgaattgaatttgggcaacagaatgtgaataaacgaaccgattnnnnaaaaaaaaaaaaaaaaaaaaaaaaaaaaaaaaaaaaaaaaaa

SEQ ID NO: 94149 - DNA, 394 bp, Heterodera glycines
  misc_feature (320)..(325): n is a, c, g, or t
  SCN-specific regions: Sequence locations=1-173,195-278,303-318
atggatgaaaacaaacgaacaaaacgagagccttcagaaggagcggagggccaagtcgagcgatacacatacggcaacggggaggaggcaccgatggcactgaatcttaacgagttggacaatcggcgcttggaagagagcttgacaaaaatcattgcgtacatgcggaaagtgcacttttattgtctgtattgcggatgcgcattttcttcttcagaagagattgattttgagtgtccgggaatcattcgcgatgatcatgaataatttattcgtacaataaaattttttaccaaaataaaagtagccaatttttttannnnnnaaaaaaaaaaaaaaaaaaaaaaaaaaaaaaagaaaaaaaaaaaaaaaaaaaaaaaaaaaaaaaaaaaaa

SEQ ID NO: 94150 - DNA, 394 bp, Heterodera glycines
  SCN-specific regions: Sequence locations=1-355,377-394
tggttgggctttttccttttgtgcgatgcttctaaaaaagatggaaattggagccgcaaatgttcggcaacatttcgaattgtctctcaaaagagcggtgtggaggattttaagagagaatacaatgaaacagtttttaacaatgaagcgaagtcttgggggaactatttcatttcttttgcggaattaatggacccaagcaaagggttgtacaacaaagacgaggacaacgtcaccttggcaattgattttacatgtgaatagcgtaaacatttcgagaaggattgaaaagggaaaggaaggaaatcagcaggatgagaagagagtcttggagggcacaaaattttcttggtgcttaaattttatatttttttatgttttgtaaagtattttg

SEQ ID NO: 94151 - DNA, 497 bp, Heterodera glycines
  SCN-specific regions: Sequence locations=1-94,116-365,387-497
aaggagaattacgtcgagatggaatcaaaggtcaaagcggtcttcgagcagctggagggcgatgccgagttgggaggcacctactatccgctccagggcatgacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgcgacggcctgaaattgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtgga

SEQ ID NO: 94152 - DNA, 151 bp, Heterodera glycines
  misc_feature (63)..(70): n is a, c, g, or t
  misc_feature (76)..(76): n is a, c, g, or t
  misc_feature (78)..(79): n is a, c, g, or t
  SCN-specific regions: Sequence locations=1-151
accaaggagaattacgtcgagatggaatcaaaggtcaaagcggtcttcgagcagctgaagggnnnnnnnncgatgncnncgagttgggaaaggcacctactgtccgctccagggcatgaccaaggacgtccaaaatcagctgattgccgac

SEQ ID NO: 94153 - DNA, 549 bp, Heterodera glycines
  SCN-specific regions: Sequence locations=1-286,309-549
tgttgatttgagtaaattttgaaaagatgccgactcggacgtgagcacgtacgacctgttggacaacgttcagcagcaacagcagacgaaccatcgaccgcaaccgcaaataaaactgaacgaccaaatgccaaggcagaacagtccacaaccaaatctattcagcattgaggacccacgactgaagaaaatatcgaggcaattaattagtgaatgaacgatgtatttttaagctaattagctcaattaaattccaatcaattcatacactatattagcctgacttggtttaaatttaattttgcttttaggtctttgcctgaagatttccattttgagtacggtgctggtcaaattcagaggaaaaattcatttgttggttcagcacgactgtttaaaaagcagatgacccgacgggctcgcgtgctcaaaaggacactgaaccaactcagaggccgggaaatggccacaaaaattgatcagaaatcgcgcatcatttttccagccgcgtttttgctgatgaacgttttctactggtcatattatctg

SEQ ID NO: 94154 - DNA, 329 bp, Heterodera glycines
  SCN-specific regions: Sequence locations=1-329
gttttccatgcttttgcctcgcagcaatggcttctcaattttgaattgattgaactgagaaagcctttccaacgacaaaatcgccttttgggcgttggaaggttggctctaattagcaacaacgaatcaattgagatggaaatggaactgatcagaccaattgaaaagcgaaaggcaccgatcggaggagagggaaaagggcgagggaaagtcggagaagaaacaatcggaaaagcacggattgagatcagtgcttatgatgatccattttatatctgatcacccacaatattaataacacagacgaataaatgttttttcaattttaa

SEQ ID NO: 94155 - DNA, 381 bp, Heterodera glycines
  misc_feature (367)..(369): n is a, c, g, or t
  SCN-specific regions: Sequence locations=1-99,121-279,301-381
acaacaaattccttcccgaaaattcaaataatccattcaaaaaatggctttatcagcaattaaattgctttcactgtttctgctcgtcctttgtattggcatggccattgagcagacccaagcttattatggctggggtggttacggctacggctatccctacggattttatggcaaacggcaagccggctttggcccatccgcaaatgttggcacttttggtcgcaacgaaggcgaaaatgccaacggaggaggaggaggaccattttcactaaacaatttttgagagaaaaaggaaatacaaaagcaaaattgactatctcttttttgtgaacgaatttttcgtcaatacaataaaatttgaccnnnaaaaaaaaaaaa

SEQ ID NO: 94156 - DNA, 517 bp, Heterodera glycines
  SCN-specific regions: Sequence locations=1-5,55-468,490-517
caaatggaagaggaggagcaaatggaagaggaggaggaagaagaggaggaggagccaaccccggagcaaatggcgcggtggcgtcgacggcgactgctgccgaacgaagtggtcagtgacatttgcgaatttatgagttttgccgagggaagccgactttacacgtcaagcggattatttgttgcgctgttggagccaaaacggaagttgtgcttggcaatgtttctgaaaagggtggaagaaactcggcagaaattggacaaaacaattgaggaagtgaatgaacgtcgtcgccatgtcgtacaactgacagaaaacattgggacaataaacgcgagattggctgaaatgggaaaccatttggccaatttggacacacaaattgtggtgaaccatttgaaattggacgaattacacaaacgaattgcggcgctgaaagaaccgatgggaaaattgagaagcgaaggaagggatgaaaagtgaaaaagagacgaacgaatggaagtgaacagaatgc

SEQ ID NO: 94157 - DNA, 456 bp, Heterodera glycines
  SCN-specific regions: Sequence locations=1-10,282-298,365-456
tatacctcataagtcatttcacaaagtcggactagagtcaagctcaacagggtcttctttccccgctgattattccaagcccgttcccttggctgtgggttcgctagatagtagatagggacagtgggaatctcattgatccattcatgcgcgtcactaattagatgacgaggcatttggctaccttaagagagtcatagttactcccgccgtttacctgcgcttggttgaatttcttcactttgacattcaaagcactgggcagaaatcacattgtgtcaacaccttttcaggccatcacaatgctttgtttttattaaacagtcggattccccttgtccgcttcagttctgagttagctgttgattgcatagaggatctcccacgatccgaatctcgccagtcctgccgtccacagttgcccgcagccagcaagacagcttgaaacttcacgta

SEQ ID NO: 94158 - DNA, 477 bp, Heterodera glycines
  SCN-specific regions: Sequence locations=1-51,73-130,197-477
tcattcattcgatcactttccaatgaaagaggcgttaataaaaattaacaatatttaatgtttaaacacaatgatttattctgattaaaaaatgaaaaaatgtaaaaaagagtctcctatcattgggcgatcatttgttcgcgcacccattcattaattaatccattcattcatcttggatcatccatccatccgtcatcactccgtcggatttgcctcgatgtgcttgaaattcgactggttccttcttccatcggccattggctgaccaacagaggagagggataaataaggacgaattgtttgttaccatttgtattgcaatcacaccaaatcaatgcacatttaattatgctaatgagctattataattaacaaatcgaagggatgaagttgtcaattctcacaacatttctgcttctgctgctgacaattgccttcgcttcgttcacagcgaccgatgggacagaaaacatt

SEQ ID NO: 94159 - DNA, 537 bp, Heterodera glycines
  SCN-specific regions: Sequence locations=1-5,27-537
agtcctcaagtcaaagtcaatttgctgctccatgcgcatttaatgcgcattcagttgagcgccgagttgaccaaagacactgattggattgtgctgaaaacggtgcgccttgttcaggcgtgtgtcgatgtgctttcgagcaacggttggctttcgcccgccatccacgcgatggaattgtcccaaatgctcactcaagcgatgtattcaaacgagtcgtacatgaagcaattgccccactgcacgcctgaactgcttgaacgttgcaaggaaaaaaaagtcgaatccattttcgaactgcttgagctcaatgatgaggacagagacgagctgttgcaaatgaatcaggcacagcttgcggatattgccgtcttctgtaacaattacccgagcattgaagtccgacatgaaattaccacgcaaaagtcgacagtgggacaacccgtggaaattcggattgatttggagcgtgaaaacgatttcaacgggtttgcaccgtctgtaattgctccgttcttccctcgttatccttacccg

SEQ ID NO: 94160 - DNA, 515 bp, Heterodera glycines
  SCN-specific regions: Sequence locations=1-515
ggatggtcgggcacaaacggtgggcacattttgaacggatgcggcaccgtttggacacattgcgggagcgtttcaactctttgcactgcaccgtggacagatggaacgcacgggtgccgggcctgaattcgtccggcaaaggcacaactgtccgttcaacccaatccatgctggccaaacatcccgaactgcacatcgatcggctggcccaagcgtggcccgaactgtttgccgactttgctgatgaccaaaatttggaggaacggctgcgaaatgaacatcgatatgccagccaggagaaacacgcgcgtgcgcaaattgaggaattgcgcaaggaaatgagcatggcgttgccgcacgatttggactaccaaagcatggaattcatgcggcccgaactccgcgacgcaatggacgagcgcaagccgaacagtttggcggcagcagccagagtccccggaatcaacgacacggctttgcattttctgcttcgttacgtcaaaatgcgtcgtcaa

SEQ ID NO: 94161 - DNA, 511 bp, Heterodera glycines
  SCN-specific regions: Sequence locations=1-248,277-323,345-511
aatcatttataatttttacaaaaatgcttctttttctttcttttccacttctttttacgttggctttgcattgctatgctttcaatggggcgaatttggcaagcggagacattgagccactgctcaatgaattgcgagaaaacagcagcgaattgactaattcggctgttgaaaaaggatgaaattgaagaaaacacgacggaaatgaacgagtttggccaaattgtttcacaaatttgccacaaaaatggaatggaaaatggccaaatggttctgagaaagatatcgacccttggccaacaaattttggcacaattaaaaatggcagagaagaaaacacagaaattcgtttatggacaaaatcgtcagcaggaagcaggattgccattagccaaatttggcactgaaatgatggcatttgtcaagagattgcccgataaaatgccggaaaagagtgctttcgtcgataaattgaaagcaatggaaactaatttgtcattgccaagcgatg

SEQ ID NO: 94162 - DNA, 525 bp, Heterodera glycines
  SCN-specific regions: Sequence locations=1-525
acaaataccaaggccgatttggggactctgacaagaaagtattgacgttgcttatcgaatcgtttccgatcatatgcgagctgtgaccgttgcattggcagatggaattggttttactaatcaacaacagaaaaagagctcgcgtaaaattaaggaattgtttaaacgcgccacgatttatggttctcaaatgctcggaatggaacggatgagcatgcatttgatggtgccggtcattgttgaacaattgggtgaaacatttcctgaaatggcgcagaacaagcacaaaatcgccgatgctgtcagaatagaagaagaacgactttggaagcagagagacgatggaatgcgtcatttggaagaattgtttcgtaaccatccgccgacgagcaaagtttttccgggcaaatttgcatttatcattgtgcaaaactatcggattgaattggaattggtcaagcgaaaggctgcgcagagaggtttaactgttgatgaggcggaataccaacgattgcacgcccaaaa

SEQ ID NO: 94163 - DNA, 447 bp, Heterodera glycines
  SCN-specific regions: Sequence locations=1-447
attaattgcaattgactgcgtcattgagttcagcttgtcctcccgttaatggcttacaaagtgcaaaatgctgtcagcaatactcttcagcgtcgccaattctcagttttggcgtgtgtgtttcagtcgctgttcgttgttctgttcgcctcttttggcgagttccacaaccacgaggaggacaagcacaaccgtgtccatgccaactacccaatgttccaggacatccacacaatggtcatcatcggatttggcttcctcctttccttcttgaaaaagtacggcttctccgccttgtccattaaccttctcctcagctccttcttcccctctttcaatgccggctccatccctcactctacgcccgaaatgcggcaccgtgccacccgcgatttgcgcacgcaggcattcttccaacttgccgggttggcactgacttttctgatg

SEQ ID NO: 94164 - DNA, 21 bp, Heterodera glycines
  SCN-specific regions: Sequence locations=1-21
aatgaaataaaaattgaaaaa

SEQ ID NO: 94165 - DNA, 222 bp, Heterodera glycines
  SCN-specific regions: Sequence locations=1-159,181-194,216-222
tatttttttctcatctttgcacccttctttctctgccatcctacataattattgatcgtaatttttgagttaccgtctctctcctgtcggattatggtaatccctctccaatcaccggccttatctactctatatttgcagctttgagaatacctttctacttcatttctttccagttttatatgcttttttcaaatttattccaagtaaaaataatgatgt

SEQ ID NO: 94166 - DNA, 475 bp, Heterodera glycines
  SCN-specific regions: Sequence locations=1-475
aaccgacggtgcgacaatatgtggaaagtcggccgagaatcgatgcccgtccgtggcaacaaattttcccggatatttccttcccacccgacttcgtcaaagagcgcgttaaactcgacgctctgttggcccgagacctcctctcccaaatgctcgtcatcgacccaaataatcggatcaacgtgcaagaagcactcaaacatccctatgttaatttgtggtacgatgcgggagaagtggatggtcccgctccaacaccatacattgagccgacacatggtgcgaatttgaacgtggagcagtggaaggagctcatttacaaccaaatcaaggacttcgaacggactcgtgacattttcggcatcggcgtaacaatgaatggggacggcgaaatgctggacgaaacctgagcacttttttgggcgacttccttaatatttccgttctgtcatgttctcaaattacacccttcagc

SEQ ID NO: 94167 - DNA, 421 bp, Heterodera glycines
  SCN-specific regions: Sequence locations=1-250,273-421
acttttaaaatttcaccccgacaaatatggaaatgacgaaaaaatggtgaaattggcaaaacaagcattccaagtcgttgaaggtctatataaggaatgcaataaattgttgctgacaattcaatcaaaagcagcaaatcgtcttaataggtcattctcacaatcggcaacatcttttcaccgcacagcatatgagtccgccattaatgagcacaactcatccaactataaccatagaaaatccgtggatgccacctcctcctcctcatacttttcccagactgatatgaatgcaaaaaaatcttatcagagaagcaattcagcaattcccacgaatcaaaatataaatcgtatgtttacagctgatgaataaatgacaccatcaagaaaatctgtggatctaactcattctcatcagaca

SEQ ID NO: 94168 - DNA, 368 bp, Heterodera glycines
  misc_feature (353)..(360): n is a, c, g, or t
  SCN-specific regions: Sequence locations=1-10,33-49,80-258,281 -315,338-368
aaatcatcatcagcaacaaaaacagcaacaaattcatttaaattcccacaaataattaattaattaattattttattttctacaaaatgatttccgtccaattttcccccatcgttttgctgctgcttctgctcactttgctgcacctttcttcaccggccaatgctcgtccccaatggtattacgccgacccaatttcgatggccaacaatcgtggcactcttttcgacaatttgtggggacggaagtgatttggcactcaaaaagaccaacaaaacaattgtcaatttgtgcataatattgtgtaaagttttgtttaattttgttttaataaatgccattaattcaaaaannnnnnnnaagaaaaa

SEQ ID NO: 94169 - DNA, 504 bp, Heterodera glycines
  SCN-specific regions: Sequence locations=1-239,261-403,425-466,488-504
ccgattgcattcgacagattgcgcagggccggggatggcaagcggcgaccgcaaatctcagaagccgatcaagaatgtcggaatcaaagtttgtggtcactaatcgccgttacacaatgtcttcttcgtccgggtctcctttatccaagccatccttctcatttttcttgaccacttcaaacaaatgtatcacaacacttcgacgcacattcaatcaaaatgccactggcgacattagctgtgacattttgcaacaacaacaggcgatccgtttcatggaaggccacgatctgttcctctgatcagtggtgctttatctccctaacattagtggcaaaagcgtgccctgatcatgtgaattttagccaaatttttaagaattgtagttgattatcacaaaatttagtctctgcattcaaaaatttttccgggttcgtccctgatattgtttgcatgcttctgaactgtctaacatatttattgtgatagagtttcactgttacg

SEQ ID NO: 94170 - DNA, 553 bp, Heterodera glycines
  SCN-specific regions: Sequence locations=1-210,232-253,276-356,378-553
gatgaccatcatcaacgaccaatttgacttggaggagttcgaagcgttggacgacgattgtgtgcggattatcggctatttcgagccgggcagtgccgcgctgaaagaatttgaggaggcagccgaggaattcatgggagagatcgaattcttcgccgttgtgacctcatattgggccaaaaagaccgggctgaagcggatcggcgaagtccaacttcatcatccgtttgaagatgaccccatctacgcgccgtccagcgtggacacggaggaggaatttgagcaatgggtggagaaacatagggagccggtgatgcaaaagttgcagttggacaactatttcaatctgtggaaagacccggaagaggacgagaagttggtgttggtattctgtgatgaggagacgcgcgaaggccgagccatgttcaaactgatgaagaaattggcggacgaaaaccaagaacacgcgggcacgctggagatcgtgctaattgacccggacgaattcccactgatggtggacgtgtgggaggaaatgttcggcattgacatt

SEQ ID NO: 94171 - DNA, 538 bp, Heterodera glycines
  SCN-specific regions: Sequence locations=1-73,95-150,172-239,261-538
ttttccctttcgatgtttcctctcttcacacaattgcctttcccttctctccttttatttttgtccaattttccatcttttgccatttcctttcggcttcaaggcgttggcgttaagggcgttttgttgtgtaacggcgcattcgcagcacacactaatttggccatttttgacgttgatcggaacccgggagattcggatgatttactggacaaaggccataccgatggcaaaggacgctttgttttggatgggaccacacgcgaattgagtcaaattgagcccgaattgcgaataatccacgactgtgcggacgatattaaaccgtgccatcgcctttttgtgatcaaagtgccacccgaattcattcatagcggcagagcccacaaaatattcgacattggcacattggacttggaaaagaaaagagaggacgagcaaaggacgtgccaaaacaatttttgatcaaccgattaataaattatgatggatggaagaacaaattctgaaatggcatgtcattacttcgttggcttat

SEQ ID NO: 94172 - DNA, 543 bp, Heterodera glycines
  SCN-specific regions: Sequence locations=1-170,193-330,353-543
gtggataacatttgcgtttatggcaacccgcaaaaggactatctgatcgcacttgtggtcccaaatcgcaaaaacttgcaagcacttgctgaaaagaatgccgtcaatgagtcgagttgggaggcaatttgtgccaacaaagaaatggccaagcttctggaaaaggaactccaaaactttgtttcggggaaattgcgcagggaggaaatcccgaggaaagtcattatctgtgcggagccgtggactgccgactcgggaatgctgaccgaagcactgaagttgaagcgcaagaacatcgagagaaaattcgcggaggaaatccgacagctttatgaggggaaatgattgggttgttaattcccggaggctatttcgcttcaatttgatctcgaccatcaaatcaagcagtttcattgtgccgtaattgccatcatcatgagctttgtacccccaattatacgcaattaatttttgttcggttttcattggtcattcttctgtcagtgcgcgtttatttatttttgatattcgttagggcttttg

SEQ ID NO: 94173 - DNA, 450 bp, Heterodera glycines
  SCN-specific regions: Sequence locations=1-256,278-450
atttgtcgcagaatgtcccaagtgcgtccaaattcttacctttcgcttgagggctttcccgaagggcaagggtactgtgcccgtacgcggacggtgcccgacatgacaggccatgtgcgaatgcccgaccgttataagccccactggggcaaataccgagacgtatgtcccaagagcaaaaggaaagcgtcgttaccccccggggcgacgtttccttcacaaaacgttcggtctgttgcagaatccgcaccggtccaatgcgtacttttacttctccccgctttactaccaatcattgcattccgaacgttatccgcccaccgccgatttggcaccgttcaaatacaacacggactgggcactgtacaagggaccatggttcgattacacggaatggttccactacaaaagatggtaccctccgttctacgacatgcacgcgtaccatgc

SEQ ID NO: 94174 - DNA, 458 bp, Heterodera glycines
  SCN-specific regions: Sequence locations=1-156,178-458
tgaaaatccactcactgatgatttgcccaaccttttcctttattttcgcttttgccttggttcgcttgtgctttggaaataaagttatagaggtcgatgggtcaatacaagagaagttggtcttaaagaaagtgaacgtctctgaggattatgtacattattttaataagtttgggaagttgggacagaattatttcatcggaatcaatgaaaatgacgaggcgacgaaatcatatctcccgtacataaactgtcagaaatataataaaaatgactgcgacaagggaagaagtgatgggtgtatgaaaacggtcaaatgcgttgtgactgacccaatccgcggctcacagcaattggcttgcatggctaattattacctacgcgacgcatcgccaaacaaaagcttttctgagggcgacatcattgagccctctctgatggactgctggcagcacgag

SEQ ID NO: 94175 - DNA, 197 bp, Heterodera glycines
  SCN-specific regions: Sequence locations=1-96,118-197
ttcattcttcctattgtgccgtcgtccttcctttctttatgatgtgctctgtagaaacagatttacagattactgtagcttaccatttcatttcccttttgccttccctttccctttgctcaaatttctctcatccgttcacaatgcttaaaattcaaatttggcgtttcgtccacacaaataaagcgataatttac

SEQ ID NO: 94176 - DNA, 521 bp, Heterodera glycines
  SCN-specific regions: Sequence locations=1-226,250-521
ctgaatttatttttggattcaccggtgatgactcatcaaaatacaacggtccctataaacttgaattgtttaacggtttggaaacaattgaccagtgcatttcgtccgataattcttctgtcgtcttttcggacacttgcaaagcacagtatccgcctgaggttgtcgagtcagcgatagcgttgctgcacattgtaaatgaacagagaaactcatcatcaaaagccaagcagcagcagcatcatcatgcgcaagcactgttttccgtgttggccgcctatttgtgcaatgttgggaagggagaaacagaaacaaatgcttgcagggagaagcatttggacaaagcgaagcgaatgtacgaaaaaatggggaacaatgaggtaaccgaaaagcagataatggagatgcaaaaagcgcgccaaacagtgttcgatacgatcatcgcttacaatgacgccaaaacgggcgaggcggtgcacgaggcgattgtggcggtccgtaaggcagtcagcgcaagtccg

SEQ ID NO: 94177 - DNA, 144 bp, Heterodera glycines
  SCN-specific regions: Sequence locations=1-78
ttctgtatcaaacgaatattacagatgattgaaaaagaatcattcatttctccacggattcattttttcagagttgtcttttaatttaaaaataattaatttatcactaaataaaggttgttttttaaaaaaaaaaaaaaaaaa

SEQ ID NO: 94178 - DNA, 541 bp, Heterodera glycines
  misc_feature (502)..(502): n is a, c, g, or t
  misc_feature (525)..(525): n is a, c, g, or t
  SCN-specific regions: Sequence locations=1-1,35-207,229-541
caaaaaaaaattaaatttttaaaaattaataaaagagaaatgccaattacatatgtgaagccttacaaattgatgaacagctgtcgtttttccacaaccagtctcgccaaccaacagcacgggctcgtcacggcgccatgcttctgcgcataaaatgagcatgcgacgcatttgcgcggtcaacacaatggcggaggacagctgaatttaaacaaaaatgctgatcattttggcgccaataaatcgaatgagccaaattgaggaaattcagtgattaagtgtgtgtcagggacattgctcatctactgactcgtattctcattttttgtaggcgcctcatttcgtgtctcgtattttagtttcatatttttttttttgaaatagaaaggccaccaaattgggcgagttggtaagaaaatagtaaatttaaaagaaatctttgccaacatactccgggcagtgcagcggctgatggcatgtacggtgagtcgacaccgaacgntcgggggatgtcaatttgtcggnccaccaagcgttgcaa

SEQ ID NO: 94179 - DNA, 489 bp, Heterodera glycines
  SCN-specific regions: Sequence locations=26-76,98-100,122-221,249-489
aaaaatttaaaaataaagaaaattcaagagaatttatgcattttatttgatttttctaacttagaggaaaaaatttcccagaaattctagaattttcgttaaagctatttttctctcaaatttcatctagaatttgcaaaaaaaatttcccggcagcgcctatcgcactgccggaccctctgttcccgaaaagtttttgaaaaaggcgcgccgcaaaaaacaattaaaaataaattaattaaatttatggattgaacccattaacaatttatccggcgaactctctctaaccctctggcccttaaaaatcttgatcaacccattaaccccttttcacgtataccgtcagcctataaaaaaatcttttttaaaatggccatgtatgtttagttttttggagattttcaaaacattttttgccgcttacaagggaaccttgcgaactgttagtcggaaaatgcatatatgttatataccattggatagagc

SEQ ID NO: 94180 - DNA, 70 bp, Heterodera glycines
  SCN-specific regions: Sequence locations=1-13,37-70
tccaattttgtcatttgttctttttaaatattatgttttgtctgataatgagaataaaacttgacaacac

SEQ ID NO: 94181 - DNA, 545 bp, Heterodera glycines
  SCN-specific regions: Sequence locations=1-71,93-285,307-392,414-545
gggcttctgccacttcttacgtgtcaattgtttcccccactcatttgaaaggcacgagccaacacattttggcacttctatttaatggacttggccgtggcgttggtccaatcattggtggctttttcatccggcaatacggcactcgcgcacttttcctttccatcgcttttctcactttgtgtgttttggccgtttattacgcggttaatttgaaactgaaaaacgaatccgtcaaatattcgggctttgacgcgttcgacgaagacaccgccgggggcgaaactttggcccctcaaggccttccgatgcatcgctttggcggcaataagattacggaggcattcaatcagacggcagtgacaaatcagaattatggtgccattgaagcgaacagcgaggaaaaacaaagggacgacgcttatgaccgatatgtgacgggacaatgaaaacggaaaaggaagaggaaaagcaatagccaaacgaaaaatggccaaaatacgcgcataaatatgcaaataaagtgatgaaatatgcacaaaaaa

SEQ ID NO: 94182 - DNA, 517 bp, Heterodera glycines
  SCN-specific regions: Sequence locations=1-313,335-517
cccaaattggttcagtctcgcgacaggactttacgtggaaagtcacaatttcaccagcgattttatgtttgcgccaaattcttcgatgcttttccaacgggacattggtgccaacgactcgaatcccttttggtggactggcaatcgggcaccattttggtacgcggttggaaaggcgggcatcgacgtgcactgctattggttccccgcttgtcataaagcccacgtcgatttgattgtccaagtgccgcaaaatcgacggcattctttcaacaattccaatagcatcgatctgctgccacatttgccaaccattgtcaaacatatcaaaaaatatcagccctacagacaacagcttgtccttctacgatacaatgggttggacaaggcacttcgctcgggcggtcagtcgtcaagtcaaacacgacaagcactttccacggtcgacaattacctgcgaaagatccaagaggagttggacacgatggaccttcaccagtcgaccaatttggtggtg

SEQ ID NO: 94183 - DNA, 511 bp, Heterodera glycines
  SCN-specific regions: Sequence locations=1-1,77-135,193-289,424-511
gaatttttattttaaatattttaatttttattttaaataaaatatttaaatttaagaaaaaccaattcttttaaatgaatcaaattaaagtagatcaggaagaaagcaccaaactttgggattggccattgcaagtaaaataataattaaaatatttaaattaaacgcagaaaaataatttttaaaaatttagtcccatgacgaacttgtgtcaatctacgatggtcgtgacagatgggaagttggcttggacaccggatttttcacgcccaacgaaatcgaagcatgctaattaattgaataattagtccaattataatgcttaattatctaattacccaatgtatatgtagatagtcaaaaggtccttaatttattagtcgaattgaattaattatttaactcgctaaataatgaattaatgttgaggtgaatgccaagtgcaatgtgttgacgatcctcgaacggcacttggttcacatcgtagctgcagttgtacaattgttgatac

SEQ ID NO: 94184 - DNA, 127 bp, Heterodera glycines
  SCN-specific regions: Sequence locations=1-78,106-127
aaaaaaaagtggcggcgccagcgttggcccatcaaccgaatgaccgattgaagcagccgatggaagggacgaatgatctatttattcattcattcttttttgtgttttattattgtgctgttataaa

SEQ ID NO: 94185 - DNA, 167 bp, Heterodera glycines
  misc_feature (130)..(130): n is a, c, g, or t
  SCN-specific regions: Sequence locations=1-130
aatgctgagaaaggcgcaaatggcgacggacaaacggccaattcggaaatatttaattgttttttttcactgtgcatttttttgtttgtttatttcgttcgaattgcacaattaaatttgactctgttcnaaaaaaaaaaaaaaaaaaaaaaaaaaaaaaaaaaaaa

SEQ ID NO: 94186 - DNA, 292 bp, Heterodera glycines
  misc_feature (277)..(279): n is a, c, g, or t
  SCN-specific regions: Sequence locations=1-292
cgaaaccaggagatcaccttccaaatgtgcaagtggatggtgatcctgtccgtgttcttcactgcgcacaactttgccatgatgttgtacgggaccaaggagaagccgttgtggccctacacgctgttcatgaagaagagtgacggagcataaagaagctctctcgacgacacatattgtttttgtgtgtattaggtgtaaacaaaattttcatgttttatggacggaaaatgttagtttggatgtttatgttccatggataaagaaagctgggctnnnaaaaaaaaaaaaa

SEQ ID NO: 94187 - DNA, 270 bp, Heterodera glycines
  SCN-specific regions: Sequence locations=1-270
acaacattgacaaagtagcgcttcttttggagctgtttgagcggcgacacttgcccctgacaaacgaagactttttccataatcctgcaattttgcgggattttggtccgaccggaaaatgtgctgtgcgagcatcgccgttttactacccacttgcaaattatacggatacgtgtacggcttcgtactatttttcgggttcattcatccatgcatgtgaatcgtacattgtttatttttttgtgtgatgaatggcacattttggaaaaa

SEQ ID NO: 94188 - DNA, 406 bp, Heterodera glycines
  misc_feature (382)..(382): n is a, c, g, or t
  SCN-specific regions: Sequence locations=1-406
gaacgccggaggggcgaattggattggaaattgctgtcccatgccataaatcacacgcaaatgtttgagcaactgctcgccaaacgctttccgagcaaaaacaattacaatttcgacagggtcatttggtccgttttcgactctcacatggatatttttgtgcaagaacagcgcggaaaattgctgagatttttggacgaatgcgcacttcgaattcgcagcggcgaggaaaagccgcagagggaaacgatgtgcgagccgtcattgcaggcgatgaacaaaataaattggtcaaatgtcgaccaagtgggcgatgagtcaccgtatgtttcgacgatccgaaaaaatctgagggcatccgttcccctaatacgcgactacnttttccgaacgtcgaaaatatttc

SEQ ID NO: 94189 - DNA, 523 bp, Heterodera glycines
  SCN-specific regions: Sequence locations=1-93,115-316,339-523
gttctgtcattgctctgctgattttcggcataatttgcctttgttttggcattttctctctcatttttgcgcccaaattggtcaacaaagcgatcagagaaaatgtttttgttggtcggtttccaaacggaagtgataatttcgcaatggaacagtacagagacccgaaatacgacgtaaagtgagtgaaaaagtaaaggaaacaacggcagaagagaagtctaaccaccggcggcggtggtttgttcatctaccgtacccccttccccgccccaaacgaccgtacccacgcgccaaattaacacatttattattattcattaattaccatttgctccattaaatcaacagccactttaggatgcagatttgggtcttttctgtgcaaaaccctaacgaaattgtgaataaaggagaaaaagtgaatgtgacggagttgggtccgttcacttacgatattcgaatgcacaaaaacaatgtgaagtttggctccaatgactcgcgactgttctaccgaaatgtc

SEQ ID NO: 94190 - DNA, 500 bp, Heterodera glycines
  SCN-specific regions: Sequence locations=1-500
tttttgtaaataaacaggcgaagcacttcgtctgctcatcgctgagccggaacgaattgaacggttgcactcaaatgcaattgtgttgcatcagctgatccggaatgctctcgagggcacaaaatttggactgatcagtattgactgtgccccgcagaaacacatcgaatatcgaacgaaggacggggagggaagggaaattgtggagcagaaattggaccgaatggtcaacaggcttctcgaccatggcattttggtgactcgcgcccgataccttctcgacaaagaaaaattctgtcccaaactgacaataaaagtttcgtgccgtgccgatttgaatggcgacgaattggaaaatttgggacagaaactgcgtctgacttttgccactttggaattttgacggaatccatcactttttgaaatacatatgctcaattgtttgtgataataaattcgataattgaaattagtatacaaaaataaacgataaaaagtta

SEQ ID NO: 94191 - DNA, 515 bp, Heterodera glycines
  SCN-specific regions: Sequence locations=1-369,397-515
cgtccgttgccttttcttttgtctcgtcgcttttgtggcgctcagtggccaaaaatccgacgacaaattaattaattaaagtgatcggtggcggcgaaccaagcggggctttttctttacacctctaacactctgtgcagcagcagatcactcacggcttaccacaaaatgaattaatttgctaattgccagccgatgacttttccttgccccccgcgctgctccccccgccactcggctgatcgtcgctgtttttgttcttcaagaatttgagcattgtgcgctcaaatttgttggatgaattggtttagcagtgatcaaaatgccagccgatgaagtcgaaagttgcggcaaaagtgcgcaaatttgcctccctctttctttctttctctatcgccgcaccgtttcgcttagttttgtcaaaggatggggcgaagggtacggacggaggacaatcaaagagacgccatgttggattgaggtgcaacttcaccgacctcttcaacttctcaatg

SEQ ID NO: 94192 - DNA, 539 bp, Heterodera glycines
  SCN-specific regions: Sequence locations=1-205,229-539
tgtatccgcatttgaaccgtggtgatctgtacaccaaacagggcattttgtccatgttacagtcaggcatcaaagtggaaccactgttgttgaaggattggagtgccgtcatggattgggcaccacatccagaacataagggcgaatatttgcagttgtggggcaaccacaatttggacagggcggtcgcccaatcgcaagcattcatcaacgaatgccggcgtgcccttggcctgtcaatgaaattttgggtggcagaaatccacgagattgtcaaaaataccattcttcattactctgaaattcgtggcaaatgcaatgagttgaacgatgcactcaagcagttagacctcacggctacaccacacaaaattcgcacaactcccagcaaacggcgttcattcatcgacatgcacgaattgcgtgacaagctgttaatgcgcggcggcacttcaacagagggcggcgcgggcaaaggcgctaaaaatggcagttccgtttccgttgcaagcgaagaagctcatgcgcaagcgatggtc

SEQ ID NO: 94193 - DNA, 519 bp, Heterodera glycines
  SCN-specific regions: Sequence locations=1-96,120-174,203-519
gggcggtttctccatgaaaaagtcgatgattgcgcgtaaaatgccccagcaggtgtccaggttcagattcatgttgctggccgattcgtttggacgaaactgctgggtgccgaggatgatgtgttgagtgctattgcgtgagttgacgcggctcacataactgatgattttgggtggtaaaagcaaaacaaaacatcaaaacgacgcaccccaatttaatgtaatccgaaccgaccaaaatcgcctgcagcgtccacttggccaatttaaaagaattgttacgcatttccgtcgccagcactgcccccttttgaatgtccagctttgaacgccaatcgacaccaccgcttagctgtttaaattaatgtctgttccacaattgaatcttccccatgtactcaccgaactgtcccattcattgaatgccttcacggtcagtttttgtacttctttcgtgctggtccccgccagcatcaccgcgtcgtgttccgttcgtgccaccaatgttatcgcagttcc

SEQ ID NO: 94194 - DNA, 65 bp, Heterodera glycines
  misc_feature (65)..(65): n is a, c, g, or t
  SCN-specific regions: Sequence locations=1-65
atgctatttggtttctttgtctgaagtaaatgtttttctgttaaaaaaaaaaaaaaagtactctn

SEQ ID NO: 94195 - DNA, 286 bp, Heterodera glycines
  misc_feature (252)..(252): n is a, c, g, or t
  SCN-specific regions: Sequence locations=1-170,194-199,221-250
caaaaggtggtggttatttgacgaggtcatttaaccatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatattttgcttcttttcatggaaaacaagaagtcaataagttgtttanaaaaaaaaaaaaaaaaaaaaaaaaaaaaaaaaaa

SEQ ID NO: 94196 - DNA, 351 bp, Heterodera glycines
  SCN-specific regions: Sequence locations=1-179,219-351
gggaggaagagggaaaagagggctcttgacagagcggtccgcgagaccatcgacgaagcgacagagaaggccaaagagttccttgaagaaaattggagcgcatttgagaaattcgctattgtgttgcacgagcgcaaaacaataagtgcggatgaagcagaggagtaattttttcccccataaattttataaaaaaatagtaaaaaaaaacaaatttaggatcttggcctattatctctagtcaataagaatttgtagaaagtaataaataggcaggtctctttgttgtaaattattgttttgcagagaagtgtttgtttgtgaataaaaagtggctatttaaaaaaaaaa

SEQ ID NO: 94197 - DNA, 162 bp, Heterodera glycines
  SCN-specific regions: Sequence locations=1-1,39-162
tttgccaaattatttaaatatgtccctcctccactttttcgccgctctgctggtgttctgcgccatgttcagcttggacttggcacaaattgccggcactgttggtgtttcgcccggtggcgtcgctgctggccccgcggtcgttcagcctgccgccgctgg

SEQ ID NO: 94198 - DNA, 524 bp, Heterodera glycines
  SCN-specific regions: Sequence locations=1-330,353-375,397-440,463-503
acaaattttcagaatgtcaaaaagtttcataaatattattattcaatttttatttctgctatgcttattttataattttgctaaatcttttggcgaaaaatccgcaccaaaccctcagcaaagtcctaatttccaacaaattccatccgatgtcttgtcagttttgtcaaaagatgttgcggcacaactggaagcaatacaaaacaatggcacattgactgtgcacgaaaaggcggaacaaattgaccaaattatgactgagcagcccagcgaagtgttggacaaaattccggacccgcccaattttggcactcttccaatgaacgtgaaaaatcacataaagcaaatactccgtcaaaaaggaaagtcgttggatgaaaaagaaactgaattggaagaatatgttcaatcattgcaagaggacaagccaaaagaagcatgaacataacaaaattgccccctacggcagtttccatttgttgaatgtgaatataagaccatccaaataaataatatatatttaa

SEQ ID NO: 94199 - DNA, 439 bp, Heterodera glycines
  SCN-specific regions: Sequence locations=1-439
tggacacggcacatttggaggacacttttctgatgagcggtgtgcttggccacgaacgcgagtcggacccattgagccgaactcaaccggtggaagagggaaaaggcgagagggaggaggagcgtaagctgaactccacctacccgttgaccaccccgcacaacaaggtatatctgacggaacctaaccggacacagaccattgaagatgggccgactctgctcaacttgacgcaccccgtggccattggggggacggcaggcgaagaaccgccgaaacagcagcagcacaaacagtcgcaagaacacactgacgaggagcagagagacatctctgcccttgccggcgttgttccataccccgttacggatgattcttccctgctgctgttggacccggcattggccaccgcctgtccgctgatcaacattatcgattc

SEQ ID NO: 94200 - DNA, 285 bp, Heterodera glycines
  SCN-specific regions: Sequence locations=1-14,60-63,142-143,173 -177,201-239,261-285
tttacacactcgtcgcactcattcttttcgtcgtagcatttgcgctgatgctatggaatttgttggagacccattcgtactatggccagaccaaaataccggcgacggtgtttattggcatccaaatggccctcttcatttgggactaccgaattctgcacggccaagcctaaacaaagcgaagaaaagatcaaattaaatgataattaatagaatgaatgatcgttgaaattatgccaaaattcctttttattttatttgaaattcgcataaaatttaaaggca

SEQ ID NO: 94201 - DNA, 296 bp, Heterodera glycines
  SCN-specific regions: Sequence locations=1-296
tttggccaacaaatttactcagcccgtccgtcgagaattgcttcgccggttcactgctcttgctagtcgcaaatgtttttctacggaaaggagaaactcgccatgtccattgtctgatacgtactctctgtcagatcacgaagccgaatttaacccagaaaaggattaaacatattgatatgttcttttgccatgtttttgatttttgtccgtttctcctccccaattttctctgaagctttagacaattttgtcagtgcaactttttatgagaattttagttaatatgtaaatga

SEQ ID NO: 94202 - DNA, 148 bp, Heterodera glycines
  SCN-specific regions: Sequence locations=1-14,36-148
gaaaaccgcaaattttggcttttttgtggataaatctgttaacaaattgcattaaaaaagcaaaaattgtccgggcggcgcctatcggcaccgccggcccccctttcatcgtaaagtgaattaaaaaaaaagttgaaaaaaaaaaaaa

SEQ ID NO: 94203 - DNA, 88 bp, Heterodera glycines
  SCN-specific regions: Sequence locations=1-88
aggcgatgatcattcatcagcggaattgtctttggcaatctaattttgaaaaaaaaagatctcaaaatcttaaaaaaaaaaaaaaaaa

SEQ ID NO: 94204 - DNA, 550 bp, Heterodera glycines
  SCN-specific regions: Sequence locations=1-192,216-347,387-476,502-550
acaaaacggcggcatcggaaaccgtttgaagcagaccattttcgggagtgccatccgtcgtcgggtgccaacctaattagaccaaaaaacgagagatgccgaccggaccaccgatctgatcaaccagccagtgatcgatgatcagctgccgaggtgccgcaatgatcgacgatcaaacaaacaatcagtcatcaattaattaattaattgcccttccccaattgattgccatccattcatgattattttattaaaattgcataataagcgcccaaaaaatctgccaaagccaaattttgttgctccccctttttgcactcatcaaaactgctgatcaattagtcatttcgttatcattatcaccactatcattagcatcatcgtcacaaattatgtgattgtttttgcatacagtatctgacgacgatggtgaatgtcgtgcattttgtacagtatccctccaaaaaaccaaaaacaattttttatattaaaatatattttgtatggaatatgcctatgtattgtaacaatatcatcatctgctcaactc

SEQ ID NO: 94205 - DNA, 81 bp, Heterodera glycines
  SCN-specific regions: Sequence locations=1-8,40-81
taattgccatataaaattcaattaaattatttttattttgcaccaattttttgtttgccgtttttcgattggaaagaaggc

SEQ ID NO: 94206 - DNA, 274 bp, Heterodera glycines
  misc_feature (229)..(229): n is a, c, g, or t
  misc_feature (231)..(233): n is a, c, g, or t
  SCN-specific regions: Sequence locations=1-161,183-193,216-226
gacccaacgaccagaatttgtctgagagagagagagaggtgccgaacccgaacaaaggatgccatggcgaatggacgaattgtgccaatgccaaatgttatcggatttattaactttaaatatttttttaacgacggtcgatttatgctgttctgtttatctttatttactcatttattgctgttatcaattattttcttatttgatttaatattacgttttctttaanannnaaaaaaaaaaaaaaaaaaaaaaaaaaaaaaaaaaaaaaaaa

SEQ ID NO: 94207 - DNA, 316 bp, Heterodera glycines; identical to SEQ ID NO: 74738
  SCN-specific regions: Sequence locations=1-202,224-288,310-316

SEQ ID NO: 94208 - DNA, 59 bp, Heterodera glycines
  SCN-specific regions: Sequence locations=1-59
ttgtgttttgatcgctgtttgtaatttggacttttattactgataacgaacgcgggttg

SEQ ID NO: 94209 - DNA, 464 bp, Heterodera glycines
  SCN-specific regions: Sequence locations=1-464
cgcgacgccaacgatgagaacgcgttactgtgcgcagtccgatcacgcaatttggtcgtgattagcatggtacgccaagcaggcggccaattagtggttccacggcctcgcattggtgtcgaactttgtctgtccgccggcaccggcggcttggacgcactgaaggcatggcacgccgccggtgccaatctgtccaccccggactatgagggacggactgcgctgcatattgctgcttctcgtggctttgatgaattgtgcttttggctttgtgagaatggcgccgatccgcttctgcgtgatcgtctcggacggagcccagccgaagatgcccgtgccaacattgatgagcatatggtccagggattgttggcaccgaatttccagcgcatttttgcctttttcggcacgccatggaagggcacatgaaacaaaggatcagaccaacacaaaccttgactttt

SEQ ID NO: 94210 - DNA, 553 bp, Heterodera glycines
  SCN-specific regions: Sequence locations=1-233,256-553
aacacgaaactcaattctgtcgagaaattgctcagcaaaactgaggtggccaagtcgaagatggaacagttgtgccgcgagctgaacaaagcgcacagagaggagaaagagcagaaccaactgaggtgcaagcaaatgcaaaatgtgcacgcggacactgtcgaatcattcaaaaagtcactggcggagattcaactttcggtggaggagaagcgggagcacaacaaaagggtggcggatgtggagaaactgtccgaacatctgaaccaactgacttccgactacgaaactcgtttagcagagctgaaaaaaattgtatgatgaaagagaatcgaatttgggcgtaattgccaaaaccaaagacagcgaattggacacactccatttgcaaatcggggaaatgcaaaagcgcgtgcagcaagtttttgcggagaatgtcgaactgaagaaagagcctttgtcgagtgaagatcgtgtgaagaaatcgatcgaatcggagattggaatgcgcaaatttgtggacgattattcggagaaatattccgaactcacc

SEQ ID NO: 94211 - DNA, 417 bp, Heterodera glycines
  SCN-specific regions: Sequence locations=1-245,282-282,305-381
ccaaaagaagcagttgaagaagaacacggagaagaggaagggcacaataacattcattttatgtacagtatcactctggaccattaccgtacccgtccccttgttacagtgtccactcatagcgtccaaaaaccgtcgtttgtttctttcttcccatttcagtgccgtcctttgtttttgattcgttcattcgcctccatttctcttccaaagcacaaatctcgtcacaatccatcccatccgaattcatttcttttcctttttcccctcattttctccttaattcccctcccccctttaaatgccttaaccaacccaaaagatttccaaattttgttccattcaaactttaaatttgctaataataaatgcataacaattaaaaaaaaaaaaaaagaaaaaaaaaaaaaaaaaaaa

SEQ ID NO: 94212 - DNA, 85 bp, Heterodera glycines
  misc_feature (17)..(17): n is a, c, g, or t
  SCN-specific regions: Sequence locations=1-53
attattgtatttgcttnaggcgtaaaatgtagatataataaatttgaactgctaaaaaaaaaaacaaaaaaaaaaaaaaaaaaaa

SEQ ID NO: 94213 - DNA, 541 bp, Heterodera glycines
  SCN-specific regions: Sequence locations=29-75,97-221,243-518
taattaattaactaattaaattattaaaggctcattaaaaatatttatgaaatttacagaaaagacaaaaaagtttaaattattggtataattttgtatagaaattttaaaaaaaaaatactgatcagtaaaaagaacccttatcatttaaaagtatgtgtcttaaacgaggttaataaattatgtataccccatctaaatacggactgattaattggccatatcaaaaattggttcataaaaaccgaaattaattaattaaaatttgtgactccacaaaaaaatgatcaaaagaaaaatatgaaccgtatagcaaaaaataatactaattagaaaatgtgataatgatccggtcatcagccctgcttttaattagcgacaaaataattcgattcattagtttaattgactacccaccaaaatactgttcagtggccagatcaaggctgatcggctccgacacaaccgacgatgttgcggcggatgatgagcaacaatttggggacggcacccgttggggcggtggtggtggcatcggtgg

SEQ ID NO: 94214 - DNA, 536 bp, Heterodera glycines
  SCN-specific regions: Sequence locations=1-536
atttattcgtaaaattcaacaaaaaatgcttgcttgaatttttcttatggttttgctgtttttacgctctttctgatcactgatcactctgtccgatgaccgaagctgttacaacctccctatgataaacccgttgcattgcatggcctgtcaatgtactgtagccaatggataccgttcgccacataacaattcgcccacactagattattttcttttgaacccctgacgagaattcgggcaaaaagtcgaaagttcaaaggatgcgcgattacatgccgaggggaatccatttacaccgtatttgtcacagttccatgcgttttaatattgtttttatacaacaaaaatggacaatgggcgctgtgaaattgagtgtttcgaaagccttcgcggccaatgaaattgtgccggacgttgtgtccaaagcaccagaaaagcttgtaaccgttgaatacgctgtcggagtgtgcgcgaagctaggcaacgaattggcacccaaaaatttaaccaatgcaccgaagctttcgtgggac

SEQ ID NO: 94215 - DNA, 515 bp, Heterodera glycines
  SCN-specific regions: Sequence locations=1-451,507-515
catttcacgttcgggcatttcaatgattgcttccggaattgccaccgaactgttggcttctgtccttcaacacgaattgggcgcagaagcgcccgcccttttggccgaagtggacgaaaacgcgagtcaattgggcgccactccgcaccaaatccgcggttttatgtcacgctttcatctgatgatgcccaccgtacgacggtacgaccgatgcacagcgtgtgggcatacggtcaaacagttctaccggactgagggatttgaatttttgaaccgaatcttccaatgtcctgccgagttggagcaaatcaccggattagccgagttacagagacaagcggacgcatttcaatcggaagttatcgaaatggacgacagtgaaagcatttaaacaagtgcattaacgggtggccatcattcacaatttgctttggaacaattttggcgacgcaaaattttatttttatattttaattcattttaaaattgattactaaattttaattgactttgtg

SEQ ID NO: 94216 - DNA, 134 bp, Heterodera glycines
  SCN-specific regions: Sequence locations=1-101
caacgcatttggcttcgctccctgcacatttatgtttcattcatttccctcggtttatcccataattgcgcttacatcatttttggatgataaatatgactaaagaaaaaaaaaaaaaaaaaaaaaaaaaaaaa

SEQ ID NO: 94217 - DNA, 444 bp, Heterodera glycines
  SCN-specific regions: Sequence locations=1-144,166-395,420-444
gactgagtaattccatcgaagtttggtcttcctctccaagtcaacagaacaacaacggttcacccgctgaaactgttggagaagcaccatcacttcggcaaatgcaacttcaaaaaaacatcaaaatgcttgccctacacacactccatgatgtggtcagtgttggccccgatttgcccagtgttgagcaatatgagcagaaaaagttggacaaccagcagagggcgatggtggcgatgagacggcacagcggcgctgtcatggcaccaacaaacaatcaacagcaacaacagcatggcacacctacagcagaccatgacgatttggtgagaaatgctcaaaatcccttcatcaaaacggcgtcaattttaacgcggaaaatggcacgggacaggccctcctcctcctcattctccgaatttttgtttggcgatgaaactgctt

SEQ ID NO: 94218 - DNA, 426 bp, Heterodera glycines
  SCN-specific regions: Sequence locations=1-426
ctacatcagaaatttagtttatgacatccaatttttcatcattttctacgcggattggatacgaatttgtggtcaaaggcattaatcgcgagtggtttcgacataaattgccaactgacgacattcccatcccacccaaagagatcccggaccaagactcggaactcaactatttgttggaggcagacgaaagccgttggcaggaccaaagaccgcccaatttctgtttcgaacaccgacacgcgtgaccgatggatttacggcgacaatttattcttcagcgatgggatcttttcctgacgacaattgcaacggaagagtcaaatcaaacggaaacgtcccccgtcccttttccaattgactccgccactttgaccgcttaaaagaagaaaaaatgcgtgcccaattggcccagtcgcttctcga

SEQ ID NO: 94219 - DNA, 559 bp, Heterodera glycines
  SCN-specific regions: Sequence locations=1-559
attcctgatgcactctttgaaattggcatttttatgccaactttgcgttttgctgattggcaccgcttctgcggcattctataagagtgccgatgtcagctgggtatcacaacaggaaaagaatggacaatccttctacgacagttcgggcacaaaaaaggatccatttgtgttgttgaaatcatatggagtcaacgctgtccgattgcgcgtctgggtgaacccgtccggtggatggtgtgacggtgccgatacattgcacaaggcccagcgcgccaaggcccagggtatggccataatgatcgatttccactacagcgactcgtgggccgacccgggccaacagaacattccagcggcatggaaaagccattcattggcacaacttaacactgatgtgtacgagcacacttatggcatattaaactacttgaaaagcaatggcatttcagtggcatgggttcaggttggtaatgagatcaactccggcatgatgtggcccagcgggaaagtgacaaactcaaattttgccaaactggcaagtctgatcaacaacgga

SEQ ID NO: 94220 - DNA, 455 bp, Heterodera glycines
  SCN-specific regions: Sequence locations=1-120,142-455
gctggagtattccaaacggaatcgtttcaattcatcgtccacattttgactgtccttttcagcatactgtacaaatttgcttacagtagtctgtccaacgctaacccattcaccgctcagcagctcatgaatgagagcaatgacgccaagatgtgagactaacacaacgtgtttggcatttttgtttgtccttagaatatgacgaagtgtttgctcaacaacagaattgcattcattttccagttcttttgctttttctttttccaatttgattgctttttcattttccagttcttttggctgttttaataaaggtcgtcccatgattccaagctcaagcaaccttttgttatatacagacgaatatttcgagttggaaaatttaaaaagttgatacgaatcattttgatgcaaatattcaattttttgttgacagggtttatagaactcagtta

SEQ ID NO: 94221 - DNA, 175 bp, Heterodera glycines
  SCN-specific regions: Sequence locations=1-6,30-110,136-175
gaacgtaaaaaatggattcattgctttgacaatgtgaatgccatcattttcatctcatccctgtcggaatatgatcaaacattgcgggaagacaattgcacaaatcggtcaaattaaataataataaaaataattgttttcaattttatggccaactaataaaaaattttgatct

SEQ ID NO: 94222 - DNA, 494 bp, Heterodera glycines
  SCN-specific regions: Sequence locations=1-494
tttatcataaaattcttgaataatcttgggatttataattgattttgttggggatctcatcaaaggattggcggaaaaagagaatcgtgagctcttaaagaatttctttcctatccacgtttttgtggatgttaaagaaatcagtgtccacctcggcgaattgaaagtcaatatcttattccgcaaaattgccgctttgtttggttcgcctgcggcttcttttgaccaaatttgtgttgatgggtcgccaaagcgaattcagaaagaagagaagcaacttgcactgttgcttttgtattcatcccacaactttggcaaattgaaattatttaaatgcgatgactgactgatgcgtagaaatatttagatattaatcactcatatatttggataattttcatttttaactgactcatatatttggatatttttattttttaactcatttaattgtttcattaaattgtagttcatattgttaaatttatttttta

SEQ ID NO: 94223 - DNA, 507 bp, Heterodera glycines
  SCN-specific regions: Sequence locations=1-365,387-507
gaaaattcccattcccaaccccgaattggcaaataccgtctatgttgttgagcaaaaatcgcatgcaaatgtcgaaaaggtagggcacaatttgcacatcgcccgtcgtttttcgccttcccgcataaacgcgtttcttttctttgggcgctttgaacatgtttatgttgaggtcggtgggcatggatatttgctgattgtttggttggggttgggctaacaataagttagcattcattacttgtttccatttaaccaaatttagaaatttaccaatggacggtccaaagttcgatggattcttcaacgaatccaacaacgaattttgaatgctttctgcggagggcatcgatacctttttgggctttttcggtaaacttttttgtactttgtcagcagcggcaagttgggaggcgaaggcgtcgattggctgctcatcctcgaaagtttcgcagtcatcgtctgaaccggactaatcttatcaaattatatggtttatacattccc

SEQ ID NO: 94224 - DNA, 224 bp, Heterodera glycines
  misc_feature (218)..(219): n is a, c, g, or t
  SCN-specific regions: Sequence locations=1-161,183-224
gatgacaaattttttgctcgtctgtggcctcaatgaacgcagtgtccgtttgggtgcgctgttttttgatgtcttttggcagttcgtcaccgatttttgttccacgaccttcgcctttttggtgacccattgccttatcattatgttgaaattgtgtcacctatttattgtttcatttctttgatgtcacaaaaacccgaatgaatgctcaatgatannaaaaa

SEQ ID NO: 94225 - DNA, 533 bp, Heterodera glycines
  SCN-specific regions: Sequence locations=1-533
aagttgaacgcatcgacgaaacgggcaatgttttgctgtttattgtggcaaataaatgcgacctgaaagaaatgcgaatggtcagcgaagaagaaggacggcaatttgcggaaaagcaaaacgcacattattgtgaaacatcggcgctcagtggcaaaggcattgaaacggttatgtcctcaattgcggaatgccttttacaagaacagcagcgactgctgaaaagtgccgagttgggccattcctccttcgacttggccacttcttcggtcgcggaggctgtggacgaaaagggggcaaagaggcgaggagaggaaaaaaagaacggaagcggcggaaatgccaatgggagggggtgctgcaccattttgtgacggatcggcgagtgccccccctcccgcctcaaattgagcatatcaccgggttcttccactcattcgaatccaatgtaaatgtctgattcactgttgaaattgccgaaacgttacttccttcaaatcacaaaatgtacattcattctttgatcggagatg

SEQ ID NO: 94226 - DNA, 512 bp, Heterodera glycines
  SCN-specific regions: Sequence locations=1-35,57-111,134-236,258-512
gcactgctcgtcaagtacaattcttccaaaactgcaccaccaccgccaccatcaccgtcgccgccgtttgcattggatgcacagaaagaagagtcttcggaggaaaagcaagcggaagcggtggtggtgggcgaaccggaacaacatcaacagcagccagtgctggagacgatgccgacgacgacggcatcgaaacaggaggtggcaacgcaaatgccgggcgaagacgatgacgaaccgccaccgccgccgccgatgccgaagaaaacagcatccaaggaggcagagacgcaagtgccggatggcggtggtgatgggccatcaccgctgctgccgcaagtgccgccgaacaccacagtgaagatggaagcggcaacccaaatgccgccggacggaccgccggcagcggaagaaatgacggcggtggtggtggcgattgtggcgatgattttgatgtttttgttcgaattcgtgtctgcagttcattagaatttacgtttctacatttttta

SEQ ID NO: 94227 - DNA, 553 bp, Heterodera glycines
  SCN-specific regions: Sequence locations=1-104,133-256,295-532
aacattttcacatttattttcatcgccttgctgtgccaataccaccgcagcaaacatcatataaatgctggaccattggacgctgaaaaatgtcggcataaatgatttaataataataataataatttttatgttttaagaattaacgttttttttatttctgtcagaaataatttaaaaaaggaaagctttttgaacattttgaaaaaaatataaatttaattgccaccaaaaaaaaacacgggagaaaaaacagataattaaaaattgttaatgttaattataaatttaatagagttcttaaacaaaaataatctgtcaaattaagcgccttcaaatggtgaaggaatccacaaatatgaagcggagaaattgaaaattggagaagttgcaaaattgaatcatggtgaaacaaaaactgaaatggatgaagcagatggccatagacattcattgccaaaagatcgtggcgatattgtgcatccaaaatctcaggacggagtgtgcaagattcatgaggatgtgaagcttgatttcaatgatgacattttcg

SEQ ID NO: 94228 - DNA, 554 bp, Heterodera glycines
  SCN-specific regions: Sequence locations=1-157,190-280,332-500,524-554
aaataacctttaaaagattttatttacatattacatatttggggatttttgtacatatttaatacatattttagcatttcttatacatattttatttacatatttcgcgatttttcttacataaaaaagaagccatgtttattactaacttttgaggataatttttttttttttttttgtataaattttgtttgattgcagctgcgcagacagctttatgtacaagcaaagaaaggcaataaaaattgcaaacctaaatgctatgtacaaattttcttccaaatttatattatataaatttaatttaagttatattatatatctatatataggtattttatatggttaacaacgagaaaatctgtcacgagtttcgtgacaaatgcagggttgactcagtcgtacggtgttcggggagatgtgacatcgaattgggagaggtgaccaagcacaatgtcatgcaattaaagcgtcttaatttgtccgtcttcccggtgttttacaatgacaagttttacaaagaagtagtcaatactggtgagctcgcaaagtta

SEQ ID NO: 94229 - DNA, 512 bp, Heterodera glycines
  SCN-specific regions: Sequence locations=1-512
tctgctgttgctgatcgacgggtgcatctcgtgcattcgggacaccagtaatgatgatacggacggcgacgatcctccgatcagtgtgatcatgaagatcagctatacaatgcccgaggggtcctttttcagcgcgtgctctgaacaaactttggaaaatgatctcttttccatttccttcccgtacaatgcgagcatcacaactgcaaaagtggccgaagcagaactgcccaaaataatggacaacgaaattatcattggcccactgattggccagcgcacttttgccattcccatcttgttggtcgggcgacagtgccggggaatgttcagcgaagatgcgccgattgggggatttggggatgtgaagctgacggtggagcacaattgcactgccgacaaaactaatcagcaaattgaccaacaattgaccaaaaggctgcaaatcaacacattcaagcacaatgtcgctgagcttcgccgcgtgcacgtcgatttgggggagcacagag

SEQ ID NO: 94230 - DNA, 441 bp, Heterodera glycines
  SCN-specific regions: Sequence locations=1-441
ataaaaaagaaaagtagaaatttcggaaatcattcagaaaactttaattttaaaaaatgaggaaacttccaattcttgctcttattttctgcttgttgctacttacaacggaaggaatatttcgccgaaaaaacagaaagaaaaattcatcgagcagcgaacaaaaaacccaaagaagaaaccgagggtatggccgaagtcgcactttttcaaatggcaatggcatgtatggccaatcgaatggattttcaaatggcaatggcatgtatggccaatcgaatggattttcaaatggccgatttggcggctccagtgtctattcaaatagcggccggtcgaatagctttccaaatggtggatttggcggctccagtggcttttcatcgatgggacataactcgggcggacttcacggctttgggtccggcccaccttctggag

SEQ ID NO: 94231 - DNA, 484 bp, Heterodera glycines
  SCN-specific regions: Sequence locations=1-238,260-325,347-484
tgattcatccagaccaaaccgactttaacatccaatgatgggtagtgtcgttcagttcaagctatcatgacattaaattcttccaaatcacctctgtattccgtagttcagtgacgtacggtcggtcttacacgtaaacataaaattagtttttattttttcccaatgacttttacgtctctgctttcatagtcgttaaacatgcaaatcctatgtaaaatcggtagaaacttcgatctgtgtgatcatttcatttccagttgttttgacaatataaagtcccactttagcattttccatggtttgcacccttttatttgtcttgtttcccccacccaacatttttcatacaaatgggactgccagtcccttttcatttacatttttggttaatctaagcctatcatgaaaaagatattcaaagattgaatcatcttaaagaatgaagccaaagaaaagacaaactgacaatgagactcaatgt

SEQ ID NO: 94232 - DNA, 97 bp, Heterodera glycines
  SCN-specific regions: Sequence locations=1-97
atataaaacagtttaaaatccgaaaagataaacagctccatcccgttgtacacaaacagcacaaagtatgatagcccagagcagataataaacagtc

SEQ ID NO: 94233 - DNA, 212 bp, Heterodera glycines
  misc_feature (206)..(207): n is a, c, g, or t
  SCN-specific regions: Sequence locations=1-212
aaattaatgaaaatcaactatcaaattgagatgaatctgacgaatgcggggagtttgaagaagaatacaacggaagttctgatgccgttttttgctcggacgaagcacaaaatgcagaaacacaaatcaagcagcaaaacccgatcgaaaaaattcacaatatgtgtcaaacttatttttctttcgtacaataaaacaaaagctannaaaaa

SEQ ID NO: 94234 - DNA, 457 bp, Heterodera glycines
  SCN-specific regions: Sequence locations=1-271,302-385,408-457
ttcccacttttggtcgcaacgaaattaactcaatacgctgcagaagatgcaaatctgttagtgcttgatgccaaaagctacgcacgacaagcagtgaatataattggcaattatcgaatttccacgggatgttttatgcacgacatgcagatagcatttggcagttttattgggttcaatttgttcaaacttttttacgttcccttcggcattctcggaattcacaaaagaagaatcgatgcatacaacagaaagaaattggcaaacgaaagaaacagcggaggaaaaggagaaggaataaagtcggaatgaggacaaatggacaaagaaaggaaccaacaaaagttaaaaagagaaagtgaaggcaaagaaaggcatttgctaaagcaattcaaatggaaatggaaatgatcattgaattgtgattgattgcttaacaaagcaaagggattgaatg

SEQ ID NO: 94235 - DNA, 437 bp, Heterodera glycines
  SCN-specific regions: Sequence locations=1-208,230-437
tgtggacccaaacttaatgagtacccgaatttgggtccgggataggaattggtcgaaagggatgccggattcgtgatcactgatcagcgaccccgaaaacccctggaaacctgttttcacgacttttgaaaacaacaaaaaatttcttcaaaaaaggggggcaaccatcggcagtattaccgaaaattaatgctttttgccttttaaaatttgtcaaaaaatggtatttccctcggattagtgttgtcttagatttcattttttcgcggtgtggtcgagtaatccctattagccagtctccggtgcattgcaatttttaccgattttggtgatttttttttaaaacctaattttcaaattgtccagggaccgcctttgactttgcgttgaagcttgttgagctgttggtcgacattggcaaggctggcgaaattcgc

SEQ ID NO: 94236 - DNA, 462 bp, Heterodera glycines
  SCN-specific regions: Sequence locations=1-172,194-302,325-462
gttatgctcgacgactcgatttttttgaaacccctgactatgaatattgttatggtcttttcaaaactgtgcttgaaaggactggtcacacttatgattatgagtttgactggacccataagctcaatcaggcggttcgtttccgttgtcctcctttattctcgtggttatctcagacaaccccaagtggttccattcacaccgccgttggcgtggaaggaggcgaactgcgaaagacgaggaccgattacgcaaaacgtgcatcagtcccaaaaccgcgtaactcggacgggctgttgaggagtggacagcaagtaaacagcacgacaaccggaggtgccatcggacaccacgggcctggcttcggttccacgcaggtggtaaactcaaacgcaggagagatggaggaaagcgcgaggcccccagccccaaatcgtcaacaggaggaagagcacagcgaag

SEQ ID NO: 94237 - DNA, 510 bp, Heterodera glycines
  SCN-specific regions: Sequence locations=1-430,459-510
ttattagcataattgagcaattagctagcgcattctatcattagaaaatccataataaatgctactgaaatgccgaaacaatatttgtccatcctcaataatcctaaatatttaaaattagttgcatctatatgaccattactgtaactttagttacggtatattatttcatatttcttacctcaggcaaagctcgttcttcctcgcatcagctgttggcattcccgcgccctgcactgaaatgtgccgtcaaaaagaagcgcgggccgcgcgaaaccgttgaaatgggacgcgagcggaaggcgtggcgcacgttggccatcattacggtatccatttttagatactgtaacgcgcgtgtcaatgaaatataatcgactaaaagtgatttggtagtaatttgtgttgtggaatttatttgttttagtagattttaatttattttctttttgtccctcagggctctttcatcgcctgttggatgcccttttttgtgctctctttgtatcg

SEQ ID NO: 94238 - DNA, 404 bp, Heterodera glycines
  misc_feature (379)..(382): n is a, c, g, or t
  misc_feature (387)..(387): n is a, c, g, or t
  misc_feature (389)..(389): n is a, c, g, or t
  SCN-specific regions: Sequence locations=1-302,324-351,373-404
tcaggtgtcgccagagacaatgaatcagtgtccgacaaagaaggagagcagcatttagacaatcaacagaacgaacgatgcccatggagcagtgatcattcatctccagccttgcaatgcgggcggacgagcgctgttggcgaatttcctgaatcgtttggatggacaaacagtcacacaattcattttgtccctgttcgatatgtaccgtcctcactgattgtacaaatttctcgccatttgtcacgtctgtatcatttttgtgccaaatgttcccatttgacttttgtgtagttcgtttccccatttgtgtcaatttaattccacttatgaaacttgtacggcaaatggcattttaagaaaaaattttttgaacccnnnnaaaananaaaaaaaaaaaaaaa

SEQ ID NO: 94239 - DNA, 494 bp, Heterodera glycines
  SCN-specific regions: Sequence locations=1-326,348-413,435-494
catcatcgatggaaaatgcgcaaacaagtcacgaatcagaaggactttcccgacagggccaaggacgcctttgcccgtctgccagtttcggaaactttaccgatcctttgatgataccaccaattgctttgcaacatgtttacgccaccgctaatatggtcacacaagcaaatgtcgatcagagtaacaaattggacttggaccgtcttccgcccgggtgggaagtccgtctcaccgaagatggttcttaccgatattacgtcgatcacaacaacgggcgaacccattggatccatccctttgcgcccgaagttttgaagccaaattggacaaaaatatttgacactgttcatggcgttgtttattataaatcatgttgatcaacggtcccaatttgaccatcctggatttatcaatggggcatttttaccaacaattcacggttcgtcttctttccaatcgctgttagaaaatgaacaggaacaaaattgcaa

SEQ ID NO: 94240 - DNA, 553 bp, Heterodera glycines
  SCN-specific regions: Sequence locations=1-553
gggattgggaacagcccgacacttattggcgctctaaagaattccttgcgtggctttataacaaaagtccggtgaaggaaaaagtggtggtcaatgaccgttggggcagtggaatagccggaaagcatggcggttttttgacttaccaggatcattacgttggacaaacgttcgtggggctatcgtcgttatttgaagccctccgatgttctttcattggccgaattgatcaatcaattagtgcgtacaatttcgtgtggagggaatatgctgcttaatgttggccccgaccacaccggtcgcattgtgcccatttttgagcagagacttcgcgaatttggtgaatggatgaatgttaactcggaggccatttatggaagcaaggcatggatccaccaaagcgatggcccaactatttggtacacaagccaaatacgaaatgcgaccgaattgagcccaagtcggatgttcaaccctcaggacacatttaaaacgattgtttatgcctttgtgctttccattcctcggtctggtcgtatcaattttccctctg

SEQ ID NO: 94241 - DNA, 159 bp, Heterodera glycines
  SCN-specific regions: Sequence locations=1-51,73-159
aaattcgattctgccgatcttccgcttgtggagggagccggcgatgatttgcttgtggtcggtggtgacgatttgcacatggatatttcatcatgcccgggaacgccgcagatttctcctatggtctctgctgatgaaggcgacggggacgactaattg

SEQ ID NO: 94242 - DNA, 242 bp, Heterodera glycines
  misc_feature (214)..(215): n is a, c, g, or t
  misc_feature (219)..(221): n is a, c, g, or t
  misc_feature (223)..(224): n is a, c, g, or t
  SCN-specific regions: Sequence locations=1-134,163-206
gcaaaggcgactctttcataggaaggattggattattaatccgctttgcgcggagagtgaactgactgatcgacacgcgatgctccgattttatcaccccacccattcattttcggttattttcgccagtgcgatctctttccctttttgttgtttattttgcgatggatttaattgatttcattccccgtgttgttgaaatagggttttttanntttnnnannaaaaaaaaaaaaaaaaaa

SEQ ID NO: 94243 - DNA, 466 bp, Heterodera glycines
  SCN-specific regions: Sequence locations=1-90,134-466
caaaggaacaagcgacagacaatgcgggaaaagagcgaaatagccgaataatccaccatttccagttcaccacttggccagattttggcgttcctgttcacaccgaccattttttgaacttcttggaggaggtgcgaaacgccagagagaaattgcctgagccgggctcagaggcaggcacggtcggcccagactctccgattgtttgtcattgcagcgctggcatcggtcgtgcgggtacctttgtgatcgtggacagcattttgagtatgttcgaaaggaaatggaaaggccaacaagtggaagagggcgaaaagaatggaacggaaaatgatgaaagggaacgagctgatcgaacggtggacgaaaagatggactctttggaggcattggtcgtgttcatcaggcggcatcggatgggcttaatccaaaccccgcaacaattgcgtttctgctggaaaaccat

SEQ ID NO: 94244 - DNA, 119 bp, Heterodera glycines
  SCN-specific regions: Sequence locations=1-119
acaaccgcatgagaaaaacggaagaatgtgaaaaaagacgacgattgactagccgagtgtattataattttttgtatttgtgacgatttcatttataaaccaagtcagaacaaaaaaaa

SEQ ID NO: 94245 - DNA, 455 bp, Heterodera glycines
  SCN-specific regions: Sequence locations=1-455
tcacacaaatcgtatggaaatcgaccagagaggtcggagtcggtcggtcgacaatgcgttcattcccacaacagatggaaaaggacgagaaaattacaaatggacactcagaagaagcagtcaaaaaagttgtggtcatagcattttataggcccgcggggaactcaaatcgaagcggccaatttgagcttaatgtgccgaaaccaattgcgcaatgagttcattaattaaaacggaacaactaattaagcgaataaataattatttatgagcctatccatcattttttactctgtacaaacatagcaaaaattcacctaatccaagcaaatgaacaaaggtttttatgcggtcgctaaagtttcctttatttcgggatgacactccgcatatttcgccatgcgcctctccaattcaggacgaaaatgtcggatcagtccctaaattaagaaatt

SEQ ID NO: 94246 - DNA, 486 bp, Heterodera glycines
  SCN-specific regions: Sequence locations=1-300,323-486
cattctctctatgggcgccattatattaaggacaagccggtgaaagagctaaaggatgacgagtacttgagcttcgttagggctcaaaaggacggccttatcgaaatcgatttacacattaattcgaatgaggaatcggagaacaaatgtttgcgtgcgtgcatggaaaacgatggctgtgcgacttttaagcgtaacgaaaattcggaaattgtggaagaatggaacaaacttcggaaccttgttcttacgatttgcgtcaacaaaatgttaattcctgtgctcagaagggagtcgcatgaaaatttgattgaggaggccaaagaatttgtaattatgaaagcggctgagcgattgcatggtctaatagagactgagtcttacaagccacagtttagctatgataatcaggacgatgacttgcacgatgtggggacccgcattttggctgtttgctattcttcagacattgcggatgcttctttt

SEQ ID NO: 94247 - DNA, 474 bp, Heterodera glycines
  SCN-specific regions: Sequence locations=1-474
gcaaaaatccgaggcccggcttcgatggggcggtgatggatgctgagtattctgctttgatggctgaacttggcgaaaaacctcccatttctttggaagccggcactgcaccaccgttagtcggtgggaagccgatccccgggttccccggcagtggattacgcccgcgtttcgcgctgcccgcgcccactcctattgtgcgcgttaatttggcgaagcaacaaaatacgcctcaacaacagtccgtctcgggtggcggttaccccgggtgggatggtgctggcttctatggcttttctggacttcctggccaagacccggccgcagccgcggctgcctgggccgcttggcaggcgggtcagagtggatttccatcgccagtgcctccaccccctggtggcggattcggacatgccaacatggaagcagcttcgacgcccggcacatcggccggcggactggcgatgttcccgc

SEQ ID NO: 94248 - DNA, 383 bp, Heterodera glycines
  misc_feature (337)..(337): n is a, c, g, or t
  SCN-specific regions: Sequence locations=1-287,327-383
gctctttccacgacgaagacggcgaagtgatacagcgcatttcgcaggtgtgcgacgatggcggagattacctttatttggccagttttgaaaatgattacatcggccgtatttccaagaaaacggaataaaaagacgcaaaataggtcattcattcccatagttttcgcaatttcagcttttctcttaatttgcagtagtaatatacaatattttaatgtcctatcaaaacttttgtcattatttccttttacaagcgataagaaaagcatttgttgtagtaaaagttaaattaataatttatttattattttaattgattttaactttttgttanatgtgcttaaaagagacggacaaataaattgcggacccacccaaaa

SEQ ID NO: 94249 - DNA, 94 bp, Heterodera glycines
  misc_feature (93)..(94): n is a, c, g, or t
  SCN-specific regions: Sequence locations=1-47,69-94
cctacgggtaatttacccctcactttcctttccgtcactccacagatattttgttatttaataattgtccatttttaaacactgagtttcccnn

SEQ ID NO: 94250 - DNA, 443 bp, Heterodera glycines
  SCN-specific regions: Sequence locations=1-443
ggatttggcaccaaacaaagacctctaatgatgaagcaacggatttgccatttgacagcaacgcacaaaacgactaaaagaccaggcaaaccaaaggttagaacggcaatacaacgcactgaaacaccggacgaaggccatggaaaagtacaaggcgaaagtggcagaacacagccaaaagataagccaaaggaaggaaagcgaattggcggataagcagaaactgttggacaaaattcagagaaaagtcggaaatttatgaaaaggaaaaatgaaagaaaaattcagcaagaaaaagggacggaaaattacgaatagtgcaaagagcaagtgagaaggagggccatggaactgtgctcgccacgacccacccatttgtgggcacagactttggccgactttggccaaatgccctccgatttggcacgccagcagttggccat

SEQ ID NO: 94251 - DNA, 464 bp, Heterodera glycines
  SCN-specific regions: Sequence locations=1-235,277-308,399-464
gcaacttgggtcacttttcgcgtgagacgattgttcgtcatttgaaggactttcacaattcgcacgaggctccgatggacaatcgccttcgttttgcacaagaaatcaaagattccattcgcgattgttacccacaactttttatcgatgcaccgatcccgacgaaagaggacatagaaaaactgagagacagtctgaatctgagcgaccaagtgttggtctgtgacaaagacggggaagtggaggagggcgagcacgaggaggacggcgaagaagcggcgatggacaaagacaacgcgaatgaggacgaagaagaagacggagaggaggatggggaagacgaagaagaaaaggaagaagaagacgtggagaaggaggaggaggaagaagaggaggaaacggaacagcagtcgaccgccaacgacgaagaagaagcagaggaaatgataggcgagggggaagaa

SEQ ID NO: 94252 - DNA, 433 bp, Heterodera glycines
  SCN-specific regions: Sequence locations=1-433
tatatacccccgaccctttgccgtgtctcagcaaacgaaacgccacacttcaaatgcttcagcaaattccatgcgatgcctttaaaaatgagtgttgggccttcgtcgccctttccccctccaaaatcgttttctccgttcgtggcactcgcacaagtgcgcaattgatcattgaactcatcgagacaatgacagttttcagctcctaagaaatcgtttcccgccggtggctctgtccagcattacttttacacgtcgctcgacgcactttggagcgttgggttcggcaggaaattgagagaattgaaaatgttgaatcctcagctgcccattcttttcaccggccattcgttgggcggtgccatcgcttctttggccagtgctcggtttgcatttgaaaaccgagactttgttaagtcgtccgaaatatttt

SEQ ID NO: 94253 - DNA, 72 bp, Heterodera glycines
  SCN-specific regions: Sequence locations=1-37
ttttaaattaatttcagatagattcataaatacaaacataaaataaattgaatttaaaaaaaaagaaaaaaa

SEQ ID NO: 94254 - DNA, 392 bp, Heterodera glycines
  SCN-specific regions: Sequence locations=1-1,24-392
ctcaatgaatggtgtttggaaaatgtcgcttactgtttttcttacggtgcgaaacttttgctacaaattgctttcgctgatattcgccattcccttggcggtgctctttggcattctgttcggacttttttccatgctcagtgtgttcgtgtttgtgccggtcggtcgtctgctcagcatcccattcggttggcttgcaaagttttgggctgttctgatttcggctgtttgcgacccattgtgccgttcatttgcgctcacttttggcaacgttaaagtgaccagatacggaatcaaccaggatccaactgccgtgggtgttgagctcaacttgaatgaatgtgtcaacaaataaagaaacgcactactgcccgaatatggaaaattgcaaa

SEQ ID NO: 94255 - DNA, 365 bp, Heterodera glycines
  SCN-specific regions: Sequence locations=1-47,72-128,151-340,364-365
ctttgaatacttccgatttattcctttcgcctccttttggtcttccattgtttccatttatttctttgagtgattctggcgatttaattgagacaaattttgggccaaaattcgaatttgaccccgcaaaagtccagcagcaggcatcttcaaatttccggcaaaattattgggatgccaatttttgtcatgagaatctcgaaatcattggcaacaaaagtctcattgtccattataagaaaaattcttatgatgcatggcgttccgtcttcgctaaatatccgattttgctcaacaaggattcgtctaacattttttactacgaaattttagtcaaaaataaaaattattggttcattagcttt

SEQ ID NO: 94256 - DNA, 267 bp, Heterodera glycines
  misc_feature (239)..(242): n is a, c, g, or t
  misc_feature (245)..(246): n is a, c, g, or t
  SCN-specific regions: Sequence locations=1-242
acgcagcgagatcagctcgaatttcgtgcacaacatgcgagttttggggatcaaacatacaatgatgatgaaaaaattcgtaagctaatgacggctcttagtctccagttcgtgggaaacgcaataaagtaaaggaatatgaaatttggaagaacgaccattctttccattagaattgttcattccatgttttttttaaacttgttattcgttcaattttataaatgttcattgttttnnnnaannaaaaaaaaaaaaaaaaaaaaa

SEQ ID NO: 94257 - DNA, 308 bp, Heterodera glycines
  misc_feature (297)..(303): n is a, c, g, or t
  SCN-specific regions: Sequence locations=1-308
agcaggtcaccggtgccacaatgacggtgaacggaacgcgcgaaaacttccaagcacagctgagggacggcgacggtccgatgggagagcccaaattcgaacaatttgaacaacatccagattttgctttatggtgacaacaattgcatggggcctttgtgtccactagcagaggatcaaatcaacgcaaaagattgtctgccaatgaatcccgggcccaacggtcagcggaaggaaaggtgaaagaatgaattgagaaatgatatcgatcattctgaataaatttaaaggttaccnnnnnnnaaaaa

SEQ ID NO: 94258 - DNA, 542 bp, Heterodera glycines
  SCN-specific regions: Sequence locations=1-302,342-379,401-429,505-542
ccaactcaaagtgagccgtggcgaacggaccgatcggcggggagagacattcccccaaatgccaaaccgacattttcagaatgttcgagaagttcgacgtattgcggcactggtttctactgcaaactattccaacggaattcgggcaataatatgcgtttttgttgtcggaggagccgtagaagcggcggaagagtaaacggaaagagtcaaaggtacagcgacaaaatgcaaaaggcgaagcagaagaagcaaaagcaaaaggacaaaccgagaagactgaaaacacagagagcgcagggacacatcgatgacgagcagtacagggagaagaagaagaattacaagcagaagaaggacaagcaaaagctgaaggcacgcaaaaacaaacgcaaactgaacaatgggcaccaacaaatgtggtgaaaggagagaaaggaagagaggaaacaaaagttggagagacaaagggaagtgaagagagagagagagagaggagagtgatcgcatggaaaagtgacaggacggaagagtaaccggag

SEQ ID NO: 94259 - DNA, 449 bp, Heterodera glycines
  SCN-specific regions: Sequence locations=1-88,111-449
tcgtcaaaatggtggatagtgtcagtggtttggctcttccgatgatgcgaatatgcaaagttgaaaaatgcaatgggacggacgttgtggtgatcaacgacggagacagcggggagcaagtcagccaactgcacaagtgcggcttccaaatgctcagcggagcggagagtcggcctttgtttatgtgtttcaacggcgaaaacatagtgcaacaagacgtgggcaatgatcggagttttgtggcgaatgatggccaatttatgacggatcgaaggtatccgatcagagacggcgcccaatggacaattatctcgaccgatacaatccaataccgtttctttgaggcactaaggccagttcagaatgaggttgctcctgtgccaattgtcagttcgctggacatgcactcgactgacccgacttcgtcttccggcgcttacgttgagctt

SEQ ID NO: 94260 - DNA, 465 bp, Heterodera glycines
  SCN-specific regions: Sequence locations=1-172,195-465
gtgcatggcatccgtcgcgtgtctcattcacagttgcgcgtgccggtcagaaaggtcaaggctttcccgaaggatgacccaaagaaacccatccatctgacggcgttcatcgcctacaaggctggcatgtcacatattgtgcgcgacgtggacaaacttggctcgaaggtgcacaaaaaggaagtggtggaggcggtcacaattctcgagacgcctcccatggtcattgtcggtgtggtcggttacatcgaaacgccgcgcgggccgcgtccgctcaaaaccgtttttgctgagcatttgagcgaggactgcaaaagacgtttctacaagaattggtacaagtgcgagaagaaagcattcacgaagtatgccaagaaatggcaagacgaggcgggacagaaattcatcgaggccgacctgaaataaataaagaaatactgtttctatgtgcgcgtcattgctcac

SEQ ID NO: 94261 - DNA, 482 bp, Heterodera glycines
  SCN-specific regions: Sequence locations=1-423,446-482
gccaaaagcaatcggcggatgaacaatccgttgttgtcagccatgtacaaataacaaagcattggcggaggggagggcgaattaattgaccgaatcccgtaaatcctcccaccccattttggtcatcaccatcgggaacaccagcgcagactttccgtaatggacgccgccgcctacggcactcatcggccgtttcgttcggcttccgccttcagcacttccacccggtactacttggacgccgacattttgaaaagacttcgaaaccgaacaggactgatcggatggtggtgtgagttgtggacggtccgctaccgcgagaagagccgtcgcattgaccttctcgcgcgcgttctcttcccgcttttcttcgtcctcttcaacattatctattggatttgctatttgaggccatatttggcggaggaaatggaggaaaactttgccaaaggaaaagcaaacgaaggcacaacaaattgagg

SEQ ID NO: 94262 - DNA, 349 bp, Heterodera glycines
  SCN-specific regions: Sequence locations=1-349
gttgggccatcgaatgggccaattggagatggaacagcacgaggcactgcagatgaagtgatcatcgaagtgcggtcgggtagtgaagccgaaaacaatggaagtgccgtggggacagagatggacagtgccgaaactgacaatgagcagagggaaagggcgccaaatggacgcaacaacggcacggataattggccaaattgacgaacgaccgaatgaatgaaggggatgggaaaatagggggcggggggggaagaccaccggacaaattagtcgctcaactacaatataatcattattatgtgagtgaaataaatgtcaatttctgcaagacccaaattatgaccgt

SEQ ID NO: 94263 - DNA, 273 bp, Heterodera glycines
  misc_feature (263)..(263): n is a, c, g, or t
  SCN-specific regions: Sequence locations=1-20,42-127,265-273
aattaaaaaaagtaaatcctctttaaaaatgaaactttcaataattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggaagggaagaaggaaaagagaggaagtggaggtggaacatggggcaacggaggaagaggaaacgagggaggaaacggaggangaggacacgg

SEQ ID NO: 94264 - DNA, 520 bp, Heterodera glycines
  SCN-specific regions: Sequence locations=1-323,345-520
cacgccgttttgccaaacatcagtctttttaagaaattcggaaaaccgccggacgaatgccttttgatttcgctgaccttttccgcctttgccttcttttgcttcggttggcatgtccatgaaaaggacccaacatttatgcagccattcgctttgctttacgtggcctcaattttcgcgcagttccctctcttctttacgccgtttgaatgctttttgaaatgggcgttcacactttggcattttgctttttgccaatttttggccaattttgtgtggtgcattcgattggccgaatttgcgcagtttaccgtcgctaaatttgcactttttcaaatggtttcggctcaattttatgccgatttttgtcatcggctgatttttggctcaaattttgcgtttttgccgatgatggtcccttctgttgcctgtgctcttttcgtcttttttgcttatctccatttcattctcattgtttttgcggaatctgttcaaatccattttttcaaatttcgttgtc

SEQ ID NO: 94265 - DNA, 548 bp, Heterodera glycines
  SCN-specific regions: Sequence locations=1-518,540-548
ctgatcttaacaattgttatacctcatttgaacacaaagtgttggacgaaattttgcacaaaatcacaccctctgacagtaagtttgtagttgtcagtgttcaagtgaccagcaaaatatacaaatatcgaaaaacgaagacagaagccgggcttagctatgacgacgcattttcacgcatcatttgtaaaggaagcgaggaattcaattctccattcaaaagcgaaataagcagtgtcgaatttctcaaaatgatcactcaatttgccatgcgtaccctaatcagagaaccattctgcgcattaacttcctctgcacaaaaccggcccttacgacaacgattatttgtcagtggaagaggaattggccaggggagctcactttcggttgccttgtgcaatttgtatttgggttgggtcgagcgacaaatttgccttcattcgccggaaatggggctgacaaattgcgctattaccctgttttgctgtcgttacatggacgattatctaatcatatccaacaaaagggaacgagttgaaaagttgatt

SEQ ID NO: 94266 - DNA, 569 bp, Heterodera glycines
  SCN-specific regions: Sequence locations=1-569
gggataaacttttaaaaaaaagaaaaaatcaagtaatgggaaatacttgcggctgcgctgacaaagctaacgaggctggaaatatccaggtcgatgatagaaagggtaacagacatggtaatgatgacgccgccttcgacaacttcgaacaaggtggtgccaagatcaccaactatggaggcaaaagagatgtaagaaatgcccttcctgaagaaaatggcgctacttccagcgaacatgctcctaatcctagcttcgctactcttctctctcagatgccaaactattctaacccaaataccactgctactctccaaagaattggcccattcgtctatgaccaagatgatcatgaagacggttatcttcctcaacttggcccttatgagctcgaaaactcagctgtctatattggtcaatggaagaacggtatcagacacggaaagggaaagcaaatctggagtgatggctctcaatatgaaggatattggaagaataatatggcaaatggcaagggaagacttatccacgctgatggtgacgtctatgaaggagaatggttcaacgat

SEQ ID NO: 94267 - DNA, 532 bp, Heterodera glycines
  SCN-specific regions: Sequence locations=1-484,508-532
agttttgttggtagcgttgcgcagccaaaatccgatttgacggcacgggacggccgtaaccgcacgccaatgtcatcggccatttctgacattgatggctgacaggtgtcgttgactcagaccgagctcgaactttgtccgggttgcaaagaatgaacagagtgccgatgccgaaaatgcaactcaaatattccgaagtttgagtggtgcgacaatgcattcggcgtccgttaaggcgcgcttgggcatccccgattgcaaagagagtggagccgtccgaatttgggacttggaatttctgcacggtgtttttgagcaggttgaacagctccacgttgagtacgcccgcacttccgcttttcccttttctgcgtttgtcgcccgtctgtcgtcgcacgaagccgtgccaccgtcctttaaggatgccgaagtcgccctcccggttcagcaccagaagcactcgctcatcgggcgaagacaaatgaggaagaaattgcaaattggagtccaactgttccttggagggcaaaga

SEQ ID NO: 94268 - DNA, 478 bp, Heterodera glycines
  SCN-specific regions: Sequence locations=1-478
gaacttttttgcggtcttttgggaggcgcaagttttggcaaaaacgtgcgatcgtggcgagaagtgcaaaaggcagccaacctgggccaatgcttcgtggccattgaccccgaatgctttgctccaacatttgtggacaatttgcagttgttcctggaccaaacgcgtgggcttaagccgcgcgacccctccaaatcggtgttagtgcccggtgaccccgaaagaatgaacagcgaacggagcgcaaaggctggcggagttatttactcagaaggacaaattcgggatttggagaaattggcaaaaaaagcaaaacgttggcatgttcccttacaaggcaaatttgtagcagaacaaaaaaactgttttctttttgttccaaagcgatgactttcaattgaattggcattcatttccattattgaacaattaattcgttcccatttgctgctgctgataaagaaaaaaagaatgaaaa

SEQ ID NO: 94269 - DNA, 339 bp, Heterodera glycines
  SCN-specific regions: Sequence locations=1-339
tgcaccatttcacgttcgggcatttcaatgattgcttccggaattgccaccgaactgttggcttctgtccttcaacacgaattgggcgcagaagcgcccgcccttttggccgaagtggacgaaaacgcgagtcaattgggcgccactccgcaccaaatccgcggttttatgtcacgctttcatctgatgatgcccaccgtacgacgggacaacccatgcacagcgtgggggcatacgggcaaacagttctacccgacctgagggaattgaatttttaaaccaattctcccaaagccctgccagttggaacaaatccccggattaccgaattaccaaaaa

SEQ ID NO: 94270 - DNA, 381 bp, Heterodera glycines
  misc_feature (364)..(368): n is a, c, g, or t
  misc_feature (370)..(375): n is a, c, g, or t
  misc_feature (379)..(379): n is a, c, g, or t
  SCN-specific regions: Sequence locations=1-340,363-381
cccgaccacatccaggtcaaagagccaccgattgacgtcgcgccgaccacgccgtactcggagcaccgcgaaaccgatgaccactggcatgccgccccagacacaaatgccgcccgcccatcgcaacagcaacttgcgaatggttggccagttgccgccccccgaacgtttttatttgtaagagaaaacccttgctgatggccctaatggataaatgggaaaatttccattaaatttgtgatttgggggggcaccggccccaaaccccctttttttgccggaaaaaaatttttgggggggtttttgtttaaaaaattttttgtttgtcgtgaaaaaacctcttttaaaatatttggggaaaatnnnnnannnnnnaaanaa

SEQ ID NO: 94271 - DNA, 481 bp, Heterodera glycines
  SCN-specific regions: Sequence locations=1-441,463-481
actgtgacagtagtgaaaaggcgaataatgaaccgccgccactcgccggtttacaagcatcagcagtagaagaagcatcattgccacgcctgatgatttcgacttgtaataacgacattgtggacgacaattctgagttttctcaagatttggatggtgatcatcagtatacagtgaagggggaggacaacgatgattactgtggtgacgtaaactcgttgaggcctggcgacgtgtacgtgaccaaccattccaatttatcagctgttcaggtcgtcttccacgttgtcggcgatcgtcaattggttgagcaggacatctcttcacgccatccgtgcatcaatgcattgcgaaatgtcatccgtttggcaccccattctggcatcaatcatatcacatttccattacttttggttgagcacatgactgaggtgtttttgcatagttttttatattatatttctccccgaccctcggggta

SEQ ID NO: 94272 - DNA, 469 bp, Heterodera glycines
  SCN-specific regions: Sequence locations=1-2,84-245,267-286,468-469
tttcctttcccgactgtctccatccgcttcttctctctttccccccccccaaatgcccctctttccctcccttaatccctcccctctgtcaattcattcgatttcccattccaaagaactccaaatcagatggttcggttggactcttttgaccatttggctgttaacagtaatctgcatgactcgagagttttggcgtatcacaaacagcggaagaagaggcggaggaaagcaatcggaagaggaacaaaatgatggaagaggaaggaaatcaggaaatgatgaagaggaagaacaggagaggaaggaagaggaagaacaggagaggagggagaggaagggaatagaggaagaatgaaagaggaggaagaggaagaacaggagaggaatgaagaggaagaacaggagaggagggagaggaagggaatagaggaagaatgaaagaggaggaagaggaagaacaggagag

SEQ ID NO: 94273 - DNA, 451 bp, Heterodera glycines
  SCN-specific regions: Sequence locations=1-46,72-93,115-451
ttctgctcaaacgattctcagaatgtatcttctcattctacaaaccaaattgaaattgaagcaaagaaaacggagcacggttctgctggtctctcaattctagaaattctacttttgtggctttctcgtttctctgttctcgaaatcgtactttgggcgcttgtccctgtcgttatttgcgtttttgttgttgtttgtgcctgtgtgatttcaagaagaaggccgagtttgcgaaacgaattgttgcgattgatcgaccttggacaccaaattcaggttgttgatgaaaatatctatcgttggaaggtgaaaataccgggaccgccaacatcgctttattttgccgaagaattattgagagaacgaacggacagatagccaaagacgcattgataattaggagaagcacggaataattaattgttagtcaattatttaactatatttcttc

SEQ ID NO: 94274 - DNA, 71 bp, Heterodera glycines
  SCN-specific regions: Sequence locations=1-5,30-71
caaaattttttctaattgttttatttttttgatttcgcttaaacttcttctctataaaaaaaaaaaaaaaa

SEQ ID NO: 94275 - DNA, 51 bp, Heterodera glycines
  SCN-specific regions: Sequence locations=1-51
cttctgtatcaaacgaatattacagatgattgaaaaaaaaaaaaaaaagta

SEQ ID NO: 94276 - DNA, 554 bp, Heterodera glycines
  SCN-specific regions: Sequence locations=1-48,89-89,114-204,241 -367,393-554
ttcattgcataaaataaaagaagaaatgcgggagaatttgcatttcatttccaaaaatcattttaaaaatatcattttttgtgcatttccgtttaattaccctttaaattttttccatcggttcgatttgtttgaagtgcgcggccaaagagtggcggcgcacttaacaatggcaattatcgatttgcggaacgaatttaatggaattaaatatttcattttaaaaacaaaataatttttggtttttaaaaaacaatttaccagaatgattgacaggtggcaaaagaatgagtaatgagaggaaaaaagctttaattgtgtccgtcgctgtcgtctcaatggcctcgcttttgctttgactgcttttaattctctgtttttccattttcaaaactgctgaacagcaacagcaacccgacgaaaaggaccatcgacaattgctttttgttcaggcaatttggcggcatggcgacagagcgcctggcaaattgccttaccccggtgaccaatactacgataaatattggccacgtggatggggtcaattgacaaat

SEQ ID NO: 94277 - DNA, 74 bp, Heterodera glycines
  misc_feature (69)..(69): n is a, c, g, or t
  SCN-specific regions: Sequence locations=1-74
ccgtgtccatcgattgaccactccatcagcgagcaatctgatgattttcttgaaaaaaacagttatacnaaaaa

SEQ ID NO: 94278 - DNA, 466 bp, Heterodera glycines
  SCN-specific regions: Sequence locations=1-466
ggagacttaggaagagatctcaataaagaccccgcacgcttagtagtaagcgagcgaaaatcgctagttggcacagttttgagccctaacacttcaatggatgaatcaaacaaccaggaaaaactcattctacacataaaaaagaacacaaatccgactccaattccaatagaccttattccatacatgcattttagaatagaagatcttgtaaaagtaacctgcgccccagaagttgatgctaacaaggtaataaggcttatctatcaaggtaagcagctgaaagatgacgatcgagtcaaagacattaaattcaagccagagacagtaatgcatatctttatcagtgaaccagttcagaaagatgtaaatataactacaataagtgctgagctctatgagcctgagagaagaggttttgataaattcaggccattggacttgatggaagaagaaattattttgt

SEQ ID NO: 94279 - DNA, 447 bp, Heterodera glycines
  SCN-specific regions: Sequence locations=1-166,189-253,277-408,430-447
ctccgttgatgcccaactgacgaacaaaacggagcagttcaatgaagtcgaaatgcacccaaagtttggggggcacaaaattcccttcggacgttagcatcggataaccgtccggtcacatcttaaaattccaatgttcaaccaacccgaacattccctgggcttttcgctgtgtctttttgtttctgctggacaccgttttggacaaggaacatcgaatgaggaaatgacaaatccgctttggctgtaaaagaaatgaaatatttcatgaaattccatccccaattttatggtacaaccgccaagtttccgttgctgcaaattggcgagttgcgattggcacacggattcactgttccgcaatgtttccaatttgatgctcacatctaattgtgaggcaattattggcagaaatatgtaaattattttgggtccgataaaacccct

SEQ ID NO: 94280 - DNA, 84 bp, Heterodera glycines
  SCN-specific regions: Sequence locations=1-84
cggagaaatggcgaatttttgaagcgacgatttttttaattgttgtaaaaaactcttgataaaacacatataaatgctcaaaaa

SEQ ID NO: 94281 - DNA, 394 bp, Heterodera glycines
  misc_feature (372)..(374): n is a, c, g, or t
  misc_feature (378)..(378): n is a, c, g, or t
  misc_feature (380)..(381): n is a, c, g, or t
  misc_feature (385)..(394): n is a, c, g, or t
  SCN-specific regions: Sequence locations=1-334,357-394
gataaatttgaggttggattagacgtgcaattttttgctccacaagaaattgaggtcaaagtgtcgggccaagatgtgatcattcattgtctccacgaaattcgcaaagatcagcacggaagtgttaagcgcgaaattcaccgtcaataccgactgccaaatgacgtcgacgcggcaacattgaaatctcatctgtccacccgtggcgtgcttacattgacagcctcgaaaaaggactaactgagaaggaaaattgagtgaatttgatgggaaattaggacggaaattttgctcatcttgtgagctgctgttgaaataaattgaaacaaattgctaaaattaaaataaaataaaatgctccaaccaaaaaannnaaanannaaannnnnnnnnn

SEQ ID NO: 94282 - DNA, 55 bp, Heterodera glycines
  SCN-specific regions: Sequence locations=1-55
tataattatattaaagtgtaaaatgtgacaaataaatgacaattggaaaaaaaaa

SEQ ID NO: 94283 - DNA, 68 bp, Heterodera glycines
  SCN-specific regions: Sequence locations=1-68
aaaatcttttttaatggtttttgctgatgactctatatttactcctgtttttgtgtatgaatgttcgg

SEQ ID NO: 94284 - DNA, 140 bp, Heterodera glycines
  SCN-specific regions: Sequence locations=1-71,118-140
aaattgaaaataaaaattgaaacaaacaaaaaagaaggataaaacaaaaatgtgaaagcatggcgatgatgggagaagagaaaggaagaaaatgaaaaatgggatagataatacaaataatgcaacggaatggataaaaa

SEQ ID NO: 94285 - DNA, 218 bp, Heterodera glycines
  SCN-specific regions: Sequence locations=1-218
tctgactgcccttttgttggtcggtttttccaaggatttgaacatgagtggtgagtttgggttgggaatgcccgtctttttccgtttgtcgtctgcaaatacaaaccatcgtcgactctgatcatcatcaaacatttccccgtaaactattaatgttcgttgttttccgaatatttgtcctgcttttatcagaaataaattataattgcttcctaaaa

SEQ ID NO: 94286 - DNA, 439 bp, Heterodera glycines
  SCN-specific regions: Sequence locations=1-79,101-176,426-439
aagccggcggattcagcggacgattcgctgtggagccgataccatgatcaaaatgcaatggaagagttgttgacctgttttattttctgaaatatttctacggaaaatgcgcgtttggtcgaagaatgtgctcatatgtacatctccgaagacagaaaagatgctcaatttccgtcttatttaaaattttaaaaaaattataaaattattatggaaaaaaacatttttttagatagattaaatttttaatttataattgcttcttcttaacatacgattcatctttttaaaatattttaattaacagttatttatttgtaataaatattaatctctgaataaattaaaaaaaagccttaattcatttactgataaaatttaatatcatttaagaaaataaaatatttttataaaaataattaattctatgaatctttca

SEQ ID NO: 94287 - DNA, 493 bp, Heterodera glycines
  SCN-specific regions: Sequence locations=1-361,383-493
cagatagttgagcatctaacaaaaagcaaaatccatttagaaaggctgcaataagtatagtatatgcacacccctacaaaaaaattaaaaatttttagtcgaaaataataggaaaaaataaaataaaaacctctttttaaaccaaaagttaataaaattcttaataaaatttacagtgtttttccctaaaagtgacaaacgtaccgcatatttttggttgatgaccaaacgctgtaaaaaaatgcacaacaatttggacgtgtccttcactgtgtcagaaatttggttggtttgtccatcggcaacataaaaacgcgaataatactcgtggattgggtgcagcacagtcagaatgtcaacctaaaaagaaaacttttgtttacaaaaaaaaactatttaataaactttttcaatcctggtcggctcaacaattgcgtcagtgaatttggtgagacatttgcggaccaacgatgacaattgaccgccaggatca

SEQ ID NO: 94288 - DNA, 132 bp, Heterodera glycines
  SCN-specific regions: Sequence locations=1-132
tatgggttgaccaggcaaattcgaatggactgattgagaaagaagcgatcagaaagtgatcgaagagtgatcgatcagaatcgattgacacaatgataaagctggacagatggtaaaaaaaaaaaaaaaaaa

SEQ ID NO: 94289 - DNA, 253 bp, Heterodera glycines
  misc_feature (230)..(230): n is a, c, g, or t
  misc_feature (237)..(243): n is a, c, g, or t
  misc_feature (245)..(248): n is a, c, g, or t
  SCN-specific regions: Sequence locations=1-14,36-253
ccagagaatatggtagacagacagagaagaggaaggacgagagatacgcttctggtggagaaccaacgcggaggagtgggagaaagacacgggaaaagtgaaggccatagcaaacaaaaagaatgatgaattgatgacaacaccgtcactttcaaacataaaatggaaggaaaaacaaagagcaacgattcatcctattctcttatttatcacagcgattaaagcgaacnattaccnnnnnnnannnnaaaaa

SEQ ID NO: 94290 - DNA, 445 bp, Heterodera glycines
  SCN-specific regions: Sequence locations=1-445
gacggattaccgattctgaggacagagagggagacaaatgcaaatggttgtccgagtcactggccaaagtcactgcgcaatggctgagtgccatgcgaccggcactttttggggacaaagctatggacacgaaggctctccatttgctcatccgtctgaatgcgcgcaaaataaaagtaggccaacgctgctcaaaattggacagtgaactgaatttggcaccccaagagcctaaatacctttacagagctggtcgaccttctgaccattttattcttctcatcgaaggaaatgctgtcgcccatttcccgaagaatcagatgaaatttgacgttggagcatgggaatgtttcggtactgaaattctcgaccaaatggaggcacagatggttaacaattatcagatggacaaaaacatcgggaaaatgcaccaccaaaagacagt

SEQ ID NO: 94291 - DNA, 439 bp, Heterodera glycines
  SCN-specific regions: Sequence locations=1-53,89-131,189-439
tccacatatactcgtcacaataacttagcaataattctcggcttgtcccggatattgctttgaacttcatttttaagttcttccaaaagcattcaacgtgatttgtgtgggcgcctatgatcgtgttatactaaaaatacaaaataaaaatgaaaacaaaaaaataaaaaaaagacaaatgcaaaaatgcttttcgacatctacatttatcgggccaggacgttttcgcgtggccattttcgcgtggccgttttcgcgtggttgcatataaaagagaattcataactcacatttatttcatgaacgctgcgcatgtggaatgtcagcgacttgtaactggactcaagcgacgtgctgctgagacgtgctaagcacctgcgactattcgtgctcaagtggtgcaaaacacatgcacacctgtactagcagcttttccgag

SEQ ID NO: 94292 - DNA, 206 bp, Heterodera glycines
  SCN-specific regions: Sequence locations=1-206
ggggagaaggacaaaagtagaggatgaagatgagaagagatggatgagctacagattctaaagtgcaaaattgggtaacaaatttaggcgaataaaactgatttgtgagtggctttagaggagggaggaaaggctcttttaaggggaaaaaggaacacaaaaaaaaaacagaggggagagaaacatggaaaaaagaaagagaaaaa

SEQ ID NO: 94293 - DNA, 553 bp, Heterodera glycines
  SCN-specific regions: Sequence locations=1-473,524-553
caggcttgaacgtgatggaaaattggcagacgctcatgccaagtttggccaattgttggcactgtgccccgaccaccagggcgcgctggacggcatcgcacggttggacaagaatgatgacaacatcggcggcacagacattgaactcgtcgagctgagcgacgacgaacacacggaccatgatgacgacaatggcagctgttgcgtcaacgattggatcgcattcacaggcctcgacacgacctccgccgaactgtccgtgttggagtccatcttcaaattgggagacgcggcaccgagcgcaatttccaccgatttgcgcgacactttgatagaatcgatgctttgaatgacaaatttcaaaacgaaggcggtggaggacagacacaaaaacgctgacattttttccgaaatttggagtcagagaacgtagatgatcttagagcgtcatgcgagcgaatgtcggctgagttggaacaggaaaagaaggagaaggaggaagaaaagaagcaaaaggaggaggcaaaagcccgtgttgccgagttggagaatg

SEQ ID NO: 94294 - DNA, 479 bp, Heterodera glycines
  SCN-specific regions: Sequence locations=1-158,183-389,411-479
aaccgcacaacggcacaagcagcaacatgggcaatggaacagcaatgcttcaggggaatttcgaagtaattggcagtgccggcggaattgcgcactttgcgagcagtgccggcggagagtcgaactgctcgagcagttcaagttcagtggttgtgcacaagggaaagaaaagcaaaaaggacaagccggcacagcgagtgcggacagtgcttaacgagaatcagctgaggatactgaagcagacataccaagggaaccaaaggccggacacgaacaccaaagagcagttggtgaagatgaccggactaaacgcgcgagtgatccgcgtttggtttcagaacaaacgctgcaaggacaaaaaggttttcagaaggcaaattgaacagcgcgagaagcagcaaagtcaggaaaaggaccaaacgattcgcagtgttcgcgccgtgggcgtcggtccgatgatcgcccggttcgccgggccc

SEQ ID NO: 94295 - DNA, 485 bp, Heterodera glycines
  SCN-specific regions: Sequence locations=1-452,475-485
cgtaaaggttgtccgtgaatatgaaagagctgtcattttccgattgggccgtttattgcccggcggagcccgcggcccgggcatttttatcgtaattccatgcattgacacctaccgaaaagttgacctgcgagtgctttcatttgacgtgccaccccaagagattctctctcgcgatgctgtcaccgtagcagtggatgttgttgtctattttcgtatttcaaatgcgaccatttcggtaaccaatgtggaggattcaagtcgatccacaaaattgttggcccaaaccacgctaaggaacattttgggcacaaaaacattggccgaaatgttaagcgaccgcgaacaaatctcgctgcaaatgcaaagcacactggacgaaataacaaagtcggaaatataattcaaggattgggatatatttcagatggactccataaaaatagcaattcttaatttaatttatttttaaatgcctccctaac

SEQ ID NO: 94296 - DNA, 495 bp, Heterodera glycines
  SCN-specific regions: Sequence locations=1-495
aacaagggcacaacatttgtctagcgcaatctttcgccaaaaacatgggtctttacggtgagcgtgtcggtgcgtacaccgtcgtctgtaaggaccaggaagaagcaacccgagtgatgtctcaactgaaaattttggttcgtgcaatgatttctaacccgcccattcacggcgctcggattgcctccaaaattttgtcggactccaaattgcgtcagcaatggctcgccgatgtgaagggaatggccgaccgaatcatttcaatgcgtacccaactcagagaacaactggccaaagctggttctaagcgaaattgggatcacattgtcaaccaaattggcatgttttgcttcaccggaatcactcccgaacaggtcgatcggctatccaaagaatttagcatttatttaacccgcgacggacgcatttcaatggctggaatcacatcaaaaaatattgaatatattgctaatgctttgcacgaagtgacgaaat

SEQ ID NO: 94297 - DNA, 529 bp, Heterodera glycines
  SCN-specific regions: Sequence locations=1-293,315-529
cctcgaactcgcgtcggctcagcagtccatcgtcgtccaaatctgttaggtcaaagatgttttggcagcgaaacggggatttcgacaatcatttaaaatgtagcaaatgcagcatatttattcccgactatttccaaacccaccgaacatgtcaaacagattcatgagcatgcatttgaacggtttgtgctcggcagaaacggactctggtcaaatggtttccggccggcaccgacacccaatccgtggtgcatttctgtgatcagccgacggtcacaatatttatcattttaatgatgctgccttccactcactccgttttcctttcgccgcgccaccgcgtggacgcgcgcgttcgactccaattcggaggacatgagaatgccgaggacggagttgtggaagcggctcagagagtgatcgactgaccagcccgggggagggacggacaattgggcacggcacccgacaaaacaacaactcactggcttcgttgacgcaaatggacagacgcatttgcggggccttt

SEQ ID NO: 94298 - DNA, 473 bp, Heterodera glycines
  SCN-specific regions: Sequence locations=1-14,36-37,62-310,332-473
attatctgttccaacaggacaaaccatatgatgtcagctacgataccggggacaaggcgatgcaatgtgggcgacacaacgacattttcaagttgtggcttatgtggcgttccaaagggatggaaggttatcgacgtcaaattaaccaacttatggaccttgccaaatattttactgataaaatcaaacgcactgaaggctttgaaatggtgctggacgaacccgaattcttaaacatttgcttctggtacattccgccaagcttacgtaaacaaattgacaacaaagaaaagatggcgcgtttggagaaggtggcaccaaaaatcaaagctcgaatgatggagcgtggcacaacaatggttggctaccaacctgacaaacaacgtccgaacttcttccgaatgatcatctcaaacccggcaatccgagagatcgatttggactttttgatcaacgaaattgtcacactgggg

SEQ ID NO: 94299 - DNA, 588 bp, Heterodera glycines
  SCN-specific regions: Sequence locations=1-2,26-214,236-588
tcttttatttaccttttttcttacattttgtacatattctgatgaggctttaagaataattcgctttttcagcagtgctttcttattcttaatattattagctgcttttttttctcaacatttattcacttcaaatgttttggtttcgtttttcccattttcttttctttttgacctttttctcttttttcttttacattttcggcgcttcaccgaataaaatgtgagttcagttgtcagttctgttcttgccgaactcagtgattcttcagtcaagcaacgcctgtcgatgccaaaaaaatggttgagagcagaataaaatgttacgtgtgcaattccgggacgaaagggcaagccgactgcactgaggacgaccacgacaagttgaagacgttcatcaaacaatgcaatccgttaacttttgggacttttgccggagagaagcgaaggcgtgccgaaaagtgcgccaaacgggtggaggacgagacgaccatcgtgagggaatgcgcttacacgggcgaggagttggacggaaagcgacggaccggcacaaaggggtcacagtgctcatcgaacagtgcatcaacg

SEQ ID NO: 94300 - DNA, 543 bp, Heterodera glycines
  SCN-specific regions: Sequence locations=1-359,382-543
ggcaaagcggtgattattcattcgaataagtgccgtatttttcaacaaattggcttcaattagtcaacaaattttgttgttggtataagtgttcgttttttgtgctgtcctttctccaacttcgtaccgacaccgcctcagggctcttcagagaatttcggtgccaattcgagaaaaatctcggcttttcgagttttatttcggtaaattttcccttccccatgggtcatttatttatttattgactcggtttatgccaagaatatcacattggctaattattctctctcgacctttagattggctgtccatcacttacccaatgggtaatttgtcgtcaagtttgcgtcgctcaatgccatcagtgaattcgtccgccgatggcaccggtgccggtgccgaacacctcgtccagcgggtgggcaccgcccggcatagcagcttctccacggaggatggcgccgccatgtgccaaaaagagaagcaacaaaattcagttggcattgccgactccgaaacaaagtgcgagcaattaacgttgat

SEQ ID NO: 94301 - DNA, 466 bp, Heterodera glycines
  SCN-specific regions: Sequence locations=1-466
ttttaattagtgatgtacgtccgagagttggaatctccagatgagcactccctggttttattcaatccgcttcgttcttgctttcgtcctactagagatgaattgttttcggcaattgcctgtcagcgacgctctatcgcccgtctggacactgaaagggcccgattccgtcgtttgaacggagctcagttccgtgtggttgtgcgattgtcaggaggcttcttgccaaactttgctgctgttatgccacagcaacagaacgtggtcaatgtgactgcggttatcgccaatgccaatcccaatggacagaattataaccgccttcagcgtttgcacgctgatttgacggagaccatcgcccgtttaactgtagaaatttctcagttgggatatatgtatgagcaattgacggaacaacttgaacatctcacggaagtgcctccgaatccgaattttaatccggctt

SEQ ID NO: 94302 - DNA, 100 bp, Heterodera glycines
  SCN-specific regions: Sequence locations=1-55,96-100
tgacggaagaagtctttgaggtggattgaatccggtgatcttttcattccccaattttgtgttatatgttggttttaaaaaccagtgttgttattaaaaa

SEQ ID NO: 94303 - DNA, 469 bp, Heterodera glycines
  SCN-specific regions: Sequence locations=1-469
attcttcaaattctcaaaattcgcccttcgccaatgtttccaaacacaaattccttgtcaaattctccccattcggattctttcaatagaaattcaacctcaaaaaggtgggaggaaacaattgcttgggtcactcacggaaagcgattgtcacggcgaattctaaatccgtcaaaggatttttcggacggagcgcttgttgcggagattatcgctcaacatttgcctcgttatgtgttatctttgaattcttttccccaagttcattcgttggctttgaagaaatacaattgggagactttggaaaggaccgttttacgccatttgggcatccatatctccacagagcatatcgaatctttggcaaatgccgaagagggaaccatccaaaatttccttcccattcttcgatcccaaattgacgatgccatttccaaacggcactttcgaccctcttccaccagcagca

SEQ ID NO: 94304 - DNA, 454 bp, Heterodera glycines
  SCN-specific regions: Sequence locations=1-207,229-454
gatgcgcaagaaggagcacaaggttcaaatcgatgacaaacacaaagaaccgtttagttttcttgcttcaattggtcgggtttatacaagtgatcacgaggaaatgccggttcttcggaacgcccttcccttggaaccaacttttctactagtcagtatgaaacggcggatgttggtgttggaaatcagaaaagcatttgtttttttgttaatgctgatactcccactattcgttcgtatatgtcttcgtttcggagacatcaaaaagaggagactttgcgcaaggaatgggggaaaaagcgagagtcaattgttaagttttataaaaaagaaaggaagtctgcactccgatatttaaagaaacgggcacaagaaaagcgataattttatcagaccgatttttgtccgtgtacatgttccatgcgaggtttaagaagccacgactaaattttaa

SEQ ID NO: 94305 - DNA, 147 bp, Heterodera glycines
  SCN-specific regions: Sequence locations=1-147
aggcgactctttcataggaaggattggattattaatccgctttgcgcggagagtgaactgactgatcgacacgcgatgctccgattttatcaccccacccattcattttcggttattttcgccagtgcggtctctttcccttaaaaa

SEQ ID NO: 94306 - DNA, 511 bp, Heterodera glycines
  misc_feature (454)..(454): n is a, c, g, or t
  SCN-specific regions: Sequence locations=1-511
gtccgctttaatcctccaatccgtccgtctccattcatttccaaattattcaaatcctacaataacaatacataaaaaatggagcattttccttctaaatttgttctctgcttgctcattgcattcatcgccgttccatgctctgttttggcactttctgctggcagccgcgtgtcgatgctcgcgtgccacaacaattaccgctcacaactggcaaaaggcactgcggacaacaaatcggtctacaaaaaaggtgccgcgtgcagcaagtgttcggattacaatggggcgacctgtgacagcgccagcggactgtgcaaattgccataagtgaggggagaatgcttggaagaaggattttttaatttgatttatgaatattgtagaatgggagtgaataaatgggcattaattattaaatcagggcttttcatttgaaataatgttaaatggnttattttcattattatattataaataacaaaaaacggcgcataaattttggaaaatt

SEQ ID NO: 94307 - DNA, 72 bp, Heterodera glycines
  misc_feature (9)..(9): n is a, c, g, or t
  misc_feature (19)..(19): n is a, c, g, or t
  misc_feature (23)..(23): n is a, c, g, or t
  SCN-specific regions: Sequence locations=1-39,62-72
aaaaaaccntttcccaaancccnttttaaaattttaaaaggggggggggggggggggggggttttttttccc

SEQ ID NO: 94308 - DNA, 165 bp, Heterodera glycines
  SCN-specific regions: Sequence locations=1-165
aatacaacaaaaagaattggtgaataatgatgatgcttatatgtatatataaatacagataataatgctaaaattcgaatatttcataagggcgaaaggcgccctgagtgagtgatggtattgtggcgcggtgatcagcagaaagaaatcttagagaagagagca

SEQ ID NO: 94309 - DNA, 468 bp, Heterodera glycines
  SCN-specific regions: Sequence locations=1-2,25-468
caaagccaaagggaaagagaaaagccaaatccaaacaaaaagtaaacttccaatccaaggaccttgtgaaaagccatctcatctacgcagttcgtgatgagattgaactgttacgtgcgcgaattgtccatttggaggcgacggttgatgggaaagggggggggcaatagttaaataatgggttggttgccgaccgtaggggttgggtcggggtcatcaaggtcggggttgaccaaatcgttcagggtcgggttcgaggttttaattttttttttttctttttccgtatttttttttaaattttcttacttcaaaatttaaactcttaaccatcaaaaattttgaccacttaaaatgtttttttcaagatttaaatgtttcctacatcaatattccacggaagtacaaaacttttcgttttgttttttggggttttcgatttgttgcttcatcgactccgaaataata

SEQ ID NO: 94310 - DNA, 249 bp, Heterodera glycines
  misc_feature (203)..(203): n is a, c, g, or t
  misc_feature (207)..(207): n is a, c, g, or t
  SCN-specific regions: Sequence locations=1-74,96-205
cttgaccattgataaaagaataggctggagaatttggcacatgacagataaaaacgaatataccaaaatataataaaatttctatttatttcccacataattccccatcggtttgcttgttatgtttgtcgttctattctctctttttccccaaattcgcttaaatggaagatttataagaaacttaataaaggattgattcnttanaaaaaaaaaaaaaaaaaaaaaaaaaaaaaaaaaaaaaaaaaa

SEQ ID NO: 94311 - DNA, 166 bp, Heterodera glycines
  SCN-specific regions: Sequence locations=1-6,28-166
tgagaaggaagggaaaaacgttttgggaggggcaaaacgtttgctgaacaggcacagcatttgctcgactttctcctcagaattcgccattttccgttcatcgacgacgaaagttccgaaggatttccatttaaaaagaaatcgaaggacgaaacgaaaaaaaaaa

SEQ ID NO: 94312 - DNA, 436 bp, Heterodera glycines
  SCN-specific regions: Sequence locations=1-436
agtcaatcaactccattaacaaattcctttataaatgtctttcggagcagcagatagtggcgatttcgacgattatgacaaaaacggagcggatgagaaggaatttcggtggccacccgagttttgcagtgattcattatgcatccaaccaaatgctaccgccccgggcggcgcttcttttgtgcttttgccgctgctcacccattgtctgcaagacgaggccctctcccaaattctgccgcttttcctcctcgtcactttgcccattttgtgggtccaattgtccgctgcacggcgtgaacagcgcgaaacgcactgcgaccgttccctgccgcgtggcattctgatcaaaatgagaaaaggtatcacaattatgttgtttgttctgaagtctctgttgctggtgagaaattgctacggttggctttgggggaac

SEQ ID NO: 94313 - DNA, 506 bp, Heterodera glycines
  SCN-specific regions: Sequence locations=1-506
tttggcaccaattaccaccgtttttccatgtgaacgaatttcatttcctttcagaaaaggagttaccaggggtaaaatgtaattttcacccatccaccattcttgtggacttgtgattttggccaaattaaggtaaaggagttggttaagcataattcgacctggactgatttcggttaattgccgggcatagatggtttgggggcgaagcatttgcgcagaaatgacggtggctgatctgaaatccccacctctgtatcgttttaagtcggttacaaaaccgggttgaaatgaaccaataaccaattttatcacctccacctttatggcaacagcttgaacgttgatcctgccttgtacgaaccacgagcgcaacgaatcgaccgggtttaagtcataggacaatctttcaaatccctccttccactcaaacttactgaccacaactgtgtctcccatttgaaggcgtctctcggcacttaccaaagtatcaggaattcccataa

SEQ ID NO: 94314 - DNA, 259 bp, Heterodera glycines
  SCN-specific regions: Sequence locations=1-259
tttcctatacaccttgaaagctctcctagtgtgtatcaacaatgaagatcgcctccggatgatttcaatgacagatgtgggatatgtgggactggtgctggagcgtctcataaagggagtcctcggcatcgaatccactgctccattatcacgagacgaccgtcgcgcctgagtgaccttctgtactaccacctggataacaactgatcgctctactgtgcatatcccactacccaatatctgggcaaacccgacttac

SEQ ID NO: 94315 - DNA, 101 bp, Heterodera glycines; identical to SEQ ID NO: 84621
  SCN-specific regions: Sequence locations=1-71,93-101

SEQ ID NO: 94316 - DNA, 484 bp, Heterodera glycines
  SCN-specific regions: Sequence locations=1-61,83-484
ccttcacttattacctaaatgtcgcacggtaaaattcgaatttgcctgaaaagaaccttaaattcaacaacttttttaacaacgacagaacaaagccaaaacaaaatagcaaaaggagacagtgaagtgtttggagaaggaatggacaatgaacagcagaagaaaacgcatagagaaagaagcaaaagccagtaaagtgccgaatgtttggttatgtgccctttgcatcattcagcaacgattggtccgcccaattctctcctccgtttgctttgcccacccaaccgaaaagtcgtccctcgtcctccaattctcccccctcggcagcagaagaagatgaaaatccgctgccagccgcgttcagaattggcaatgagtcggagagcagtgacgagagcggcgcggaaaggtcggaacacgaggaggaagtgatcagacgaagcaaacagatcaggaatcgagaacgatgggaactgctcaagta

SEQ ID NO: 94317 - DNA, 394 bp, Heterodera glycines
  SCN-specific regions: Sequence locations=1-71,93-241,263-394
atcggcgtcgactgtcagtgccgcttcttctcgcgcttcggcctctttgatgcgttcggccagtgccgtgccgtccgccggcagcggcggcgaagcgacacgggccatcacgtcaagatcacccgcaccagcagcagcatcggcacagaggtcgagaacggtggtggacagaaacgcgagtccggcggcgatgccattgcagacttctgcatccctaacttcgttgaccagaaaccgcacaccaacacggaacagtaccaatgcacgaagaccgtacggtctaatgcgtgtgcaaagttcgagcaatgcggtggaacgtaaaccggcacaaatgtccatcaaagtgatcagtcttacatgattaaacagaaatctgcatgatcacaaaaaattc

SEQ ID NO: 94318 - DNA, 281 bp, Heterodera glycines
  SCN-specific regions: Sequence locations=1-27,49-74,118-199,222 -225,254-281
tccttattttttgtggccttttaaatctcattgcccaattctttctctgaatgattttataggcttgtgaggacttatttttagtttttttaatttctattcattatttttatcttttaacattccttcccatttaaaagtgcaatattttttcattttcattaattgtgattgttggaaaatgtgttaagttggagagataattttgttaattcaattttgctcattatttatctttaaatttaaaaaataacagaatggcataaaaatgcgtatttgtc

SEQ ID NO: 94319 - DNA, 90 bp, Heterodera glycines; identical to SEQ ID NO: 61246
  SCN-specific regions: Sequence locations=1-90

SEQ ID NO: 94320 - DNA, 380 bp, Heterodera glycines
  SCN-specific regions: Sequence locations=1-195,217-243,265-291,313-380
cccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctcagaaggatgccgaggctaaagccaagaaagacgcagaagagaaggctaaaacggatgccgaggctaaagccaa

SEQ ID NO: 94321 - DNA, 438 bp, Heterodera glycines
  SCN-specific regions: Sequence locations=1-164,186-438
tgtgaggaggacggaataaaagtgcctttccatttgcacccattcaccatcaaagacttggacattctgtcgatggcctcacgtctccgaacgtgtcctcagcttaaagaaattcgatatctgcacccggacttcgacaaagaagaaatgcttgcctacttcgaaagtgaggagcagcggctgcgagcgaacgaatcaacgacgggatatatagaatcggagattgtgatggtggccaaaacgacgggaagcaaattgtgctcggcacttgggagcgattcgccttcgccaatgtccaaccaatggtcgccgggggacattcagcagggcaattccatggaaataagcgacgaaatcgtgtcgatgctcagccaaaatcatttagaggcgcccaacgtggagagtcttctcggcggcttacaaatcggacaacgaatg

SEQ ID NO: 94322 - DNA, 478 bp, Heterodera glycines
  SCN-specific regions: Sequence locations=1-250,272-478
caaggagaattacgtccagatggaatcaaaggacgaagcggtcttccagcagctgaagggcgatgcccagttgggaggcacctactatccgctccagggcatgaccaacgacgtccaaaatcagctgattgccgaccacttcttgtttaaagagggcgaccgttttctgcaggaggccaatgcttgccggtattggcccaccggactcggaattttccataacgccaagaaaacctttttggtgtgtgtcaacgaggaagatcacctccgtatcatgtctatgcaaaatggctgcaatgttggacaagcgctggagcgtctcataaacggagcctaggacatcggatcgacaagtccgttatcacgtgacgaccggcttggctggctgactttctgttctacccacatggggacgactgatcgcgcgaaggggcatattcgactttcgaagatcagcgcaaaacccgacttcaagtca

SEQ ID NO: 94323 - DNA, 186 bp, Heterodera glycines
  misc_feature (181)..(181): n is a, c, g, or t
  SCN-specific regions: Sequence locations=1-186
cgagttagccaagcggaaaccggtccaaatgatccgccaaaaagtgcggggacgaaaccgccagcgatccttccgagaccgacagaaatcgctgagggcatatttgctacgtcaacaggggaaaaaagtaaaatgattttgttgttattttttttctttcgaataatgggaaagtgattanaaaaa

SEQ ID NO: 94324 - DNA, 240 bp, Heterodera glycines
  misc_feature (41)..(41): n is a, c, g, or t
  misc_feature (44)..(44): n is a, c, g, or t
  misc_feature (47)..(55): n is a, c, g, or t
  misc_feature (57)..(64): n is a, c, g, or t
  misc_feature (74)..(74): n is a, c, g, or t
  SCN-specific regions: Sequence locations=1-86,108-120,184-240
aaatgatgatgccgaagaagtcgaggaggggggaagaaggnagnggnnnnnnnnngnnnnnnnnattacagganaaacaaggcaagcaagaaaaccaaacccccacccgggccatttgggaattttaaaaattaaaaaaatttatttttaaaacctttttaatggttttttaaaaaaatttttgggaataaaaattttaagcttaattggaaaaaaattttttttggcccagggtttaaa

SEQ ID NO: 94325 - DNA, 554 bp, Heterodera glycines
  SCN-specific regions: Sequence locations=1-554
tggttttaagggttggataatttggggtttattgcatttttcttcggctgggcgatatccctgaaattcacacaaaacccattttaggcattgaggctgaagtctcttccgactccgaaggtgcttccgttgcgctacagaagacagaaacggtggatgccattgtgtcccaaactgattgtgagctttacgaatgggaaacgacgcccttttgccagggggccgaggcgcgactgttcgcgtgcactttcctccgtcgtcgggcagtgatgaaagagcggtttgtgaagcggtacagacacgcggaattggacgcgcggctggcgaaggagaggacgcgggccgaactgaaggccatcctcaaatgccaagagattggcattcgcgtgccatccgttttcttcgtggacccgctcaaaaatcggataattttcgaactaatttgctcgtctggcagcagcgacagagcaccgaccgcaaaacattttctggacaaattgcagcgggacgaatcggcgtcgaacaatggcgaacaatttgcagctcaattggcg

SEQ ID NO: 94326 - DNA, 417 bp, Heterodera glycines
  SCN-specific regions: Sequence locations=1-417
tcggacagcgatttgtggggtcgaaaatgagctgaaagaatacaaaatgttgctgaacaaatttaacagtggcgctactcgtgcgcaacttttcaatgaacacgcttttcgtcgtgtcgtttaccttaacaatttaactcctcgggccatttgcccttcgatatttaacgttgtattcaatgccgaatatgtcgccgggaataggaaaattgctcgcgctcagatcattcattttgttattcgtgaggttctggcattgacgagaaatgcttgcgtcgacatcgatatttatttggatactttgttggattatttgtcttctaaaatcaaccgaacggaaattgtgattttccttaaacagcgcggcattcaaaacccgcatcattttttgataactcaacccatttcgcttcgacg

SEQ ID NO: 94327 - DNA, 484 bp, Heterodera glycines; identical to SEQ ID NO: 85131
  SCN-specific regions: Sequence locations=1-188,219-302,338-341,367 -402,424-434,476-484

SEQ ID NO: 94328 - DNA, 233 bp, Heterodera glycines
  SCN-specific regions: Sequence locations=1-233
ataagcatccatgagcaagtgatggagaacacgaaacgaatgacctttcgctcgcaacaagtggctttacaattggagaaaattcgaattgatagccgaaagggggccacgtggaaaaaaggcgagcgggaaattgtgtgagaagtgtaaaaagaaagggagatgctcttattgtccattttgtgtttcatttgtatttgttttgttgaatgaataatggacttgcttctttc

SEQ ID NO: 94329 - DNA, 410 bp, Heterodera glycines
  SCN-specific regions: Sequence locations=1-410
atagttttgtcaaaaatccgcaatattggattcatattgcggctaatgaacaaaatagaagcgaatttatggtgatatcgctcttacaaaaatacagaagagaagagcgacgggtcaaattgcaaatcggattctctgtttttcgtgtgtatgaatcatcagaatttttgaaggccgagaattttccattgccggtatatgctgaaactccggctttttcgagagtaagagaggcaacacatcattttcaacttgaagctggaaattatgtgattataccatcaacgtttggaagaaatgaagaaggggagtttttattgcgcatttttacgacagggactattggaatgtacaactcaactcctaagaatttgtgccctgagcaacgctataattttggtgttcgggaa

SEQ ID NO: 94330 - DNA, 394 bp, Heterodera glycines
  misc_feature (393)..(393): n is a, c, g, or t
  SCN-specific regions: Sequence locations=1-394
cgtcgaaatcactgagcgtgcgatggcacacagcggtaccgccgaggtgctcatcgtcggcggggtcggctgcaacgagcgactgcaacaaatgatggacacaatggcgcaggaacggggcgccaaactgttcgccaccgacgaacgcttttgcattgacaacggcgcaatgattgcgcaggccggctgggaaatgtatcgtgccggactcagagcatcgcttgaccagtgcacttacacacaacgttaccgcactaatcaggtgaatgtgtgttggaggaaatgatattttattactgcttttttgatgttttttaccaaattttccgtcacagattttttgtcttttttgttgttgtttttctcctttgaattaaacaattatataagaana

SEQ ID NO: 94331 - DNA, 525 bp, Heterodera glycines
  SCN-specific regions: Sequence locations=1-210,232-525
cattttcacccattcaccgcatttatttggcgcaggaaaggatgagcagcggcggcgctaaagtcatccccggcggcgttgttgccgttaagcgtttttgcccgcgggcactgtgtgccgccattggctgctggcagtttgccgctgtttgttgtgcccttctcatggtgcaagccagcatcgttaccagcatgcacatcaaagacacgcagaacgacgaggatgtgctgagacggcatttacaatttcgacaacaacaacagcccatttttgcccttccattggatgtgtttgatgccagccccaccgcggtaattggtcttaagccgtttgctgagcatttggtgttcgagaagcggtttgcgccacgcgagatgggcaaacgagagcgtatcatcatggatgctatgggcggaaacgactatctgatcaaacgttcattcggcagaaaatgaattagccaaatgatgatgatgataatttggcagcctttattttgattggggtggcatggtcaaatcgatg

SEQ ID NO: 94332 - DNA, 51 bp, Heterodera glycines
  SCN-specific regions: Sequence locations=1-51
ttaatatgatgagaattgcctgttaaattttagcccaaaaaaaaaaaaaaa

SEQ ID NO: 94333 - DNA, 485 bp, Heterodera glycines
  SCN-specific regions: Sequence locations=1-79,101-410,432-445,467-485
caatgtgcatcaatcaatacccatcagatcccctaagaaagaattattctattttttttaatttctaaaaatgcatcggattccattcatccaacttttcattctgttgatcaacatgatcggaattgccaattctaaggacggaattaaaaatttatttgttgggaaaaagaacaataatgactatgataagtgctctgatcaattccattatgaagtgatcgaagatggcacaacagaggaggaggacatgaaaaaagcaattcaaattggcaaaacattcttttggcgagaaatgatagcaaaatgggaatgtgaaaatgaagatttgtataataacccgcaaaaaattggaaaaaaatccatcaaaaaattaaaaagaatttgtgaaaattggaaaatgaaagcattgtcagccgatgcattcgtgaaaagtttaaagtgcaagaaaaagcaaaaatattttatggtcacacttttaataa

SEQ ID NO: 94334 - DNA, 436 bp, Heterodera glycines
  SCN-specific regions: Sequence locations=1-58,80-393,415-436
tggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctgaaacgattgagcatacttcactcagtcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgactcaaatggcgtccgcggccacccgtttcattgtccgagcaaaaagtgcgggagactcgcaaatcgttgaagcaattgtcagcgaagtttgaggaggaggacaaaagggaaatgctcaaagtttcgaaggaa

SEQ ID NO: 94335 - DNA, 396 bp, Heterodera glycines
  SCN-specific regions: Sequence locations=1-325,351-396
agtatgatgccataatgagggagtgtgtgagacgcaagtactttttctggagaaatgtgctcaaggagcgtccagaaaccaaagagaaacaacagtctaaggaacaagtcgttcaggctgttcgtgggtataagcttccaacacaattgtttttcactgctgctggtattggtatcgcatacatgctgggcctgtacaataatcctatgtcatacagaattatttgccttggaacaggtctgttgtttggaacattttatggagaattcaaatatgctactgagatatttgattctctaccaaagcttcctgataaagctctagagaaagaaagacaagatatttacaactattgcttcagtttggatgtcagactgattgcggatgctttggcta

SEQ ID NO: 94336 - DNA, 457 bp, Heterodera glycines
  SCN-specific regions: Sequence locations=1-183,206-457
gacgaggaggtcagcccgtccggttcatgtgccgaagaagaggaggaggaggaggacgagcagcagcatcagggcggcaccgggccgcccatgctgaacgtgttggacgaattggtaggacagttggagggcctggacatcgaccaacagcaagaacacaaaatgggcctctctgaccacctgcaccagcaacagcatcaccagccgatgccgccggcgccgcgttatgcggactcttggctggacaacatttcgcttgtcccctccgactccgggtccgcttgtctgtacaccggtgccaacaatgtctgtgccgccgccgtgccaatggcgtcacctttccaacagtccctgcctccatcgtcgttggttgagccgccctgctccgactatatgaccgtgccgccaatgctcgcctcggtggaccttgcgatgccagcggagccgtccccattgg

SEQ ID NO: 94337 - DNA, 116 bp, Heterodera glycines; identical to SEQ ID NO: 52452
  SCN-specific regions: Sequence locations=1-116

SEQ ID NO: 94338 - DNA, 521 bp, Heterodera glycines
  SCN-specific regions: Sequence locations=1-217,242-521
tcgtaaattgccgacgacggcaactgttggcctgttaattactctgaaaagggttgcaaaaccgttaactatgaagaataacctagaagaagggttgaacaccgaacagcgcaacaccaatcaacgaaaggaccaaagttcaagtacagcaagttcatcgagaagtgagcagacttcaaaaatcgaggaaagactgagccctgatcaaaaacatgacaaattgaataaaaatgatcgaaaaacaagcacgacttccaaaaaggatgagacaaagctaaagattaagccaacatttgagcaaaatcaagatcaaaacgcaacaagaagctcttccaaaactaagcagaaaaaaggaaatgaaaagccgatcaatgatcaaaggcctagcagaaatttagagcaaacaacaagcattgcttcaaatagtgatcaagcgaagtctaagaaagaaattaatctggcaaatcgccaaggctctggtcaaattagtcagaatgcaactgcggcttcaaagagtgatc

SEQ ID NO: 94339 - DNA, 258 bp, Heterodera glycines
  misc_feature (234)..(235): n is a, c, g, or t
  SCN-specific regions: Sequence locations=1-49,71-78,100-124,147-232
gacactttgctgccactgatcccggcacggaaaatggagtggacaagttgaacagaaagaaaggggaaaggtgcgacaatctcttgttgttgatgttctggctttacacgcgcatctcttctattttctcaaattgtcaaataaaagcgggtctttttcacacaatcatttccctctgttaatattttatttcccttgtttttttatttgcaataaatttgtttatttttttannaaaaaaaaaaaaaaaaaaaaaaa

SEQ ID NO: 94340 - DNA, 611 bp, Heterodera glycines
  SCN-specific regions: Sequence locations=1-62,86-611
ttttaagtattaatctataattttatcgtaattgaagtttgtccatcacacaatataaattttccatctcaaattaatttaaaaatgtagtagtttgtgtcttcctaaattggtatattaatatgtccagattagttttttaagtcagtgagtgattagcctttttactgattgattcgatcatacataaaaactgataatcacaaaacaattgggtgcatagttttcttttctcaattagtaattaattaagggatttgccattttaaagtgcacagccaccaaaagccattcgtaagacgcccgcccaatgccaacttttgcagaacttttcgaactcagcgcaacgggcaaatttttggcatttaattaaatgatgtttttccaattgtccctctgcagatgtcgtcctcgttgttctgttcgtatacgtcgtctacaaattgttcttcgctcgtcgccatattccgcctccccccgacgtgccgcaagtcgaaccgttgggagagcaggacatgacggtggagcagctgagacgctacgacggagtacaagacgaacacatttgcatggcaatctgtggaaagatttgcgacgtgacaaaggggagg

SEQ ID NO: 94341 - DNA, 431 bp, Heterodera glycines
  SCN-specific regions: Sequence locations=1-8,30-210,235-431
aatattaatctgtttccacaaaatcaaaatttcacaaaatctcgaaaattaggggtgcgcctaccattttccatcatgaaaaacccggtactgaagtgtccaccttcaacaggactaaaccgtccgacatttaaaacagcgggatacgcaaatttgaaatttccggtctctagtgaaaccactttttagccaatttttttttgggattagaataattatttaattatttttttagaaaacgcttctcctcctcctatcatgaacgtacacaaaattgtgttgttccttttcgttttgttgagtttctgtgctgcaggcgttcattgccattctgataatgatgaaagaaacaaacctaagtcagcgctaaaaaaacaaaaagacaaaactaaaggtggtaatccccatactccaacgcgtagaaaaatgaa

SEQ ID NO: 94342 - DNA, 573 bp, Heterodera glycines
  SCN-specific regions: Sequence locations=1-573
acaaaagataaatttgaggttggattagacgtgcaattttttgctccacaagaaattgaggtcaaagtgtcggttgccggcacaagtttggaccgacggacagctcagcttaaccatgtgatgctgcaaagggccggttttcagccggcccccgaagatttgcctgaaaattggccagacaaagcgcaaatcgaatcaatcaaaatggcatgggaagcctataacaaatccgatgcaattgtggtgattttgatcaacgaaatctcggagactattttcgatgcaaatttcttcgagactgagttggaccgactctcaaatggacgcattaaagtcgaacggattacattgaatgattgtgcacacagatgtaaattggatgaaaatttcgcactgcgtttggacggtcgcgaagtggcggtggttaagtcgcgctattccgtgcttggattaagagccaggggcagcgaattgaacatattgaaaaatttgcggttgatgctcgaacgatcactcgcaatcaaaattccgtcgactttcattggctttagctgctcaaagaaagtgccacag

SEQ ID NO: 94343 - DNA, 598 bp, Heterodera glycines
  SCN-specific regions: Sequence locations=1-24,57-162,187-195,217 -345,367-598
gcagaaaaagcggatcagcaaaactggggagggggaggaagaggagggcgaggaactgatccagcaggaggacgacttgcaaagtgtggaaagtcagaatgagaattgtcgcgctgacttttgccttgatcgtcatgatcatcagcagaatgggaatgcagctgatgatgatgatgatgatgatgaatgttgtgatcaggaaaaactcaaactgattgaacagcaggagacaatgacgacggcagaggcccccctcgaagcaaagggtcgtccccgtccagcaatgttacaaattcacaccgttcagccttatcagtcggcggagaaagtgaagagtccagcacccaatgctgctgctgacgaagcctttcttggccaaatgcgcgaaaaaaaaaagtggccggtctgatcgcccgtttcaatgcttttgcgccgacgacggcaacagctgtgaataatgagaacgctgctgggtggtggtggttcgaattcgaaaaaaatgggtgggggccgagccggcaaaagtgggcgaacttcgccaaaaaatttatttgagaaaaaattttaatttttgcggggaaaaaataaattgaaattt

SEQ ID NO: 94344 - DNA, 501 bp, Heterodera glycines
  SCN-specific regions: Sequence locations=1-57,80-389,412-443,484-501
ttacgtgtgtcagtcctaatgaagtggatgccaatgagacgctcagctcgttgaattatgccaaccgagccaaaaatataaagaacaaggtggttgccaatcagaataaatctagcaccctgattacggatcttcgcatcaaaattcaactgctagaagctgaactccatgaatggaagacggggaagagacgtaggtctgggcacattgcagttactgagcctgaggacaaaaacagtaccgaacaagtttttggttgcttggcgagattggatgaggaggaggaagcggaggatgctgacaatgaggaagaacctggagagatggaacacgaacgaatctgtacggacttggacaaactgcaggagaatatcagcagcaaagagcgacttatggccaactacgagaaggaactcgagaagattaagcaggaaatcaaccgcttggaagagacgaagaaggaaaacaaacaggaaatcaaccgcttggaagagacgaaga

SEQ ID NO: 94345 - DNA, 490 bp, Heterodera glycines
  SCN-specific regions: Sequence locations=1-14,66-349,371-490
gcgccggaggggacgcagcaatgcaacgacaacaccagcaacaacaacagcagcagcagaacagcctttgtccgcaacaacacatggggatgatgtgcgagaacggatggagggcgagtgacaatgccatcggcgacccatccttaccattccccaccggacaattgggcaaacggaaccgagcagtacatgaaattcacattccctctggctcgggtggtgctccgctgctccattcccaactgcgaaaaatgcggatttcaactggtgcatcggttccatcgacaccaaacccaacaacgagtgaccaaaacagtccgggtccgaccgaaaagagggtcggcggagttggcactgttttgggaatgtcgaaacgaatttcgctaccggaaaatttggaattccaaccgcaaatgctgctcaatttgaagcaatcaattcatgtggaaaaacagttgacgagcaactctgacacgagtgattccgcctc

SEQ ID NO: 94346 - DNA, 36 bp, Heterodera glycines
  SCN-specific regions: Sequence locations=1-15
aaattgttaatgtagaataaaaacaaaattcaaaaa

SEQ ID NO: 94347 - DNA, 154 bp, Heterodera glycines
  misc_feature (139)..(139): n is a, c, g, or t
  misc_feature (151)..(151): n is a, c, g, or t
  misc_feature (154)..(154): n is a, c, g, or t
  SCN-specific regions: Sequence locations=1-2,24-31,71-91
tcctccgtgccctccaccatgcccaccaccatgctgttgctgtggaggcggcggcggtggtggtggcggtagaccaatcattgtgaactgcggcggtggtggcggtggatgcggtggtggatgtggtggtggcggtggnggatgtggtggnggn

SEQ ID NO: 94348 - DNA, 427 bp, Heterodera glycines
  SCN-specific regions: Sequence locations=1-186,217-427
aaaaatgcgtcggattccttttgcccaactgttcattctgctgaacattataattgaaattgtcatttttgtggatgggatggaccagtcccaatttgaaatgattgactattatggcacaacggagaagaaagacattgaaaaagcgaaacaaattcgcaacacatttgtctccattggcattgtgaaattggaaaaatgaaaaatccagaagaaattggtgaggaagaatccgctgaagaattggttaaattgtgtgaaaaatggaaaatgatggcattggcagtcgatgcatttgtggggggagatttaaatgtgaaaccacaatttgaactggtggtaaaacagcagctggacagaacccatcatcaactcctaatgagctcagcaatggaagcgatcaaaacaattattttggtaaatgaga

SEQ ID NO: 94349 - DNA, 406 bp, Heterodera glycines
  SCN-specific regions: Sequence locations=1-27,50-182,204-406
aattaaaataaatacaataatccacataaaataaaacaatgaacaaatttgtgggcatatttgtcgctgttttgctccaatttgtttcgccattttcggcattttcccgcgtgccaacgacgaccaccgaacgaccgataatttatgacccaaaagaaatggtggaaatcgaagtgaatttggtgaacaacaccaacaacaactgcacaaatgatgttcttcgaaaataccgtgtggagatcactaattatgtgttctttttggtgtgcgatttgaaaattcaagtccaattgccggaaggggcaaccttggagaatgtcgtcaacctgaaaccgttcaatggcaccaccgatcaattcatttttcccgattccttgcgctacctttacgtttccaaaacgctcga

SEQ ID NO: 94350 - DNA, 456 bp, Heterodera glycines
  SCN-specific regions: Sequence locations=1-12,34-68,91-270,297 -375,397-456
gcctatcaaattgagaggacgacgacgacgacggatcggcaattaaaaaaacgccaaaatccgatggcggactatgattatctgatcaaattcttggcactcggcgattccggtgttggcaaaacgtcattcctgcaccggtatacagataattcgtttacgggccaattcatttccacggtgggcattgatttcaaggaaaagaaagtggtgtacaaaaatgcccgagggggcttcggtgggcgaggccaacgaattctgctccaactttgggacactgccggccaagaaaggttccgctcattgaccacggcatttttccgtgacgccatgggcttcattcagatctttgacatcaccaatgaacagtcctttctcaacgtcagggactggctgtctcagctcaaaattcacgcctacacagagacgcccgacatcattttgtgtggcaacaat

SEQ ID NO: 94351 - DNA, 484 bp, Heterodera glycines
  SCN-specific regions: Sequence locations=1-53,75-484
aaagcggacgaatttgggtcaccgcttaaactaaaaagacccacggacggctacacaaagttgactcacgaaagagccgatgagacgcagagttcatccgctggcaatggcactgagttcgggcggagtgtgccgtcctcctccgatttggtccttttggtgcgcgccccctccccttctcttcggcaacttccgtttctttcaccggtcaaaaactggggaggttttctttctccaaaacaaactgttgaaactgtgagtgcgataagtgaattctctgccgatttattcaaaacgccgtcgcccgcgcggttgggaaaacggccgattatttgtgcaaatgtgggccaactgctgaccccagaaaaatcgacgatttccatggccgaaaagagcgatgagagcagccaattaaatgaaaagggagcagaaacagaaatggagagagaattggtggagaagaaaaagcgaacgcaacggaaga

SEQ ID NO: 94352 - DNA, 528 bp, Heterodera glycines
  SCN-specific regions: Sequence locations=1-7,184-286,466-528
gaggaggaagaaaagtgatcaaaagaaaagcggaggagaaaagtgatcaaaggaaaagcggaggaaaaagtgatcagagaggaaaaacggaggagaaaagtgattggaggaacggaggaggaagaaaagtgatcaaaagaaaagcggaggagaaaagtgatcaaaggaaaagcggaggaaaaagtgatcagataggaaaaacggaggagaaaagtgatcagagggaaaaaatgtgatctgaggaaaagcggaaaagaaaaaaaaatgattagaggaacgatggaggaagaaaagtgatcaaaggaaaagcggaggaaaaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggagaagaagaaagatagcaagcaccacatttgatttcatttgcactttcaccaaagcatcgtttgttttctctatta

SEQ ID NO: 94353 - DNA, 441 bp, Heterodera glycines
  SCN-specific regions: Sequence locations=1-441
tacttgcagggcggccttcaaggcgttggattgaagacagccgaagaagtgttcacaaaggcatccagtcatgccactctaccgagtgtcctcgttcgtctgcaattgtacacaaataaacgactcaaagtaaaagtggacgctgattttgtggacgcctttgttcgcgcggagaacacctttttataccaaattgtcttcgatcctttaaagcgagaacagagaccattgaatgcctatcctgagacaggggaagaaaaggaaaatttgttggacaatgaaaagaagtcgtttctccacggaatgcccttcgccttgccttgggaaatgacgacctttccaagtcgtcgcttgaggatgaatttgttttgcccagtgaaattcccgtgtcgtcaatttggaacagcaattacaaaaaagtgttggaaacggaaaaggacc

SEQ ID NO: 94354 - DNA, 282 bp, Heterodera glycines
  SCN-specific regions: Sequence locations=1-164,186-282
gcgaacgatgttggtgccaaagccagccaaatcaacgaagacaccggcgctggcaaatttgttgaagagcgtgtccttccgggcgcaaaagaattgacggatgaagcgaccaaatttgtccacgaacagacaacgccataagccacggcggaaggatgaaaagccgaaaagaaagagaaacaaagtgaaactcgaaaggcacggccaatgaaatgacaaaaagacatattaattgctttaaactttgatgaaatgtgctttttgtttataaatggaagtgcc

SEQ ID NO: 94355 - DNA, 422 bp, Heterodera glycines
  SCN-specific regions: Sequence locations=1-61,204-422
ttggcatttttcttttttaaaaaattatagttcggctcaaacttgtggggccaaccgtggtaggaagaaaaagaaattgaggaaaagaagcgagcagaggaagagtaagaaaggaggagcgagaaaggaggatgaagagagggaggaagaggaagaaaacaaagggaggaaaagaagcggaggaggaagaggaaaaaggaggataatgcagtagggctgtgcgagaagtgatttttaccgggaaccgagaaacgagaccgagaaatgaccccgagaaacgatacgagaacctagaccccaaaaaacccgagaaatttctcgactcgggaatcgagaaccgagaaatctaaagtgacggcattttttttgcttttaaaaacgtttttgctgtttttccaaaaaatttttgtaatttcttaaaa

SEQ ID NO: 94356 - DNA, 478 bp, Heterodera glycines
  SCN-specific regions: Sequence locations=25-478
ttgaataaaaattaattaatcaatgcattcctttcttgtactgaccattctttttgccaatttggcaacaaatgcctttgggcaacaatggccaaaggcaactagtgaagaaactgttaaggcaacaatcaaagtttcgggaggcgtcaaagactttggcttcaaacggttgaccgcctcttcggcattgggtagcggtgatcagtcggagggccaaaaagcattgatccgtgccgaaaagaacgcagtgatcaaaaatttgatcattggccaaaacggggcggacggtattcattgctatgacgggtgcactctgcaaaatgtgtggtgggagaatgatggagaacacgcggccactttccggagcagcatcgggtgcaaggagtacagtttcacggacacacgcggcggtgtgaaaaatgccaaagacaaagtgttccaaatgaacggcggtggcactttgacgatcaaaaatttt

SEQ ID NO: 94357 - DNA, 347 bp, Heterodera glycines
  SCN-specific regions: Sequence locations=1-134,197-215,237-347
tatgtggcctattgtcggaattcggatgacctcgattggtacgagtttgacgatgcgaatgtcacccgagtgaacagcttggaagtgctttcccaagaggcgtacattctgttctacaggcagaaggagactttggaagacgaggaagcgatggaggaggacgaagtgttggaggaggaggaggaatgggtggaggcaaattcatccgacgaaatggaaactgagggcggcaacggcacgtgaaagcactgcggcccccccccccttattgtgattattcattatctttattacatgtagtaattatttgccgatttcgccaataaacaaatggacggaaaaaaaaa

SEQ ID NO: 94358 - DNA, 405 bp, Heterodera glycines
  SCN-specific regions: Sequence locations=1-319,344-405
aacaattacaatgtgatcaagtcgggaaatgtgaaaatgacgataactaatccgaattatgacaagccgctttgcttgaaagggctcagccaatacgaggcgttgccctcctcgttgtgcaatttcgatttatgcaattttatcggccgcaatttgtgcgaattgttgcaaaggccaggcaatcacacggtgcgcgagatggagcaaaaagcggggtggaatgccactgttgtgatccccgaatcaccacggatattcggcatcccttttgtggaccttttcgctggcgagttcaattttgaatttctaatgaaaacggacgaaagaaaagaaagaaagacagcactaattgaaaaccaatgagaataataagaaacaaaatatttatcaaaaaaatgcaaataa

SEQ ID NO: 94359 - DNA, 75 bp, Heterodera glycines
  SCN-specific regions: Sequence locations=1-75
tcctgtatatcaatgcatttattctttttattccatttatcatttttatattgtagtgatttttgtacataaatt

SEQ ID NO: 94360 - DNA, 364 bp, Heterodera glycines
  SCN-specific regions: Sequence locations=1-333,358-364
ggacggcagcaatcagagaaacgatggaggaggccgggattgacgtgaacaaattgcgaatccacaaggaatttatgtacgaaatgcgctatttgtcaaaatccaccaaatacggggaggaacagaagaaagtcacttattggcttgccgaatccacagacccggaagtgatagttatgttgtccgatgagcatcaaaattggaaatgggccgagcttaaaagtgcgcttgaattggccaaatttgatgagatgaagaaacttctgaacaaagctgagatgtttattgccgagaatctgtaaaagaatgcaaaaatagataccctaattatcaattttattggaaaataaattataccttggtc

SEQ ID NO: 94361 - DNA, 419 bp, Heterodera glycines
  SCN-specific regions: Sequence locations=1-97,119-255,303-351,387-419
ctttgttttggccttgtgcaaacggtgcgcgaggcgttcccttcgctgatgcatattgtgaaggagcaccgccaaaggaaaatgaacattcaccacgccccccagggggtggggtccccctgagaggccccgggggacggagccgggacaatccggcactttcggaaacaaatttttttctattttggttagcctttttcccaaaggtcccaactttctttaaatgtaatatttctattgatcgcaaatcgattcaaatattacaaaaatattattttcatattattgtattaattaaatttgttttgtttacataatttttctttgggttatttttctgcaattcgctaattccctttttctgtctttgtttttcttttcgtcttacttatctcaggattttttttttgttttattta

SEQ ID NO: 94362 - DNA, 455 bp, Heterodera glycines
  SCN-specific regions: Sequence locations=1-31,53-156,178-184,207 -384,408-455
tctctctcattaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcttcagacagtacaaaccataaaaaagaccataaaaatgagcatccaaagtatgattccccaattttagccggttcatctggcagtccgaaaaaaggaaaatcgccgaatgccgatccgaaaaaaagctgcttcacaccatgtgccagtaacaccagggaaagtatgatgagcaaagtcttaaaatggtgaagaaactgtgtggaacgatgatgccaaccatgaacaaacccaaagctgttgtagtagatgtagaaaaaaaactgtggtatcatcacgcttttat

SEQ ID NO: 94363 - DNA, 369 bp, Heterodera glycines
  SCN-specific regions: Sequence locations=1-11,63-369
acaaatgcctgaagcgcttctcccactccggctcttactcgcagcacatgaaccatcgctacgcgtactgtaagccattcatgcagcagagacaaagggccgaggagagaacgccgtcaaaggatgaaaacacagagtgaagcaaagaaagaacagcaagcacagtgcaaaaagagcgtgtgagaaattaaaaacgtcgcaaatccctcaaaagccaatcgaataaataacctctccgtcccttcaatgatctttagtatttaatttggtcgctttccctttttgcaaaaccttattaaccactttgacccactaaatgtgacttttggtgctatgcattcataaattaacataaccaaaaaaaaaaaa

SEQ ID NO: 94364 - DNA, 154 bp, Heterodera glycines
  SCN-specific regions: Sequence locations=1-154
acaaaaccaaaacatgaaattcgagacttatttctccttcggaccaagactaaaaaacccgagacttttcccgagacgctcgaacaatattgtaaatgataaatatttggtcaatatatcaaaagatatggtgcctcccgccagggcgtaggcc

SEQ ID NO: 94365 - DNA, 423 bp, Heterodera glycines
  SCN-specific regions: Sequence locations=1-13,35-423
ttttgcctttgttctttgctccttttccttctcccctcggctcttttcgctgatggcttttcgtcgtctggccaaagagttgttttggcccgggtgatcattttcaaagcatccgaaaagcaggggacgattgcttctcaacagtgtggtcgggagggcattggtcgtacatgagaaggcggacgacatgggcaaggggggcaatgaggagagtgggaagacgggcaatgcgggaaaacggatcgcatgcggagtggtgggagtgatcagagaggaaccaatgaaagtgaccactgatcagaccaacggaatgtgaaaacagcgatcagcagaggaattcatggacaatgaagaaatgcaatgcattgagtgttctattatttacgtcttttaattcatataacttatggaaataaagagcaa

SEQ ID NO: 94366 - DNA, 119 bp, Heterodera glycines
  SCN-specific regions: Sequence locations=1-119
aatttgaagatgtatgtctatttggcataatgggacggcacgggaaaagagatgtgatcctcgatgacaacccattggaaatggctatttgataaattttgatatgaaaaaaaaaaaaa

SEQ ID NO: 94367 - DNA, 433 bp, Heterodera glycines
  misc_feature (430)..(430): n is a, c, g, or t
  SCN-specific regions: Sequence locations=1-236,259-433
tggcaccgttcattccatggttggcttttcccgggcggaattgcgagtcaaaaagtaccgtatcactgtgtatgatttgggaggatcggctcgaattcgcgaaatttggcccatttatttcgccgaggtgtttggcgttgtgttcgttttggatgcgagtgccgccagtctaatcagtgagaacaaaaagatggtcgactctttggtcggactgcccgaccttctcggcaaacccattctgtttctgctcaacaaaaaggaccttccggaagcactcgacgaaatgcaattctccgaacgattcaatttgcattcaatggcaaaacagaacagaacggacattcgcgtggagggcatttgcgctgtcaaagggacggggaaagaaattgatcaggtcattgtggaaggattggaatggctgatcgagaangtg

SEQ ID NO: 94368 - DNA, 319 bp, Heterodera glycines
  misc_feature (290)..(294): n is a, c, g, or t
  misc_feature (298)..(298): n is a, c, g, or t
  SCN-specific regions: Sequence locations=1-2,25-221,243-285
aaggtggttctgatggtggtggtgcattgagtcaacaaagcacgtccacggcgcccaacagaagcagtgaggaggaaagcgacggtcgtgttgatgcatcatcatcggaggaaagcgacggtcgtgttggtgtatgatcatcggaggagcacaaataacttagttttccactctcatttggcgcctttgtttcactaattgaaattgttttatgcgcgggtgcttttcttttctcaaaaacctcattcatttcatgctttttcgatgaataaaccgagttagcacaaaannnnnaaanaaaaaaaaaaaaaaaaaaaaa

SEQ ID NO: 94369 - DNA, 453 bp, Heterodera glycines
  SCN-specific regions: Sequence locations=1-453
tgtttactgcattttttgttggaaaagtttctggccacaccataaataagtgattaattttcatcacaacgctttgaacggattttgagataaagcaaaaaaaaaaatccgctgaattatagagaattcatggaattattggagcagacaaattgtatctatcagaccatgtctaattcagcaatttgcaacacgacaagaatttttgtcaacatacaaaattgggtggaattttccatggtttgcggttcgtttgtcgcaatcgccatgaatgtgttgatcatttactgtgcactgcgcatttttaatcgcaaaaatcgcgacacaattcatgtgtatataatcagcatgacgatgggcgatctgattcttgtgatttgccaatttctcgagtcgatgaaccgcttgacacccgtccagttcatctccagctcttattatgcctgttttttg

SEQ ID NO: 94370 - DNA, 475 bp, Heterodera glycines
  SCN-specific regions: Sequence locations=1-1,25-475
atttgggaaaaaagaaccccattttattcaaaagcgaatgtctgatatattttaatgatttcttaatggggattgaattctagaccggctcaaaaattgttgaaaaactaataactaattcgaatgtcaaccatcccaatgccaccaccaccaacacaagacgaaaaggaccaacaagtgccataaatgaatgtaattcaaagtaaaactgtaattaagaagaaatcccaatggaaaccgctggagataggaagtaagtctgagagattaaggaacaaagtccggaactttcagtccaaaacgagattttttgttcagcaacgaaaattccggacccagaagaattgcctttcggaattgtacagactgcattccgagcttcagatcggatgcgcacgacctcagaagattcggccgagtcttttgacgcctatggaccggagtgggaagggaagggacggggaattgggaacag

SEQ ID NO: 94371 - DNA, 525 bp, Heterodera glycines
  SCN-specific regions: Sequence locations=1-33,55-222,244-525
agaatttcttcaactaaaatcataaacacattcaataagaaaatgatgcttttcattctactggtcataactttcgtccaaattggtcaactgaatgctggcatatgcacatttccaaatccgtcaaaaagtgttacggtccaatcgatgatgactgtttcatcgagtacggactataagaacactttgtttgtcggcggttccggcattttgaacggcgcgtgtgatgtgaacaatgacaaactgaaatatttgatgacattgaagaatggcgtgaccatcaaaaatgccattcttgacacgcccggtttgggcatttactgcgagggcaattgtgtgctggaaaatatttactacaagcgattgtgttaccatgctactgggttcgggtataagagcaccagcacttcatacacttaccaagtgattggcggtgctggccaaggttcacctgacaaatatttcacccaatcgggcaaaggcactaccatcatcaagaatttttgcgctgaagcaaatacggca

SEQ ID NO: 94372 - DNA, 527 bp, Heterodera glycines
  SCN-specific regions: Sequence locations=1-527
cgcaatttcggaaggggtgccgggccaagaagtttcttcctcctcgtccgacatggtcggctcgtcctcttccgcttcgtccgcctcttcccttggcggcggcagcggcacggccattgtgaccacttctctgctgcgtccattcccttgtgcctcccttacgcatgcgcaccatcagcgaacccatttggcaaaggaaccgaaaagaaatgccgaagaaagcgaagggtgcgcgggagggacggcggaaacgaaatggcaacaggacgatagggacgaggacgaactgttctgcaagatcgtctaccggaaactgtgccgtattggggacgaacggctcaaagagtacgcgaaagcccgcataatcgatttgttggtcgacgttcagtacggaggaggcgcaggaacagccgacggggcgtaccgatgaatcgaaaacaatcgcacggcgcaaagaaaaccctggcgacgcattcagtggcaaaacgagtgccaatgtcacattcccatttgcaccttcgatttgt

SEQ ID NO: 94373 - DNA, 514 bp, Heterodera glycines
  SCN-specific regions: Sequence locations=1-260,283-514
ggtgttcgtcaacgtcgatgagttcaccgactttcctcggcctctttttcccaatttcattttcatcggcggattggaactcgaaggaacacccgagctcaaagccctgcaggagccgttcaaaagtgagctgctgaaggggcgaaagggcgtcgttttcttttccatgggttccgccgtcaaaacggacgttttgccggcgccgtttatgaaaaatgtgatcggagcatttgcggaactgccggattggcatttcatcgtcaaaatcgagccggacgacgaacaaagccggaggatggctgagaacgtgcccaacattcgcctcacttcgtgggcgcctcagcccgccattctctcccatccccgcctccgtctgttcattacccacggcggttacaactctttgctggagggtgcacaaggcggcactcccgtgctcagcatcggattcttcgcggatcagcgaaagaatgcattggttgcgcagagaaacggatggggaaagagagaccgt

SEQ ID NO: 94374 - DNA, 369 bp, Heterodera glycines
  SCN-specific regions: Sequence locations=1-369
gaggatttatcgccaaagttcggcggaatccgacagagcggcgaaaggcgttttatgctcccgatggatggcgatttcgtagtgcgacttcaccaacgaacgccgcctttgcgcttccgatttttcaatttgctcagtgtgccttcacaagtccaagccgaatccatagacaaagtctctcggattgctttccccacaatgttcgcccttttcaatattgtctattggtcttattatggacgaaaagcggctgagacaagcgccgaattgcattcgagcggaggaatgatgattcaatgaccaattgagacggggagaaagtgcatattgaatattcagattatatgaataaattgtgtattctgtcaa

SEQ ID NO: 94375 - DNA, 249 bp, Heterodera glycines
  SCN-specific regions: Sequence locations=1-95,117-125,152-222,244-249
tgtcattgcgtgaaatttacagacggcttaagcttcttcgaaagatgcgacggagtcgacaatggtctcttcgacagttcccctaggccaagtgatcactgatcagcaacaaacagaagaaatgaattgattggttgactgattgattgatgcgattatgtgatcaaatattggattaggtattatgccatttgaatgtggttgtattgatttttgctcattcacaaatgaataaataggacttgttta

SEQ ID NO: 94376 - DNA, 491 bp, Heterodera glycines
  SCN-specific regions: Sequence locations=1-491
ttggcaagttggagcagaaagttcgcgaactcagcgaaagatgcgcagaggcggagaggagaagcatcgaattggaagccaaaatggcggataaaacggaacagacaaagacgggacaaagtgaggccatcgtcgaaaatgtgaccgttgcgaaacgattccgagcctttgaccgacaattgttgcaacaaaagtccgatgtcgaccccatcactgtgctttgctcggaaacgttttcacttggccttcaaaagtccgacaacggcgaagggaattccgacccttcggagtgtccgagggaattctccacgtctacccctgtgccttccttctgctcaaagtctgaatcctccgtcagtttaaacattctccaaaatgctgacaccgattgtgaaatccctcacataatggcgaacgaaggaaatctctgcgatttttgtgtgacttcacgcaaagaattggattacttcaaatctctgcttggacattta

SEQ ID NO: 94377 - DNA, 434 bp, Heterodera glycines
  SCN-specific regions: Sequence locations=1-129,168-225,247-270,293-434
ggaaaatccatttcaatctctcaattctccggacgatgattttatggtggaaatcggtgacagaaaggtggctttgtccgcttctcggcttcgctgcttctccccggtgatcgatcggatgctaagcgtggagatgagggagaagcagcagcgatcagtcactttgaacgaattgagcattgacatggaccaatttttggattttcttttgtacatttcgccaaatgctctgagccaaccaattcttcccaatccaaaaaatgtgcttactctgctcagtttggccagttacttccaaattgattggctgaagtcgcgttgtgagacgcttttgttcaattgtgtggaggttccgttgatcgaccgcgttaatctaatcgaaaaatatgggcttacaaatttgaaaaatttctttttgaatttgaatgtgcaca

SEQ ID NO: 94378 - DNA, 196 bp, Heterodera glycines
  SCN-specific regions: Sequence locations=1-26,51-77,99-196
cgactacaacacgggtgcaacgacggatgttcttgtttgcagaaccaacacatcattttagtctctcgaaaatttcgtgaaattttatatccatttattgatacaacacactcttgtttttactaaacaacatatgtatgagggaggacgagggtgatatgatgatgatatgattaaatgattaattatcccccta

SEQ ID NO: 94379 - DNA, 386 bp, Heterodera glycines
  SCN-specific regions: Sequence locations=1-362
aaaacattgataaaaatttaaatttgttttttttgaattcactcacatgaaaaagaagtgggaatggtgcggacgaggtgcaggcgtgttgacaatcaatgcaagcgcatgagtggtcgaatttatccggcacttcgttgcatttgatggctgtcattgagcatcaccacgttgatggtgaacggcacatgggtgaccttgctgtacgtgccaatgtattggaagaacttcttcggtgtgcacagttcaattgaagtgccgcaaagaatgcttaacacaaaggccgtggacgaagtgcgcacctttaaaaagagaaaatttgaatttgtacgaaacaaaagttggaaatggcacaaattgccaaaaaaaaaatttttttttaaaaa

SEQ ID NO: 94380 - DNA, 450 bp, Heterodera glycines
  SCN-specific regions: Sequence locations=1-98,134-450
gtatttacttcttctttccattttcagcgccgaccgcttccgtcaaaatgttgcccacttacatccgtgccattgcggtcggtgaggagcacggcgaattcttggcactggacctgggcggcaccaactttcgcgtgctgctcatcacgctgaagggcgactgccggtcgacgatgcgaagcaaaatttaccgtgtgcccgaccacatccaaaagggcaccggcacggcgctgttcgaccacatagccgcctgcctggccaagtttatggaggagcacaaactgacgggacggccgaagttgccgctcggcttcacctcctccttcccgtgccagcagcacgggctgaccagcgcgaggctcaccaattggacgaagggattcaaagtgaaagcgaatggatgggtggtttttggcatttcatttggggtgcgaagagcaaggcacgacg

SEQ ID NO: 94381 - DNA, 451 bp, Heterodera glycines
  SCN-specific regions: Sequence locations=1-451
ggcaaccgctctgaagactttgatctatgagttgaacgaagcacttgcggtcaatgaggcggcaatgggcagcgaacggacagagtaccagcaaatgttgagacgatcttttgacgggatgctggagagattgccgacattttttgatggcgaaaaatttcttcccgacgtgacaagtcaagacggaaaagccgcacttggaggtgccaattctcagctggtgaacggagtgctcgaccgactcagccaaatcggcggaatggcggcagaaatgcacattttcgactcaatcagcggacttagcgaataaataacggcggagaacacagaaaaatgattagagtatttatcctctgttagtttttgaaagtgattttgtactttctgtttcaccttttgcctcacaatcaacttataatttttgtgctttcatcgatctcaacatcatttt

SEQ ID NO: 94382 - DNA, 510 bp, Heterodera glycines
  SCN-specific regions: Sequence locations=1-510
ttttctgaatttgttcagaaggagggggatgagcatatgattggagtcaccgagcaaatcaaaaagaaagtcttttctctgcttagtggcgactatggcaaatacgccacttctgtgctcctctgttccatcaacaaaattaccgcgcctgaaaaggggtcgcgccatcggcacaattggctgatgccattcctcgaggaaattcagtcgaaaatgcgggaaattgtgaatgattcttcgcttacatttggcgcagaattctcttctcaaattgtgccttcctttgagcatggaattagagagctgaactctctcctgcagaaccatgacattttgaacataaagccggagggagcggacatccggatgaggaaaagcattcaggagaacacggaagacaaagtgtcctccatttgtgtgatgggctatctgttgaacataatcgacgacctcaacgagtacatccgcgaaactgcagctgatttgagcagagaaagcccggaaaacgca

SEQ ID NO: 94383 - DNA, 439 bp, Heterodera glycines
  SCN-specific regions: Sequence locations=1-23,45-138,211-325,378-439
cccaattaaaaaaagtaaatcctctttaaaaatgaaactttcaataattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggacatggaggaggacacggaggaggaaatgacagcagcggcggaggtgatgattagaagccatagctaaaaagaagaagcataatatggaactaagaaaagaacgagcacaaaatgcttttagtcgcttattttttgctgcatttaaaatgttaaattttaaaaataaaaataaatttttgtattttttaattcatttctttttacccgcataaaacaaaattagctcttccgttcttttgacagtatccctgaa

SEQ ID NO: 94384 - DNA, 83 bp, Heterodera glycines
  SCN-specific regions: Sequence locations=1-3,25-83
ggagtattagaaaagaaccatagatgtgttatatatatatatatatgtgccgttatttctatgcgatgaaaaacaattcatac

SEQ ID NO: 94385 - DNA, 124 bp, Heterodera glycines
  SCN-specific regions: Sequence locations=1-124
acgatttagttatatattggcataacctatctataaaatatcaaaatctagctaaaaaacaaacatcaaggttcgtagatctgaggctttagcctcattttgtggttttttgttaaattttcca

SEQ ID NO: 94386 - DNA, 429 bp, Heterodera glycines
  SCN-specific regions: Sequence locations=1-168,190-429
aaatggcattggaaaatggaaggacgatgaacggaactcagcaaaacaataaaacagcgattcgaccgtcggagtttgaggatgacacggagagcagagactttgaaaatttgtccatgtcagtgtcggaggcatcgtcagaagtgggaagtgtgtccatccaagacggagcaatgctaaaccaaaatgaacggccaatgcttgaaaatggaatcacgaaaaggaacgtcagactgaaaagtgatttaagaatttcgcccgcaagttccggaagttgggagagggcaattcgtcccgtagtgaacaaacatcacaatgccaatgctgcgtccgttggacggcgacctgcggcgaatacccaacgatcttcggtgtgttggtattgtggtgtgaaaggacatgccgcagcccattgtcaaaaaaagcgca

SEQ ID NO: 94387 - DNA, 522 bp, Heterodera glycines
  SCN-specific regions: Sequence locations=1-215,237-319,342-428,469-522
cgcaagtgcgagaagacgcacattttgaccaacaaaatcataatgacttcttgcggattttacggcgatgtgctccaattgaggcgcattctcgagctacgtattaaccacttcgagtttatctaccagaggcccatgtctttggaccagtgcggtgaaatgctttcccgtactctttactcacgccgatggtggccaaacgaatgccatgacgacgtggggagagggagaagcatcgcctggccaattcgagagtctcgaccaaattccgtccagggacacagaaattttaatcaaattgaatttaaaattcaaacccaatgaaatttatttgttattattgttcgtgttttcattcttcaaatatcaaaaatatttttgacatatcgcccgccaccttcatttgagaaaaaacaactgtgagtccctaattttatcatttaaattaataattcatatttatattttgtttgtccattagctcgttcattttttctcaattaaatgattaattaattttgt

SEQ ID NO: 94388 - DNA, 448 bp, Heterodera glycines
  SCN-specific regions: Sequence locations=1-121,143-448
caaattcgtttagcatttttttatggaaactctgctggacaaaaccattttttcggtcatcgacccgcccaatttgcgcattaatttgccgcgatggtttacgttccccacgcccatgcaaacctttttcttcattcttctcacttatttcctcgtctccggtggcattgtttacgatgtgatcaacgaacctccgtccatcggttccacggtggatgaacgcggaaacagtcggccagtggccataatgccctaccgcgtcaatggccaatacattatggagggcctcgtcgcttcgttgatgttttgtctcggaggccttggcattatcattttggacaagtgcacccatccgttgactgccaaaaacaaccgaatgatgcttttcggactcggcttctccttactgtgcatcggcttcttcaccacgcgaatgtttatgaagatg

SEQ ID NO: 94389 - DNA, 400 bp, Heterodera glycines
  SCN-specific regions: Sequence locations=1-213,261-400
atatatttcataacggttagtaaaattgcctatttaatgaaatgtggtggtacggtggcccgtttaattgtttatcattctctgagtacggtatttaattttttggtggatatttggctaattaaaaatgatgtcaattaaaaaggtaaataaagatcatagtttaaaactttgtggcggtctctgagtcataagacgaattttgtcctttacaaaattagtaaatttaaaatataataactttataaaagtataaatttggagagcaaacggaggtaaaagaaaggggacgagaaaatttgtgtgatgatttgtcactaattattacacacattttatcagtgaaaccatcgaagaaccaaccatcccaatccatcatcatttgttaacactcgcagca

SEQ ID NO: 94390 - DNA, 89 bp, Heterodera glycines
  SCN-specific regions: Sequence locations=1-89
ccgaaaattccagcgcagtgaatggaggaaatttatcttcctgtctataattttaattgaataattttggttttattataaaaattcct

SEQ ID NO: 94391 - DNA, 499 bp, Heterodera glycines
  SCN-specific regions: Sequence locations=1-27,103-388,411-499
acagattgatagctttttcatgattcggtggatggtggtgcatggccgttcttagttcgtggagcgatttgtctggtttattccgataacgagcgagactctagcctactaaatagttggctcattgcttctatgggcaaatctcatttcaggaattcttatgcattgcgagggcaaatccactttcattgtcattgaaatctgtgttcgatgagcttgacgttgatggcgatggatttataacgcgatccgagctgaggatggcattccaacagatgggccatgcgctcaatgatgccgatatcaaagccatttataaacgtgttgacaaaaatcaggacggcaaaatcaacttcaaggaattttgtgagatgatgacccgaggaagcactagcaacagtagcaacagcaattcatgatgataaatgaatgacggaagaaggaatacaccataaattgtccaattaacttaagccaattaatggttgcttaatttttc

SEQ ID NO: 94392 - DNA, 131 bp, Heterodera glycines
  SCN-specific regions: Sequence locations=1-131
catctcaacccactcttccacggcggggcacgtcacttctgagaatcaaagtgaattgtgcgggatcaatcgatccattgggaggcggatgaataattgaccgtaaacatttcaatttccgcgtttatttc

SEQ ID NO: 94393 - DNA, 56 bp, Heterodera glycines
  SCN-specific regions: Sequence locations=1-56
atccctaaagatgattagtaaacatttttgaaaaaaacccaaactagcgaagaggc

SEQ ID NO: 94394 - DNA, 163 bp, Heterodera glycines; identical to SEQ ID NO: 85129
  SCN-specific regions: Sequence locations=1-163

SEQ ID NO: 94395 - DNA, 192 bp, Heterodera glycines
  SCN-specific regions: Sequence locations=1-130
agggaaaggaaacgaattacgaaaaagggacgaaaggaaaagccaaaggtacgatggaaattaacagaaatgagctaattacaataacaaatgtcacattaacgcatcaagaaataaaaatagccaattgaaaaaaaaaaaaaaaaaaaaaaaaaaaaaaaaaaaatttttttaaaaaaaaaaaaaaaaaaa

SEQ ID NO: 94396 - DNA, 143 bp, Heterodera glycines
  SCN-specific regions: Sequence locations=1-143
tgtggaaagaggactcggaagcgtcagaagattctcacccgctgctgtggcgtcccgaaatactcaaaaaacagcgtttttaatcctgttgttttaattttgcattatacatgtttttaattataaatgaacaaacccaaaaa

SEQ ID NO: 94397 - DNA, 452 bp, Heterodera glycines
  SCN-specific regions: Sequence locations=1-129,195-266,342-349,377 -379,401-452
agtagatgactcgcccctacaaggaattcctcgttcacggacaataattgcaatgtccgatcccaatcacggcaaatcttcaccggtttaccaacccctttcggggaaggacaagcacgctgattttgccagtgtagcgcgcgtgaagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagttcgtggatctgatcaaaaaagaatgagcgaagaacagcgactgatcggagggaa

SEQ ID NO: 94398 - DNA, 335 bp, Heterodera glycines
  SCN-specific regions: Sequence locations=1-85,107-247,269-335
ccaccaattcggtgtgttggttcttctgttttaattaattaattatccgttgtttttttgatggtcaaatgaacggcagccgattaaacagcacggcccatagaatcgtggacagaacggaaaaaattgagaaagaatcgaagaatttttggaagaaagtgacctttggatgagcacaaataaatgggaatgacagaagaaggaagttgaaagcgaagagttattcatttgccacttctattgaatgaattgcattttaacaaataacatttgatctgctaattgatccccgatcataattattattcattaattatgagtgcttgggcgaatgg

SEQ ID NO: 94399 - DNA, 311 bp, Heterodera glycines
  misc_feature (145)..(145): n is a, c, g, or t
  misc_feature (152)..(152): n is a, c, g, or t
  misc_feature (156)..(156): n is a, c, g, or t
  misc_feature (222)..(222): n is a, c, g, or t
  misc_feature (261)..(261): n is a, c, g, or t
  SCN-specific regions: Sequence locations=1-147,206-224
gcacccctgcccaaggggtcgctctcttcgcttccttcacccccaaccattcttttattcgttttgctggacttttcgatcaatttttttcaccattttacgcatttttaattcgtcgatcgcttctttaataaattttgtgtcnggaaaanaaanaaaaaattttttttttttaaaaaaaaaaaaaaagggaaaaaataaaaaattttttttttttattanataaaaaaaaaaaaaaaaaaaattaaaaaataaataaanataaaataattaaatatttattatattataattatttaaaaaaaaaaaaa

SEQ ID NO: 94400 - DNA, 117 bp, Heterodera glycines
  SCN-specific regions: Sequence locations=1-21,45-117
aggcttcggccttagtggtgcacgggtgagtaacacgtgggaacctgcctttcggttcggaataacgtctggaaacggacgctaacaccggatacgccctttgggggaaagttcacg

SEQ ID NO: 94401 - DNA, 119 bp, Heterodera glycines
  SCN-specific regions: Sequence locations=1-97
gcaactcggttctttaccggaaacactgtctttgtttggtaaaatacggttacaaggttttaatattgtaaaggatctgataaaagtgattttctttaaaaaaaaaaaaaaaaaaaaaa

SEQ ID NO: 94402 - DNA, 152 bp, Heterodera glycines
  SCN-specific regions: Sequence locations=1-152
gacccgttgatgccgtgattgttcgcaataatgaaaccaaaagcagtccgtcaccattttttttgtttctgttattcactgaccattgtattgctttaaatttccgctttcatttcacttgaaaaaaccatggtaaaatgaatgaattttgt

SEQ ID NO: 94403 - DNA, 134 bp, Heterodera glycines
  SCN-specific regions: Sequence locations=1-134
aatgagcacactcacaatcagcaacaacagcagaggagggcgtatatgcagatcaattcccattttattgcctctcccaattcgcgaatctcaaataatcttttttatgatgttccataaaatttgattgtttc

SEQ ID NO: 94404 - DNA, 77 bp, Heterodera glycines
  SCN-specific regions: Sequence locations=1-77
ccaaaccaaattaaccaaaccgcacacaatgttcacattcagtaacggttgcttacaacgaaaaacaataacatcgc

SEQ ID NO: 94405 - DNA, 5 bp, Heterodera glycines
  SCN-specific regions: Sequence locations=1-5
aaaaa

SEQ ID NO: 94406 - DNA, 293 bp, Heterodera glycines
  misc_feature (278)..(280): n is a, c, g, or t
  misc_feature (282)..(285): n is a, c, g, or t
  misc_feature (288)..(290): n is a, c, g, or t
  misc_feature (292)..(292): n is a, c, g, or t
  SCN-specific regions: Sequence locations=1-125,149-178,201-293
gtgaacattctgttgaagtgaccgatttgttttgaagcgctttcttttcggactgtcatgaacaaacccattttaccgttgaaaattgtggtgacgtgttaaattccatttattattagtttattattaaacattttacaattagcaggaaatgattcctaaaattggtgttaaattgatgttattcactgttctgatttggttgcttcttatttttccggcatttgtaattcgcttgaaggcatttttctcattgtaccataaataccatctcatannnannnnaannnana

SEQ ID NO: 94407 - DNA, 73 bp, Heterodera glycines
  SCN-specific regions: Sequence locations=1-2,32-73
accatttttaaaataaaatttttcaaatttgttaaatcagattaaattggatttaacggctaaaaaaaaaaaa

SEQ ID NO: 94408 - DNA, 491 bp, Heterodera glycines
  SCN-specific regions: Sequence locations=1-105,128-301,340-491
tctgataaaagttccttccgtgcttttctccgatgagcagaaaccaaaccaagcaccccaaagtgaataattaaatgcacaaaacaaatggattaataaggttgcaattaattatttataaataattcgggcagccaaatggacaaaaacggggggggggggaattagacaaattaagcaaaaagcgactgatatttgcatggactgacaaatgagtgcggtaaatgggcgagaaaggaatgacggatggatgataataaacaaattggcattcactgaaacattccattcattcgtcagcatttaaaaatgttttaatttaaattaatttataattaacaggcgcaatttattatttgattttattaaaaacaaaacaaaaaaacatgctgagtaaagcgcgcatcattgtggaacagagcagttcaaaatttttgtcattttattataaaatgccacttatgtttctacctctttttaggcaacccctt

SEQ ID NO: 94409 - DNA, 263 bp, Heterodera glycines
  SCN-specific regions: Sequence locations=1-163,185-263
aatctaataagtctaaatctaagttttcgagttaaaaaatggtccgccaacgcttccatataacatttgtttcatgtccaattcatccatatatagacctactcacgcacacagaaaaattaaattttagcacagaaaaatgaatctatgggtaagttcgatataaatgagaagatatgcaaggtaacaaataaataatttttttttgaccgtaaaataggtaggtaatttgaatttggcgctattaaatgtgatttatttat

SEQ ID NO: 94410 - DNA, 172 bp, Heterodera glycines; identical to SEQ ID NO: 65679
  SCN-specific regions: Sequence locations=1-94,116-172

SEQ ID NO: 94411 - DNA, 386 bp, Heterodera glycines
  SCN-specific regions: Sequence locations=1-128,243-337
aaaagtaaatcctctttaaaaatgaaattttcaacaattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaagaaggaaaagagaggaagtggaggtgatgattagaagccatagctaaaaagaagaagcataatatggaactaagaaaagaacgagcacacaatgcttttagtcgcttattttttgctgcatttaaaatgttaaattttaaaaataaaaataaatttttgtatttttta

SEQ ID NO: 94412 - DNA, 510 bp, Heterodera glycines
  SCN-specific regions: Sequence locations=31-47,82-94,122-165,208 -254,373-510
tccctccgaagtttcccccaggatagctggagctcgttaagcagctatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatgaatgagcgctgaggaggccaaggagaaatacattgagacacttttggaaaaatttgacgatgctgggactcaggtggacatttcggattggctgtccaaaattgacccgtcaatcagaaccaatttggcgctgctcggcaaa

SEQ ID NO: 94413 - DNA, 367 bp, Heterodera glycines
  SCN-specific regions: Sequence locations=1-31,71-267,290-367
agattttgcacgggccaacacattgaacattcaccagcgcattcacaccggagaaaagccataccaatgtcacttatgtgacgctcgttttacgcaggatggccaactgaagacgcacattttgattcacacgggtgaaaagccgtacaaatgcacttattgtccccaaaaatttacacgtgctggcaatttgataacccatcttcgtcgccacaccgaaaagaagccgttcatgtgttcccattgtggcaaacaatttgcagagtcaagcaatctgcaaattcatctgcttacacactacagaaaacgtaaagcaaacggacaattgagcaacagaatgaatgaattagtgcccccaaaaaatggc

SEQ ID NO: 94414 - DNA, 367 bp, Heterodera glycines
  SCN-specific regions: Sequence locations=1-367
cccgttacttgtagcaccgtttcggcttcaaaagctccggatgtttctcatgcggttcgtttgacggttcccgaagtccaggccaaacagcgtccagtcagtcgtcgttcgttgtcgcaagtgcgcgagcaaacctcagcgatcgttcagccaccgatgcgttttggaaacacttcgcgccgaaccgtcatctcaaaagggaccagcaacgaaggcatgactgtcagcagcggtcccgttactcgtagcaccgtttcggctgccaaggcttcgggtgtttctcatgcggttcgtgggatttgcgtggtgcgcaatatgccgactaacaataagaagcaacagacgaaagataagcagtgatcggaga

SEQ ID NO: 94415 - DNA, 503 bp, Heterodera glycines
  SCN-specific regions: Sequence locations=1-130,152-396,418-503
gcagcgcagcgtgcacgcagcatgcaacgccaaacgcaaaatgccgcagcacgacaaccaagtcgcgcacagcggcaatccgctgaagaacggcatggaagcagttcacgtgaatctaatataaatgccaaattggaaaaaattgaccaaatgtttgagcaaggtatagcactggaagtaattgaacgaacagtaaatgttccaactgttgaattgaaatgccgttttgcacgactttatttaatgaaagcattcgctttaccaaaagaggaatggaaaaagcatggtgtaattgataaaggtattggtttcgctaatgaggcgcttgcaattgacccaactcataatgatgccttaaaatatttatgcatgttaatgggactcaaaattggccaaatgcaaaaatctttaacaaatgcgaaaaaaatagttcaacttacagtggaattagataaattgttgcaacgagctgatcagcatgatcctgaaatacttcatgcaca

SEQ ID NO: 94416 - DNA, 79 bp, Heterodera glycines
  misc_feature (41)..(41): n is a, c, g, or t
  misc_feature (63)..(63): n is a, c, g, or t
  SCN-specific regions: Sequence locations=1-79
acggacttcacaattaatattgtcagggtttttattctttnggaaattttatgtaaataaatnttgatgaatggaactc

SEQ ID NO: 94417 - DNA, 293 bp, Heterodera glycines
  SCN-specific regions: Sequence locations=1-293
atcagattcggcttattgatgaaccttttgttggacaccttgaatgttgcttctgaactgattgaaacattcgcaatggctgatatttttttcccatctgaacattctttttgctctcccggtgccgtggtcggcgctttgttgaatcggtagcgaaatataaatggccgaaaatgactcctttgttataacattgttaaattaatatttgtttattaaacaggtgtcacagaatgccatttcttggcaacaaatttacaattttatgacagaatctgtataaaattttatta

SEQ ID NO: 94418 - DNA, 152 bp, Heterodera glycines
  SCN-specific regions: Sequence locations=1-52,77-78
gatgcattttcaaattaggaaatcaaattgaagacggaggattttcacccaattttccattgtcttattgttttttccatatttatatttatgctttttcaataaataaaatattaatattaaaaaaaaaaaaaaaaaaaaaaaaaaaaaaa

SEQ ID NO: 94419 - DNA, 309 bp, Heterodera glycines
  SCN-specific regions: Sequence locations=1-83,105-309
ggactgataaatgcggcgctttacttggcgtggcttgaagcgatgagcgccgaattgccgcccacgctgatgctgcggggcaaccagcaatctgtgctcactttttattcataaaacggacaaaggcgaaggaatggatggaattgtgaagccattggattaaaagattgatgtaaaataaacacatcatactcaaattgtttttcaataataataatttcgaattttaacattgtttttttatttctcactttatacaattgtattttaattttaatttcacagttaaaataaaaacaaaaaattttc

SEQ ID NO: 94420 - DNA, 552 bp, Heterodera glycines
  SCN-specific regions: Sequence locations=1-348,373-552
gaaccgttgctgcaagcgaaggaaaattacgttcgacagggggcgttggtttccctcgcttttgtcctcattcaacaaacgacatcgacctgcccaaaagtcgcagactttcgaaaaactttgattaaagtggttggagagaagggagaagacacaataacaaagttcggtgccgttgttgcacagggcatattggacgcgggcggtcgtaacgtcactctttcgctgcacaaccagaacaaccaaaacgacatgccgtctgtattggggatttttgtgtttttgcaacattggcattggcactcgatgactcatttcatttcattggcacttcgtcctacttgtgtgattggcctcaacaaggatttaaaaatgccaaaaatggacttccgctgcaatgccaagcagtcgatgttcgcatatccgcaaccaattgaagaaaaacgcaaagaaaggatggaaaaggtggaaacggcagttctctcgaccacaaaaaagaaagcgaattttggacagaaagcagaagatgccgacggaaaagccgaagagaaa

SEQ ID NO: 94421 - DNA, 483 bp, Heterodera glycines
  SCN-specific regions: Sequence locations=1-323,360-483
gcggaagagttggggaagacgcaccgcattttggcgcaattttttggatttaaatttttttccgaaaattccgaaaaaaccaacaaattttccaccccctcgtcttccgtgcaaaaatacggtctaaaataatatattgctgatgaatgaattttatgcgttttaatcattctttttttgccattttgatcagtagttggaccacatgggcttgcgaatccatcgcagacggaggccactgttcgtccgaattttgatggacgcggcctccgctgcccgtacagtgtccttgaccgactgcatcaaattctgcgcgttcagcaccagctgctccatggcctcctcgtcctcctctgtcccatccattggctcccatcaattaatcaatcctccaattattttcctgagaattaaaatttttctttttattttctttaaatttcggcacaatgaatccatcgatggatggcacggaacagccga

SEQ ID NO: 94422 - DNA, 145 bp, Heterodera glycines
  SCN-specific regions: Sequence locations=1-145
ttttgctgaggttccctcccatttccggtcaaattggtcaagctaccaagtcgaacttctcgctttgctcatcatttttgtttatgcgctgaattacgcttacggaaagtccaaaaaccattccattgctcacaaatggttcatg

SEQ ID NO: 94423 - DNA, 367 bp, Heterodera glycines
  SCN-specific regions: Sequence locations=1-237,261-367
tccaccgtttccgcgtccaattcgtcctcctcgttgcagataatgtaaatttgttgtcggatttcagttccgtgcaccgaaaaaaccctatcgaaagtgacactgtaattctggcggagcatttccagcactgttaagtccgctatttctgtcgcataaattactcccaattcgtccattctttcttctccattcgatggcccttctgttttcctccatttacctcctctccatttcgtccatatcttttcctcttttcctaagctaatttcaactaatttcgctctctctttctttctctttctctcgtttttgtttcacattgtaaatgagtttaataaattaaaagagtgaatttggcaaaaaa

SEQ ID NO: 94424 - DNA, 325 bp, Heterodera glycines
  SCN-specific regions: Sequence locations=1-325
cgatcatttacaatacttatacttttgtgctgttttctttctgtactcagatggcatgcgcaattgttgtcgtgcctgccgccttcggcgctgttttgaggccggcatgcgactcgatttggccccaaatgcccacggcaacgattggccttacgctgagcttaagtccgccgtctcctcggccaattttctcgagaggccacggccaacaaagcgtgccattagcgatgccattatcagtgccattccgacgacttctttcctcagcagtccctctgcctttgatgctggcttattgttatcgcctctgccggtcactaatcga

SEQ ID NO: 94425 - DNA, 81 bp, Heterodera glycines
  misc_feature (76)..(76): n is a, c, g, or t
  SCN-specific regions: Sequence locations=1-7,29-81
cggacaaatgatgaaaatgattaaatatccattcaattgtttcccaacgaagagtaaccaaaagactaaaatcgcnaaaaa

SEQ ID NO: 94426 - DNA, 94 bp, Heterodera glycines
  SCN-specific regions: Sequence locations=1-34
attcatcggctcgtcatttcttttcaaatgtttgtaaatataaacaattcatttttcaatataaaataataatttaaaaaaaaaaaaaaaaaaa

SEQ ID NO: 94427 - DNA, 405 bp, Heterodera glycines
  SCN-specific regions: Sequence locations=1-405
agtgcaaagcagccgttgtttctgacctggcgcaaccccgaactgttggcccacctgacaatgccatgccatcagctcattttcaaatgcggcgatgacatgcgtcaggacatgctaacattgcacgtcatgcgaataatggacgcaaaatggaaaagccaattacagcaggacttttgcatgacattgtacgaagtgttgccgatgggcaaaaatattgggttgatccacgttgtgcccgactgtcaaactctgttccaaattcaatgcgaatcgaagcgcaaatacaccggcacatcactgaacatggaggtggacttgttgaacaagcacatctacaagaagtgttgtgctaacgacagcaagaagtatttggagtgcgtcgatcggttcaccttttccctg

SEQ ID NO: 94428 - DNA, 300 bp, Heterodera glycines
  SCN-specific regions: Sequence locations=1-300
tgaccgtattcagtcaaatgtgttccgttatatgggcaacaacatgttggcctatcggtcatgtgacgaattggcggagcttaacttgcgcatgtggatgtcctgttgtgatgaaacttgctcagcacgtgcgtcgactggcattgacagtgccaatgatgggaatgagcaaagcagaaggcgtaagcgcgctgttcatctatatgcaaatgggaataattaattggaaaatatgcacaactaaaaagatcaattctaccataaattgttgctttaaatgatgtttgatttacatttaca

SEQ ID NO: 94429 - DNA, 459 bp, Heterodera glycines
  SCN-specific regions: Sequence locations=1-459
aacactatgggcggaatgccaacacttcaagcccaaccgaatgccatgggcggaatgccaatgtattatgccgtacagcaacagcagccatatgcccaactgcagtttgtttcccagcagcagccggcgacggtaagacttggcactccatcggcgtcagtaaagcctggcactaatcaacccatgatgcccatctcacccacacaatcagtgctggtacggattctcaaaaaacgcgaaaacatggacgaaaatccatgccctccgctgagttcgccggccgacgatttgaccgtgcatattggtaacagagaggttactgtgtctgctgcttggcttatgtgccaatcgccgatggtccgtcaaatgctcagcgtggaaatgaaggaaaagcagcagcgatcgctcacattgaacgaattgggcatcgacatggagcagttcatggattttttggag

SEQ ID NO: 94430 - DNA, 469 bp, Heterodera glycines
  SCN-specific regions: Sequence locations=1-469
tacgatctagccaaaacagtcactgataatagatttgatcttgtgttacacaagccagaacattttgtcaacgccgaaacagatttgtggatgggcaacatctgggctgatctcacaaaaatagaaccaagttcaaccaaagataaagttggaggtatgcgtcgtatgtgtggatctatccctttgtttaccaatagcctcgagcacttgctttacctgatatttaatcgctacgacagacacgagtttcaacaagggatgtttctagtcaaagctgaatttgggcaagattggttcactcctattatgcagcaccctcattgtatactccgtcaacctgtgcgacaagtggcgcttagaagaaacagcactgcaggcacagagtacaagaatcttacacctaatgtacaccaatcattcgtattgttttacttgggacctaatgttccgcaattctgcgctacgtttt

SEQ ID NO: 94431 - DNA, 259 bp, Heterodera glycines
  SCN-specific regions: Sequence locations=1-112,134-259
atcgacttaattttgccgtgcattttctttttgcttcgtccattatttgattttcccaccgattgtcctatcagaagacgaaaaaccgaacaatgcttccgccagactcagagaaagggttcaacttcagaaagcccgcagggggcacacaaccgtcggcagaatcactcagcactattcaaaaagtgatcagatacgccgagaaagacgacctcttactttacgtaacagcagcatttggcatctttatgcccgcggt

SEQ ID NO: 94432 - DNA, 393 bp, Heterodera glycines
  SCN-specific regions: Sequence locations=1-393
tttcgtcccatgcttccgactccgacccatctgttcgtttttatcgtattttttctcaaaatctatctgttgtcggcccgggtttgggctcgtagtcaatgcgttttggcccgtgggcgcgtcatttgtcccactgaccccgacagccatttcaacgtgcaaattgagttgatggacagcgatgcattgccatgggaaacggacgatgtgatgggcagtgccaccactgatttgcttggaaatttctctgtgcgcggctgcgccagtgattccggcctttggaacgatccggacccttaccttctgatcactcaccgatgtccccaaatgggccacgacatttcggtggtcaaacgaaagcacagaattccgatcgaccgaatttatctgccg

SEQ ID NO: 94433 - DNA, 204 bp, Heterodera glycines
  SCN-specific regions: Sequence locations=1-89,112-129,155-176
aaacgaaggactgaccattcaggcgaagcaggagctgcacaaaatgtgcgagcagaacagaagttactcgagcatgaagaaattctgactgtttttctttgttttgtgatttggtctaaatttgatccgtttttattttatttatttattttttggtcgcttttccttccatttccttttaaatattaatttatttgttaaaaa

SEQ ID NO: 94434 - DNA, 426 bp, Heterodera glycines
  SCN-specific regions: Sequence locations=1-2,24-426
ttctttgctccttttccttctcccctcggctcttttcgctgatggcttttcgtcgtctggccaaagagttgttttggcccgggtgatcattttcaaagcatccgaaaagcaggggacgattgcttctcaacagtgtggtcgggagggcattggtcgtacatgagaaggcggacgacatgggcaaggggggcaatgaggagagtgggaagacgggcaatgcgggaaaacggatcgcatgcggagtggtgggagtgatcagagaggaaccaatgaaagtgaccactgatcagaccaacggaatgtgaaaacagcgatcagcagaggaattcatggacaatgaagaaatgcaatgcattgagtgttctattatttacgtcttttaattcatataacttatggaaataaagagcaaagttttgttaaaaa

SEQ ID NO: 94435 - DNA, 491 bp, Heterodera glycines
  SCN-specific regions: Sequence locations=1-399,422-491
cgctggaccaagtgaacggactgccggacatggtcttcgcctgcaacagcggccttttctaccgcaataagctttacctttcccactttcgccacgctcaacgaatcggagagcagcggcacttcgccgacttttacaaagggctcggcttggagctgtacggcgccgattgcgcggaagtattcgaaggcggcggcgatgcgtttttctccgacgagcgaacgctttgggccggctggggagggccgaggacgaacagaaaggcctacgaacacatccgaaagatgggcgacttcgaaacagtgccctgcgaattggtcgacccgcgcttttaccatttggacacgtgcctttgcccggttggcattgactcggcgctttggttccctcccgctttttctgagaaaccaaaaaagaagcctacggcgtttgccgcgggcgatcgcagtttcggagaagaagcaatgacgtttgtgtgcaatgccatcaca

SEQ ID NO: 94436 - DNA, 446 bp, Heterodera glycines
  SCN-specific regions: Sequence locations=1-90,113-446
ctccaatatttgggtgaaaaatttggtttggtgaacgaaacggccgaggaaaaggccatttgtgcgatgttggcacaacgcatcaacgaccattttgaatatttgaagccttacgttaattgccttctcggccttatcccggcgaacaaattgcctgcgttggctgagaaatgccttcggccgtgcataacggaggattttgggccaatgtttgagcggcaattggaggccaataacacagggtatttggtgggcgacaaactcacctgggtggacttttacgtggcgagttttgccgacttggcacttacatttggccgattcgacatcctcgaccgattcccccgcgttttgcaccactgccgcgcggtgttttcacttccgcaactccaacagcacatcaagaacagaccggacactctcttctgatggttggcgtaacaaaa

SEQ ID NO: 94437 - DNA, 525 bp, Heterodera glycines
  SCN-specific regions: Sequence locations=1-210,240-453,475-525
agcctaaaaatgcaaatttcgtgccgccgcagggcactgttgcgcagtgccattgcagcggtgggagagagttttcgaatagttgaggttggcgcaagagatggtctccaaaatgagcagaaaattgttccaacagcgaccaaagtgactttgatcgacagactcagcgattgtgggctcaaaaccatcgaagcgacaagttttgtgtcgcccaaatgggtcccacagatggccgaccatgccgaagtgatcagtcgctgcaaaaaatttgccggcgtcagctatcccgtgctggtgccgaacctcgccgggcttcacaatgcgatcaaaaatgggaatgtgcgtgaaattgccgtttttcgtgccgcgtcggacgcattcacaaggaagaatttgaactgttctcgggaggaaggagaacggagagttggggaagtgacggaaggggccgtggccaacggactgcgagtgatccgctgtccttacgagggccaaattaaagcgaacacagttgccgctatggct

SEQ ID NO: 94438 - DNA, 476 bp, Heterodera glycines
  SCN-specific regions: Sequence locations=1-95,121-476
gtcgaaactgaaagtgctctcctcctccgccgacttttcttcgttcctttttttggcccttctcttcgatttctccttctctcagcccaccattcaacaaaaatccatccaggaattgttgaacacgccgacgttcttaccaactgccgagaaacacgactacttcgtcgccccttttctacaacagcagaaacaacgttggctgtccgtccgacccttccaagaatttagaagaagtccccaaacggccgaccttggactcctgttgcaatatttggacaacaaacggaatgctccgtcgctaatggaagatgagggaaatgggagacacggcataagcgggtcccctctgggcacaatgcgattcggcaagcgaacgttcaactcgccattgggcacaatgcgattcggcaagagggaatacaacaaatctccgcctggcacaatgcgatttgggtgagaaaagtgacgacaga

SEQ ID NO: 94439 - DNA, 435 bp, Heterodera glycines
  SCN-specific regions: Sequence locations=1-186,213-435
ggttgacaggtctaaaggaatacaaagataagaaattgagcctggccaataaaatttatcattatcagaaaatatgtcaaaatgagcgaaataattggaaaagggtaaataaaaagaataaaaacaaaaacagcggaggctaattatcgatcgtttgttgtttgtttgtacgctttcattgagggggacagagaaagaaagaaagaaaagccgaggcgaagcgaagtgagcaaaaaatgtgcaatttgtgcacggagcggaagaaattggaggagataagggaaaccaaatgaaaacagatggaggccgagagtgaggagatgtttggtttccaagcagaaatgaatgacgaatgctttgggaatcaaaaagagacggaaaattgctttttgtgggccaaaaatgtatacttttttgaattaaaggatttgccac

SEQ ID NO: 94440 - DNA, 398 bp, Heterodera glycines
  SCN-specific regions: Sequence locations=1-398
cgaagcactgggaggaggacgaagaggccaatcgcaggacgagcagcaacaaatggagcggcagtggtcatcgggggccaaaaagtattcacttggccgctgacagccgaagtgatcggaatgatcagtcatcagcagcaagagtggccagcttgtggttgatcaacagcagggaggggaggaagcctgatgggattatcttttgatcagttcggcacacgccgattgattaattgatcgatcgacgaatcgcctataaaacgccggctttctctgatccgggcagaagcgaatgcgactggcagaaacacacttgatcgaattgtggagctcgacgtgtgtagctgtggcagacgatctgataggtggccaagtgatcaacttcacacagtcattac

SEQ ID NO: 94441 - DNA, 339 bp, Heterodera glycines
  SCN-specific regions: Sequence locations=1-40,63-339
ggataattattatgtctcccgctaagccctttctgctgatgcttttcctctgctgcttttttggctttccattggcctccaaagacggacttttgaaggaggaaattgcccaacacgaggacaaaaaaattgctgcgatgcttttggatgtttttctgaacggttggagagaatgcatcgactggaaaagaggggaaccgtcaattcgctgtgtgccctttccggagaagaaaccggaaaaatgtgcaaaaaatatgtgggaaaacgcgatggaaaatgttagaaacggaaaaataaagaaatgctaaataggaaagaaaaggataaaatgagaagcga

SEQ ID NO: 94442 - DNA, 479 bp, Heterodera glycines
  SCN-specific regions: Sequence locations=1-479
caacaaactgatggacaaatgccacgggtcgctgtcactaccgcaagtcaccacaccgaattggtgcaaaaggcattggacgcgttggtcgaggggaaactgatcagcgaaattgaacgcgtgggaggcgcgggctttaaagtgttgcgctgtttggagggggccactgcttacgtttttgcctcgaggggctgcaaaaaatgggacaccgccgcacccgaggctttgttactcgctgctggtggaactttatcggatatgtccggccgactgattaattacggcccctccgtacagttgataaacagcgggggagtgctcgcgaccgccccgggcgtcgaccaccaaagtttcgttgccgccatcccccaacttgtgaaggaatcgctgccagaaacagaaattgttggtctgtgaataccaatttgacagtgttgtgacatctccacctccgtccgggttcccttcccattttgata

SEQ ID NO: 94443 - DNA, 499 bp, Heterodera glycines
  SCN-specific regions: Sequence locations=1-181,212-247,269-499
ttaataaccattgtaccccgatgaatgcaggcagcatcgacaatgatcatgatcattaccataattccatcaaaaattcttccccgaaattatcatatgactccgtgaattgttggagtatggaaagcgaagggagctctgtcaacaacgatgagaatccgaatccggaaatggatgatgaaatgatggaagaagaggcagcgcatcatgaggacgatcagctggtgttaggcagtgataggacgaacaggaggaccccaaggactacagaaaaggtggctaccaccctgtgcagatcggcgatgtgttcaaaaatggccgataccacgtcatccgcaaattgggatggggtcatttctccaccgtttggcttagttgggacatcgaaataaagcgattcgtggcaatgaaaatagtcaaatcggctgagcattacacagaagcggcattggacgaaataaaactgctcgaatgtgtgcgggactcggacccaaccgac

SEQ ID NO: 94444 - DNA, 517 bp, Heterodera glycines
  SCN-specific regions: Sequence locations=1-468,490-517
tagaaactgtgagcaaagtgcaaaaattttgagtttggctggagccacgtgcacgggcaagacgagtttggccaattcactggtggaggagctgaggcggtgcggtctttccgttcgactgattggccaagaccgtttctacaaaaccaaagaaattgtgcgtacattggccaatgccgaggacccctccatcactttctacgattacgaccaaaccgacgccttgaatgagcatttgatattggatgaaattgccagcgcttcgaaagaccccgaattggatgcattgataatggaaggaaatatgctcactgacctcgacgccatccgctgggccgactgcacagttttcctcaccattgacaaggagagctgtcgtcagagacgcgtccttcgcacctacgacccaccggacgaaattgggtactttgaccaagtcgtttggccagcgtatgaacgaacgctgcaaaaagcaaaagaatttaaagagacatcgacgaggccattagcatttgtc

SEQ ID NO: 94445 - DNA, 121 bp, Heterodera glycines
  misc_feature (86)..(90): n is a, c, g, or t
  SCN-specific regions: Sequence locations=1-32,66-83
aaatgcggctactttttgtgcggaaataagcaaatgtaatgttgttgtttttgatttttgagacataaaattgtgtatgaggtaannnnnaaaaaaaaaaaaaaaaaaaaaaaaaaaaaaa

SEQ ID NO: 94446 - DNA, 51 bp, Heterodera glycines
  SCN-specific regions: Sequence locations=1-51
aaaaaaaaaaaaaaaaaaactctgacaaagaaaccactgactttaataaaa

SEQ ID NO: 94447 - DNA, 485 bp, Heterodera glycines
  SCN-specific regions: Sequence locations=1-2,24-408,441-485
atcattcctagctgcttttggtttgatcacaaatgttcgtccaactcgtcctccttgccatcgttggcattacttttgtcgatgctgccgcaccgccgttcggccaattgtccctcaaaggcaccaattttggtcggctcaaacggcaaaaccggtgcagctgatcgggaattccttggtctgggaaccaccggtacccacaattttgaatgcccaaacagtgaaagggcctcaaatggcattggaattccaatgggctgcgccccccaattggcggggaaaaagggcggctatttgggtgtccggaaacccccccaacccacttgacggcacttggatttgagggcgccttttccaggggattttactgtatccccaatttgccacgcccttaacccaaaccgggaaaagggattttattttttccccaaaatttcaaaggggtggggctccaccccctttttgtttttaaaaaaagttttaag

SEQ ID NO: 94448 - DNA, 211 bp, Heterodera glycines
  misc_feature (188)..(188): n is a, c, g, or t
  SCN-specific regions: Sequence locations=1-211
aaaaattatttcatcaatgtcctttttactttttgtgactattgcttttgccaatttggcaccaaatgcttttggccagcaatggccaaaagcaacaagtgatgaaacggttccggcaacaattgttgtgacgggaggctccagagactttggctacaaacggttgaccgcctcttctgcgttgggcnaccggtgatcagttcggagggcc

SEQ ID NO: 94449 - DNA, 408 bp, Heterodera glycines
  misc_feature (90)..(92): n is a, c, g, or t
  SCN-specific regions: Sequence locations=1-27,99-105,128-132,154-408
catttattgttgattttgatgtttgttgataataaatgttttaatttgaaaaaaaaaaaaaaaaaaaaaaaaaaaaaaaaaaaaaaaggnnngaaaaacaacccctttaattaaaaaaaaaaaaaaagaaggccccccgcgtttgttcccccctgttttacaaaaaaaataaaaaggcggcctttctaaaggatccaagtttactaactcgggtgtgcgacgttatacttcttctatagggaaaaaaaattcaattcccggacctactttttaaaacgtcagaactggaaaaccccgggggttaccaaattaaatagctttgaacaaatcccccttttcaccagttggggaaataacaagaagagccgaaccgaccctctttccaaaaatttacccaccctgaagggg

SEQ ID NO: 94450 - DNA, 367 bp, Heterodera glycines
  SCN-specific regions: Sequence locations=1-222,247-270,292-367
tttaattaattgtcgacaattaaaaatgtcctccccctctccccgttttcacatccttcttctgttggtcatctgctgcttttcagcctttttgtgtttggcattggcccacgttgttggcgaaagtcaaattgacacaactggtattcgcgctcgtcgccaatattatgaccaatggggcaactattggagcggtggcaataccaattggtggaactggagaaagaaataaatggaagagaatgggcgacgaagtgatcactaatgatcaaataaaaacattaaataaaatttaacacttttttgcaacttttaattagttcaatacaatgaattaactcaattctacagtatgcttaaatttatg

SEQ ID NO: 94451 - DNA, 498 bp, Heterodera glycines
  SCN-specific regions: Sequence locations=1-37,85-103,172-498
gttagttttaccctactaaagacctgttgctatgatagtaatcctgcttagtacgagaggaaccgcaggttcagacatttggttcatgtgcttggtcgatggaccaatggtgcgaagctaccatctgagggattatgactgaacgcctctaagtcagaatcccgcctaggcaagatagcaatattcttgctccccggtgtcgggaggcactacttatgcgcctaccgactgacggcagctgtgattgaggcggccattgcacagggcatttacgtgatcgtcgattggcacgcgcatgagccgaacgaggacaaggcgattgaattcttcaccaaaattgcgaaagcgtacggctccaaccctcacttgctttacgaaacgtttaacgagccattggatgtgtcttggaacgatgtgcttgtcccttaccataaaaagggtatttctgcaattcgtgccatcgacaaaaagaatgtgatcattctcggcactcccaat

SEQ ID NO: 94452 - DNA, 303 bp, Heterodera glycines
  SCN-specific regions: Sequence locations=1-269,291-303
ccaatggaatcgtcgtcgaaccggcgtgaagaatttttggaaatagaactcaaaaaggtccgtgaagaattggcggagtacaaacggagggaaatgtgtgccatcaccacgcccaaaaagaaaggaatacttaaaaaaaggccctccgctgaatatcgaccgtatgttttcgacaatttccacccaaaacatcgtcgaaacaaagccgagccgacttcctcctccactgccgcactggacatttttgacggtcagcaggacaatgccaacccaacaacaacaacgcttggctcgtactatgat

SEQ ID NO: 94453 - DNA, 530 bp, Heterodera glycines
  SCN-specific regions: Sequence locations=1-8,30-82,123-530
taaatcctctttaaaaatgaaactttcaataattttattgctttccttggccttttgtgcgttaatcatcgatgcatgtgagaaaaaattaatataatgaattatttttaatattttaaatagatccatcgggaaatggtaaagatcttgaagctgacaacgaaagcttatgccctttttgccaacggttcatcagagacacactgttcaatgcgtacaatcgcttcagaacacacattaaattggagctggtcccttatggaaacgcaaaaacgaatggtactcatttcacgtgtcaacatggcacagaagaatgccgaataaacaaatttgaatcttgtgccatcaattacatgaatgacccaatgccttttgtgtactgtttggagacgttactttatgaaaatgtgaaatttgatgacgcaacgaaactttgcttcgatttgatcaatcctggaaaatttgtgcttgatcggatcacgcaatgttttgacggatcggaaggcatccttttgcaaaatttagctgca

SEQ ID NO: 94454 - DNA, 263 bp, Heterodera glycines
  SCN-specific regions: Sequence locations=1-263
taatgcccgagaacccaacaaacacttcggaccaccagcgtttggaggaaatgttgtgccacttaaccccgcacggtgcggcggtgccgtacaatgtctgttttgattccgaccattgcctttgggttgcgtcaaaaaggagcctttttaattcgttgtcgggtctcctggaatcagtccaacttgtttttccttttaaaatgaattccccgagaaaatgggacataccctcaggtttttattttaactccaacattatattc

SEQ ID NO: 94455 - DNA, 51 bp, Heterodera glycines
  SCN-specific regions: Sequence locations=1-51
aattaataaaacttccaaaattttatatcttacatcaaaaaaaaaaaaaaa

SEQ ID NO: 94456 - DNA, 526 bp, Heterodera glycines
  SCN-specific regions: Sequence locations=1-228,250-483,505-526
ctgatctcttcggtgctgtgatcacccaacttggattgttggatatgctgcgcttcaacaaattaggcattggctcagattgggtgtcggagtacggcgacccggacaatgccacagacttttcgtacatttacaagtattcgccgcttcagcagctcagcgtcactcccgggaagcagtggccggcgactcttttgctctcggctgaccatgacgatcttgttgatgtgtctcacacactcaaatatacggcacaactgtatcatttgttgcgcaccaatgctgagagttggcagcgcaaccccgtggtggcaaagattttggtggaccaagggcacgcgttcaccggcacaccgaccgagaaaaaaatcaaagagaaggttgacatttacactttcatcgcgcgagcgcttgggctgaaatggaccgaatgattaagaacaaatccatctgtgtgatcactgatcagatcattatcgatgcaatatttttaggattttcttttcataaatttgcattccataca

SEQ ID NO: 94457 - DNA, 243 bp, Heterodera glycines
  SCN-specific regions: Sequence locations=1-243
attatcaaagttctccgtgaagaaattgatgagcagcaccgagtgcacggaacgcgtgtcaaagtgtgacggatggccgaaccaccttgcgcctttcatgcaaatcaaaagttggcgttggttcatcggcgcttttctttatttggcgagcggattcggcattccgttctttgctgccgagttccaactcaagatttttttccactccccccgcgcggagaggaacacgatggttagatgaag

SEQ ID NO: 94458 - DNA, 258 bp, Heterodera glycines
  SCN-specific regions: Sequence locations=1-30,60-258
ttcatccacttttacattgatcagaaagcattgtgttgttgctgtttttgttgtgttgatcacttgctggaccaacaaaatcatctgctgcagatgatcccaaacacaatcgccggacagaaaaatgccaattaattttcccaatgataattaccaatattaattaattatacattgatgatgctcagaaaaccttttttttctttttcacaccgttagatttattcgaaaattttgtttttcctatattttaaattt

SEQ ID NO: 94459 - DNA, 264 bp, Heterodera glycines
  SCN-specific regions: Sequence locations=1-264
acgactactatagggggcgaggaaaagtgccgaaagggaggggaaacggagcaaaccgagcgaagcggaagccatatttttaccgatgacgaaaaaacatttgcctccggcgccgttcgaatacctttcgacgagtgaaagtgaaaatgaaatggaaaattgtggacaaacggaagcgtccaaattggcgcacaaattctccagcatattttatttgtcaccctcagaacgaatggcagccatttttttttttttccccccccc

SEQ ID NO: 94460 - DNA, 510 bp, Heterodera glycines
  SCN-specific regions: Sequence locations=1-510
ctcaacgagtaattttttgacttttttttgaaaatgaaattacattcggccactctttccaaaaggctctttttggccggtggtccttcgcccttctcgtcctccttttgctcgttttgttgtcgaattcgcttccgacccgtccactcattcccgccactctcagaatcggccgtttcttgcccaccgtcgtctgcctttttctgttgtttctctgctgccgtgctcttcttctcgtcctccaaaatggtcagcacggcatcgggcaatctgaaaagtgagaaacaattggactagtcactcttgtaaccttttcttaattccgataaatgtttaatcgatgagaattcatactttatggccatgtgtcgaacatttcgccacgggtccgtctcaaatggctcttcctttggtgccgtcgttggtgtcgtccctccgccgccgtttgcgcttgtgccgttgtgtggaggtgccaatgtgctcagtttcttcgctatgctgaacagatga

SEQ ID NO: 94461 - DNA, 436 bp, Heterodera glycines
  SCN-specific regions: Sequence locations=1-436
gaaataacttcttgctgactgatcagcattttttgaggaaagctcaaacgattaaacattgaccaaggaattagagggactccctaacccgagtaggcgaataactgatgccatagattaatctccaaattggtagaggtttttgtttatccctgattttttgtgccccgaaggtcgaggatcagctctaatttgtattattaatactattttgatccacatttcctgctaaataattgatcagcaattgctaggaaaattccaacactttttcttttattttttcgttttactttgctggcaaatggttgaaatcgttcaggtccaattcgtgttgcgaatgcacgaaataaatgcgttcaatgtcccagatcacttcgtctcgaaagggatgttccaaccaatcacaatgtgcctgaaaaggcgtgcggataaa

SEQ ID NO: 94462 - DNA, 458 bp, Heterodera glycines
  SCN-specific regions: Sequence locations=1-458
cagttgatccaagtcgaagcagtcgagctcgacaaatttctcgatctcttgcaaaggttgaattatgcacaacaccccgaggcaactgcaggttttgccaatgcttttaagtataaacaaaaagcttttagcgattctcgtcattatacggaatatggaacccgacccggacccggctgttatgcgttccctgttgaggttcttgtttcttacacagccggacagggatttgttcacagttgatgctcttaaattgatcgttgattacagtgacaatattccaccaatgagcgattgcatcagcaaaatggtcaaacacgccattcacaatgacgaaattattgcgccatttggacaaacgaaattgggcaaggcacgtccaagggtgccggtggtggagaacattcttgaccatttggatcgttttcgaaggcattgtatcgacagagagtcaaaag

SEQ ID NO: 94463 - DNA, 389 bp, Heterodera glycines
  SCN-specific regions: Sequence locations=1-139,161-389
ttcgggagccattcaacaaaattttgaagcaaatggaaagtgtccaaaatcgtgtcccaattgtgtcaattgatattccttcgggtaaatttgaacaaccgacggatttgtttttaataaaaggtcaacccaaaggttgggacgtggagaaagggccccctgatgaaaagagcggtttgcccattctgagccctttgttttttatttcactgactgccccgaaacaatgcgcacaattttttaaaggagaatatcattttttgggaggccgttttgtgccacctgcgtaaacttttaacaattttttcttgtgaaattgaacatttaagcttggtacagaaattcggacttgaaaatatgccaccatatgaaggatcttcccaatttat

SEQ ID NO: 94464 - DNA, 261 bp, Heterodera glycines
  SCN-specific regions: Sequence locations=1-16,38-169,192-261
gttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtctcctgacagtacaaaccataaaaaagaccataaaaatgtttttttttaagccccacccagaacttatatatgagcaaggaaaaccgtcgccagacagtccaaagt

SEQ ID NO: 94465 - DNA, 297 bp, Heterodera glycines
  SCN-specific regions: Sequence locations=1-297
aaccaaacgtactcacgggcagtttggcatcaacccaaacatggccgtcaacagtggagcaagccgttggttcagcacgcgttgagtgaatcgtcaacttcttcactgcagcaagtccgtaattggaaaaagcccattgtccattcggcactaaatcttgaattctagcttcataaaggccatgttttcttgaaatttccttttacccctgacctttcttctctttctcttttttttgtttccgtttcgttttcactttgctttttctgtcctctgtgataaattatttttttggca

SEQ ID NO: 94466 - DNA, 405 bp, Heterodera glycines
  misc_feature (370)..(375): n is a, c, g, or t
  misc_feature (380)..(380): n is a, c, g, or t
  SCN-specific regions: Sequence locations=1-127,150-223,255-267,314 -328,350-375
aaccctttgccacattgatggtccaaatggagcaaacgccctgacgcttgcgcacctgcgtcgccggaggtgcgggcggaggagcgaactcgccaatattgccccgttcagctcgcatcggcggtggtccgccgcgctgctgctgctccggcgggtaataatcgccacctccgatgtcgggcgacgaccgttcacggtgagccgagtcctggaactgtggacgaccgccaccgcctcctccaccgccgcctccgtaagcgcgaggcgctcctccgcttccccctcctccatatcctccacctccccatcctccattccaaatcaattaataattgtaaacaatgcttttgtgttaaatgtgttttttctnnnnnnaaaanaaaaaaaaaaaaaaaaaaaaaaaaa

SEQ ID NO: 94467 - DNA, 469 bp, Heterodera glycines
  SCN-specific regions: Sequence locations=1-381,408-434,456-469
tgtacggctcgtcacgcattccccgtccggctgatctggcatccaacaattcatcccgtccggccagccgtgcatcagatatgggctccgactttggcaccaatggtggcgtcaccagcgcgacaccctcacgcattccggcaccgcgtgcccagcagcagaagggggtacgattcgcgagcggaacggggggcagcagtgacgggagtggccgtaatacgccttcggtcctctaatgaatgcgtgtgcggaatgatctggcggtgtcggaatgtttcacccgctaatgaccgcatcaattaacaaaaataaaaaataaatcaaataaaccaaattgtgtcatttgcgtgtcttaatcattattgtctaacactttctttttcaattactttttattccaatttgttcatgcctatcatcatttgttgtcactattattacattttattcatcgtttcatcaaattgag

SEQ ID NO: 94468 - DNA, 304 bp, Heterodera glycines
  SCN-specific regions: Sequence locations=1-304
tcctttacttcttcctcggcttgtttctcaccggcaatgactcgtctcgtggtgctggcgatgatgaccctttgttcgacccccgcgccaatccgaacataaaagtggccaaagaacggtgataaaacatacgagacaataatttattaatgggacactttttggtgaatcgactgttcaatatttattatatgtgaaaccaattatccttttgcttggacgtggggaacggatttgatccttttttaattgtgattttgccgtaatattttttgattagaaataaagagattgtgagtaaaaa

SEQ ID NO: 94469 - DNA, 390 bp, Heterodera glycines
  SCN-specific regions: Sequence locations=1-390
tttttcgccgaccaccgacacgtcgttggccaaatttgttgtcctctcaagcagatttccaactctgccttcttcttgctcaatctcggccattcgctgtgccgcattcgttcgcagcttttttgccgattcggcaagttcgtcgctgatcgcctccaatttggctgcctctgctgagtccataagtgggcgaaggctatttaagtcagaatttagctggccaaatgccgtcgtccatcgcgcatcaaagtcggaaattgccaatttaagtgcatcttttccaatgagatcattgtgcagtttgtgagctgtgtcctccaacagtgatcggagtgaatcagtgtccgcgtcaaaccgtgctttgagtgtttccttgcttcgtgcctgatc

SEQ ID NO: 94470 - DNA, 221 bp, Heterodera glycines
  SCN-specific regions: Sequence locations=1-11,35-142,164-200
aagagcgccttttgccgccgcctccgccgccgacaatctcaaaactgcacagaagctgcactgaagaatcatcggctcaaaattcggtcattctctactgagaaaggaaaagcgtagcgaaacgcaccaaatgcattcattcattttaattgtttcattttgcacattttccaactgacttgctcaagaataaagcacacattatttaaaaaaaaaaaaaa

SEQ ID NO: 94471 - DNA, 115 bp, Heterodera glycines
  SCN-specific regions: Sequence locations=1-46,68-71,95-115
tgaaatgcttaggggaatttcgagcaattatcaaatggattgttaattttatttgttattatattttggataaaactgagatttttaaaaattaagccgaaaaaaaaaaaaaaaa

SEQ ID NO: 94472 - DNA, 122 bp, Heterodera glycines
  SCN-specific regions: Sequence locations=1-57,79-122
attctttatattagcaataaaatatcatacaagcttatatatcatatgttatcatataagctttgtttataattttttcgctcttattacttattaattgaattattaattagaggtgaaaa

SEQ ID NO: 94473 - DNA, 320 bp, Heterodera glycines
  SCN-specific regions: Sequence locations=1-182,209-320
tgggcttggccctcgcaattgcattggcatgcgttttgccgagttccaaatgcaagttgcgctggcactgattgttcgccgtcttcgcttctctcccggcccaaacacaccggactcagaaatatccgcccaaattgctctcttcggaaatgcttcgcaccgaacaaccacttgttgtgctagcagaaaaaatttgaatttgaaaaaacagtctccatcaacaattattttcttcaacatttaattcgcccattttctctgtttaaaagggattgatcagtttttttttgtccggcgattcaataaatttataaatttaa

SEQ ID NO: 94474 - DNA, 511 bp, Heterodera glycines
  SCN-specific regions: Sequence locations=1-92,114-511
tacgaagcgagcacacagcctgacgacccctgcaacatccaatacacaagcggaacaaccggcaaaccgaagggggccacgctgactcaccacaacattttgaacaatgcctttttcgtggggcttcgcgccggttacgccaaccatcggacggtgatttgcatcccaaatccgctttaccactgcttcggctgtgtgatgggctctctcgccgcgctcgtccattttcagacgtgcgttttccccgccccttcttttgagcctctcgccgcgttgcaggccatccacgaggaaaggtgcactgctgtttatggcactccgacaatgtacatcaacatgatgagtcatgctgagtacccttcgttcgactactcatccatccgttcagggattgtagcaggcgcgccgtgccccgtcactctctgctccagattggtcaatgagttgggcatgaaggatcttcaagtgtgctatgggaccaccgaaacttcgcccgtttcgtttatgtcaa

SEQ ID NO: 94475 - DNA, 192 bp, Heterodera glycines
  SCN-specific regions: Sequence locations=1-147,186-192
ttaataatgccaacaaatgaaattgccattgtccaattcgactcccgacatgccttgaatgccctccactgatgtatggaaaaggcacgcgaatgattcaccaacggtcgacaacactttttggcatttgcgcaatacatttttgccaattttattacattaaaaacaaatttttaaaattaaatgaaagaa

SEQ ID NO: 94476 - DNA, 466 bp, Heterodera glycines
  SCN-specific regions: Sequence locations=1-36,58-146,168-250,288 -404,426-466
acaaaaaatcgcataataggcagtaattagtcatagattatatttttcgtttttattgcattttaaggatttcccaaattccttaataggcactaaaaatggcgaaataggcacaaaataggggtccaggcattaaccacaaaaagtccaaaataggcattataaaagacatcttagacaccccaaacaaagtataataaaatgcttttaactgcgcaggaattttaggcatttgcctaaaaaatgaagcattaataataattaaactaatgaatatttttaataaagcaattaaaaatactaaacgtccgtccctttcccccattcctctcccaattttcagttcgtctggttggtcgcctttttcggcaccgctttcctcaacattacgttcggcttggccctttctctgctgctctccttggccatgttcggccttcgcaaattgaatgacgccatcgccaca

SEQ ID NO: 94477 - DNA, 200 bp, Heterodera glycines
  SCN-specific regions: Sequence locations=1-14,36-200
tttgtttttattgcatttttgttaaggaattttccaaaaaatctcgaaatagtgtcaaaacgccaaaatagtgatttttcactattttagtgacaaaaccccaaaatagtgatttctagtgacgaaaagtgacgtccaaatgaaaaaattttaacgcagagatgcgttttttgagctcctttcttcaaaacaattgttgt

SEQ ID NO: 94478 - DNA, 383 bp, Heterodera glycines
  SCN-specific regions: Sequence locations=1-133,155-291,313-341,364-383
acgactggcgaaccaatgggttcttcccaagggtcactttctgcgacttgaaaacgcgcgacattggccaatttcgagagcacaccgtccaatgtgtgctaatgataaacatgttcgccgaaaagattttcatcttcctttggctttggttcttcgtctttttaattatcgcttctttgaatttgctgttttggacctatcagattctttcaatgcgcagcaaagaaagaatgataattgatgcacttaggcttcaaaacatccgcccaagccgacaaattgtaaaagtttttgtttacaaatttctcaaattggacggaattctcgtccttcgactgatcgactcaaacacaggacaaatccatatggcggacattgtccat

SEQ ID NO: 94479 - DNA, 462 bp, Heterodera glycines
  SCN-specific regions: Sequence locations=1-60,82-373,395-418,444-462
ggtgatggacatgctccgattccacaagtttactgtgggcagttattggatgaacgaatacggtgacccggagaagccggaggaatttgaatacatttacaaatattcaccattgcacaacatacgattgtctcgtggcactcaatggcccgcaacactgcttatgactgccgaccatgatgaccgggtggtgccaagtcatacgctaaaatatgccgcacaactctatcattacttgaagaagccggaggtgaaattaacccaacgaaagccggtgattgtccgcgttgaaaccgacgcgggccatggggcgggcaaacccagggacaaagtgattgatgaactgaccgatattatgagttttctgcagagagttattcagctaaaatggtacgacgattaatttcaaatgcggtactttaattgtttttaatttattttgtgcgaataaaaattgatttt

SEQ ID NO: 94480 - DNA, 486 bp, Heterodera glycines
  SCN-specific regions: Sequence locations=1-118,141-199,232-486
ggacagatgttcgctaccactccaaccccgtcatcccaaattcccacccatttgttgacaatgctcgcccgcaatctccgcataataaattgtgtgccaacaactccaaggatagatgttttctcgaccctcccctcctcccaaccataatcaattcctctccaaaaatttttgatgtcattgacagcggaggcgattgtaccaccaatcaacaacaacaccaccaccaaagacgctctttggccgttccccccgtcagtgagagacgaaaattttttgagagagtggcagaatataacacccttttttgagagggaaagacacgcaattcgatgactgatcattcattccacttgtccattcactaaaaactacctgtgcacagctcacatttcctttttgtttattaatttgtcgtaatggatgggcatacaatcaacatcaaaattgtgaattgagcatacttcaccaatgtgataaaatgac

SEQ ID NO: 94481 - DNA, 458 bp, Heterodera glycines
  SCN-specific regions: Sequence locations=1-458
atggccaaatcccaacgatggaaagtctcattgtcaggttgaactcgacacgggcgacgagcggccgatgatcgcttctcatgtgaagggaactctcgcttatttggctcccgaattcttgaccagtcgtattttgaccaccaaacccgacgtgtttggctttggtgttgaccttcttgaagtgtccaccggacaacgcgctttttctgtcagtcgcaacccacaaggaattgtcgaatttgtccttaaaatgtgcaccgaagcaaaacataaagatgatactaacttcaaaaacaaatgttattttgaattagcggacaaacgaacgcccaaaacggacgacgaaagaagtctgcttattttcaacaaattactttctgttggtatttcgtgcaccgaaaaggatcggtttgcaaggccaattttctcggagacttttgcccgattggatgacgaag

SEQ ID NO: 94482 - DNA, 269 bp, Heterodera glycines
  SCN-specific regions: Sequence locations=1-209,232-269
ggcgtggccaaaatgtcagtcggtcagcgggcgaagctgaccatcagcccggacatgggctacggagccaaaggaatccccggaacgatcccagggaattcgacgctcatcttcgacgtggaattgatagccgtaaaataatggagagaaatgacagtgatgaggggaaggaccgactaattgagccgcgcatttttttttactgccccgccctcattccgtttttctttgtgttcactaagtaaatgggctttcgaaaaaaaaaaaaa

SEQ ID NO: 94483 - DNA, 535 bp, Heterodera glycines
  SCN-specific regions: Sequence locations=1-535
gcctaagaacggagagaaacatttgggggcactcaccgccggaagacgcgaccattgggccaaagttaggaaggagcacttcacgggcaacaacaaaacgtcgctgcggcttatcgaaagatcagcctttgtcgtcgttttggacgaagagcccgtattctatgacccgaatgatacttcgaaattggaccgttgggcggagaaacttctgcacggcaaaggatacgatcgttggtttgacaaatcgttcaatttgatcatctcgcagagcggccgaattggcattaacacggaacactcgtggggggatgcggcggttactgcccatttcatggaatacgttgtgctccaggactattgcgttcagggctacacttcgtccggcgattgcaaaggcgaagtgtgccagagtgtcaaattggaaagaatcttattcgatttggacgaagtagtgcagaaacaaattgaagtttctcgccacgtggcggatgagttgatcgctgacgtggagatggcactgttggtttggacagac

SEQ ID NO: 94484 - DNA, 336 bp, Heterodera glycines
  SCN-specific regions: Sequence locations=1-167,189-336
cgaagaggaaagagagggcgacaacaaatgccaatcggaggaagtgccatcggtggaggaacagcaaaagatgggcaaatttgagacggagtttcacgcggcattcagccacgagggcattttcaaagttagtccggtgcttgccaaactcaagttcgctgatgatgcagaaaagacggggaagggccgctgccaaatgccgagcgaagaacacattttcctgccatcactctctgtcgatgtgacgaggaaattatgacggaaggaactcaatttatcactttataaccttacgcagagattttcatataattctataagataaactacgaatct

SEQ ID NO: 94485 - DNA, 311 bp, Heterodera glycines
  SCN-specific regions: Sequence locations=1-222,244-249,271-311
ttgatcactcccattagttaaatggcataaatatccgcggggtcgggttttctgccggacatttaacgaaattctcgatccgttccacgtttaactcggtttgtcccgaaaagcgaggcttttcagtgtccaacgaatccctgtgccgctttttgttcaaccttcaaaattccgctatccaaatctagtcttcttgaatggccaaattagttgggtctcgaaaatgccaatacggcgggtgggatgccacctgaagcctcaaaaacaattataaaatcgaaaatttcttaagtatgcaaaattttgggatt

SEQ ID NO: 94486 - DNA, 428 bp, Heterodera glycines
  SCN-specific regions: Sequence locations=1-78,100-428
actaaacccgggcgaactcgactttaagggtacgaaacggaaaaaagggaaaacaacggacaaaggggacggggggtacaagaagaaactgagagtcattcattagagacgtaaattgtaatagagagagagagttttctttttgttgcccctttgtcattaagcactttttagagggccaaatcattcagctcgattcgcaaattgacgagcattggtttgagggcacagtggacggccggaccggctttttccccatcacttacgtggaggtgatcgtaccaatcccttcttcttccacgacggcacaacaataaactttgtagaacaccgaacagatgacacaaactgtgctttgggatggtcaacagaacaagtcaaacaaactcacctaaatttgctaataattccttaattttcactgtttg

SEQ ID NO: 94487 - DNA, 284 bp, Heterodera glycines
  misc_feature (266)..(267): n is a, c, g, or t
  misc_feature (269)..(271): n is a, c, g, or t
  SCN-specific regions: Sequence locations=1-284
ttattacagcttttcaatgaaatggcaaaagctcatgaagtttggagaccaatacatgaatttttatcggtttggccctcaacttggtctcggcctttgtttgttcacttttgttggtgttgtgtttcatggcgagcatatgaagctttattggaacggaaggatgaggaaatggtggtacaattggaaggaggactaacaaaccattaattaattataaatgatcgtttttattttttctttgaaatgcaataaacaagccatcnncnnnaaaaaaagaaaaa

SEQ ID NO: 94488 - DNA, 510 bp, Heterodera glycines
  SCN-specific regions: Sequence locations=1-510
attggtcatgtgtttatttgggatttaacttgccctgctcgccccacgtggaaattacatttcgacgattggaattctcctcctcagtccatttgctggaccgaaaaagataaaattgccatttccttccgtcgtcgtctttttcgtatttacggcctcattcctccgtccgaatctgaccaatttggttcgtcccatcctgttttggagtgcgacctgaacaaaacctgcggcgcaaagtgctgctcgcaaccgttgatctttcccggcctcatcagtttcgaatcatccactttttcctattttggaataacgcagcaggcgccttcttacatttgggtgacttcttcgccggacgatgagtctgaaaaggaccaaatttgtgccacaactctcatgcagggccgtacacttttgcacttgataatgcatgacaaatcaattgcagaaagcgaagacaataataagaatttttgcttctcacacgacgagtgttgtacttatcggagg

SEQ ID NO: 94489 - DNA, 460 bp, Heterodera glycines
  SCN-specific regions: Sequence locations=1-460
cctaatttgaaccgcagttttattgatggaaacaatttgcagcaattctcaagaagtgcttcttgtcaacaatttacaacattagcgaagactgtgtctccaaaagtagtcctccgcctaagcagcccccgtccgccccgactcgggcatgggcagtgacgaactgtcgggtggatgggtcgggagatttatgtgccaaacattggacaagtacataaactcgatgaccatgctaatgagtccattctcttctctcagcattgtgcccgttttgcctgcctccctcccggcctcttctgtctgcaaatgggtcgacttcaccaacaaacatgggttcggcgtcacttttcgtgatggcactcggtcgttgctattcaacgatcagtcgtccctttcaacgagttattgtcaacgatactttacctatcgagcacaaaaatttgttggcaattttgtcgaa

SEQ ID NO: 94490 - DNA, 473 bp, Heterodera glycines
  SCN-specific regions: Sequence locations=1-65,87-473
gcttgaggatttggacaaagtgcagacggaacttgacactttaaatgaaacagccagcgacgaaatattaaaagtcgagcagaaatacaatcagatgcgaaagcccttcttcgaaaaacggacacacttcatcaaacagataccaaatttttgggtgacagtgttcataaaccatccacaaatcagcaatatcctcgaggaagaagaggaagaatgcttgcactatttgacgaaagtcgaggttatcaagcccaaaacattaaatttactacttttatttcaagattgaggaaaatgaagacatcaaggccggttataagttgaaattttctttcgacccaaatccattcttcgagaactctgaaatagtcaaagaattcaattggactgcagcagaaccgaacagtgtgacaactgaaatcaaatggaagcaaggaaaaaataaattggctaatgggactggaagcgaggaa

SEQ ID NO: 94491 - DNA, 388 bp, Heterodera glycines
  SCN-specific regions: Sequence locations=1-267,289-325,347-388
actcaaaagtaccgtaaggcgttggaacaaatcaaagctgagatggtaaaggatgcggattactgtaaggattgtgcaattcctaccgttacccaagtcttggcaacaccaattccgcttagtgaacaaaccaaagaattgatgcaaaaaggcgcaaaaaaacttgatgagaaatttaaaacatttactaagcgctcatgattttcaaaactgcgtcaacaaatgaatgatgggatatgggaacagtgaacggatattgtgtgatgaaatattcattattatttttaatttcaagcatgatgttatattatccaacgaaaaaacatgtttttagatgatattgttaagcttccggtttttatgtcctaaaaataaacatcaatcagcc

SEQ ID NO: 94492 - DNA, 260 bp, Heterodera glycines
  SCN-specific regions: Sequence locations=1-172,194-260
aaaaaacgaccgccgtttcttcttcattggcacagcgcaaaattttgccacaatcggcactttgtagacaacgatataacgacgcttttcaagctctgcaaaacgcttacagttccaaacaacaaacagtgaaagagcatcgaaaaatggatgaagagacaaaagagcatccgacaaatgaagaggaattgacgcaactgaagcgcaatttggccaaccacagagagcggtggaggacggaggagttgaacgaggcctac

SEQ ID NO: 94493 - DNA, 398 bp, Heterodera glycines
  SCN-specific regions: Sequence locations=1-101,126-166,188-398
ggctgcatgcctccgactgatgcgacggagtcccaagccgaaagttcgactcaggctgcctacgatgagcagtgtgagtttggctgggagcagtgccgaatcggaggaggacagcagcagcatggatttcgcagtcgtaccgcagttgcggcggcgctgagtccgcataattattttgcccatttatcaccacaaacgccatcttcgtctgcttgcgcatccgtgtcaacctttagctgcgaacccaacccaagcagcaacaacagtccgagtccaatctacccaaaggtccctagtccttgtctctcctcccattccacgttcattgatgagtttgcctcccccgccttcgaagatgaccagcacaatttcgtccattttcgccaaatcgattcgga

SEQ ID NO: 94494 - DNA, 549 bp, Heterodera glycines
  SCN-specific regions: Sequence locations=1-549
ccggtgctcacccctttcttaactcggcttttatcaaaatggtccgacgttattctgagggcaatgcaataactttcgcatggatccgtcctttggttttgcctgagttgcgaattgtcgacagagtcgacgcggtcaatcgacttgttgacgtttacgactttatgggcgcgtacctttggcttagctatcgttttgaggaacatttttccgaccgagacaaagtccgcgagttgcaacgagaatgtgtgggatttattcagaaaagcatggacaaaatgttatctgagtatggagaggaggaggcaaagggagcgccgcgcaagggaaaaaggagggaaaacagcgattcggagtacgaattgagggcgatgggactgcacaggaacagctcgaaaaggcatgacgacactgtttccaaagtgcagaaggaaggcctccaggaacagttcaacgcgctaatttctaaaatgcggaaacaacggaagcaagtcaaatgaagggttcttctgcttaccactcattaattgttatctcattgataaattg

SEQ ID NO: 94495 - DNA, 514 bp, Heterodera glycines
  SCN-specific regions: Sequence locations=1-19,41-43,65-514
tattcattttcgtcaattatatttaaaaatgaatttgtggatgttaattttaatgtttggccctattcattcagttcgaattcgaagacattgggtaaaagggcaactaaatgatgaagtaaacagaaaagactttgaacataatgtaaccgatcattcttgcgcaaatgccaatcattctgctgatcagattgcgaattttgtcctttctgatcaatcaaaaaattgtggtaaagacagaaatgtttttgatcaatcacaacaaagtgatgaactcaatgatagagatgaaaaagccaatcactctgttgatagtttggagagtgatcaatgtcttagcaataaatccaaaagtgagaggaaatgtaaatttgctgatcaccaaaaactcagaattaccaatcaatacaatcattttatcagtgcctatttgcgaaaaggaaatcattcgaaaaatgaatggggaaactttttgaagaaattggccaatgttcttggcgtaaaagggcgtaca

SEQ ID NO: 94496 - DNA, 188 bp, Heterodera glycines
  SCN-specific regions: Sequence locations=1-152,178-188
ctttgcaattgattgaaattaattagaatagtccatgctttttgttttcgtcttgctcattcacatcccgtgtgctaattaataagtgagttggatcgctagatatgcttcatttatttcacaccattgttttatgtattagtaataaatgcatttaaataatgaaaaataaatttgtacaataaaaa

SEQ ID NO: 94497 - DNA, 414 bp, Heterodera glycines
  SCN-specific regions: Sequence locations=1-414
ccgacgacttgtcgccaccgttgacacaattgaacatttttgcgcactgatggaccttcataacatcaaagataggctggcgttggtaaaggcggcgttcgctccgctgactttgttctgtgccgtctcttccaccgcacgggtcacccgtaaccgtgacattctttgcctctgcaatttcggctacgtcccgcgcggtgcccacctcagttacgccgagccatatcatttttccaatcgattggtggacagagcgctggacgaattggtggagccgttcagaacgttcaacttcaaagagcaaatgaacacgcaatcggcattgaactgcacgcaaattgaggaagaatgcggcggtcatctgttgggagtttctggcagatgcttccacaatagcggcgaattcccgccctc

SEQ ID NO: 94498 - DNA, 295 bp, Heterodera glycines
  misc_feature (271)..(271): n is a, c, g, or t
  SCN-specific regions: Sequence locations=1-269
catttgcgggctgcccgagctgtacgattgggttctgaccgcaacacatccaaatgaaatggaaaatgaccgaatcccccgttacatcgcttttctgatttggtacccgggtgtcatcacgcaaatcgtcctcttttcttttgccgacaccccatcgcagaaccgttacgaacttttggatcgacaaatttcgcacatttctcgctgattctttttcattttccaatcctatagacaaataatgcttttaaataaacatattaagttttanaaaaaaaaaaaaaaaaaaaaaaaa

SEQ ID NO: 94499 - DNA, 521 bp, Heterodera glycines
  SCN-specific regions: Sequence locations=1-72,94-107,129-521
tttctcgtaattttttggggtcatttatttccataatatttttcggtaataaattccatgaattaataaccctattaaaaaatattattatttgtcaaccaaaagttaattaatatcttcaataaacttattgatcggtagctgatcaattgaatgtttagtatgctcaagctgatcagaatcaaataatttatcacttcatcccaaattgagatgacattgatttgtacgtcggtggtttggtggaagagccgctgatcggtgctttggttggcccaacatttgcctgtataattggtgatcagttcaggcgtacgcgggacggggacaggttttactacgagaatcccggcattttttccagtgctcaattggccgagctgaaaaagacaagtttggcacgtctgctttgtgacaacggcgatcagatcagcaaagtgccgttctacgcgcttctgcttccatcagcgatcggcacagtgccatgtgccagattggcccagttggacctgcacaaatgg

SEQ ID NO: 94500 - DNA, 221 bp, Heterodera glycines
  SCN-specific regions: Sequence locations=1-4,42-221
ttccggttccgggggaagtatggttgcaaagctgaaactgagtgacaccgtactccgcatggactacgagcaccgtaaccgacccgtgcagctgacggtcaattgggacgcggtgacgcacgacaaattggacttttaccacttccattggacaaagccggaggacgaagtgttggatcatttggaggatgccctaggaattggtaccgaaagcgatggca

SEQ ID NO: 94501 - DNA, 97 bp, Heterodera glycines
  misc_feature (78)..(78): n is a, c, g, or t
  SCN-specific regions: Sequence locations=1-97
aaaggaagaaacggaagactaagtttgatgggagatttgtctgttttacatttcgtcagaattcaagtaaattgatcnatgaaaaaaaaaaaaaaaa

SEQ ID NO: 94502 - DNA, 175 bp, Heterodera glycines
  SCN-specific regions: Sequence locations=1-15,37-175
gacaaaaattctcgtggaatttttaatggaaagagcgcggaaatttattcgtccgaagaacaaccgacagagtgtgcagcaacagattggactttcggccgagctggagaggcggagaaaagcgaagaaacagtgaaataaaacgggaaaatttattcgtccatccattttttgt

SEQ ID NO: 94503 - DNA, 119 bp, Heterodera glycines
  SCN-specific regions: Sequence locations=1-92,115-119
aacgaaaaacaattagtatattttcatgttttttcttgtgatctcgtctcgttctatcgaataattacagtagtacaatacatggcacatgcaataaaaaataaataaataaaaggcca

SEQ ID NO: 94504 - DNA, 522 bp, Heterodera glycines
  SCN-specific regions: Sequence locations=1-522
actgagtcttcaagtccgatcacttctccggacaacatttctcagctttgcactccgtcaaacccctcaccccctcagggcattttaagccttccggaatttgccaattcctaccaattggacattatctccgcgttgcgaggcaatgagcacgatttcctggcaaaggcagccattgcggacgcaattcgagcatttcaaagtgatgaggacaaaatggaactaattgatttcattgcgtcagaagaacacggggccattgccttaactttggagaacaatgcgtgcaaaatgttcaattgttcgccctctgaacttccgctggtttcgtccaattataagacgaaaaagcactttctgtccgaactttgcgagctgttcaccacctctctttgccagtcaatcccaacgcttttcgcaatgctttacccacttcagcactctaacccaaactttcaaatccgtaaaatcattttacgccatttccgtgaccgcgttctcatccgacttttggccaatttt

SEQ ID NO: 94505 - DNA, 73 bp, Heterodera glycines
  SCN-specific regions: Sequence locations=1-73
ctggaatttttgttgataaaatgcgatgaatgtacgaaaacttcgaacctaattaaacatgtttaatttacta

SEQ ID NO: 94506 - DNA, 418 bp, Heterodera glycines
  SCN-specific regions: Sequence locations=1-146,221-418
ttaaatttagagaacccgaagtgctaaactttacaaaatatttgaaccatcggaccggagatggtcatttttttgtgctttcatgttcatttttcggaatttccactggagagagcgaaagtgaaagttcattggaatcggacgacgaggaggaaggggaggagggggaatttggtgaggaggaagaagagggggaaggtgaacacgaggaggaagaggaacatagagaaggcatttaagaggggaaagggagagatgaaagtgacgcggaagaaagcaaacgatgccaatggatggggccacggaaagacagaaggccattgtccgttttaaccttctttatgtcctttccatgttaccttttgtttttcccatccgctgctttgacttcactcatccgtttgattgtccggttaac

SEQ ID NO: 94507 - DNA, 425 bp, Heterodera glycines
  SCN-specific regions: Sequence locations=1-425
acatatgattagtttggtgacggaagaagtaagaatcttatcattggactattagttaaaattaacaacttttcagaaaccattgttttttctagtcacattttcaaatccaattaaatttactcattttacgctttttcaggttcaggaatacaccggacctcgaaaggcgatctgttcgttggtcaatgtggaaaaccaagctgtgaatgggtcaatcacgtttacccaggaaagtccggcggattcaatggcttttgagggacgcattaagggcattaacgccaatcactgcgatcttttcgtgcatgaatttgacgacctttccgaaggtctttcgtccgtcggtccggtcttcaatccgccacaaactctgttcagtgggcatcagttttttggctccttccataagtttcaaggatagc

SEQ ID NO: 94508 - DNA, 416 bp, Heterodera glycines
  SCN-specific regions: Sequence locations=1-416
gagtgccattccccccacttattttttaatctaatccacttcctcatcgttaataaatccattccttttttgtctcaaatggcaccacttatcctccattagtcccccccgaaaaaataattccattcgcttttttgccggtcattccgttgttcaatgggcggctgttgcgcatgcctaagggaaattctgttgtaggaccaagcggccgacatcagaattaacgtggttgaacccacaacagtcaccaaggaaagagacggcacttcgaacgtggcacatggcggacaaatgtacggcacacaattggacgtgccaaaaaccgattaaacgattcagaacaatttatttcgctttagataaaaattacagaatagagatgccaaatgcaaatgtaataaaattcaaaaggactc

SEQ ID NO: 94509 - DNA, 504 bp, Heterodera glycines
  SCN-specific regions: Sequence locations=1-197,219-504
gtgttggctctgcgaaggcaaaattggtggagaccacggggggaccatgcgtaatcgaagcagggggatggattttcaacaccgaagcacatcccttggacccggggatcgtttactgttgttcgaaaaagcatcaatctgacacggcactgctgcaacaatttgagcaagacatcgatttcatcccaccataatttgcaccattgtcattttcatcagcaaaaggtgcttcaaaggcaatgtccccggttggcgttgccgccgtgccatcattattgtactgctcgaaattgatggcacaacgccggccatggaccaacagaatgccgtcggcgccaatttcgagccgagtgcccatcaacggctggccaatgggcaccaaattgtgcgggtcctcaaatatttgttcacactttatgtcggcgcgttcaaagcgatgaacggatgcccagcagctgacttcggtcagtccgtacacattgaacaccgccatggggcacgtct

SEQ ID NO: 94510 - DNA, 266 bp, Heterodera glycines
  SCN-specific regions: Sequence locations=1-35,108-166,188-199,227-266
aaataaaaaaacaaatttctaaagacttctcttggtattataaaaaaaaataatttttagttttttaataaattattaaaaaaaataaaaaaaaaaataaaaaaaaaccttcatcctccaatccattaaaaaaactaattaatttgctaccttaaaacaatcaccctaaaagggcctttaaaattaataatcaagaagcaatttaaaaaaattaaaaaaaaaattacccattattctaaaaaaaaaacttttagaaaaaaaaattt

SEQ ID NO: 94511 - DNA, 529 bp, Heterodera glycines
  SCN-specific regions: Sequence locations=1-63,85-340,364-396,418-529
aaaagcaatgatttcggcccgttcggctggccttttgacagtgtccgcttcactgatcgccatggtgtccattttcttttatttgcctctgttagtgttcaaaatccaacggataaacgagcagctcaaagttgactcggacgaattcaaagcgatggcggacgaaacgtgggatcagctgatcaccgtgagaagcacgctaccgcaagaaatgctgctgaggaaacgaagacaggcttacgaactgcctaaggcgtatccgctgcacaacagttatgccaaacaggacgcatatgttcacgggcccacctgcgcgtgtaacccactgaacaattgcccagcggggccgcccggcccgccgggaaaaccgggagaagacggcattccggggacgagagggccggccggggggccgggactgcccggaaatgcgccacccgtcgcggtcgacccgaatgccgggtgccgagtttgtccacatggacccaccggaccagcgggtcctccgggagagtcggggccgaccgga

SEQ ID NO: 94512 - DNA, 124 bp, Heterodera glycines
  SCN-specific regions: Sequence locations=1-5,84-90
atgactatttatttatttttttatttcatgagaaatcaaaattataatgtttttgttttatatattttgaaagataaatttttgacttctaaaaaaaaaaaaaaaaaaaaaaaaaaaaaaaaaa

SEQ ID NO: 94513 - DNA, 160 bp, Heterodera glycines
  SCN-specific regions: Sequence locations=1-160
tgccaaagtcaaaatcatcatggccaccaatcgacccgatacgcttgacccggcactgctccgtccgggccgattagacacaaacatcgaaattggattgatcaatggaaatacttccctcgacgcgctgaacaccccatgccaccaaagtgttgaacat

SEQ ID NO: 94514 - DNA, 527 bp, Heterodera glycines
  SCN-specific regions: Sequence locations=1-67,92-205,227-452,476-527
tggtccgaggacacgcccatttctgctggcccaatttttggccaccattcccacagaattggcgcggcaccaccaccgccgccaccgcagcacgctgcgcgtgctgcggtgggtgccgcgggcgcattggccaccgaccgttcggcacaacagcaaaggctgccctcccactacgaccgcgatggtgccaatgccaatgccaaccatgcgctgttggcacggggcgacttggccaacgacgacggcaacaacgatccgatgggctttggccaggcggaagcgggccaaacggcacgccatcggcgcgggccggcactcatccttctgctggtcgtgttgccgctggttgttggcgcatttacagtgctgctcgtctttctcaactaccactgcaacatgctctgatcattaatttggcacaaaaaaagagtgattgatagacaggatttatatagatatttttagcttttatctcgcctattcgctttttttgcactttaatttcgccattgtaaaattataaaaat

SEQ ID NO: 94515 - DNA, 514 bp, Heterodera glycines
  SCN-specific regions: Sequence locations=1-129,151-154,197-353,382 -479,501-514
ctggaaaaattttagtgatttttaatgcgatttgttaacagatttgtccacgaaaatggccaaatttagcgacttctagcatattttcaagaaaattaaggatttttaggtccggcggtgccgataggcgccgccgggaaatttttaaaaatttcaaggcaatttattaacagaaaattgtataaaaattgctatttttttgacaaaaaaatcaaaaaaaattccgaaaaattccaactttttatcaaaaatttcggaagtcggaaatcggaattccgaccccaaaaatgtcggaactggaactcggaagtccgtgccatccctggtatttatgcaggcagtttaggccacataaaaaatttttctgttaaaaactgtttttaggggtattcggggttatagttatgattagggctccaatttttaggcaaaagcctattttttcctgagctccccgtggcctgaaacgcacgaaaaacgtgttttttgtgctgttgttaagctacttttcgag

SEQ ID NO: 94516 - DNA, 88 bp, Heterodera glycines
  SCN-specific regions: Sequence locations=1-88
tttgaattttgtaattgttacttttttgtttgattttttgtttggttttggcgcatacatttccatgaacgtcaaaaaaaaaaaaaaa

SEQ ID NO: 94517 - DNA, 542 bp, Heterodera glycines
  SCN-specific regions: Sequence locations=1-438,461-542
gtcgagctccgccgagacggaccctggcattgtcagttttgccgaaatttggacaccgatcctgcaaaatttgggcgcaacattagtcggcattggtcctggtgaaccgtttgcctccaaatcgagcgctaaccttgaggaaaagatggaattctgttccaaaattgagcctcccgttgatgtgctgctggcggagacggactgccaggccgaggtggccgagctggtcgaggaacggggcggtttggccgtgtccagcgaatgggtcattcaggccatcgtcactgtgttggctgaatgaacatccacagttttggtggtggatgacggcggcaatggactttgactctacttgaacacacctaacaatatcataaaccattcgcttttttggaacgatacccggaaacttttctctttttgtcgcagaattatctgccctaattaattattattttattgtcccactgacattacacagcatacgaatttgacaataaatttgatgtttaatggataatagcgttgcttcgtctgctgga

SEQ ID NO: 94518 - DNA, 310 bp, Heterodera glycines
  SCN-specific regions: Sequence locations=1-250,273-310
tttggtaaaacttttaattaacaaaagaatggcagaaaattattttctttttttagtgcgtccataaactgtttgagcgttaagcagaacaaatatatactatttataaagattaaaaccatttcgagcaagcaattggattggcctatttatgcgtgtctcacagtgaacccaggttaagctgaccaaacaaaaggtttctttttttatcctcattcaatgatttagcaaaattttattatacccaaacaaaaaatatttttaattattttctttgacagaagatcagtcacttcctttatttagtcga

SEQ ID NO: 94519 - DNA, 453 bp, Heterodera glycines; identical to SEQ ID NO: 74084
  SCN-specific regions: Sequence locations=1-154,177-200,222-304,387-453

SEQ ID NO: 94520 - DNA, 414 bp, Heterodera glycines
  misc_feature (410)..(410): n is a, c, g, or t
  SCN-specific regions: Sequence locations=1-174,196-281,303-414
ccgctaatattactcctatagggactccattttttaccaaattattaaattaacaaaatgtcccctcttcgttttctcgccgttctgctgctgatctgtgccatgttcagcttcaacaatttggggctggccaatggcgaggaaagcaaagacagccaagtcgctctccgtcccgatgttgctgctgttcagcctgacctcgtcgttgttcgcgttcttcgtggttactatggaggtggtggaggctgttgctttgttggttgcggaaaaaagaaataagcagccaaagaagaaaggaaggatgccgacaaagattaattatctttaattagtaaatgatccattcgtccattttgtaattggccaaatttagtaaaagacaaaatacaatgataaattttgtaaaaaanaaaa

SEQ ID NO: 94521 - DNA, 521 bp, Heterodera glycines
  SCN-specific regions: Sequence locations=1-12,34-214,237-415,438 -496,518-521
aaagtaaatcctctttaaaaatgaaactttcaataattttattgctttccttggccttttgtgcgttaatcatcgatgcatatccatcgggaaatggtaaagatcttgaagctgacaacgaaaaaaacagtgactgttgtcgttgtgttagcaggaattttgtgcgaaatcaaattatcaacaatgtttattattttgagaaattcttatcctatttttgttgttttttataaacatgggaattcataattccgaatgccttttaagccgctgcccatcaaaatgtccctgcgtcataatgtcccagcgtcataatgtcccagcgtcgaaatgtcccagcgtcataatgtccctgcgtcataatgtcccccaagccaaaatgagtcaaaatgtccccctctaaaaattagtgaaaaaactgaaaattatataattatatgccttcatacgatctgcttttaaaatttatgctttagcatcaatgtggaccgtaacaaaattgaaattctccaaaaaagtcg

SEQ ID NO: 94522 - DNA, 286 bp, Heterodera glycines
  misc_feature (280)..(280): n is a, c, g, or t
  SCN-specific regions: Sequence locations=1-286
ctaatgaaggggattcaaattggagaaccaaaccgactggaatcactagcacagcggattcccagaacagttggcgaaccgtgtcaaagccagcggcgacaccgcaaccgacttcgcaagagactccggcagctggaggcggaaatgtgtatattccaccacacttaagaaaaaggacggagcagaagtgaatcgagatgccaatcagtattggattgttacgaaaaatgaatttatcagctcatgaacaaactgttgaaaatcataaaatgttttatcngaaaaa

SEQ ID NO: 94523 - DNA, 519 bp, Heterodera glycines
  SCN-specific regions: Sequence locations=1-21,43-304,388-519
taattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaattgagcatgaaaagtacgaagcagcttactttcaaagtttgttgtttttttatatgagcaaggtaacatacagaaccatgctaccggtaacacgtttattcagcaatcataaaatttttatctaaaattaacatgaaaattagaaaattttataaatatatttaattattttatataacatatatatttatcagaatggcataacattttactcaaataaaagtaaaatttctgttatttttttttgtttcgctccaaatgtgtccatgaccaaaatggcggtgcataaatggcaccgaatcattaaaataaaatttttaacg

SEQ ID NO: 94524 - DNA, 455 bp, Heterodera glycines
  SCN-specific regions: Sequence locations=1-285,309-372
ctcattaccacttccatcatttggccttttttaaaacaaaaaaaaatgagaaaccttcttctcgcagcgttggcaattgcggtaatgcttttgtgttgtgcggaagccgttccaatggaaaacgaaaagtatggcaattaatataattaactgtatattaaagcaagcattcttcatatgcatacgcataattcgtttttaaaatttgagtaaaaaaaggtcagttttcagacggcaaaaagtttttcatattcaataaacagaaaggttagagaaataaatagtatttattaattaatgaaatgacaatttaattaaagtattttcgtatttgttttccagtcaacttgttcgccataagcgttggggttacggttacggtggtggttggggcggcggatggggccgcggcggatggggcggtggatggggtggccgcggatggggcggcggct

SEQ ID NO: 94525 - DNA, 475 bp, Heterodera glycines
  SCN-specific regions: Sequence locations=1-138,160-475
tgcccacgcctttctccgcttcgatacgattgctttcgacaaattgtttacggttatcgcaacttcgagacgattcggcacggatggaccgttgtttatggggacgattgcatttggcagcagcacgactatttgtgtgctcggcccaacctgacgcagaatcggatccgtgccattttcgtcgacgacggattcgccgacgggggtcccttttcttttcctttggtcccaaattcgctggtccttttcatttttcggttgcgtcagtggccacgattgggccattgttgagctcgaagtgcccattgccttctccgaccgcgtccttcccatttgtttgcccgcttcgcccgcccttcagcaaatttcggacggcgaagtgctgacagtgacgagttggggacggcgcgatgccttccataagggtgaccctctgatccgtgagattccgttgcggcatgacgcgggatgcaaa

SEQ ID NO: 94526 - DNA, 490 bp, Heterodera glycines
  SCN-specific regions: Sequence locations=1-362,384-490
ttacgtcgagatggaatcaaaggtcaaagcggtcttcgagcagctgaagggcgatgccgagttgggaggcacctactatccgctccagggcaatgttggacaagtgctggagcgtctcatagagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccacctgcgacggcctgaaattgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatg

SEQ ID NO: 94527 - DNA, 194 bp, Heterodera glycines
  SCN-specific regions: Sequence locations=1-122
aattgaaaaataggcattcttttggacattttgaaccccaaagaattttagtgccatacaatgaatctgaaaaaggtttttatttttataaaacttttaacattttcgaataaaaattatttaaaaaaaaaaaaaaaaaaaaaaaaaaaaaaaaaaaaatttaaaaaaaaaaaaaaaaaaaaaaaaaaaaaaaa

SEQ ID NO: 94528 - DNA, 441 bp, Heterodera glycines
  SCN-specific regions: Sequence locations=1-45,68-338,366-441
gagaccaatcaacggatgaatgtggcccaatatttttttcaatttattaatattcatccttatttttggggctcttacggaggcacaaaatcaacagaaaatagaaactaaaactcttgttagcgatggacagtcacacaccttggaaatttcgggactctatatgacgatgacacaagaaacactgtccgatgggacaattgtgctgagatttactgggaaaaacattgacgttgaaacaagtaaaagtgatgataattccttgacgaccgaagcatctttaccgactaatgaagtgtcgtcctccacagctaaagaagcttcgacattgaactgtgcaaaagaggaggaggagggggaagaagcccaaaatgccgctgagtctgatgatggctcatttagcatgcctgacgaatcagacgattcaatggccgatcgcgt

SEQ ID NO: 94529 - DNA, 390 bp, Heterodera glycines
  SCN-specific regions: Sequence locations=1-369
catcagaatgtctctcctcccttctgatcattcaattgtcaccgtttctgatcagtcaccgatttctgtgtctgatcactcattggtttccgtgtctaatctctcactgaatgcccattttctccattccctcatggccatatctcgccagtttgaataactcacttactcgcccaattcccttcatataatcactcgccttccaaaaatctctacctcccagctaaaacttgattgatccttaactccgttcttcgcataatctaaaccaattaaacaacttaagtaataaatatttcccacatttacattcagcagaagcattgttatgtaaatgtggtggttcactctttacacttttatttaccattttcttttcttcttcaaatt

SEQ ID NO: 94530 - DNA, 89 bp, Heterodera glycines
  SCN-specific regions: Sequence locations=1-35,59-89
gatccgatcgatcgatgatgtcatttccaccatggtgatgtgccaatgatgtgtgctggtggcggacattttaaaatgccatggatttt

SEQ ID NO: 94531 - DNA, 306 bp, Heterodera glycines
  SCN-specific regions: Sequence locations=1-47,69-94,138-219,242 -245,274-306
gcaaattgcgcttcattctttccttattttttgtggccttttaaatctcattgcccaattctttctctgaatgattttataggcttgtgaggacttatttttagtttttttaatttctattcattatttttatcttttaacattccttcccatttaaaagtgcaatattttttcattttcattaattgtgattgttggaaaatgtgttaagttggagagataattttgttaattcaattttgctcattatttatctttaaatttaaaaaataacagaatggcataaaaatgcgtatttgtcaaaaa

SEQ ID NO: 94532 - DNA, 477 bp, Heterodera glycines
  SCN-specific regions: Sequence locations=1-90,113-210,276-477
cggctgctggacgaaattgggactcaattgcaacaaaatatgataaatccgatgaatttgaagaatttaaaagcattgttggtccaaacttggccaaatttgtccattttttgtagtattgtagcgaaaaaaattgagacaaagtacggcacatttttcccttcatggataaaagtgtgccgtgcaatgagcgcgctaaaggatatggaaaagaccaaaaacaacaacaacaacaaaacaccaagaaagggaaaaattcaaaaagaaaacaaaaaggaggtatcaagtaacacagaaggacaaggatagtaagaaaaaccgaagatgaataccatgattatcatcgacgagaagaaagaggtagtggtgatctttctaatttcgatccctttttatgtctttgttttccgacctttgcatcactgtcttataaaacacgttgtttaaacattgaaggcaaatgttgtttgaaatatt

SEQ ID NO: 94533 - DNA, 235 bp, Heterodera glycines
  misc_feature (214)..(214): n is a, c, g, or t
  SCN-specific regions: Sequence locations=1-175,202-214
tgataagatcaacaagggtcaattggatggcattgccatgtcatttagttcgattactctcggcaccaacggaccacatgcgaccgcctcgtcggattcgatgatggtcgactcgaactcatgaacgcgaaatcaaatttttgtttaatgaaaacccataattatttttgataccaactatattttatattttaatgaattatctaaaaacccnaaaaaaaaaaaaaaaaaaaaa

SEQ ID NO: 94534 - DNA, 541 bp, Heterodera glycines
  SCN-specific regions: Sequence locations=1-4,28-159,195-541
caccgatttggaggagagcaaataccaacaaatggagccaagactgtccatttacgggagggcgaaggacgaatgggacaaattggcacggtgggccattggacacgatgtttggtccccaaatgcccgttggataatccaagtgccgcgtctcttcgacatttaccgtaccaataaaattttgaaaacttttgacgattttctcgacaatctcttcactccgctgtttgaggtcaccaatgaccccaactctcatcctgatctccaccgattcctccaacatgtttccgggatcgattcagtcgacgacgagtccaagccggaaaatgtggcatttacgaaggattcaccggagccggcggattacgacaacgaccagaatccgtcctactcctattacttgtactacatgtatgccaatttgacggcactgaacgccttccgacggatgcgcggactgaacaccttcgcgttgagaccgcactgtggcgaggcgggcgctgtcggccacctgagcgtgtcctacttgacctcggaaagc

SEQ ID NO: 94535 - DNA, 453 bp, Heterodera glycines
  SCN-specific regions: Sequence locations=1-22,44-413
agcagcattcctcgcttggacaatgtgcgagtgttggtgatgggagtggcggaggactgttgccccaaggtcactgccaaaattcacatcgatcagtttattgattgcattgctcaacactgtccacagctgactcggttggagatccgctgggacgatgaaacgcttcgcttctctgataagtccagcaaattcatcgacgtcctccgcatgaaatgtcccaaattgcattcgctggtgctcagcgatggccaatactatgagctcgtccgctcaaatttcgaaagagccgaccgactctctgtcgtcaggacgacagaaatgtgcaagactggccttttgcactgctcgaaatatttcaaccaattgctttttaactagaaattctgtatataaaatgcttattgtattgcaattttttaaatataaaaataaatgttaatattttaaaaa

SEQ ID NO: 94536 - DNA, 346 bp, Heterodera glycines
  misc_feature (333)..(337): n is a, c, g, or t
  misc_feature (339)..(339): n is a, c, g, or t
  SCN-specific regions: Sequence locations=1-346
cttggttaggtggatagagcaccaatgggttcttaagaaaaatggttttattttctgccaaatgagcacgagtgccgagttattgtaaggattattagacgcatttccctcatttaattatttcccattggccattatcaattcaattacatttatccttttctcacctttttccttttctcattgtaatgtttctccgcccattctcttcgcattttctccttccccagtgatcagtcagtcagtagtggtgatggaacagacttcaattatttattccgatttctcgcttcgtataaatccaacaacgaatgaataaagacatctttaacnnnnnanaaaaaaa

SEQ ID NO: 94537 - DNA, 511 bp, Heterodera glycines
  SCN-specific regions: Sequence locations=1-217,239-379,401-511
agtacctacctattctaattaatattttaattcaactttgacttttcattcaagaatgtcaaacattgcctttataagaattcaaaaagaatgcaaagaaatcattttatgtaaagagttacaagaaaatggtgtaacaattgaacctgtaaatgagacgctttttgaaatcattggaaagatacgaggtccaccagatatcccatacgaaaacggaatatttattttggacgttagaattccacaagaatatcctttccaacctccgaaggttaaatttactactcatatttggcatccaaacattagttcgcagactggtgctatatgtttggatattctcaaggaccaatgggcggcatctatgactctccgaacagtgcttctcagtgtgcaatcgttgttactttcaccggagccaaaagatccacaggatgcaattgttgcgaaacaatgcttaagtgatcctgcattattcagatccactgcaaaatattgggcacaacattat

SEQ ID NO: 94538 - DNA, 530 bp, Heterodera glycines
  SCN-specific regions: Sequence locations=1-484,507-530
tgcgaagaagtatccggttggcgatcgaaacggagcgatcaatgctttcatccgaaaggcaatcaagaagctcgtcgaacagaacattttgatcttagtcgaaggtgcaacccagaagtcggctcgatatcgtttggcaccagaagttaagcagcacatgaaaaaagttgagtcgaagactattccaacatcgccaaagcccaaatcggaagaagctaagaaggctggcgaggcaaagaaaaaaacgcaaggtgtctgctgctaagatcaaggatgtcgaaggaaagaagaagaagaagacgggtgtgtccaagaagaaggttgtgatgactcgtaaaccggcacaagaaaagactaacgtcctggcaaagcctaaggtaaagaaatcggctaaaaagaagacgccaaaggctgcaattaagaagtcggcgccggctgcagcatcggtgaagtcgtccgtgaagactgacaaggcctaaggatctagttttataaatatgttattttgttgatgttttattgccttgtca

SEQ ID NO: 94539 - DNA, 317 bp, Heterodera glycines
  SCN-specific regions: Sequence locations=1-170,192-249
tcgctttattaaaggatttactcttccaagaaaagaacacccaccaattaaccaaattggctgattcaactgaacccgtctttgttgtcgccaaattcgaccaaagaatgctcttccattcattcgttggcattgtgtgaagaatggcatgcgcttgctgaccaacggaaatttatttaaacaatttatttgttttcgtgctgatgttcttttattttgtcttggaaagttaaataaagtataagtcccaaaaaaaaaaaaaaaaaaaaaaaaaagaggagggggaaaaaaaagaaaaaaaaaaaaaaaaaaaaaaa

SEQ ID NO: 94540 - DNA, 188 bp, Heterodera glycines
  SCN-specific regions: Sequence locations=1-42,66-159
caaaagagatgataattgggagaggacagaattatgagttatcaatcaaagcaaaacaaagaaaaactgtttttagttcaatttttttggcgatttgtgtgaattttttgctttccaattttttcaatgcatttaatcgaaaaaaaaaaaattttttttaaaaaaaaaaaaaaaaaaaaaaaaaaaaa

SEQ ID NO: 94541 - DNA, 383 bp, Heterodera glycines
  misc_feature (345)..(349): n is a, c, g, or t
  misc_feature (351)..(353): n is a, c, g, or t
  misc_feature (359)..(359): n is a, c, g, or t
  SCN-specific regions: Sequence locations=1-113,136-349
acccgaataaatttaccaagtgtatgacattgtgctcaaactcaaagaaaagcgacacgaagtcaactcgctgttttatggttgattgtcttagaggaagactgtcgagaaaaaggaagaaactgaagttcaacagtccgattgagcccaatctggaagtgattgtatgcacattagttgagcggactactagtggaagtgaaaatccaagcgagaaatttatcaagtcaagctgaagcaacagaatgaatgtgatagcgaaagaatggctgaaaacaataatttttttgctttaagcaaaaattttgaacacttttttggtttaataaatcattggatttttcnnnnnannnaaaaanaaaaaaaaaaaaaaaaaaaaaaaa

SEQ ID NO: 94542 - DNA, 483 bp, Heterodera glycines
  SCN-specific regions: Sequence locations=1-483
aatgcacgccgatgcgaacgtcgactgggccaagctgttgggcacaatggacggcgaaaacgaaggggaggacgaagacggacaagagcagcgacaagcggaggaggaatggcaccagaaacgccttcaaatgatcaaatggcgggcggagcaggaggagcggaacatacgggcgaagaagcggacgcggcaggacgacgacgaggaggggacgaacggacgtcggagggacgcggacgacgaaaaggggccaatcgtggaactgttggaattggactcgccgctttttgcgctcggcaagaaacttctgtgtgccgccaaagatgccaattccgcttcgccatcgtcgtcccgtgtcgtgccctcctcttccctttctgccgcctctctgtttgccgatgtttccattccgcccccagcaaaacggcgcgattcgcttcttaactcgtacctccgtcgaactgatgctgccactattcgcac

SEQ ID NO: 94543 - DNA, 460 bp, Heterodera glycines
  SCN-specific regions: Sequence locations=1-393,419-460
cgggcaatcgaattgccacggcactgttttacttttctcagcccgaaaagggcggcttcacggtttttactgagctgaaaacgccgcaaaaacccagcaaatacgacgcacttttttggtacaatttgttgcgaaatggcgaaggcgacctcagaacttgtcatgccgcctgccccgttctgctcggagtcaaatgtgtgtccaataaatggatccacgaaaaaggccaagaactgctgcgaccgtgtgccctgaagccatccgtccaggaacgttatgtgggcgatttgggtgggcccgagccacgagggcatccaaatgtcagtccgtactgcaaaacggcattgtactgcgagtagatatgatttttatgcattcttacgttttcacaactgttttttgttttgtctgtttgttcccccctttccgaattgccagtctttgccatttgacacctttc

SEQ ID NO: 94544 - DNA, 531 bp, Heterodera glycines
  SCN-specific regions: Sequence locations=1-1,30-146,168-203,226 -235,257-531
catttaaaattcatttctttaatttaatgtcgacaatttttcttcccttttctcagcccccgaggggacgatgaataataataattagtgacaaattaattggggcagcacaatttgttggcaaaatcaccggccaaatgtgcgtataaaagtggtgatcaaatggctgtcaaatcaccaaaacattcattcattttattattttattggcccttttcctaaaattcaatttacaaaaatggtttccaagcttcttccggtcattctctgctgcttgtttttggtatgtttaagcattcggtataaaatactgtaattcgagtagaaaatcagggagtacggtatctatgatattattaatttctaaaacagggcttaaaaaatccgtgaactattttaaataaagattaagcttaaactttactttttaggcttctttcgccctctgctcgcccaaggctgctgatgtgctggtaaatggctcatttttggcattatggaaaatccaaataatattaatatcttgagacc

SEQ ID NO: 94545 - DNA, 381 bp, Heterodera glycines
  SCN-specific regions: Sequence locations=1-148,170-322,370-381
gcaatttcatttaagcaggttaaattgaaatgagtttttcattgagttcaaaagacatcaaaaacccgcagtgcgcatgttgtgaaaaggaagtgccatttggtgacaaatttagtgtcgatcgattgacgagttggcattttttgtcattaaacttcttttttaaaaatctataaacaaaaaaaaatttgctattttttttttcaccaatcacgcttcaaatgtgccatttgcgacaaggcgcttgaggttggctcttgaacactagaacgtggcctgtcgcggtacggaccattgtggttttgttgggaacacatgtgagaataaaaaaatctaaaaaataagtaaaaaaacaaaattaaaatttttgcataatttatg

SEQ ID NO: 94546 - DNA, 554 bp, Heterodera glycines
  SCN-specific regions: Sequence locations=1-554
caattaatcacttccgaaaatggcaacacccattcatcggaaagaatcaccggaatacaaacagaacgaagtgcctcgaggaaacgaaaagagccgagccgacgaccccgtggaatcaaacagaaggtggaattcgccatcaactgctcatagtcccacctgccataattcgcattgtcaacttcacaacgttcgtcctcttacttcttccagtccgtgttgtgcttgcaagtggtggcaataacaatggatcggttatcgttagaatggtgcaaaatgttgcgcgtcttcgacccaactccgtacacatatcgttttcctttaaaactggccaagtatttgtcatggttgggaaaatgcggttggagatgccatggtttgtcgtccttaaacgggtgctcattgttaaataatgggaacgaaaggtcgaaatttggtcgaaaattctgcaaattcgaactcgcccacgcgaccattgccttgccaaagtcgaagcccaagtcggtgttagcgtagtcggggaaagtgccaaagtataaattaaacaccaaatg

SEQ ID NO: 94547 - DNA, 335 bp, Heterodera glycines
  SCN-specific regions: Sequence locations=1-335
ctccggtttaattgtccaatactataacgcttttttgaaaaggaattacgtggtcagctggcagtgcttggacatcatccgcaaggacatggtcgacccgttgagcggcaagcggatggccgagtcggacatcatcgaactgcaacggggcggcacgggctacgcagctacaaacaagctggacgccaagctgatcagaccccaattggaactgcaataaatggatgattgttcatgttgctgacttgatcatggatttaccaaatatttgctataatttctgtgtttgtaccattttacaatttacaagatttgatgaaaaaaaaaaaaaaaaa

SEQ ID NO: 94548 - DNA, 488 bp, Heterodera glycines
  misc_feature (355)..(355): n is a, c, g, or t
  misc_feature (407)..(407): n is a, c, g, or t
  misc_feature (449)..(449): n is a, c, g, or t
  SCN-specific regions: Sequence locations=1-122,162-259,289-488
tatttttgtctccaatggtcatcgtgatgagtcggcttctcctcctcttaatgccctctttgtccgactttctcctctttgcccaattcctctcggcttcatcttccgttttggcaattcgtccctccccctccctctttccctcctccttcccatcctccgatagcccaaacaatggtcgaattcctgccgcacttcagttcaaccctgtctacagacaaatgctgaagcaacgcctttgggaaacggtgcgaaggcgtcggcttactttggtggcccaccaccaacggaactgtttcttctcccccattaattgccatttgccaccgacagtgggcacagagacatcgaccancagcagaaactagtgaaaggaggcaaaatgcagcagaagaagaagacacganaaatgggagcagtacagagagaaggcagaagaagaaaaaaangccaaagccaaccaaccaattcattaattaattagaaaa

SEQ ID NO: 94549 - DNA, 359 bp, Heterodera glycines
  SCN-specific regions: Sequence locations=1-359
cgtcagccctgcgtggtgttcgccggccatccgtcgttacgaattggcgaaattgtgcaattgctcgatttgtggggcggaatgtcgcgcaatgccatcataatgatcgaccctgactacccgctggagacttactacgcaccgtacaaatcattggcaatccgcgcatattattacccaattgagacgcggttggacggcacgcaagtgctgaacaaaattatcggcgaatgtggcccaaagcaagtgctttttccggaagagtacgcaagtgcctttagcactttgcaggcactgcccatgcaggcaatgtcatttcgccaaaatgagtgcgtctcgttggactcagccaaaggatc

SEQ ID NO: 94550 - DNA, 469 bp, Heterodera glycines
  misc_feature (388)..(388): n is a, c, g, or t
  SCN-specific regions: Sequence locations=1-355,380-421,443-469
caacggtcgggggggacgaaggagtaaactcactgctccatagaatttcctgagggggaactcattcgaattttttgatttgttgcaatttttagaaaagctcatatgattttctcaaatcgtccttgctgattatatgtttttactcaatttaaattttgcaggagttggacgaggatcaggacgaaatgcgcgacgatgcctcatttgccaactcagactggaattgacttgacacaaatggcacttaattctcacctttttgtgcacaaaaacactcaaaatgccaatttattattttattataccattaaatcaagaagaagcagcactttttaccttagctttttaattgtccttttattttagttaaaattaaccaaaaaangacaaaaagtacaaccatttcattcattcattctttcacctttaactgtaattattgttctcaactccctttcctttcaac

SEQ ID NO: 94551 - DNA, 511 bp, Heterodera glycines
  misc_feature (171)..(171): n is a, c, g, or t
  misc_feature (178)..(178): n is a, c, g, or t
  misc_feature (190)..(190): n is a, c, g, or t
  misc_feature (212)..(213): n is a, c, g, or t
  misc_feature (246)..(246): n is a, c, g, or t
  misc_feature (451)..(451): n is a, c, g, or t
  SCN-specific regions: Sequence locations=1-1,23-87,121-511
gtgaaaaaataaaacattttttcccattgcccatcagttattatcgggaaaacaaacgaaaaagagatacgtattacgaaatggcttcttctgtttcttcttcatcatcactggctcatcaccatcgttctcattttggcattttgcccactaattgtttcgccgcttttncctctgncctgtcaatttntcggcacccgatgcccattccnncatcgacggggttgaccgatgccgcgtttcagnccctttcagcagcgacaacccgttcgcactctttgccgtcgcgcaggaagcggacgaaaatggcggcattggaagtgcttcactgatggcaaaacggcacctgttcgaagcattggcacgccaaggccgttcgccacgctccgcttcttccgcaacaatgcgaaacgcgctcgtgcgtttcggcaaacacgctctcttcccttcngtggcattggatgataagcacaaccctccacaaccattcatccactttggtcactcagca

SEQ ID NO: 94552 - DNA, 381 bp, Heterodera glycines
  misc_feature (152)..(152): n is a, c, g, or t
  misc_feature (317)..(317): n is a, c, g, or t
  misc_feature (346)..(346): n is a, c, g, or t
  SCN-specific regions: Sequence locations=1-172,195-381
cgggtcgcccgaatgggagcaggtgactgaagagcagaaatggcgacttggcatcaccgttgacgaggacggagagttttggatgccatggcatgagtttgtccgttacttcaccgacatttgcgtttgccaactgctcacaatgggcacanttgaccgaatgcaaacagccgcaacagaaacaggcacagagaggggtcagcttgaggaggaaacagctgagcatgcaactttcgaacgtcacaattgggctaacggagaagcggtggagagaatggactttcttcaaccgctggtcctcaaacagtgtcaagtcnggcgccccaaaaaaccatgccggaggcantgtccatttcccggcaactttctgctataatcctc

SEQ ID NO: 94553 - DNA, 579 bp, Heterodera glycines
  SCN-specific regions: Sequence locations=1-15,37-400,422-579
attcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgaatgacacaaacaccgcctaccgactgacagcagctgtgattgaagcggccattgcacaaggcatttacatgatcatcaattgacacacacataaaccaaacacaaacaaagcaattgaattcttcaccaaaattacgaaagcatacagctccaaccctcacttactgtacaaaacatttaacaagccattaaatatatgctagaacatttacttatccctgaccataaaaaaattatttctacaattcataccatccacaaaaacaattgat

SEQ ID NO: 94554 - DNA, 788 bp, Heterodera glycines
  misc_feature (450)..(450): n is a, c, g, or t
  misc_feature (681)..(681): n is a, c, g, or t
  SCN-specific regions: Sequence locations=1-117,148-479,502-613,635 -759,782-788
gactctactataattccgtccgtccctttccttttaacttccaccaaatgcccctcgtgcacaattgcatcgctggcactcgccattccctcttaattgttttgggcctcattatgataatggccaattgtggacaagcgatgcggcagcaggcggtggccgtacgtggccaactccgttgtgggaacagacccgcctcgggggtcaaagtgaagttgtgggacgaggacgacgggcccgaccccgacgacgtgcttgacgaggcgtttaccgactcttctggctccttccaaatgaaagggtcaacacgcgaactgacaaacattgaccccgtgctgaaaatgtatcacaactgtgacgatgggataatagccaaacaacacaaattgaaactgcacatccccaaccaatacatcacaaacagaaggttgaccaaacgaacttttaaantcgaagtacttaattgtaagacagtctttactgaagaagaaaagaacttcatttgaacatagaaaacaagaagaacttgcgaaataaaagctaatttattatcacatacagtataatcagtcattccatttaatattctttatataccacatttatattcatcaaaataatatacaaacaattataaactatacaatgtatcaaaacaactataactagaggatctcgatngatcgtgggcatagaaaaatagaaaaagttcccttcgtttttaccacttatgctagtagtgtatgtagcacccctctaaaagatccaacttacttcacttctgtcga

SEQ ID NO: 94555 - DNA, 582 bp, Heterodera glycines
  misc_feature (164)..(164): n is a, c, g, or t
  misc_feature (197)..(197): n is a, c, g, or t
  SCN-specific regions: Sequence locations=1-279,301-582
gaacgtcagcgacgggaaatgctaagagcggagcacgacagaagacagagtcaattgagacacaaaatggaacacatgcgacaaatgaaacacgaaatgttgctgaatgagcgtcagctagcaattcaacgtttccaaaataatgaacgccaaattatgcagcnagcgaatggctggtacaacaacgcgcaacaaanttcatcagtaccaaatgccacctatggtttcgccctaccctcatcaacagcattatcagcaaattccgaattccatgccaccaaacactgctgttacaatgaatgccattccatctttgccacaaaacatcaccacgcctatgccaccaaatgaaatgttgacgaatgtaaatcttgtgggaattcgagcttttcaaagcaacgaacaccagattatgcaacaacaaatgatgggacagcaaccgcaaatgcatcaataccaaatgccgcatttggcgtcgccctaccctcatcaacagcaaccgcattatcagcaaattccgaattccatgccaccaaacgctatcactgctgatgagcaaaaaaatcaaatgaccggcgtaca

SEQ ID NO: 94556 - DNA, 461 bp, Heterodera glycines
  misc_feature (146)..(147): n is a, c, g, or t
  misc_feature (237)..(237): n is a, c, g, or t
  misc_feature (294)..(294): n is a, c, g, or t
  misc_feature (301)..(301): n is a, c, g, or t
  misc_feature (323)..(323): n is a, c, g, or t
  SCN-specific regions: Sequence locations=1-461
gcgtgttcaagtgttgtggaacggaaaacaccacttttacaaatttagtgcttcattcgaacgaaaaagttacagcctcgagcatcgttcatgtgccagcttggggaagccgcttgagactctttgctttgtccattgtgccagcnntcaaaaatggccttttttaacaaacacttagttgggtttgtgttcactcagcccccttctctgagggagctttgcttttggacggtgcancgacaactcgcggaatggcgccctcgggggaaaatatggaggggcggaaggacccanaaagaantgcaagccatgttcaaaataantcaaaccattcaaattgttcattgaaaaagcatggatataccgacccataaatcaaagctataaactataaagttttaacatcaaagttcattattttttaatcaaaatctgttaataaattacacctaaaaaaaaaa

SEQ ID NO: 94557 - DNA, 461 bp, Heterodera glycines
  SCN-specific regions: Sequence locations=1-44,66-107,129-461
gttgtcgtgtgaatttcggacggaccgaaaagtgaaagaggttaaagcggaggaagcgcaccgcccaattcaacgaccgacaattccctttaattagcatcgaattacgggggctgggaaaaggaggacaaagacaacagccacaattggacttctaaagttgcgtattgtcagcttctgagatggtcgagggcggaatcactttggtcaaatacctcctcttcttcgccaacttcgtcctttggactctcggcttggcctttctaatcgccggtgtcgtacttcaactcaagtacacgggccttttggacattcttggcgatgaacggctcaccacccccatgcttctgttggccatcggctgtctgtgcactttgctcggttttgtcagctattgcagcaccatccacaagaattactgcttaacagtcagcttcactattctactcacacttctacta

SEQ ID NO: 94558 - DNA, 498 bp, Heterodera glycines
  misc_feature (287)..(287): n is a, c, g, or t
  misc_feature (350)..(350): n is a, c, g, or t
  misc_feature (361)..(361): n is a, c, g, or t
  SCN-specific regions: Sequence locations=1-498
aaaattccaaatatttgtcctggcattattggtcttgcttcggtttttcaatcctcccaattgccaggccattgtcaagctggtggagacgttcagtgctgctgatgagctggtcggattggacttggagagcggaagccgtgtgttcctcaggtgtgtccccagaaatggggggacaacaaatgggtcgggtcataaaaagtgaacactttcattcattcccttcccccgtttagggcgtttgggacaatgtgtgcgtgaagcaggcgagtctgaacgcctgtcanaacatcacctccaatctgctggaggtggacgaggtgatgcatgccggcatgccccacttgaangggggacagtnaaaatgaaccgaacggaaatgaaagaacaacaccaataaatcacaaaatgttaatggctttttctttattaaactctacactttattatttaaatcagaccactactatttgtactttttcaatctcgctttcttta

SEQ ID NO: 94559 - DNA, 367 bp, Heterodera glycines
  SCN-specific regions: Sequence locations=1-56,78-214,247-367
tactcttctgtgttgtgattggtttcattagaggcgtcgatatggaggcgataatttggagcaaaatattcaaaataatcgttgtaaggaagttctgaaagattgaaagggttctaattatcttcaaaattgctaaggtcgttatgttttatgattaatgtgaacgaatgtcaaagaacaaccgtcggatatgtcaatgtccacggccaacgacgtctcatacgtccaacatcgagcaacattccgaggagtgtacctttttcaaaaagcaaactgtcaaacaaaaatcgcagtattacccgccgccgcctaataacatcaacagcaaattgcaatcacagaaaaatgtcacgcattttccatgtcc

SEQ ID NO: 94560 - DNA, 479 bp, Heterodera glycines
  misc_feature (321)..(321): n is a, c, g, or t
  misc_feature (394)..(394): n is a, c, g, or t
  SCN-specific regions: Sequence locations=1-174,200-343,365-479
gcgcccctctgatcagttgtgccgcctcttcgatgatgccttcgtccgtcattccctcgggctcttcggcgttggcccatttgggtgccgtcgactattattctgcggctgccctccagcaacagcttttgcaacaacaactgactgcattagcagcagcaaatccggcactgtccgtggcagcggcacagcagcaacaacagtacgctgcggccattgccgcggcggttgcgtcgaattcgtccattggccagcagtgcgccgtgccaactcagtccaatgggtcagacagtccctcggccggcggttggtctctgtcantgcacaatttggcctctgaagtcagagaaccaacactgtggcaaatgttcagaccattcagtgctgtcctatncataaagttatccaaaagaaaagaacaggcaaccattagcataaccaattataaagaaacaattataacagcaaatacactaaat

SEQ ID NO: 94561 - DNA, 493 bp, Heterodera glycines
  misc_feature (318)..(318): n is a, c, g, or t
  misc_feature (394)..(394): n is a, c, g, or t
  SCN-specific regions: Sequence locations=1-24,67-78,100-143,166 -340,363-493
ttttgtacaacttattgaataatgaaatattttctaatatttttcatttcttttttaatatttaatgactgtcgccctttccccggtgatgaaaatgaaaacgaagaaaataatcgccaggaatctggcgagtgttctcgtacaaacacggggcgaggcaaaagaaagctacccgaagaagaaaaagcaaaaatactcaaaaatttgaagatgagcgaaattcgtttaatactaggcaacaaaatctcagagaacatgccaaaaatgaattgctgggaaaaattctaaaggcaaaaaatgaatttatggaaaagatcnaaaacgaaagggcccaaattgcggaaaaacttttttgcaaatttggaagacgaagcgatggcggagcaaagcacanaatcaccgggggtcaaccaaaccacagataatcaaatcacatactaacaacctaagccagtgccaaatgaaaactgatggatatggatgttataattat

SEQ ID NO: 94562 - DNA, 447 bp, Heterodera glycines
  SCN-specific regions: Sequence locations=1-90,113-344,378-389
ttttcagaaatgcatttcaaattctctctcatttctctcgcctttttgtgcctaacattttgccttatcttccaaatgccatgccaaactgaggctgctgttgctggcgctcacactgtgctgaaagtggctggctcaaagccggggtcgatggcactaaacactgtggcacccggtctcggcacagctgcccgggtcgccaatcgtgtggtcaatcattagcctcgtcattgagcactgccgtaggagaccggtggaaagaaatgccaaacttgggaggagtggagaagtgccggaattttgttgcaaatccttttcatatttgtagtttgttctttttttaattctttttcagcttttgaatttgggctatatattttcttcaacacaaaaaaaaaaaaaaacaaaaaaaaaaaaaaaaaaaagaaaaaaaaaaaaaaaaaaaaa

SEQ ID NO: 94563 - DNA, 275 bp, Heterodera glycines
  SCN-specific regions: Sequence locations=1-237
agcggggttggtccgactatccacgaaatcgacgacgatgaagcggactcggcaaacccgaaacgtcgcaagggcgtgttcggcaaattcctcggctgattgtgagagccaattcgatttggcattggcagcgatgtaaacattaactgattgcttttaactgatcacgtagtacccgacaaacttttgtcgcccaatgggtgattggtatgaatcccaaacttgtatcacaaagggatttttataaatattttctaaaaaaaaaaaaaaaaaaa

SEQ ID NO: 94564 - DNA, 391 bp, Heterodera glycines
  misc_feature (148)..(148): n is a, c, g, or t
  misc_feature (162)..(162): n is a, c, g, or t
  misc_feature (180)..(181): n is a, c, g, or t
  misc_feature (193)..(194): n is a, c, g, or t
  misc_feature (213)..(213): n is a, c, g, or t
  misc_feature (224)..(224): n is a, c, g, or t
  misc_feature (365)..(365): n is a, c, g, or t
  misc_feature (368)..(368): n is a, c, g, or t
  misc_feature (371)..(371): n is a, c, g, or t
  misc_feature (373)..(374): n is a, c, g, or t
  SCN-specific regions: Sequence locations=31-391
aattaataaattgaataaaaattaattaatcaatgcattcctttcttgtactgaccattctttttgccaatttggcatcaaatgcttttgggcaacaatggccaaaagcgactagtgaagaaactgttaaggcaacaattaaagtgtncgggagggcgtcanaagactttttggcttcannagcggttgactnngcctcttctgcattgggcnagcggtgatcnagtcggagggccaaaaagcactgatccgtgccgaaaagggcgcagtgatcaaaaatttgatcattggccaaaacggggcggacggcattcactgctataacgggtgcacgctgcaaaatgtgtggtgggagaaggttggcnaanacncnnccactttccgcaccagc

SEQ ID NO: 94565 - DNA, 493 bp, Heterodera glycines
  SCN-specific regions: Sequence locations=1-493
tcatttgcttgccgatgttcgtcagaggtttcttcaaaagggcgggcgtttggcgctttgccgaaaaatggtaccgtttcggctgtttgatgttttcttctgcctcgaagttttcacattggcgaaagttcggtgtgcttttgttgcggctttgaagggcaaagacgcgccgtccctttctctcaatgacgacacaactccgagcttgaatggttcggggtcgttcctggatgttacggccgacgaaaacttcaatcgcttgatcccggcgagcagccaattggagaagagagacattgccatcggcgttttgagcagccaattggacgttttgaacagccaactggagaaaaaagacatcgccatcggcgttttgaacagccaactggagaaaaaagacatcgccatcggcgttttgtcaattgctgtcgtcgggatgggcgctacaatcatttatctgttgaaccgtcgctgagttaacgctaaccttctg

SEQ ID NO: 94566 - DNA, 354 bp, Heterodera glycines
  SCN-specific regions: Sequence locations=1-354
catcgattgaggagtacaacctgggccaggtgggctattacctggacgaagaaaacaattgggcgctggacatggacgaattggaacgggcattgaaggtagtgagcacgatgtgaaggcgattgtggtgatcaatccgggcaacccaaccgggcaggtgctgagccgagccaacattgaaaacatcatccaatttgcgcacaaacaccgactgtacatcttcgctgacgaagtgtaccaagaaaatgtgtacgcggagggtgccgaatttcacagcttccgcaaagtgatgttcgaaatgggtgcgccatttgacaaactcgagttggccagcttctactcctgttccaaggg

SEQ ID NO: 94567 - DNA, 269 bp, Heterodera glycines
  SCN-specific regions: Sequence locations=1-269
atgaagttggttaccctattgctattcttgaagattgtgtttgccgacaacgacaaagatgactgtgacgatgacaaggataagagtttgaaggatttggattatcgcgaccaaattggatttgttgactgcggatgttcaaccatcaacggcacggtagtttgtgcttatgctgatccattcccaccttaccaaatgaagggtggattcgactgtcaaagttaatccaataaaaataccattttagcgttaaaaaaaaaaaaaaaaaa

SEQ ID NO: 94568 - DNA, 526 bp, Heterodera glycines
  SCN-specific regions: Sequence locations=1-4,26-65,88-478,500-526
tctcttaaaaaatcaataagatagtgccaagaaacaaaaaagttctttgctttcactaattacccatttatttattttaattaattactcgcttttattgccaatatggccactgcgtcgaaagcgtcgcgcgtttttagcattttggaaagggccaaattggtctgttggtttgaagagaccaattcgtacacccaaacagcacgaagatttcggaccgaatttggaatggacccgccgccgcgagaacaagtcaaaaaatggcacgacacttttctgaagacgggcacaattgggaagaaaaacggagagggcaacggcacgacggacggccaaatggcactttgaccggcggaagaatgggccgcgaaaggatgcacaatttgtcggcactttgcagtgatcgccccgcttggcattcaattttagttgtggcgttaatgggacaatcagtgaataattgaagtaacaaaaaacaaacatttgctcaccgaaccattggaatttttattatgaatttattttg

SEQ ID NO: 94569 - DNA, 753 bp, Heterodera glycines
  misc_feature (392)..(392): n is a, c, g, or t
  misc_feature (602)..(602): n is a, c, g, or t
  misc_feature (701)..(701): n is a, c, g, or t
  misc_feature (747)..(747): n is a, c, g, or t
  misc_feature (753)..(753): n is a, c, g, or t
  SCN-specific regions: Sequence locations=1-13,35-753
gctttttccacgcttaaagtcccattcattcctttgcttttgccgatcgatcgatccgaacaaaacaaaatataatcgaggtccaagagaagacgacgtaaaggaatgccttcgggaggcgacgatgaacaacagtttgaggaggcggtcaaaccggcattggagtcccttttggcggatttgcaaaagaccaccgaagttcttcggcaaggcaaacatggcaaaggccgacggcaacagaaggaggacgaatccgccgctttgttggacttgaagaagcttcggaactctccccgccagcgaaaccaatcgccggcagcggtcgccaatttgcgaaacgggggaagcgaagagctgcaggcttgccgtgacccgatgcttgagggcgacanattgggcatccacaccatacccgagggggactgtgctccgtgcaaccaggcaggtgatcggcccgcagcaatagcactgggcaccatactacatacagaggtacgtccggggggctatcagagtgtgggtcgccggtgccactggtgggccgcgcccacgcgcaggcgacaggagcacgcggcccagcgaggcacacggccgcgcgggancgacgcagcaccacggcgtgggcgtcaccctgcgcgccgcatgcgcgtggcgcgcgacggcgcgctaagggagggcgcgcggaacgcggccgccgacgnagctgaccgaccggcgcaggcgcacgtatcaggcggccgggcgcgngccccn

SEQ ID NO: 94570 - DNA, 393 bp, Heterodera glycines
  misc_feature (145)..(145): n is a, c, g, or t
  misc_feature (161)..(161): n is a, c, g, or t
  misc_feature (344)..(344): n is a, c, g, or t
  SCN-specific regions: Sequence locations=1-393
tgactgtgcttccgaattgtcaaaatcattaataatttatcgcaaaaatggccaacaaatttttaattgctgcttttattttgacaatggccatttttgtcaatgggcaaagtgaggcgccgaacaattcgtcggaaatggcatncggaggagagcaattncggaagagtcgggcagtgaggagcagcagttcaacccattcaaatttcggccattttttggtccttcgtcgtccaacagttcggcaccgccgcccttcggcttttggcccttttttttgggcaaatgccattgccatttaaccgccccgccaaccgaccgccgtctgacaattgatcactttntgagtgatttttgtccgtcgatcagtgcgaaatgaaacggatgatgagc

SEQ ID NO: 94571 - DNA, 456 bp, Heterodera glycines
  SCN-specific regions: Sequence locations=1-220,242-456
gtgttgcggatcgtgagaatgaacgcatccaatgcttctcagctggcttggaaggcacaactcacaaccgaagggcgtatgtgccaacgggcacatttgtgaccaaagcagaaaacattggccgaatttatgccataagagagaaagaacactttctggttggagtaaccagttgggaccgaagtggccaattggaaccgcaagtgttcgtgatggacatgaacacggggaaggcgaacagtttcgcgaaggggttggccaatgcccatgcggtcgctctcagcaacggcggcgacattttcgtgtcgcaattggagccgcaacaaatcgtcaaattcagtatcccttccgccggtgatgcgcaatgaaaattggaaacagagagaagcaaaacgaagaaaggggcggaagagaaactaaatcagtgaaaaaggctaatggaaaacgaaaccaaaa

SEQ ID NO: 94572 - DNA, 264 bp, Heterodera glycines
  SCN-specific regions: Sequence locations=1-264
ccaaagttcagctgaagtcgcaactgttgatgaacctcgaaatgcgcccagtccaattcgaagatttggcaagacaaatgttggcccatggacagaggaaaacagctgacgaatactcggatttaatcgaccgagttgagaacaccgacatcattcgcatcgcccacaaaatgttggacagccgactttcgattgttgggtatggagacttgagaaacatgccgacgtacaaaagcatcgagtcaaggctttgaacactcagat

SEQ ID NO: 94573 - DNA, 337 bp, Heterodera glycines
  SCN-specific regions: Sequence locations=1-304
tcggtgatgcaggatcccaggaagtgattggaggcatgatttcaatgaagttcttcgagagatttgagccatttacttgcttcagaatagtatatttcacatcactgggagtgtttttcattgtgcacttactgtgagccacggagcacctcctgtaagccttatattgttcattggcttgacaatatttgcctggctaaataactacaaattctttacaattcagtcgtaagtgttcatgcaaatggatattaaaaaatagagtttattcaatgagaacaaaaaccttcatagctttagatctaaaaaaaaaaaaaaaaaaaaaaaaaaaaaaaaa

SEQ ID NO: 94574 - DNA, 160 bp, Heterodera glycines
  SCN-specific regions: Sequence locations=1-160
gcgaagctgatcttctgtgtattcgtgatcgtatttatctgtatttgtatgtattgtcatgtattcatctcgctgttgtcatttcattcacttgtatatttcaaattaatataggtaaatattgaagttgataaatttacatgtaaaaaaaaaaaaaaaa

SEQ ID NO: 94575 - DNA, 522 bp, Heterodera glycines
  SCN-specific regions: Sequence locations=1-14,37-522
attgttcactctttcctcccatttttgaaaaggaatcgccaaaatgttcttctgctcgcttcttaagaaagacgaattgccggccgatttagccgcccttttgtcttccaaagtcgtagcggatattaatgcattgctggccaacaagtcgctggactgtgctcagaaattggaaaagatcgacgaactgatgaaaacggtgccggacgaagtgatggaaaagctgccgatgccgccgcatttggcacaacttccggaggaagtgcaagcccaaatcaagaaattgtgcctagaaacgaagcacaaatcggtggaagaaaagaaagaagcattcaaagcgtacgctggcactttgcccgcggaacagcgagcgatcatttgcaaggaaaagccatcatgtggcaaatgatagaaccgatcagaaatggggacggacggaggacggaaaagttatcagaggaaaatgcgatcagataatcagcccaatccattgtagtcaatttttagtgtaattaatccgac

SEQ ID NO: 94576 - DNA, 519 bp, Heterodera glycines
  SCN-specific regions: Sequence locations=1-519
atcgtcgatgggaggagtcactcaacggtccagcatcgccactgccgatttgatgctgccccggcaagtgtccattgttacggtcggaacttcgacgagggcagcggaaaagcgcaggaaccgaacgacagtgcttctgatcgcatggccggctcctacgccgtcctttggcttccctttacgttcgtttccattctgatcgacttggattggcttggcgtggagagtggctctccaattgtcgaacgcattgatcaaacttgcaaattgttgtccatcacctcaatttgcgtcaatccctttctgtacggctatttgaacaccaatttccggcacgaattcaatgagattttcctttattgcttcgcttggcttcccgcggtgaaggaaagtcggcaaagtgaaatttcaagctcactcggcggcggtgggggaagccatcggagaagcattccgcaatattcggcaattgtcagcaaaacggatgggtcgactcaacaatccaacggagtaaaagtg

SEQ ID NO: 94577 - DNA, 195 bp, Heterodera glycines
  SCN-specific regions: Sequence locations=1-34,67-129,182-195
tacgcctaaatttacggaaaaataaataatacgcttaaattaaaatataaaattaagtttaaaatacctgcgttatgtcatgcactcgctcatgtgcctttaatgtcgtctaaatattaacaccaaaaaaattaattaattaatgcaattatttggctaatttttttattaattattaaatatacaccgaaaaaa

SEQ ID NO: 94578 - DNA, 539 bp, Heterodera glycines
  SCN-specific regions: Sequence locations=1-139,162-539
atcatttgcagcgcacctcacgtcgcaaattggctgatgaaatcgcggctgtaataaaacgggacagatcacgctcagccagccgggcgtccctcgaacggatcagtcgggaagttcggcacaaatttgctcattacacgccacagaagaagaaacaacaactgccaagataaaaaaaaaaggcttacagacgactaaaaaacactattcgcctgatcaatgccaaatttgatgtgttcccgccactcgaaaaactgcttgacatcaaacgccgcatctgtgggtcattgcaatacgcaccaattgagactagtgcaggtgttggatttgtgtgcactggatgtgagggagctctggaggcgcgtctttcatctgccaaggacaatctgatcagatttggcgacgaaatcttcataaagctgagcggcgaccatggccagagttgtacgaagattaccgcctcattcagccaggctgctcggtcaaattctccatcaaacaatttcgtctgtgccgttttccctacaaaggatagccgc

SEQ ID NO: 94579 - DNA, 422 bp, Heterodera glycines
  misc_feature (378)..(378): n is a, c, g, or t
  misc_feature (380)..(380): n is a, c, g, or t
  SCN-specific regions: Sequence locations=1-215,239-352
acggcaacctaacttcctgtccgatgtggatcgaattgcaattcccacggccattacaaatattggacagggcactgatggaaagtgccagcgaaatcggcatggaagaagtgcacagcttttcctgaccaaatcaattcgtgatcagtggtgccttcggcataccgaattattaaaacaaagacattagccgtgttacaatccaaccgatcatttttcatttttattgaacaaaattcacttttgactttcgacccaacaaagtttaagtttggtaacacgggttgactaacacaagctttgattaatttatttgattcatataatcagctaaataaacttgaattattgcaaaaaaaaaaaaaaaaaaaaaaccananaaaaaaaaaaaaaaaaaaaaaaaaaaaaaaaaaaaaaaaaaa

SEQ ID NO: 94580 - DNA, 520 bp, Heterodera glycines
  SCN-specific regions: Sequence locations=1-39,68-143,166-520
taatttgtttctgttaccccggagcagaagatcagaacgtacaaaaaaccacagaaaaagtcctcaaaattgcagcacaaacagacgaaattttgctccgctaaaccaattgtgtcgctattctgtcagcccatcacgaattcgtacaaaggaagaaatttgggatggattcagacgattcagagcaggagacatcgtcagaattatcgacgaagacgaggggaagggatattttgcgcaaacagttgcatttatcaccgatgactataccaaccaatttgcgatggtcatttggcttcttccgaaactcagccgcaattcatttccaaaaccatttgagtttaatgccgacagatttcagcatggctttgccgaagaacgccccgtcccaatcaaagcttgtgaatttataagcaaatgtccgccgttccctccttacaaaagaaaatggacgccaattaatcaaatcttagctcagaaacgcagcgaaatcactcgaaggattgaggaaatgaacctc

SEQ ID NO: 94581 - DNA, 468 bp, Heterodera glycines
  SCN-specific regions: Sequence locations=1-160,182-184,206-447
ttgaagaacaaattcaaaggactgaagaagggatgctacccaaggccaacgggtagtgaaaaaaaggggaaaaaaggggagggatacggtggacgaaagtacaaaagcctactgtaaagggatgggacaaaaagcatacggtaggtgtatttggggaaaaacagttggaaaatttaattgagtctataaaaaacaattaattaattaggatgcctttgcgtggtgggcaaagactccgccgggcgggagataacggagagacgccggaaggagacggactgcaaatgccaaaagggggaacggtcggcacaatgtccagcggatggggcgtaagcactgatcgatcattggctttaattgaaaatgatcggacatttcataaaatcggcttaatcttccgatttttcttctgcgtttgtccttttttttatcatacccataatattaaatgtccacaaaacccaaaaa

SEQ ID NO: 94582 - DNA, 355 bp, Heterodera glycines
  SCN-specific regions: Sequence locations=1-40,62-355
tgtacggcacaacgcaacggcggctgttcccacggatgtgttaacacggaaggctctttttactgcgcttgtcccccgggaatggtcgttgatccggcacatccgcgccaatgccttcccatcgacggcggactgaaaagggcggccgatcttttttcgtactgggcaaaaatgtcaaaaaaagccggaaaggaggcgatgatgaacgtgtgtagagcgatggataaacgattgctcagacgtgtattgatcaaaacgaaaaattgatcagagtgatcagtcggccccattttatgtatttgcaaatcattactttacaacatttacgcaaaaataaaatttacagctgtaaaaa

SEQ ID NO: 94583 - DNA, 479 bp, Heterodera glycines
  SCN-specific regions: Sequence locations=1-234,268-479
ctaaccctgtggtggtcactgacatttgtgccgtgccatttaaggcgatgttacgctttatttacacaaacaatttgagtgttttggacggacaaaatgcaatggctgtgttttatgcggccaaaaaatatgcaatcatcggtctgatcgaagcattcgccgactttcccatttcgaaattgccaaatgttttccttgccttagccgaagctcgtcttctgcaagaaaatgtacaaaaattaatttttgaattataaataataatttcaatcacttttattttgggactttgctggtcgttgcttggcttacattgacaataacatggaaaaattgatcaaatcggatgattttttaccaattgatcaaaagttattcctggaaattctgagccgtgatcagctcaaagttggagaagaaagtcacatttggcaggccgtatgaaaaaagaaaatttaacaatatgaaacattgatttg

SEQ ID NO: 94584 - DNA, 210 bp, Heterodera glycines
  SCN-specific regions: Sequence locations=1-210
aggaaggcgaagggtgactgcaacacattttaaactatacatagttttattgttgttaattcataataagtttaagaaagatatgtataatctataaaagagcataaagcttatcaagttgacttgctaaacaattaaaacttataaaattgctttttatctaggcattatttgtattaaatctgattctgaggaaaaaaaaaaaaaaaa

SEQ ID NO: 94585 - DNA, 530 bp, Heterodera glycines
  SCN-specific regions: Sequence locations=1-530
ttacttgtcgcgcctgtgccgcgttctttcgtcggactgtttcattaaagcttcaatattcttgcaagcgtaaagaccattgcgaagttgacaaagcggcccgaaatatgtgcagggcgtgccgctaccaaaagtgtcttaggcagggaatgcttacgacggctgtccaacattctcgggacggaatcggcaaaaggtcggggagtgtccaacgcgagagactgctcgtcacttccactggcacttccggcgaaaccaaaatcgcccgcggcgcatcggatgcggtcagctcctcctcttcttcggctggtggccctcaagcactaattggaatacaacagaaagcacaacatttactcggaacagcatacggcagaaacagacccctttcgccatgctccagcagctccgcacttctgttggaccaggcagcaaatgctgcgaccattgtccaactgaacgcggcccccgggcacagctccgcgcggccttcggccctttctcctctcagcatcactacgccggcggcg

SEQ ID NO: 94586 - DNA, 252 bp, Heterodera glycines
  SCN-specific regions: Sequence locations=1-252
tcaaaaagtataactgaggagccaaaaaaacccaaaaagcctaaaacccaaaaaatcaaaaagccccaaaaataaaccacaaaaagccgcaaagcatcatttagaaaaaatcacaaaaagattcctaaatcctaccgtaaagtccatgttttcttgacatcacctttacccctcaccattttttttctttgttacttttcattttcactttgctatagtatgccctctgtcataaaattattttttggcaaa

SEQ ID NO: 94587 - DNA, 427 bp, Heterodera glycines
  SCN-specific regions: Sequence locations=1-44,67-240,262-427
tggatcgatgaagaacgcagccaactgcgataattagtgcgaactgcagaaaccttgaacacaaaacattcgaatgcacattgcgccattggagttacatccattggcacgcctggttcagggccgctgtgtttaataattcattttaggataataattattcaaaatccatttccgtttataatccatgtccattcaacgtcaaatgaagaaggcgtaatttggattatcagagtcaggaagcgacaccaccacctctacccactaaaactacttaacctttgcttcgttttcactattgtccatctctgccttttcactttacatttttcaatgtgctcatttctcccctcatcagttctaattgtgatataatacttaattccagcgcattaagataactaataatattatctcgttaaattcg

SEQ ID NO: 94588 - DNA, 534 bp, Heterodera glycines
  misc_feature (146)..(147): n is a, c, g, or t
  misc_feature (184)..(185): n is a, c, g, or t
  misc_feature (200)..(201): n is a, c, g, or t
  misc_feature (231)..(231): n is a, c, g, or t
  misc_feature (241)..(241): n is a, c, g, or t
  misc_feature (251)..(251): n is a, c, g, or t
  misc_feature (258)..(258): n is a, c, g, or t
  misc_feature (273)..(273): n is a, c, g, or t
  SCN-specific regions: Sequence locations=1-15,37-293,315-478,500 -509,531-534
tctttcaaatattaatctgtttccacaaaatcaaaatttcacaaaatctcgaaaattaggggtgcgcctaccattttccatcatgaaaaacccgaaaacgcttctcctcctcctatcatgaacgtacacaaaattgtgttgttccnnttttcgttttgttgagtttcttggtgctgcaggcgtnntcattgccattctgnnataatgatgaaagaaaccaaacctaagtcnagcgctaaanaaaaacaaanaagacanaaactaaaggtggtnaatccccatactccaacgcgtagaaaaatgaatgcccaacagatacaacaaacacatggaaacgaatctaatggctgatacggccagtgatggcgaagaattccttccaccattttggtgttgttgcttacatatttgtgggaaagagcattttaagtatagcatttgttatttaaattttctaaattttcatggcatttgtccgtatttatttgtcttacatttatttgtcttattatttttgggtataaaaatttcttg

SEQ ID NO: 94589 - DNA, 508 bp, Heterodera glycines
  misc_feature (150)..(150): n is a, c, g, or t
  misc_feature (170)..(170): n is a, c, g, or t
  misc_feature (181)..(181): n is a, c, g, or t
  misc_feature (220)..(221): n is a, c, g, or t
  misc_feature (252)..(252): n is a, c, g, or t
  misc_feature (263)..(263): n is a, c, g, or t
  misc_feature (287)..(287): n is a, c, g, or t
  SCN-specific regions: Sequence locations=1-94,116-371,395-508
tgcttctttcctaagtaattacagaaacctacagtaatttacaataaaatgggcaacttaaaaccaaaaggcataatttatacggccgcacaaaaaggtaaaaaggggcagaaaatgtccgaagcaaacggaaagtcaccaaagggcaanaaggggaccagaagaagtcncgtttcaagtnagttcattcttcaagggggaagggaaacggaagacaaannagtggcaaattcaaagaaaagcggctattanttggcagagcnaaaatgaaattaaatgaattcaancttttgttttcaattgcccggaagaatgctcttcgaaaagattctcattaaatgattaaatgagccattgacaatacaattgactgaatatataatatttttcaaatgcattagttttttctgagaattttccactcggaaaaaattgaccgtattcatttgttaacatttaacaagaaatatgattcaccaaaataataaatttgtgagttgtcaaataa

SEQ ID NO: 94590 - DNA, 586 bp, Heterodera glycines
  SCN-specific regions: Sequence locations=1-328,350-586
aaggcaaaagcattcaaatcacttcaattttgaattggcatttctctaatttaagatgcgcttcgttctgtccctcgcccttttggcacttttcgtcgtccaatgccgggccgatgactctgaggctgaagatgagcagcaattctctcccgctgatgagcaaggacaaggagcaccaccaagcgacgaaatgccggcagattttggcgatcgccgcaagcgaagcgctttcggcgattttttcgcgcgttttttccatcgaaatggcgcgggaacgcgccgccacggtccacccccgtcgaactgcacagaaattccatcaaatcagaatgaagaggaaaaggaaagcaaaacggatgcaccggaacgggagaagcgcagccttggcaaatggaaaaagcaaaaaggaggaggaaaagccaaaaagggacgaggagaacggccaaagggattcccatcgaccgtttcgccgacggatgaataatgaaaaagagattggcaactgattgcgaaagtgtggcgttgaaaattgaaatgtataaaaattcaattgaattcattttccgaggatttgcttttggctatg

SEQ ID NO: 94591 - DNA, 482 bp, Heterodera glycines
  SCN-specific regions: Sequence locations=1-221,255-255,285-317,339 -395,417-482
ttcggcactggatggcgcaagaatcgcgacgaggccaacaaaccgatcttttgggatgggaagaatgagggcgggaaagtgatgatgcacattcgccatgagctgaaggccaaacactcatggactggtccacaggaggaagaggagtccaatacgaaagttgcgcgagatgatgcggaacgtgtggcgccgcattgacccttcgaaacgtgccatgttcggcggtggccgctcggccggggtgctttcgcacgacggaggggcgcgtggcgggcgcggcggtggaaactttcattatcgcaaccattagacgaaacatttggcattccaaagaagagctttttattattggacattttcacattattcaacgaaaggatgagccaagttgtcaccacattatgttattttctggtcaaagactgactgttcaaaacgaaaactgctgaataaactgtgccagggaaaaaaaaaaaaaaaaa

SEQ ID NO: 94592 - DNA, 393 bp, Heterodera glycines
  misc_feature (143)..(143): n is a, c, g, or t
  misc_feature (150)..(150): n is a, c, g, or t
  misc_feature (187)..(187): n is a, c, g, or t
  misc_feature (207)..(207): n is a, c, g, or t
  misc_feature (236)..(237): n is a, c, g, or t
  SCN-specific regions: Sequence locations=1-51,111-270,313-327,349-358
tcattccttccattttcctgtgtcctaaaccttcatcaattaaaaacaatgcctttcctccgctcgcttcttctcccttccgttttgcttcttcttcttcttctgcttctgtccgtgtctctttgctccgcgggggtcttcanctccgcntgcgtatgaaagcgcccaattcgattggtttggcaanttcgatgggtgccgcgtggncgccggcttcggagggccggatgggtgtnncggcagaagatgaaaccgttaaaggcgccaaccaattaataaaataataatgcacaataataataatatttatttcatttgcccccgattccccattttcaaatgaataaattatatattcaaaaaaaaaaaaaaaaaaaaaaaaaaaaaaaaaaa

SEQ ID NO: 94593 - DNA, 633 bp, Heterodera glycines
  SCN-specific regions: Sequence locations=1-453,482-633
actctcagccgtcgtttccccgcgccttggccccgctccaatcgatcgccggcaatttgacgtttgaatcagcaagcgaacgaagcacaaggaatttcactcgtcatattttgacacacattgctttgtccatccatcttacattccaacagcagaaaaacagcaatggcatatgcaacaaaatattacgactatcagattgccgttgtttttgccattttactcggcggtcttttactcctcgcgttggtagtcacagccatttattacatttgtgtggtcaatatgcggggcaaaaagggcggcattacgcgcgttccttccggcagaagtacagtaaggaccaggatgaatccgcaacagtactcgccgtctgctcaaccgcaaatattccatcaacagtacccacagtattcgccgtacggtgggatggaagggatgagcagccaacaaacgcagcagcagcaacaacaacaacacccattccaagcgcaaaattatgagcaggcgggggtcagagtgagggaaatgcaaccggagtatttccaacagcagggtccaatcagttacaccaattatccctatgatcagcagccaccaaaattatcagcagacacacaagctgcagcaaca

SEQ ID NO: 94594 - DNA, 176 bp, Heterodera glycines
  SCN-specific regions: Sequence locations=1-176
cggcgaaaattgtgacgacgaagaaatgttagggaaaagacaaagcgcaaaatgggaggaaaagcatgagaaaatgaaagagtggagaaaaagaacaaagggaaggaaagacaaagaattaatgattatgataagagacaatgactgataaagtttagcataaaaaaaaaagaaaa

SEQ ID NO: 94595 - DNA, 435 bp, Heterodera glycines
  SCN-specific regions: Sequence locations=1-212,238-328,350-389,414-435
atcagcataatccatccgccgactgatgtggtcgaattcatcccggcacttggaaggggcgcatcggaaagaatgcgtaaagtaaactcggcaccgtgccttcaacaaatgctttgcaccaccgttcggaattcgttcacggacggaatgccaaaggaataggcgggcagcattttatggcggactgacggacgaatgttgcggcagaagatgaaaggaaaaaggaaaggaaagggaggacaacgtcagtcagcaaaaggccacccaatcacttctgttgccatccacttccactgatctaattaattgatatgctagtcaaatgcaaatttttgaatacgtttttcatgtacaaattttttttctttttcgtacaaaagtcaattatttccaaaattcattttgaaaaataataaaaagtttgtccattaaaaa

SEQ ID NO: 94596 - DNA, 507 bp, Heterodera glycines
  SCN-specific regions: Sequence locations=1-507
tcgcagaagcgccttttttaccctttaaaactgagggccaacatttcggatgcaaaaaaaacctaaaaatgcgctatccaatcttccaaatctttctgattatgtcttttatttgtcgctttaaatcggcggtaatcttccgatcggacacaatgaatcagacggattatggcccaatggttcttgctcataatggcacatctccgagtgatcaggataaaattcgagatgaagagactgatcactggctaacattaacgcaaactgatcaaacaacaactgatcagaattcaacattgagcatcgattggatgagcaacacaataatgaaagccgatcatgacgcaactttgagcttgggagaagaccatggacagactttggaagccaaaaacgatgatgaacccaatttggaaaatggtcattatggcacaactccgaccgattacgagccaaatgaggagaaaaatgcagtggataatgctgatcataatgatatggcagtgg

SEQ ID NO: 94597 - DNA, 544 bp, Heterodera glycines
  misc_feature (148)..(148): n is a, c, g, or t
  misc_feature (163)..(163): n is a, c, g, or t
  SCN-specific regions: Sequence locations=1-164,187-544
gttacgaaaggaaaagtatcgacgaaaattcgttgagtatgacggcgttaaaagcattcttttggcattgaatggtcgtgccaattttcaacttcaataccaactcattttttgcctttggtcggttgggttttttcgcacttttaanctcaaaaataatccntggaaaaagtttgttaatttaatttccccatttccttccgaaatttgttggagaaaattgacaacagagagatggtgcgcgaatcggcactgcaaatggtccaatgcaaaacgctgaaaacccttgaattgatggacgccaaaaagtttgacgacccggacttggtggacgacattgaatgataaaaatactcatcaaaattctcgagaccagcagcgacccattgccgctcagtgttgctgctcatgacattggcgaatacgtccggcattaccatcgcggaaaaacaattgtcgaacaataccaaggcaaacaagcagtgatgaagttgttgagtgcagaggacccaaacggacggtaccacgctctgttagcaatcca

SEQ ID NO: 94598 - DNA, 607 bp, Heterodera glycines
  misc_feature (534)..(534): n is a, c, g, or t
  SCN-specific regions: Sequence locations=1-305,327-409,431-607
cattaaatattacagcataatattagaaagaatattcgcgaacgaagtaaatgggaggaacaaccaacagaagcagcagcaagatgagggcggacctatctaatccaaataaatcctacccccactcttttcaataaatccatcttctctttcccttttcaatctttttttttggtgctgttcatccattgccaatgccttggttaagcaaaggtcgctttctataaatttaaatgaggatttccggagtcgctgatcatgaaaatgacattcatttcgacaaattccggccgtaaagaacaggcaaaataaatttaaattttaagacgaaaaaaattatgtttttgaaaattagcatttgaactttgaaagttggcatttccatttcttttccttttttgtattttttgtcgccaaatgtgggctttgacagacagagagagagcaattttgcgaaaagttataccaacagaactttcaactcatttggtttctcttccgtccagcaacaaatcggagagcatcgaagaaatntgcaagcgcaatcgtttgagtgcagccgatgtgtcggcaatttacgacagtttgccccccgaaattgaattct

SEQ ID NO: 94599 - DNA, 592 bp, Heterodera glycines
  misc_feature (331)..(331): n is a, c, g, or t
  misc_feature (333)..(333): n is a, c, g, or t
  SCN-specific regions: Sequence locations=1-351,374-592
gcttgatcggatgccgatgtgacactaatgaggagatcatccactgtgatgaccatgtgctgcgcaaaactgtgccgcttcccccgcatgggacgcatttgcgcggcttcaccgtcctctcgttgaccaacaacaacattgacgagttgccggatgaacagctgttgatgaccaaatttcccgatttgaagtcggttgatgttgaagacaacaaaaattttgattgtgacacactgaagctgttcaccaagctgaacgtgctgagcgattgtggcaaaaagaacgggaaaaaggatgatgaccgtgttcacgtccatgggccaaacagcananatgatgagccaaaacatcggggaaaaaatgaatggaaaaaatgtgatgacttaaaacggcgtcgcaatgatgaccaatatgtcggctgcctttgggaccaactccatgaacggcttaatgaaatctcggaggattacggcctgaaaacgttgatcgatgacattggcaaaatgttcaacgatgttggtgaacggatcaagaaaatcacttaatctgatcgaccgatcatgattaaaaccatggaattgatgcctataat

SEQ ID NO: 94600 - DNA, 278 bp, Heterodera glycines
  misc_feature (135)..(135): n is a, c, g, or t
  SCN-specific regions: Sequence locations=1-278
aatcatagcgagttgcgactacgatgaggcagatagcgaatggagcgatcggagaagggtagcagccagcgagtggctagggccagcgattggtgactacaaggaagaggacatggcgatcgaagaaccaacagnagtgggcgatcactacgagtgctgggcggggcgaccagcgattaatttctctctctcacctcacatgcattttttgctttgatcagtcaatcaaccaatcccaatcaaaagtgcattttcgataaaaatttttccattaaaaa

SEQ ID NO: 94601 - DNA, 724 bp, Heterodera glycines
  misc_feature (704)..(704): n is a, c, g, or t
  SCN-specific regions: Sequence locations=1-159,184-296,318-724
aagaaggtccattttggaagaggaagtggtcagcaaaaaggaaggggacggcgaagaagcagacgaaagtggggacacttctggcagaatggacattgccgacgaacaaaaggcggaatgggagaccgttggcgagacggcggcgatggtttctgggcctgttcctcctcctccccttcccagcgaggaaccgaccccagcccaagttgaaagtccgacgccagtgaagaaaaccaacgtgacgacgttacaacagaagcaagtggtgccgttgtcgaaactcaacggagtgttccaagaggaagaggaggatgaagtcgatacgttgcatcagatcaagaaaaagataaagcccttcgaaataacgcgagaggatcgattacaatcgatgacaccggaagaacggaagaagctgatcaaggaccttatcacgcggattcccaccgacaaagccaaacttttctcttttgaagtgtgttgggaattcgtggacgaaaatctgatggaacggcgagtgaggccgtgggtgaacaagataatttgcgaatacattggggaggagggacaatcgcttgtcgcttttatttgcgagaagatagcgaacctatcaacggcagacgaaattctgcaggacctttctatgggtcttgacccacgaagcagaagtttcatggtcaagttgtgggagataattgtgtacgaangagaggcataccggctgggc

SEQ ID NO: 94602 - DNA, 488 bp, Heterodera glycines
  SCN-specific regions: Sequence locations=1-26,48-380,404-488
ctgactagttgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaaccggttcatctggcagtccgaaaaaaggaaaatcgccacatgccgatccgaaaaaagctgcttcacaccttgtgccagtaacaccagggaaagtatgatgagcaagccttaaaatggtgaagaaactgtgtggagcgatgatgccaaccatgaacaaacccaaagctgttgaagtagatgtagaaaaaaaactgtggtatcatcacgctattattgttgtgtaaaaaacgatccgtttttacctcttttcg

SEQ ID NO: 94603 - DNA, 127 bp, Heterodera glycines
  SCN-specific regions: Sequence locations=1-127
gaattcggacccattacaaaccgattgtacggatagaggacgatgattcggcacagttcggatgttcggaagcagagcgatattggatgggaatggcggtgggtcatttatgctgttaatgagttaa

SEQ ID NO: 94604 - DNA, 67 bp, Heterodera glycines
  SCN-specific regions: Sequence locations=1-44
cgtcgccaatacgaggagacggagttggagaagcggcgcgaattggaactcgagactagttctctct

SEQ ID NO: 94605 - DNA, 176 bp, Heterodera glycines
  SCN-specific regions: Sequence locations=1-176
gcgggcgaatgaaatgaaagagtgtttcgccgacggcaccttcagcatcacaccgatgcctttccaacaagtgtacgcaattttggcacgtcggaatcgctgggtcatcccagtgtgctactgcatgctgtccaacaaaacgcacactacatacgagcgtggaattcatgacaaaa

SEQ ID NO: 94606 - DNA, 266 bp, Heterodera glycines
  SCN-specific regions: Sequence locations=1-266
acttccgaagcacccaattatgcattgtatgaacatgcagtgggttacacactattcaagatcaatgaatatgaagacattggtcaaatacaaccagaggtgcaaagtgcgatgacagatgctcagcgttttcaaacgattgtccaagttcatgcatttgacccattcagaaacactgaggcggcgcttgaaaatgcgaatagcattgcggaagggattatccacgttgatttgctgaactttttggaggctaatctaccgaaaaa

SEQ ID NO: 94607 - DNA, 160 bp, Heterodera glycines
  SCN-specific regions: Sequence locations=1-160
ttcaaattgtaaatctacgaccaaaacaagcagtagaagtgcaactgatcgttgaagaatcggaggaaaggcttacggaggagcaagtcgatgaattagttgagacaatcatcaacagtttacctcggaattattaatggacttttaatattttaaaaaa

SEQ ID NO: 94608 - DNA, 207 bp, Heterodera glycines
  SCN-specific regions: Sequence locations=1-207
ttgtccaacgacgcactaaaatcggtaactgacgttggcaacaaaatcgttcacatactgcgcctcaaagaagcaaagatataatgtcttttctgggttgaagttaccttaaacgggatatcgtggtgatggtcccttttcgttttgtgtatcatatcaaacacgatgtcctccacccttaaatcaataaatcttcatattagaaaa

SEQ ID NO: 94609 - DNA, 58 bp, Heterodera glycines; identical to SEQ ID NO: 56848
  SCN-specific regions: Sequence locations=1-58

SEQ ID NO: 94610 - DNA, 61 bp, Heterodera glycines
  SCN-specific regions: Sequence locations=1-10,32-61
ctgaagaaaggagaagaagctgaagaggaagcggtaaacagtgaaatgggaatattcaaaa

SEQ ID NO: 94611 - DNA, 203 bp, Heterodera glycines
  SCN-specific regions: Sequence locations=1-62,84-203
aacctttcgcagtttgttttattttttattttctttgtcggcgccgctgcgccgccaaacgaaaaaggaaaagcagacaaatcgcaaagccaagggacaacggcagaaaaagctgagctcactttgactttgactcttgaggaaatgttccgttttgaagcggaagtcgtcaaagtgttaagcgataaatttgaaacgaaaaa

SEQ ID NO: 94612 - DNA, 200 bp, Heterodera glycines
  SCN-specific regions: Sequence locations=1-200
tgtacatgatgggccaacaactgttgatgagcgtcgtccgacttcaggcggtgtcgggggaattaccaactatgagagcataaattccatgacccatccattaccacccacttaataccattgattgaaaagttatcctgacattttcgaatctcgtatattcggaaaatctgacaatcaaaaagcattcaaatcaaaaa

SEQ ID NO: 94613 - DNA, 102 bp, Heterodera glycines
  SCN-specific regions: Sequence locations=1-53,75-102
tgtctgaccagaaacaactgtttttattcggtcaaactcttcccggcaatcagagtggacttcttgaaaggatgaaagaatgtgcggacaaacggaacaaaa

SEQ ID NO: 94614 - DNA, 71 bp, Heterodera glycines; identical to SEQ ID NO: 64340
  SCN-specific regions: Sequence locations=1-10,44-71

SEQ ID NO: 94615 - DNA, 187 bp, Heterodera glycines
  SCN-specific regions: Sequence locations=1-187
tcaaagtgacgaaaaagtgtgctcgacacctccgacggggcccagttatcagcggaatgattgatatttaagaaataatgaccgatctttttgagctatgatgaattggattgattgattgatgatatttttgtttgctctttaaactgcctattgacgctgaccattaaaaataggaatttgaaaa

SEQ ID NO: 94616 - DNA, 259 bp, Heterodera glycines
  misc_feature (2)..(2): n is a, c, g, or t
  SCN-specific regions: Sequence locations=1-191,213-259
cnagtcaacaaagcacgtccacggcgcccaacggcagcattgagggggaaggcgacggtcgtgttggtgcatcatcatcggaggacagcgacagtggtagtgatgcatgatcggaggagcacaaataacttagttttccactcacatttggcgcctttgtttcactaattgaaattgttttatgcgcgggtgcttttcttttctcaaaaacctcattcatttcatgctttttttgatgaataaaccgagttagcacaaa

SEQ ID NO: 94617 - DNA, 211 bp, Heterodera glycines
  SCN-specific regions: Sequence locations=1-1,23-211
gacgaattcatcttttgatcaaatgatcggccataaaagtgaacgaattgacggacaaagcaaagcgaatgtgtgagaaaggcgagacgaactcggaaattagctgaaattgccggattgagaacggaagaaagcatcggaattgatacaaatttctccataattttttgactcaaaattcgaaataaatgcaaaaaaaaaaaaaaaaaaa

SEQ ID NO: 94618 - DNA, 54 bp, Heterodera glycines; identical to SEQ ID NO: 58510
  SCN-specific regions: Sequence locations=1-20,42-54

SEQ ID NO: 94619 - DNA, 143 bp, Heterodera glycines
  SCN-specific regions: Sequence locations=1-100,122-143
tcccccccccccccccagggggtagaggataggaacgctgatgactgcaactgccatcgaaactcatttttttcaccctccactcaatcgcatcaattgaataaaaatggaaaactttgaattatttttggagagatcactca

SEQ ID NO: 94620 - DNA, 98 bp, Heterodera glycines
  SCN-specific regions: Sequence locations=1-98
gtacggtgtgccaatgttggttggatgttgcgccattctttggatgttttgggaccgattcaaaaaaaaaaaaaaaaaactcgagactagttctctct

SEQ ID NO: 94621 - DNA, 119 bp, Heterodera glycines
  SCN-specific regions: Sequence locations=1-119
tttcgccgcggtgccttacggcaatgccggcctcggcacccgacatttgaggagtgctggagtgctggagagagagataagacattaatagagcgacatgagagaaagagataggaaaa

SEQ ID NO: 94622 - DNA, 161 bp, Heterodera glycines
  SCN-specific regions: Sequence locations=1-118,143-161
tattatcacatggaatcggtgataggcaaaacgccgaacgaacagaaggacaaacggacggatcttttgcaagagtgcggatgtttttggaggataccatcgctgagtttggcatgtgaaaaataaaaaaaaaaaaaaaaaactcgagactagttctctct

SEQ ID NO: 94623 - DNA, 257 bp, Heterodera glycines
  SCN-specific regions: Sequence locations=1-257
agtaaaaaaacacaggaaagtccattgcaaaggcgttggaggaaaagtagctggaaaaatgtgctcaacactttgatcacgcccgaccacacaaagaaggcctacgttcgcttagccgcagattatgatgctttggacgtggccaacaaaattgacattatctaaacacattctttttttattccgcgctttgttgattttcgggaataaattgttgtttgaaaaaaaaaaaaaaaaactcgagactagttctctct

SEQ ID NO: 94624 - DNA, 222 bp, Heterodera glycines
  SCN-specific regions: Sequence locations=1-15,37-179,204-222
gaatttgtcacctgaagttttgtgcttggggcgggggcggcgttcgctgtgttcgttctttggacatcgaagttcgttcgaggagcaactaattaaactacaaagtcaaattgtgctgattatgaccatttttgtctcgcatataaatgacgaaattagaatgctattaaagcggtccctttttaaaaaaaaaaaaaaaaaaactcgagactagttctctct

SEQ ID NO: 94625 - DNA, 69 bp, Heterodera glycines
  SCN-specific regions: Sequence locations=1-69
agcgaatttaattcttaatggaatcgcccgttgaaaaaaaaaaaaaaaaactcgagactagttctctct

SEQ ID NO: 94626 - DNA, 183 bp, Heterodera glycines
  SCN-specific regions: Sequence locations=1-183
ggaaagccggcacattgttatccctcagaaggcatttctctcaaaaccatccattacgatatttgctgcgactaattctcttattcgataaattctctaaaccattcgtagtttttccctggtttcttaatgatgaactttgttttccaaaaaaaaaaaaaaaactcgagactagttctctct

SEQ ID NO: 94627 - DNA, 149 bp, Heterodera glycines
  SCN-specific regions: Sequence locations=1-149
tttgtgggatcaaattcgtctcatttacccatgtggaattttgactttttgttcgaattcggatccggggtcgaaattggtcgaaatgaatgtcatattcgtgatcagcgaccccgaaaaccccaggaagacgtttttgacgaattaaa

SEQ ID NO: 94628 - DNA, 102 bp, Heterodera glycines
  SCN-specific regions: Sequence locations=1-102
agctcaaagcaacactaatttgacaccaaattcaaaaaatgggacgtgaatacaacaacaagcgaactcgggattacagccccgcgggcgacgaatgccaaa

SEQ ID NO: 94629 - DNA, 125 bp, Heterodera glycines
  SCN-specific regions: Sequence locations=1-44,68-125
tcagaagaagtgaatgtaatgaatgaattgttgagaaatgaccgatcattttgaattatgtaattttgtcctgctcatacataaaaattgtttctttattgtagagaaaggcaaatcaacaaaaa

SEQ ID NO: 94630 - DNA, 110 bp, Heterodera glycines
  SCN-specific regions: Sequence locations=1-18,40-83,105-110
ctttaaacggagattccgctgctcctactcccgcgaattgttcttttccctccatgaaaaatgtgctgcattcgcctttcccctggcaaaacaatgatttttgcgtgaaa

SEQ ID NO: 94631 - DNA, 153 bp, Heterodera glycines
  SCN-specific regions: Sequence locations=1-125,147-153
tcaatggacggccaatttttgggatgtctaagtccgctgcaaagacgcaaaaagtgacgacaacaaaaggacgaaaatggacaaaaaagcaaatggaaaaatgcggaacatttttaatgtaaatgaacaaaaacaatttattcaaataaaaaa

SEQ ID NO: 94632 - DNA, 68 bp, Heterodera glycines
  SCN-specific regions: Sequence locations=1-68
cgaatttaattcttaatggaatcgccgttgaaaaaaaaaaaaaaaaaaactcgagactagttctctct

SEQ ID NO: 94633 - DNA, 72 bp, Heterodera glycines
  SCN-specific regions: Sequence locations=1-34,57-72
gtcgaataaacgcattttgggaatattttaccggattaaaaaaaaaaaaaaaaaaactcgagactagttctt

SEQ ID NO: 94634 - DNA, 269 bp, Heterodera glycines
  SCN-specific regions: Sequence locations=1-269
ttcaaacagttgtcaaagcattcctgcaaagatggcgaatccacaacagtctcagcgaatccgaccaaaatcatttggggaaaacgacgaaagcccggcacaacggagggttggcattggctgaagggaataatacgaaaatgggcatttgcattttttacccggctctactggcatataccgtatctcctgtatcaaatacccaccgttcctctggttaatactcataccgtatatatcaaaacaaaattcaaattggcacaaaaaaa

SEQ ID NO: 94635 - DNA, 112 bp, Heterodera glycines
  SCN-specific regions: Sequence locations=1-112
acccactcaccactcctccttctatccacagactcaacaaaaacaatttgttcaaaatgtattaatccgaaatttaaccgtcggcttcttccccccatccatccattcaaaa

SEQ ID NO: 94636 - DNA, 181 bp, Heterodera glycines
  SCN-specific regions: Sequence locations=1-111,136-181
gtgaacgccttgtgctcggcgctttcgcatttgtgccattggctttcggatggcgccacacatttgctaattgcgctgcgaataatttcgtgacaagcgaattggtggtcatttgttggtgtttgttgtgttgtgccccttgcccatcagcagctgattttgaagtgcataaattccaaaa

SEQ ID NO: 94637 - DNA, 159 bp, Heterodera glycines
  SCN-specific regions: Sequence locations=1-53,75-83,106-159
gtggaaaatgggaagcaacggcaatccggaggaggatttaattaacttaacagacaaattaaagaaaaaactcgcaaagcatggagaagacgaagaagaagaagccaaactgaaacgaagaaaatcgaaaaaagggattttcgatagaacaattcaaaa

SEQ ID NO: 94638 - DNA, 211 bp, Heterodera glycines
  SCN-specific regions: Sequence locations=1-116,142-147,170-211
tttaatcgagagtcattgccccgttaatcatttgtaacggtacccactcgggcaaataaccttctcggctacaggtgtctaaattcaaatgaagccaaaagatttttcaatatttcacagcctttacaattaattttatgctcgttgattttgaaaaagatgaaaaaagactgacaaaaaaaaaaaaaaaaactcgagactagttctctct

SEQ ID NO: 94639 - DNA, 145 bp, Heterodera glycines
  SCN-specific regions: Sequence locations=1-5,28-67,89-145
aaatgaaaattattttcgtcaaaatattcactgccggcactttgttggcaatgctaacggtggcggtaatcgtcacaaaattttactttatcgaggaacgggaggagagaagggacggcggaggacgccatcgaaacaggcaaaa

SEQ ID NO: 94640 - DNA, 134 bp, Heterodera glycines
  SCN-specific regions: Sequence locations=1-13,39-47,75-134
atataatggcccgtggtcaccaaaaggcgctgtctcagcaaaagaaccagcaaaaacaacagcagcagaagaagggtcagggcaacgatcagagagcggctgccgccaaagcactgacattcaaatgctccgtt

SEQ ID NO: 94641 - DNA, 217 bp, Heterodera glycines
  SCN-specific regions: Sequence locations=1-84,106-217
cctggtaagactcacaatgtcgtcgattttgagaatgctgcgcacacattcggctgcctgtttgacggcgaacgaactgaccaaaagaggctgcaccacattttcttcgcgaatgtccgtaattgcaccctgaaaggactcaaacatgtcataataatgagaaaaccataatttgggcaacagacagttcattaataaataaactgaaaaggtgtaa

SEQ ID NO: 94642 - DNA, 49 bp, Heterodera glycines
  SCN-specific regions: Sequence locations=1-49
aacgctgtaatatcaaaaaaaagaaaaaaactcgagactagttctctct

SEQ ID NO: 94643 - DNA, 52 bp, Heterodera glycines
  SCN-specific regions: Sequence locations=1-52
cgcctatgagaaatgaccacaaattgggagaaacttagaaaggaattaaacg

SEQ ID NO: 94644 - DNA, 285 bp, Heterodera glycines
  SCN-specific regions: Sequence locations=1-285
gtgcctaagaatggctcttcgcgttcttcccatcgtcattttggcactgtttttcatttttgatggcacttttgcaaaaacggaggatgaaattaagcaaacgcaactgctgaagatcttaagcacaaaaacaacgaaaaactcttctgtgcaaacggaggatattgaagacgcaattgcgtacatgaaattgacaaacgaagaaggatacgaatcgcggatgacgaaaggcactggtgcaaaacagggtgatgaagcgacccgtgggcgtgtcgaacagcaaaa

SEQ ID NO: 94645 - DNA, 211 bp, Heterodera glycines
  SCN-specific regions: Sequence locations=1-148,171-211
gatttgatgggccattcggaccgcgtgctgtgcgttgattggacagtgccgagccgtatttgcagcggttcggtggactcgacggtgaaagtgttctcacatgggaccgaagaaaatatctaattgtttatcgtgatatcatttgttgttttattatagttaaaatttctgtacaaaaaaaaaaaaaaaaaactcgagactagttctctct

SEQ ID NO: 94646 - DNA, 223 bp, Heterodera glycines
  SCN-specific regions: Sequence locations=1-223
cggtacggcttgcgtggtgacgccggttggccgaattctgtacatccgccagggcaatgggcgtgccggccgaatggaggacatgcaaattccgatgccaaattcggatgaagaaccattgaacatcatgcagagactgtacaaagcaatcaccgacatttattatgggcgacagaaacgcgaagaatggactcggattgttgtctaattatataattaaaaa

SEQ ID NO: 94647 - DNA, 167 bp, Heterodera glycines
  SCN-specific regions: Sequence locations=1-167
accgccactaattgtcagaaaaccaccgacggaaatgcgagtgatcagcggaaagggaatgccaatcgttggtggcaaaacggtgatgctttcaaagccgcgtccccttccgatgaccgacctcactttgtttggaggaggaattgggccaagacgctattataaaa

SEQ ID NO: 94648 - DNA, 246 bp, Heterodera glycines
  SCN-specific regions: Sequence locations=1-34,56-91,113-246
cgaaaatcactgattttattgaggcaaataatgtacttccaaattgccaacatggctttaggagaaaacactctgttacaactcaacttttggaagtcattgatgattttagtttggctttggaaaacaaaaaatcaattgatgttatatattttgatttagcgaaggcatttgacactgttccacatgaaagattagtttctaaacttaaaaatgttggcataaatggtactttgcttaaaaaaa

SEQ ID NO: 94649 - DNA, 128 bp, Heterodera glycines
  SCN-specific regions: Sequence locations=1-89,110-128
gatccgcctcaatttgctttacatttgcttccgtttcttattttaattattagttgacaattcgctgttaaataaatcattattttccgaaaaaaaaaaaaaaaaaaaactcgagactagttctctct

SEQ ID NO: 94650 - DNA, 120 bp, Heterodera glycines
  SCN-specific regions: Sequence locations=1-120
ttctcgaccctttgtgcgtctgccttaattggctccacacaattttaattgtacattttccattgatttgttcgttttgtccctccatccgaagcatttaatcataacctttcactaaaa

SEQ ID NO: 94651 - DNA, 219 bp, Heterodera glycines
  SCN-specific regions: Sequence locations=1-219
ttcaatcacatcacattgttcgtcaatgagcaccagcaacaaattgcgtcgcaaaaacagcagcagcgcaacgccctcctccgcctcactgctgcacatcaatgatgcacggattgcgggactgtacgacttggagcacaccattggcaagggacactttgcggtggtcaaattggcacggcacgtgttcaccggggaaaaggccatgatccctcaaaa

SEQ ID NO: 94652 - DNA, 109 bp, Heterodera glycines; identical to SEQ ID NO: 54000
  SCN-specific regions: Sequence locations=1-109

SEQ ID NO: 94653 - DNA, 413 bp, Heterodera glycines
  SCN-specific regions: Sequence locations=1-267,309-413
aaatgcacgaatgcggccacatcacgatttattggttcttccaggacagtgatggggttgataatgccgaaatggagtgcaccagggtggcatctgactattttaaccccatgcatgatattaaagaaaagcctgagttgaaatgaagggaagaactcattgaattagcaagaagggaagtttttcaaagaaacggctgagacaaaaggcgcggaagaaaggagccaagaggaagaagggaggaggtgactcatcgtccaattcatcggaaggagaggaggaggaggcgaacgaagaagaagagaagggacaaagtcgggagggagacgaatgatcgtgttggtttatgggactgcatttactcagtttattaaactcattatttacgagcaaatatatttttgtcactaaaa

SEQ ID NO: 94654 - DNA, 364 bp, Heterodera glycines
  SCN-specific regions: Sequence locations=1-292,316-364
acggcaatttttgtcctctttatttgctttttgttcattgtcctccccaccatcgcccaaatgaatcagccgcagggaatcgcattggtccgtcgggacagcgactacgacgaactgctgaccgaattccgctccaagggcagtcgaatgcgtttcggcaaacgatcgcttggtccgtcaacggatgccattggccttccgtcgtcggattccttttcgaactcggcggaccctaacaatttgatgtccggacatttcaattggaactgatgaccgaacgaacagaccgatctcatcatcatcatcaatcacatccatttattaagcattcttccaacgataaacttcgagaaaattaaaaaaa

SEQ ID NO: 94655 - DNA, 504 bp, Heterodera glycines
  SCN-specific regions: Sequence locations=1-229,252-367,389-504
tccaagggtggggcaactgatgccggaggaacagaggacggacttcaacatggacagatggttggacgcgtacgacgaggacatcggtcgttgtgcggaagtaatcgtcgactatttgaagaatcgaagtgctgtcggattcgatgatttggaaagcggcggagactttttcgcgcgtccttccgcacgtcattattgcggagtgttcacccagtcgaagcttcgaaaggattgggtgaatgcgtatgacaacgcaattgttttcgtcgagacgggcgtcgccgatccgaacatggcggcgcgagtgacccgcaccggcgacttcctccgcgagttttttgtccactgcgaattcgggtggaggtgaagaacctgagcaagctgatgaagatgaagctgcgagcagcctttcttttaatcgactgacaaaacggcacaaaacgcatttcctttttttgtgaattttggcacttccatcgattgctctgtcacttttcaattgtt

SEQ ID NO: 94656 - DNA, 513 bp, Heterodera glycines
  SCN-specific regions: Sequence locations=1-325,347-473
ccattctttcttccgatggatccctccactgctgctcttccccctatgcgtttttcttcgacctctctcgtccccgacccctccgtccaatttttgctcgatttggaaaccaatgcgcgttccattgcctgtggcattgacatggcattgcgcgacttgcggggctctctccgtggaatgagtgatttgacttgtgagtctgcaaatgtttttggctctgtggtcaattcgacttgcgattcggtcgacgcgtccattcgatcgatgtatacgatgttagcgaagactgaggagcttgacgagtctttgcggagcattgagaagctgctgcagcagatcaaagacaccaaaagacttctggacaaattcgaagagcacattgtcgtaggaaatcagtgatcagaaatgatttggcattttgttttgaatttttatccatttttatcgaacaaatcaataaatggatgaaagggaaaaaaaaaaaaaaaaaaaaaaaaaaaaaaaaaaaaaaaa

SEQ ID NO: 94657 - DNA, 417 bp, Heterodera glycines
  SCN-specific regions: Sequence locations=1-339,361-384
ctttttgcactcgaagtgcacccatcggctggcgatttgattttctttttccgtgagaaaaacggcgatcggaaaacgaacgccgacaaaaatgaaaatacgcaggaacgcgatgcgatctgtgaggtgtcgagcaattccttcgcggatgcatttcacgtcggaataattgtggagcggcgaacgcaaaatcagtgggcggaggaggacaaaacggagagaattgtgcacgcggcacgggacgaggcaagcagagaagcagaaaattaagctgaagacgcaaaaacacaccaaaacaacgaaaacacaaattaaccatttaaaatgaattccaaatttttgagtgtttattttaattttcaggctaaaacattattctagcacaaaaaaaaaaaaaaaaaaaaaaaaaaaaaaaaa

SEQ ID NO: 94658 - DNA, 327 bp, Heterodera glycines
  SCN-specific regions: Sequence locations=1-295,320-327
ataaatgacttcaattggcagagtacattccatttgaagtgcttcaaagtccttctcgttcaatttcggcatgatgatacagatttgacatcaccattcgaagcaattgccccagtcacagccacaccttctttgactctttttccaagtgctaacgacaaaaatgaaatggccgcggcgaggccgccgctagaccctcctttgtttgatggcttctgaaaaacgcaagaattaaattaaaatatatttcatggccaaatcgcaaattagcgattgaaagtgtggacccgaaatcttttaaattttaaataaaatgtaatacggaaa

SEQ ID NO: 94659 - DNA, 554 bp, Heterodera glycines
  SCN-specific regions: Sequence locations=1-554
tcttgtgacaattaaaatgtgcagctgcaatagttgcacaaacaagtggatgtgttgttgcggctgtcatgtgacatctggttctttggtcattgcttggctttatttggtgtccagtcttctgactttaccttccgctttttctgctttagtcagccaatatcatcttgttgcgcacaactttatgcatttaacactgacacttttattttgcttctgtgctattccgatcattgttggagaaatgtgcacacaaagaacgcatcacatgtatttgccatatctgatcataaatcccgtggcactgatagtggcattatttgtcgcaatatttgctccatcaactaatattatgtcaagagtgccaaatcaccaacaacatgatgttgcagctgtttttgttgcaactttaatgctttttgcgcttattctttctctaaacatttggatgtattcagttgtgtatcgggcctaccaatttgttaagcgctatggccaggaagaatagaagaaaaaaactgatgatgaaaaatgccctgcggcacataaattgt

SEQ ID NO: 94660 - DNA, 467 bp, Heterodera glycines
  misc_feature (3)..(3): n is a, c, g, or t
  misc_feature (14)..(14): n is a, c, g, or t
  misc_feature (18)..(18): n is a, c, g, or t
  misc_feature (92)..(92): n is a, c, g, or t
  misc_feature (128)..(128): n is a, c, g, or t
  misc_feature (175)..(176): n is a, c, g, or t
  misc_feature (205)..(206): n is a, c, g, or t
  misc_feature (224)..(224): n is a, c, g, or t
  misc_feature (240)..(241): n is a, c, g, or t
  SCN-specific regions: Sequence locations=1-386,408-467
cgnggaacttgcanacgncagcgtcttgacttcttcgctggtacaatttctcctgttcattcgttttgcaattattacggatgctgaaatgntcaaacgaatacaatagaagcgtgcacatgacacantgtgcgtgctttactcaaagcagaacgttgcggtcgtggaaggaccnnacaaagtaacagtaactttcacagataanncttgctactgtaaatggnaagaaccagcggatgnnctgtttcggagaaggggtgtgtaccacgtgaacaaatccgcagatgaaattacgctttacggtcgcaccggaatatgaagaaaacaacagcagaagcaacaggcaaagaaacctgaacacttccactgaccaagatgatattttgacattttcggaatgcaaaatttgttgcgatgttatgccatttatgttacatttgttagcggataaaaattgttgtcttaaa

SEQ ID NO: 94661 - DNA, 513 bp, Heterodera glycines
  SCN-specific regions: Sequence locations=1-17,40-513
ttttcgagtgacaaattattttaattttaccaaatttaacaatcgaaaagcaatggctactccagtgggcgatttggaaacggaatgggagacgtacgaaacggaattcaaaaaagcggagaccgagcacttgtcctacactcaacggcacaacgaaaacggcaaagaactgaagcgaaaattgtcagagcttgttcggaacatcggacgtctcttggcagggggcggagtcagcgacgacgacaaaggcagattggaagctttgaagacgaaggccgaaaaagctggcctcaaactttcggaaatgtttcgcgacgaggcgattgaaaaactcaagacgagctacaaggaagcaaagaaaaatcccttctggaataacaccatcagtactgcttctctgttggttgacgactcggtcttccgttttctttcagacgccgtgaacttgtgtgaaggtgagccggtccgtttttccagtactcgccctgtcactggatcgctttgatttcttct

SEQ ID NO: 94662 - DNA, 575 bp, Heterodera glycines
  SCN-specific regions: Sequence locations=1-575
gcgtgtatggcatttaccgttcggcgtccactgcgcgaatgccaagcgaatcgcgcgggactgaatttgcggctgcacttgccccgttctcgctctaacatcgacataccggcctttggatgtgccggtgccaattatatgccattcactggtttttctgccgtcaaatcggatatctaccgtgtgaacccattatattcattgcgcaattacatgtccgacaaatattaccatttttcgcatcgctacaagcgtacacaattccatcgccattattaccacggacaaattgaccagtacccgtatgaatggaacttcgaagggcgtggaacggcaacgggacaattttactttgcccgacgtatgaaattcaacccgtggcagttcgggtggaatcgcttctacgacccgtacagacgctactacgacccttaccatgacgcgtacatcaagctgtacgactacagaccacgtctgattgacggcatttattgaccaatcacacaattgatcaaagaaaaagggatgggacagacagaaattgatgagaaaaaaatgccaatgacaactgccag

SEQ ID NO: 94663 - DNA, 502 bp, Heterodera glycines
  misc_feature (284)..(284): n is a, c, g, or t
  SCN-specific regions: Sequence locations=1-242,268-502
acattgacgagaatgccgacactttgatcgaatcggagggatttttgcaaattgaccaaaaaatgttgtgcgaaattttggaacgcgacaaatgctcagtgtggacatgtgggagaagcagcagcgactgatcactttgaacaatttttgcgtggacatggagctgttcaagcactgcggagggcgacgcgttggatcagttggggctgcgtcactactgctgcctttggatgttgttgtcgcacgtggacctgatcgaaaagctgcccagcaagcataatgtngaaacggaaatagaggttttcctggacttgccgggaacgacggttgcgacacagaatgcttttacgcttctaagggaaattagtgagttttatcagttaatggcttgcagcagcaatcaatcatactaaacattcaataaaactttattaatgaaaaacgtacaattaaaaagtgtgtttcaacaaataacaaatgtttctcttttcttcgaatatta

SEQ ID NO: 94664 - DNA, 665 bp, Heterodera glycines
  SCN-specific regions: Sequence locations=1-392,477-477
ttatttttttggccttcccccaacaaaacctgtccttccgcttgtcccaaacacaacaacaatttacaagcaatggcaatgtttggcgtttggagggacaaaaaaagcgaaaaaaagagaggaaaataatggacaaaaatggaaacataatgacaattgtgaaaggcgtcggcgaatttttggtcatttcgccccgagggaaagagcgccaacgaaacgcgaatgaatcttcggcgcggctggtcaattgcacaagggttgggtggatggatcatcaccaacgctgatggacagtgcaacgcaccgcacaaaaaacacagacgttggtacgcaattggaagccgtgcagcagtgtctgtgaagaattagagagatagggcgacagtagcactagagggtggagtagggagggataagggcgaaggagagggggagaagaggagagcaggagagaaaagggggcggaggggggaaagagagagggaagggagggagaagagaggagaggacaggggaaggaagggggcggggaggaaggggggtgggagagggaggagggagagcagagggaagggcgaaggggaggtgaggagggagaaggggagaggggagtagagaagagagatgggggagagagagaggagagaggagaagaggaggggagg

SEQ ID NO: 94665 - DNA, 396 bp, Heterodera glycines
  SCN-specific regions: Sequence locations=1-100,122-396
ctattcaaatggcattcaaattggcattttttttcatcgcacccgtgctatgcttgtcaattttaatgatcggccaaatgccatgccaaactgatgccgttgctgttcatcccgctgttcgaacagcggtgagacttgccaatacaaaaggcggacagattgcacttggaattgtggcgcctagtgccctcccagctgctcggatggccaagcattttgtgcgttagcgtacgctgaggcaatgtgccaccagtgactgatcagagaaaggcagcaaatggctcgagtgatgggaaggatcggaattttgttgtaacaattttttcccaaatttgtagttttttcatcatttttaattaattttcggctttttattaaagttgggttggacaaaaa

SEQ ID NO: 94666 - DNA, 530 bp, Heterodera glycines
  SCN-specific regions: Sequence locations=1-530
ctcgctcaaattgccaaatcgacacaaaatgtgccgcccgttgctgctgtttgtctgcttcactgtcgcttttggcattctgtccattgtggcgccaaatcaagcgctggccgagccggtgataggaggaccaccaccagcaccaccaattgaaggagtagcagcactggcaggagcagttgatccagcggaccaaccggttgcttctggtgttgcaccaccgaagcaaccagttgtagtggaagcgtcacaagtggagcaagcggaagtcgatcagctgccaaaaagttatggccgaaaatgatcagtgtaatggacaatgggcgaagtgatcagagcgacgatcactgctgatcagagtgattgattgatgatatatgctcaagtgaccatgattgaaagaggccggatttatgaccacagccaatttaggtacatattccgaacaattttggcgctttttaagttttacgccatttgagtccggtctcaaatgacctacacattcattgaaataatttgctagaatt

SEQ ID NO: 94667 - DNA, 379 bp, Heterodera glycines
  SCN-specific regions: Sequence locations=1-146,168-379
tgatcagctttatattgttcgtcaaagcatttggaggaggttcaccaaagaaaaacaaaaaaatcaacgatggattggcacaacgcatgagcaaattgttgagcacgggcgcttatgcagatgtacaatttgtagtggaagaaggcgacaaaaaagagcttctgctcgcccataaggcaattctttcgcatgcctccgaagagtttgctttaattctcggttttgacacacaaaattcatcacattcaaatggaaaaatatctgctgaaacaattaagactgtgctggtcacagatgttacaattggggcgttcaaagtgatgctgagctttatttatacggaagggttgaagggtgataaattgagtgtttgcaaaaa

SEQ ID NO: 94668 - DNA, 206 bp, Heterodera glycines
  SCN-specific regions: Sequence locations=1-177,199-206
ttattattttaaaatggctgcattggaagaattccgaaattttacattgaaaaattgcatgaaaaactagctttgaattctcgactcccggacccagtgatcaccggaagaagaagtgatcatttgagaaatgactaattaattttgatttattatcagtttctgttgatttgtatcagttttaatgaacaaatgaggcgaaaaaa

SEQ ID NO: 94669 - DNA, 259 bp, Heterodera glycines
  SCN-specific regions: Sequence locations=1-167,191-259
aaaatgtccagctctgaagacgaatccaatcactactcgaaaaaggaaattcgggaaaaagaacgaaggcaacaaaagaacaaaaagaaaaatgaatccaaaaaggctaacaaaaagaaccgcgaagaaacgatcatcacattgggtgaagaaaaagtcgaactgcctgaagcggtgaatgaaattgatagtggatttgaagcggaaggagggacaaatgaaacggaggaggaaaaggacgtttcggaagtggtcaaaa

SEQ ID NO: 94670 - DNA, 462 bp, Heterodera glycines
  SCN-specific regions: Sequence locations=1-4,26-462
ccttcctctgcttttcccaatggatcggccgcttttccgtgcgcgagcattgccccaactttccgcactgtccgaatatcagttgcggacactgctcgcccactcggactctcagccggaaggaatctctccgaatgtgatccttttccaacgtggtgaatctctcagctgctggtacttacttttgtccggccaaatccaactttatctcgaccactgttcagctgctgattataatcaaccttcctcttcaattagtcaacttaaactgattgttcccggcaccttttttggcgaacttcgcaattatgccgatgcgactcattgttgctcggcaaaagttatccaacgggcggattttgtgcgcattgatctccgccattttatggccctttataataaatgggcagaacagttgcaaaattgcataatgccaatggaggatttggtggcggaaactga

SEQ ID NO: 94671 - DNA, 342 bp, Heterodera glycines
  misc_feature (281)..(281): n is a, c, g, or t
  SCN-specific regions: Sequence locations=1-255,277-319
tgtttttggtttcttcgggtcgtcaattatcttcattcgctcatctctttgtgccaattaattgccggatttttgcgccgaatattcgaaccatgtcgacaaagcctcccgctgataatgagtccaacaatgaaggtcaacagaagagcagtaactcactcgcacgagacgggaattatgaagatggaaatatgaagaatagagacaaacaaaaagagttcggaggacctgctggtccggagccaactcgatacggggattgggaaaggaagggacgcgtnagcgatttctgatcttcttcatgattttgtaattacggaataaaataatttaaatataaaa

SEQ ID NO: 94672 - DNA, 438 bp, Heterodera glycines
  SCN-specific regions: Sequence locations=1-438
gctcaaattgccaaatcgacacaaaaatgtgccgcccgttgctgctgtttgtctgcttcactgtcgcttttggcattctgtccattgtggcgccaaatcaagcgctggccgagccggtgataggaggaccaccaccagcaccaccaattgaaggagtagcagcactggcaggaggtgttcagagtgattcgctggcgaatgtcaataatttagcagttgatccagcggaccaaccggttgcttctggtgttgcaccaccgaagcaaccagttgtagtggaagcgtcacaagtggagcaagcggaagtcgatcagctgccaaaaagttatggccgaaaatgatcagtgtaatggacaatgggcgaagtgatcagagcgacgatcactgctgatcagagtgattgattgatgatgtatgctcaagtgaccatgatagaaa

SEQ ID NO: 94673 - DNA, 507 bp, Heterodera glycines
  misc_feature (240)..(240): n is a, c, g, or t
  SCN-specific regions: Sequence locations=1-147,169-466,488-507
ttcgtctgcattaaacccgaatccgtccgaaggtgcctcgtaggaaagatcattgaacgctttgaagccaacggctttcggctaattgccataaaaatgatcgttgcaactcgcaaacaagcgatggaccattacgtcgcttgtgccggccaaccctttttccccaaagtgatcagttatatgacctcgggtccggtggtggcaatgatctgggaaggtgtcggtgttgtgagaggaatncgcaaaattttgggtgccacccccgacaaagttcctccgcccggcaccctccgtgccgattaccgtaacaacagcgacgtgggcaaataccatgacacggtttgccacggatcggactccgcggaggacgcacagcgcgagtttggcatttggttcgacaaaagtgagatgccggcacctctctcgagggtatcgggctgatgtgatgggccgaccgatcgaacagaaatggacaaaatatttgcaaattcgaaatgctattcattg

SEQ ID NO: 94674 - DNA, 276 bp, Heterodera glycines
  SCN-specific regions: Sequence locations=1-7,29-234
gaatgaattcctgacagaaaataaaaaacagagaatgacatcattggcattaggcggaattgggctcggaatgagtggcaatgagtgaatggcccgccacaaaaacattctccgcattcatttgattattctttccttcgctaatgctaatgcatcatttttgtccctaaaagtccattttttgcttatttgccctttcttttcctttttttgtcattattatttttttgagacaaaaaatttcaataaaatattaaatcgaaaaaaaaaaaaaaa

SEQ ID NO: 94675 - DNA, 587 bp, Heterodera glycines
  SCN-specific regions: Sequence locations=1-190,212-323,345-587
cgaagtgcgcaacacggtgaaggcgaatgccgattgtgagatggacccggaggagataacccccgtgcctgatgactatttgacgaaatgatagatcgaatgcacaggatggaagtgcgcaacacggtgaagtcgcatttgtgcgatgatgggacgagctcgggcatcagcactgtgccttccgactactataccaaataatttgttaaaatgttttgtgttaggataaataaaattgtcttgtcttctgccgtttttatacttacatagttttactcgcgggggaagtttggacatcaaatcaaggattaaaagaaattgtgaaaaaattatgtaatttaaaagcttaggtcgctgatcacaaatccggcatccattcggccaactccgaaactcggacacgaattcgaacatttaaaatgagaaatgagggacggacgacgcttcgtatgaaaaatctgagcaaaaggggcggaagacgaaaaacggacgcatttgtcacttgcgagaaattggactatttctcgagaatcgcctttcccgcaatttacacgctgttcaatgtagtctactggacttattacatg

SEQ ID NO: 94676 - DNA, 77 bp, Heterodera glycines
  SCN-specific regions: Sequence locations=1-5,45-77
aatgtttattattgaataaatacacaaaaaacaaaatatgcgaaatttgtcaagaataaatccgaggggcttaaaaa

SEQ ID NO: 94677 - DNA, 510 bp, Heterodera glycines
  SCN-specific regions: Sequence locations=1-510
aatgataccgaatcaattgtgtaccgattggatgagaggtgaacaacttttaactggttatgtggaacgaggagaccttgtagaaattcgccgtggatcttacatgcattgggctgtctttatcggacatatcagtggacaaccgcttgtaattcatatttcgacagagtcatccgatatgggaattagcacaaagaaggaatttgtccggaagatggccaagggttgtgctgctattgtaatgcttctcacatccatctgttcaaccttacaaagactcgtcctttctctccgtttttcatttctcaatttgttcaaggtccgcagcgacccttttctgaatgttatttcgactgacttctgtcgtgtcaataattgtttggatgcaaatcgacgaccttttccaccctcaattattgtcgaacgggcattgactaagcttggaactggtgggtataatctcatcaaaaacaactgtgaacaccttgctaaatggtgtcgttatgctct

SEQ ID NO: 94678 - DNA, 425 bp, Heterodera glycines
  SCN-specific regions: Sequence locations=1-333,355-425
gcccgtcccacaaatcgcgtgctaaacgaacggacggagtacggcaaacgaatgaagcgattgtcgcagcgaatttttggcgagatcacacgaccgactgatatcaaatcgttgcgcgttgctgaaattatggcctccgagccatgggagcagcaagccaagctaagcgagaagtactacccgaacacgccaatgctccattacctcgtcaaaatgctgaaactgcacggcctgtacttcgacgagcatctcgtttggcgcgaagttcagaatgaaattcgtatttcaaagggtaaaatcatttacccgccaatcggtgcaggaaaacagaagatgaaagccaaaatataaagcaaaaacgttgtcggcgtagctctttttctgatcacatttgatttaaaataatgttttgctatgtgtttttt

SEQ ID NO: 94679 - DNA, 471 bp, Heterodera glycines
  SCN-specific regions: Sequence locations=1-30,53-221,243-471
ggcacacttcgaaaaggttttcctggcgaaatggcacagaaattatccacagaagcggaatggataggcaaagcattgctccaaaatgcgcaattgtaccgcgtacattgggaaaacttccattttgactacccggcattggttctaattgacgaaaaagcgacagataagtctgataattttgttgtcggcgatttggttcatctaaaaaacgcagaacaaagcattaaatggttggatgcctatgaggaatgcggagaacagttcaaccaaccaaatgaatacattaggaaagaagttactgtccaactgatgaccgatcaggaggcctcacaaaattttcttgcctcaacttatgtctatggttggcccattaaagactctgatggtaattttgttgcccctgttcgtgagattgtagttgccggtgattggctaaaattcgtgcaaaaaatattgaaaactaaaaaa

SEQ ID NO: 94680 - DNA, 360 bp, Heterodera glycines
  SCN-specific regions: Sequence locations=1-83,106-179,201-242,264-360
gtggaaatcggggacagaagggtggtgttgtccgctgctcggcttcgctgcttctccccggtgatcgatcggatgctcagcgcggagatgagggagaagcagcagccatcggtcactttgagcgatttgggcattgacatggaccaattcatggattttcttttgtacatttcgccaaatgctctgagccaaccaattcttcccaattggcaaatcatgaacatttgatgacttcgatcggcaaagaatttttgggagatttgacttggcgaatttgttgttgaatgcaaattgaattttatcttatcacagacacttttcaatttaaaaagaataaatagttgttcttaaaaaaaggaa

SEQ ID NO: 94681 - DNA, 466 bp, Heterodera glycines
  SCN-specific regions: Sequence locations=1-466
ttggccgtcctttcaatgtcccgagtgattgtctcctattttcgtcagtattcgctcaaggattggcgcgattattttctgtccacccatttttggggtccggtggccaattggggccttcccctcgcggcgatcgttgacttccgaaaggacccagagatgatcagtgggccaatgtcctgcgcactgacaatttactcgtccgtttttatgcgatttgcttggcaagttcagccgaggaatatgctccttttcgcctgccatttgacaaatttcgtagctcaacaaattcagatcgttcgcttctccaattaccatttcctccatttgtacaccgaccctttcgccaaaacggttaagaaattgtaaaggggacaaaatacgaaagtcgagcaaaggcattgcgcattcatccattgtttgtttattgtaacctttttaccataaaattagttgattaaaaaaa

SEQ ID NO: 94682 - DNA, 563 bp, Heterodera glycines
  SCN-specific regions: Sequence locations=1-354,448-485,508-563
cgccatcgtcgctgacgatacacaacccaaacatcgaccaaataaacaaccgagcagagaatgagcgcggcgaaaattgtgccgatgagcaacggatccgtcgacggcacgacatgccattggagaagcaatgtttcatcactgtccatatgtagaaaattccgatgggaaatatgtgcaagaattgtcacatctgcacaaagcattaatccagcagaaaggagcgcataagttaatgactccttaattgataggaagagatttatggctaaacaaatggaatctttaaaacgaaatttgtcattagaccgggaattttgggctaaaccagaaccagaaaagccatgaattttcaaaaaaaattttaaatttttttaaatttatttgttgttcgagtgaaaaataaataaataaaaaatattttgtttttaatttaagaaaaaaaaacagaacaaaagtgcagaactcgtaagttcggtattttgatgaataaaaattgtataaattgaaattgaaattgtcttttgttaacagatttcaccaaaattgtaacttttatgaat

SEQ ID NO: 94683 - DNA, 524 bp, Heterodera glycines
  SCN-specific regions: Sequence locations=1-32,61-93,117-326,354-524
tttgtcatccaccgaatccaaagtcgtgaaggccagtacaaactgtgcaaggtgaagaaacaggcggtcggtgacaagcaagtgccgtacattgtgacgcacgacgcgcgaaccattcgcttcccggacccacacatcaaggcggatgacaccgtggtgattgacattggcactggcaaagtgacggactacgtgaagtttgatgctggcaacatttgcatgatcactggtggacacaacattggccgtgtgggcattgttggacatcgcgaacggcacccgggttcctttgacattgtgcacatcaaagacaaagttgtgaagggcagtacaaactgtgcaaggtgaagaagcaggcggtcggtgacaagcaagtgccgtacattgtcgcgcagacgcgcgaacactattcgctacccacggacatcaaggttttctcgatgcaacattggtgcccaaatcctgcaagttttgcagaccacccatgcacttgttaatctcacgcatccgatcagcacgataat

SEQ ID NO: 94684 - DNA, 204 bp, Heterodera glycines
  SCN-specific regions: Sequence locations=1-204
ttatttaaaatgtcttcgcataatacttcagttattgatgaaaatcgacgatggagtgacttacgctgtttaacagatagggcgtctacatttgccaattcaggattcgtccctggaatcaaggtaaaattttgtgtaatagtttagatggtaaccatcctttttcaaaaaaaaaaaaaaaaaaactcgagactagttctctct

SEQ ID NO: 94685 - DNA, 263 bp, Heterodera glycines
  SCN-specific regions: Sequence locations=1-263
cgaatccatccaagctttggctgaaggcattgaagacttcagtggcggtgttgtgatggtaactcacgacgaacggcttatcagagccacagactgtcgtttgtgggttgtggaggatcagaaaatctaccaaattgatggcgattttgacgattaccgaaaggaagtgctcgatcaagtggagaaaagtctgacttcaattggctaacatttagcctttcctgatcgtttattgttgttgataaatcttatgatttggaaaa

SEQ ID NO: 94686 - DNA, 452 bp, Heterodera glycines
  SCN-specific regions: Sequence locations=1-398,422-452
ctctcttccgttttcatgtggggaggttacggtggtggttactacgacggctatggctacggtgggtactacggttcacagatcattttggtcgtcgttctgctgatcgtcggctgtctctttctcacttgcgttgtcgccggcctttggctgctttattcaagacaacagaaagaaaggggcgaagtgcggcaacaacagcagtattacccccaatattacactcgcaacggcggaccatacgcaaccaaagaattgagcacagaatttccctaaaaatggcattgatcagtcgccacaattggcattttaatcggacaaatgaaggcgcaaaaaaattgaaaattcaaaaaaaaattagcaagaaatgcgcatttattgaacgacaatgaatttagcatatcattaatatgtacatacatataattttatctgatcaacaaccctcgtca

SEQ ID NO: 94687 - DNA, 500 bp, Heterodera glycines
  SCN-specific regions: Sequence locations=1-82,104-239,261-383,407-500
attctttggttcgcctcgtccatgtgtcgtcttctgccgttgtttctgacgctctttgctgtcctcgtcgcactttgtgtttctgtggaggggcagcagccatccgccgagcagcctcgcgcagtccttttggatctgatccctaccgaacttgtggagaataagcgatcgccgcgacactttgcctttgccaaacgcgccagatcgttcgcttttgcgaagcgaaatgccaacggatggggaagggcttttgcctttgccaaaagaacggcggaattgccccaatggaatgaaaaacgctttgcttttgcggacggcggcgccagccgaaggttcgcattcgcaaagcgaaattatcgaaatttcgcattcgcttaacggagagagaagggaaagggcagaagcaaaggacggcaaactgagaaggacacgcgccgttcttgcaagcgataatatccgctttaatctccacttttatcccctcgtttatccgcccttct

SEQ ID NO: 94688 - DNA, 408 bp, Heterodera glycines
  SCN-specific regions: Sequence locations=1-408
cttacaaatgttagcttctttacccgctccaaaaatggccaattctgttgcgccttcactccaactgtctcccgtttctttcgatccacacgctggacattgcggccaagtattttgtggtcgccgaaacggactcgccggctgattatctcctcaaatttcaaattttgattgtgattgacaaaaacaaccacccatttgagcaaatgcgcgatttgaattctctgctctgtgcgaaattgaatgccgcagcggccacgatggctgacatttatggtgcactgcttctgcatgcgattttcgatggcagcaaagattacaccatggtcagtgttagcttccgtcgcgagcatcagccatttctgtcggagtttggggcgttgtgtaccaacctcagacatttactgt

SEQ ID NO: 94689 - DNA, 466 bp, Heterodera glycines
  SCN-specific regions: Sequence locations=1-429,453-466
cttttgcaatttgcttcaccgtctttaaacatgctgtcaattttgatgtactccatgcttttgtatgctgcccttgttctgttgataagtccagccacagttgtggccaacgaagatgtggttgggttggccatgcgcggcactcagcaattctttagacgaaatgccaaatggattaatttgccatcgggcggcggatcattggttagtggccgtggaaattttcggcccggcttccattctttgcatcgatcacgtactcagctggcggaacctctgtttatcacttttaaaagatctcccacaaatctcgcttcaatgatggttcgtttgcagaaaaacccgagacacaatgatggcacaaactgagaatttaagtgatctggataactcgaaaaatgtggaataaattaaatgcattggaattgataaagataaaagcaaaaataaattcttgcagttttaa

SEQ ID NO: 94690 - DNA, 490 bp, Heterodera glycines
  SCN-specific regions: Sequence locations=1-114,136-490
aaatttactttgacttcaataaagaagaaaaatggcttcatctggctttagcgtctatggtaaaagttctttcaaaagttgtagctttgagcacccttagaactgaatccaactgcaataccatttacggaatttcagtctatgtttacgtaggagcttttttgtacatgggtttttctggacataaataatcgacagagcatcttaaatcgcaaaatcgatggagaaaatgaaagcggcagaaaattatcgatgtgtcggtctaaattatacaccgaaagctaccaccaccaccacaaatcggtgtgaatgatgtgtggttaaagaaagctgcgcagttgattgggaagaagttggcatcattccgtacaacgcaactgaagcggacattggcaatttgtttagtcagtgcggagtggtcaccaatgttcgcatggtgtacgatcgcaagaccaatcgctaacagggcttctgttgctgtgaattccag

SEQ ID NO: 94691 - DNA, 587 bp, Heterodera glycines
  SCN-specific regions: Sequence locations=1-90,112-587
aagagtcggtcgagcagagtttgaccgaattggagcagaatgcgatggtgcgaaggcaaaggcttttggaatttcgaacgcaattcgtcaaaaaagcccaacagcaaaatggcgagaaagaatcgagcgacggagaagaagcaatggaagagccgatttctttgttttttcgctcttacaaaccctcaaaaaaggcagaagaggcgccggacgtgcccaatttgggcggaacgcataaggaaatggacaccttggagaagcacattcctgatcagctcgaggccagcgaagacacgaaaatgcgtgacgaattggacctgaagacgttggcaccgcggaaagtggactgggacttgcgcagaggagtgcaggaaaagttggacaaattggagaggaggaccaagaaagcgatcaatcagctgatcagacagcgcgtgaacgaaggggcggaagaccaactcgccgcagcagtggattcagtgggcgacggacgatgagagaaagggaacgaacggacagagaaaagagacaattcgtccgtctgatatgtcttcattgatcaaaaaggaaatgaatcggatggaatg

SEQ ID NO: 94692 - DNA, 524 bp, Heterodera glycines
  SCN-specific regions: Sequence locations=1-524
tttcctatggcacttttactaattgtcgatgcatattctgctgcttttgcccacccaattcacaacggtagacctactaccgctattgatggaaccaagctgttgctggtgccatcatcggcgaacttcgccaaagtgatgatggcaaatgagggcaccgccaccaaacattttgcatattcgccacggcaaaatggtggcgaagcattgtttttccggaccgcaaaagcatcgccacaatcagcttcttctgctggaattttcccttatccacaatcatcatttgacttccaaaatgatggagaattgatgaaaaatcatcgttttgctcgggacgtcgccgccgatggttcaaacggagtttttgttcgatctggtggtggtgccaccaaatttgcgtttgccaagagaagcggcggcacatttgcagcaagggcaaaccgatgggatgacgaaagcgcagcagcccaaggcggacaacttttcgctgtggagcccattgaatggagtccgttgagcagtga

SEQ ID NO: 94693 - DNA, 454 bp, Heterodera glycines
  SCN-specific regions: Sequence locations=1-107,129-454
cgtttcaatgcctatcataaattttgatcggttgcccgccgcaatgcgtccccagcgtcgtcgtctgcgggcaatccaactctttcaattggtccttttgtctctgtttggcattttgctttttgcaaaagtcatttataaaacggaaatggattcagaaaagggcggcatcgtctttttcgctatttttatgttcatcataatcattctttgcattcgcgaagtttacaaaggttcgcatggccaaaaatggcacttccatggcctttgtgccctcactttgttactctttcttttgtacggatggtattatggcctcttaaagcatgaaccagccatcagcgcaatttgggcaggaattatgtgcgaattgtttgcatacattgtgtgaaacaaaattatatccgttgatgaagagcatcgaattgaggaattggtgaatgagacaaacaaa

SEQ ID NO: 94694 - DNA, 263 bp, Heterodera glycines
  SCN-specific regions: Sequence locations=1-221,245-263
acgggacttttattcaatcggagcaaaacgaggaatgcaaatggggacgatctcggcgaatcatgactcatcagttaaattcgaactgatcagttccgatttaagcctatttcccatcgaatttatctgttgtcccatccctatccttctcaattgtctggctcaactcccgctatcaaatatgaaaaaatccagttttggacaaagtgtaaattttggtgaaaaaaaaaaaaaaaaaaaaaaactcgagactagttctctct

SEQ ID NO: 94695 - DNA, 169 bp, Heterodera glycines
  SCN-specific regions: Sequence locations=1-141
gaaatgccgcataacaaaaaaaccccgagagttatttcttctaagccattgtcggacgacgccgacagaagtgccgaagggagcagtaacactcagttggtgcaggcatatgccaatgagaacagcgaaggcggagctgacagcaagaaaaagaagaagaagaacaaaa

SEQ ID NO: 94696 - DNA, 144 bp, Heterodera glycines
  SCN-specific regions: Sequence locations=1-121
catcattatgttcctttgtgagataaaagaaaaatgaaaacgtatagtaaagtaatacatagtaagctgtggttgtttcctttcatatgttcgcttattaatgctgataaatttctaatcgaaaaaaaaaaaaaaaaaaaaaaa

SEQ ID NO: 94697 - DNA, 86 bp, Heterodera glycines
  SCN-specific regions: Sequence locations=1-86
aatagtgactaatgtttcatgctcaccagttcgttctcgtggtcattttggcattgtccattaacgaggtgaactgtatgccaaaa

SEQ ID NO: 94698 - DNA, 774 bp, Heterodera glycines
  misc_feature (476)..(476): n is a, c, g, or t
  misc_feature (573)..(573): n is a, c, g, or t
  misc_feature (726)..(726): n is a, c, g, or t
  misc_feature (771)..(772): n is a, c, g, or t
  SCN-specific regions: Sequence locations=1-449,472-774
gtcttctcgagacaaacattttgccagattcttgacggaaagacgagaaatgttgcagggcattcgcattttgcggcaagaacccgtcgagacgcttttcgcattcatttgctcagcaaacaacaatgttccgagaatatcaaaaatggtcgaaaaactttgtcaattttatggcgattctgtcgaggtgaacgctcaacgtttttacgactttccgtcagttactcaaatggccgcacatttaaattgtatggaacaaactctcagagatgccgggttttggttaccgggcgaaaagcattgtgaaaacggtggaaatgttagctgatggtaaattgggaaattctgcctacctttggctccattctctgcgaaatttgccataccatgaggccaaattggcacttatgaaattgccgggggttggccctaaggttgccgattgcatttgcttaatggccttggacaaacatcangtggtcccggttgatcgtcacgtgttcaatttggccactgagatttacacaccgacatttttgaaaggttgtaaaacattatccactgggatctacnggccaaattggtgcctttttcgttgatcctcacggcgattatgccgggtgggctcactcccgtttggttagcacgcgtggcaagcctttttgaatgaatggatgggagaagaacgagaaatgcctatgtattaaattatgggtctagtgtgtntcggtcatatcatcttccgtgtctgctcacatctggtgcgtcagnnaa

SEQ ID NO: 94699 - DNA, 421 bp, Heterodera glycines
  SCN-specific regions: Sequence locations=1-292,314-421
gaccacttggactgggagatccggaaagcaaaacattaagcaaagtagaccaagaaatagttattcccgatttgatgggtaaacaggttcataaatctgaatgcctccaagaatttactgcttttgtccaatgtttgcgtgctgaaaattccatagtaggaccacagaaatgcaagccgtatattaatgtttacgaagactgcaagttgatgaagttccaagacgatgaatttcgtaagaaagtgattgatgagtatatggacgaacgttcgaaattcatagaggttggcttgaaccaaaaacaaaggaagttttatgaatatctcaattggaagtctgctcacatagcgaaccaaaacgagtcaacagattctgttgatcaatttggatgatagtaaacggttatgttatagattttgaa

SEQ ID NO: 94700 - DNA, 311 bp, Heterodera glycines
  SCN-specific regions: Sequence locations=1-270,292-311
tcgcttttacaatttttctgttcatcgttttgcaattaacggatgctaaaatgtcaaaaaacgattatgaaaatacgtgcggaaacacatgtggtcgtttcgcgaaaaaaggtgattgtgctggtaaaagtccgataaatacgtgtgtaacggaaggagattgctactgtaaatgggaaggatgcagagcagactacgaagagtatgttagtaatccctgatctgatgtcatttttgttacatttgttagcggaaaaaaaatttgttgtcaaaaaaaaaaaaaaaaaaaaacttcgagactagttctctct

SEQ ID NO: 94701 - DNA, 187 bp, Heterodera glycines
  SCN-specific regions: Sequence locations=1-187
ttcggcccaagcgcacaatgttttgtcggacattgacaagaagttgcatgagaacaatgcgttgaccaatctgctgggcaaaattgagaccagaactggcctcaaacgatttcacatatttggagccttggtagggcatcacatgcttcaccttctgcacggtcggtgggctcaactggcatgtaac

SEQ ID NO: 94702 - DNA, 548 bp, Heterodera glycines
  SCN-specific regions: Sequence locations=1-186,208-452,486-548
catatgctttcactcttctcgaaaaatgattgccttgcgcccaaaattggccgtctaaaggcaatggccaacggatggcgccggaggcgcaggcgaaacattatgccaatggggacaacaacaacgattgggacaacaatggcacgaatgatcgtgccatttttggtgatttcggcagtgacagaggcagcatcagcagcagcggcagagcaaacggcacgagcaattcgaagagcagatcccggcggttttcgagcccaacgaatttgctatcagtgccaaatgccaatgcaatgccaatccggcttctgttacggcgatttttgcgtgaaatcgatggtggctggcaaatatgtgagcaaagggtgcgaaaatcggacaatttccgcctcaaatgccgcattttatacctccgccaatccgtcaaaagcttcgcagagtcatgggcctcgtaaaaaatttcatatatttttaaattttaattacccccccgccccttcccccgttttgctaagtgtacgcccgttcagcagaggcgatgggcgaag

SEQ ID NO: 94703 - DNA, 652 bp, Heterodera glycines
  SCN-specific regions: Sequence locations=1-652
tggtgtcggtgaccgtttcttatttgctctaataatttcaacatttgcctacaaaatattaaattttccgcaatttttcttctgtttcatcgcagttgttgctgcatggattttttttcaatatcaccaaaaaaagcattggcaccgtttggacgtgccagggccaaatgtgaacattttctttggcaacacaataaagcaaattcgcaatggcagcattgatgttgaccgagaaaatttctcaaaatatggaaattcatttggttcttttttgtttgatcgtcgcgaattttgcaccaaagacccggatatgatccgacaaattttcatcaaagaatttgcgcacttccaaaatcgctttgatttcatccccgggcgaaaagaggacgcgcccaaatcattgacgcgtaacatgatcaacatgttgcgcgacgatgattggaagcgggtgcgcaaccgcgtaacgcccgcattcaccacgggaaaactgaagaaactcattccaattttatgcgaatgcactgaaagactctgcaaggtatgtgaagatgaatatgcgtcgaacaagaaggagattctcttaaaagatctttacggccgatttctgttggatgtgatcagtcgctgtggattatcgttggatttgaacact

SEQ ID NO: 94704 - DNA, 522 bp, Heterodera glycines
  SCN-specific regions: Sequence locations=1-332,354-378,401-495
tgcgaagcgggcgacgcgcggacaacgccgaatttatgaagaaaacaagcagactttgttatgctatgtgctggccagcatttgctcttccgttttggtgttctctctcaattactttctttttctgccgcaaaagggcgcgtggattggactcgcgttaagctctgccagtcaagcattttctgtgattcttatgtctatgatgatgaaaaccgtgcggaatgagcgtaatcagttggtcgatgctgggttggacctcaacgatccgaatgcgtttggagagtaaaaaaagctttaacattcgccacaactgcggtcccttaaggtactgcaaagacatcgtcattctgagtgtgtctgcacagcttctgagtctgatttggaccggcttcttcttcgtcctgctgtccattccctttttcacactttacaaactttggacgaacattctcggcccttggttcttcagaccgactcttgacgacgatgagaaagaggacaagaagaagcagaaaaaaccca

SEQ ID NO: 94705 - DNA, 482 bp, Heterodera glycines
  SCN-specific regions: Sequence locations=1-120,142-332,354-482
tctatagttttgtgagttttacatttgcggaatttattgacgaggaaaaaatgactgaaggggagtgccgattgactggtttggattctacgaatttgaaatgttccgcttgccgattgttgggccagttcaatttggaagaaatcttaacagattgtctgagatgttgtgaagagataaaaattgcggaagagcgcttcgcttatgctgaaatgcatgtttgtgagtgcaatttgcaccgatttccgcaagttgcagcctttgtacgtagtgaaatgaaggaccaatggggagggaagctgaaggtcaagcaggtccgtggagttttgcctacaattttgctgaagagtggcgatgggcaaacgcacaaaactctcagcattgaaaaatgggacacggacacgatgactgagtttctcaacggggctttgtctttgggatgatcttcgatctctcattaactgttattattattctttcta

SEQ ID NO: 94706 - DNA, 334 bp, Heterodera glycines
  SCN-specific regions: Sequence locations=1-334
ctttcgaatcacgaatcgtgggtcgctcagacgcacctttcttggcttacacgaccgagattatgatgccaattgattgctctgttacgaatcgattagctccaaagagacattgacgctgaggtgtattcattgattgcactgggactgcttagattcgcgggctcatcatttgcccaagaccacggctcccgccgattacagatggccaacttgcttgtaatgcttgttcccatccgataacgaatcgacaccagttgttgacaaactcagggccaaacttcagacagtcaattggagtagctgtggtcttggacttcccaggatcatcgaa

SEQ ID NO: 94707 - DNA, 254 bp, Heterodera glycines
  SCN-specific regions: Sequence locations=1-52,141-218,242-254
gttcccggtggaagtgccgctctcgaaggtgccagcgtagccggtgtgaaaagacggacggaggcacggacgaaccgaacgaagctgaaaagacggacggaggaacggaagaaacgaagagagccgaacagacggatgaaacaaatgactgggtgctggatgaatcgccgtgcactgccacttaaagaaacacattttacaccattgaaatttcattcttaaaatttaaaaacaaattttacaccattgaaaaa

SEQ ID NO: 94708 - DNA, 249 bp, Heterodera glycines
  SCN-specific regions: Sequence locations=1-249
cactgacccctaaacttctccggccttttcgggtcgtcgtcgctgcgaccgttttgttgcttcacgatgaaaacgcataaggtgttcactaaattggcgctgaccggcgaattgcttcttacaatctgtgcgacttaaatgaaagatgttataatcgaacctatatccgcttatattatccgcattacttccaagtaatttgccctcctctattgacgacgaacatttcaataaattgacacaaaaaaa

SEQ ID NO: 94709 - DNA, 265 bp, Heterodera glycines
  SCN-specific regions: Sequence locations=1-265
acgtgcaaccctttgtccagtaaacatatgccgtatacacactatcctcaaggtctcccaattcaaaatgggtaatgagtccacgtttgcgcaaggaatactgtacgttatgaccgaaaacaaaagaggttatggtggacatacgaatcctgattgattccgaaaatcttagacaacaaaaaacattgtactgcggatggaatgagttgactgctgacattgcgttcatatagctagcaagcgttgtaagcacttcgagttggga

SEQ ID NO: 94710 - DNA, 545 bp, Heterodera glycines
  SCN-specific regions: Sequence locations=1-232,254-545
aaatccattcactaagccgccagcattttatgatttcatctcggcatatttgataaatcattcgttttaatttttgataaattcctaaaatgtctgaagagcaatggagcggcgagtcgagcaacagcaacgaatcggagggagtgcaccacagagaggacccccattttgagcaggtcgaggaccaaatccgcgacattcagacccaagctgaccgtttgctcttcggttcagtatttttgcggcggcccaaaggattggctgaaaatgccgtcgtccccgaaacgccgtcggaagtggcggatttggaggggacaacgcgccaaatcgcagagacaatcgaacgcatcgacgatttggaggagaagctgagggaattgttggagcacaaagacaacgcaatttacgaagaccaaattgacgaataccttcgtgaattggaggactcgcgaacgttaaataatcgtcgtccgcaactttggcataggcaatcactttgcgccgttgtttagccagacaatttgacttataatttcaaatttttg

SEQ ID NO: 94711 - DNA, 243 bp, Heterodera glycines
  SCN-specific regions: Sequence locations=1-213
tcttgaatcgacgtggcagaagttcaagcagcaacacaaaacgagatttggcacgcaaagatcacttttttccacataaatttctgattttttgtggcgtaagcaatttggaggaccggatattttttataatttgtggacccaaatcgcggaattttacccaataagcacataaatcaccttctgtttgttacttaaagcaattctgataataaaaaagaaaaaaaaaaaaaaaaaaaaaaa

SEQ ID NO: 94712 - DNA, 366 bp, Heterodera glycines
  SCN-specific regions: Sequence locations=1-23,45-366
atttttgcatatttttgattatgtccacatcactgaagcacagggattttgtgggtgaaccgatgggcgacaaggaaatcaccgctgtcgccggaatcggcccggtttacggcaaaaagttggaggacaaagtaaaaaaattcacggagttttcgggatcgttaatctcgaattttcaaccaattcaaatccctgaaaaagggtccatccctttttggattttttcgggtcccaaaaaagtaaaagtgcctccaattgttaatttttgttttttttttcagggtttcgaccaggcgtacgtgttgtttggacagtttttgattctgaaaaaagacaaggaattgttcacagaatggctaaagggag

SEQ ID NO: 94713 - DNA, 489 bp, Heterodera glycines
  SCN-specific regions: Sequence locations=1-489
gctaaaagtgctcaaattccttaacatcgacaaattgcatcaatcagcggaaatttgtgagcagcgagagacgtcggaacgtctgaacttggaaagtcggccattcattcgaaggaacgggtacagccaaagtcgaacaacagacagcggacgcacagctcggaattggcctttgctgacgacagccgtaggaaacacgaaatagcacacactttgtagagaccagcagagggacatacaccaagagacaacgcaaaaagcacaatgttctttctggacgataagaaacgaatgggagggagcaaatggaaagaattgcgccacaacggacgacggacacaaaatgccaaaggaggggccgaaaatggcaacagcacggggagcgaagaatttgaagcaattagcctttgaggttgaaagatttgttgcggccaatttgactgatgcgaatgagcggcagtcggcggagcagcgaatggttgttgcctt

SEQ ID NO: 94714 - DNA, 488 bp, Heterodera glycines
  SCN-specific regions: Sequence locations=1-457,481-488
ttctgttccttgcgctgctcatgaagacaatgttcagcaacggctttgttgtccaacagcaacaacagaattttaaggaccttaatggatttgctgacaatgacaaacaattgccgcctttacccgctgttcaattggtccgttcgcctgccaattcactcgacgcttcccaccgattgctttttgaacgattgtcgtcggaggcaaaggatcggtttgcgcacaaacaaatggcaatgggagaagcgaaagaatgggacgaacggcgaattccgcgccctcagcgtcgttggctaatgcgcacgacggaacttaaagagggaagcggcggcgacaaatacgtgaaaagggtggtcagcgaaagcgaactgaacgcactgctgaagaacgcgtggctgggcaaaaagcggcgataaaaaagggggagaaatgagaacggagcaaacgtgatttgatcagagagagaaagagaggaaggaacacgaaca

SEQ ID NO: 94715 - DNA, 55 bp, Heterodera glycines
  SCN-specific regions: Sequence locations=1-55
tcgcgccctatcaacgctatggagtcggaacacttctgctctaccacattttctc

SEQ ID NO: 94716 - DNA, 300 bp, Heterodera glycines
  misc_feature (2)..(2): n is a, c, g, or t
  SCN-specific regions: Sequence locations=1-300
cnggatgaagctaaatgcgtaggaacatgcatctgaaaggtgcaccaaatgatggaaaaacaaaaatattatttagattgatttgccaaaatgttgtggtgacatgcagttgttcgtcaatttgatcagaaattcgcgcacctccgcccacttggcaccggtccaacgagaacagttcccgtttgatcatgtgcacgtcctcaatcgctttttcacacatttgccctttttgatcagtgtccaccgtgttggcaaaattgacaatgtaactggacataaatgttgccacctgttgaaaaa

SEQ ID NO: 94717 - DNA, 259 bp, Heterodera glycines
  SCN-specific regions: Sequence locations=1-230,252-259
ccttttcccagtgggaccttccgtcgatgcgtcccctcccccttcctatgaaaatgcacttcgactgcccgcctttccattggcttcttcggcccctcctccgtacataaatgcccctttccgagtgccaaaaacaccaaaagaacgaagggagcaaaggagttgacaaagaagacaaatatgttaataatatcattttgggtgaacccctagtttaattcattcaaatgaaaattgaataattttaaaatgcaaaaaa

SEQ ID NO: 94718 - DNA, 393 bp, Heterodera glycines
  SCN-specific regions: Sequence locations=1-205,227-365
cttcgcttctgtcattggctggggttactctgctgtgcactcattcaatttgttgttctattggacggacttttggacgtgcgtcaactttcaagcggatcacacaattgtgccgttgatcacttttgtgctcagccttgtcttggcgtgttcgtccatcttcgagattgttcttcacaaattcgtgctgaatgatgtcgacacggaaagtgacaatatgggcattcatcagaagcagaagaacggatgtgcctttgtgtgaacaatgagcagagagacgagattgaaacgatgctggtgccaaaatatgattgatgatattatgataatcggattatatattgcttggtaaattgttttactccaaaaaaaaaaaaaaaaaaaaaaaaaaaa

SEQ ID NO: 94719 - DNA, 414 bp, Heterodera glycines
  SCN-specific regions: Sequence locations=1-68,107-236,258-361,383-414
cgttggctctccttcaaagccgctttattgtggacattttcgcggggagtacagcagaaaaacaaaagccatggccaatggtccgttctgatttcctttttgatttacgaaatcaaagatgcttatttggcgcatattcgaacccttcgctcgaattctcttccgcacattgtcgagacttatcgcttggaattccatcgccgtaaaaaatcccaagcccaaaacgccaaacgcgcgattttgaagaagaaaaagattatcaatcaaatcgagggaaaatgacgggggaacggtcagctcagaatcagaagatttgattcaattgtcaaaagtgcctttctaatgattctgttgagttgattttcttttgtttggccatttcgctcgatcagtgaaagattggaataaaaaaaa

SEQ ID NO: 94720 - DNA, 621 bp, Heterodera glycines
  SCN-specific regions: Sequence locations=1-21,48-53,75-252,274-621
catggcaatccgaagcgaattattatttttaagttgtttatttttaattgatggccaatttcaatggaaacgccgacacatttttgtgcagagacatcggagaatttaaggtaatttcagagttttgactaagttaacaccagaaatctgataaatggatccggaattttttgacaaatagccaagcgaaagtttgctaaatgagtgggattgaaattgaaaccccaaaaaatgagacttataaatccaaaatgcctttttcttcacatttcccttccctttgccatttggcgtgtcattgacaaattgcgggcggcggaggacaaaataatactgcgactgaactgcgaattgcccaccaaatcattctcaaaacaattggacaagcagcgaatttgcacggacattcagaaaagtctgttcgaaactcggaaaatgcgcgaacatttgttggtgcggtgtctccaggaaaacgaagcgaccgccgaacgatgcaaagaaagcgcagaaaaagcgacggaagggaaaacggcgaaagcaaatttgcgcctcatcagaacagaaatgactgtggaagagattgtgcggaaccaagcggacacggcacttcgggagaggtgc

SEQ ID NO: 94721 - DNA, 475 bp, Heterodera glycines
  SCN-specific regions: Sequence locations=1-100,129-475
gtgatcacagatgacacaacagaggcggaagacatggaaaaggcaatgaaaattggccaaacttacttttggtgtaaactggtgacagaatggaaatgtcaaaataaaaattttaaaaaaaaaataatcacaataaaaaattgatcaaaatttgcgaaaattggaaagtgaaggcaattgcggcgaatgcctatgtgaaaagttgggtgtgccaaaaaaaacaattggaacaagctgaagttggtacaagttcatcaggagcacaaaatgtggaaatacaggtgtattcatgcctttgtatgaagccaaattttcaaatggtgaggcaaggcgaactgcaaatgagctcagcaatggaagtaatcaaaggagtgtaccgggacttattcggctggggcaatggcaaatggatgcaaattaagatgggactggaaagaaacaacttgtggagcatgactacttatttgtttgataa

SEQ ID NO: 94722 - DNA, 505 bp, Heterodera glycines
  SCN-specific regions: Sequence locations=1-160,182-427,453-466,488-505
tcctgctggtgatggctttcatggcattgctcgtcgtccaatgttcttctgctgcagccggtgatgtttcaccggctttagataatcaggaggaaaagcgagtactttccgccgatgaatcgggaccactacaaaactttcgtactgtgctggaaggacgtcacaaacgaagtttaatgggacgctaccgaaactcgacgggtcgaaaacgaaattcgaatggacgcaaccgaaattcgacgggtcggaggcgaaattcgacgggtcgaaaacgaaattcttacggacgtaatcgaaattcgaatggacgcaatcgaaactcatttggtcgtggcaaacgaagtcctatggcctttcctcctgctgctgacaaatgagaaagccaaaagggtgacattggaccggctaaatacaaaaaaaggaagcgaaaatgatataaaaacaaagtaaaatttatatggatgtgaatataattaattatttaaatggtgattatgaattaaaa

SEQ ID NO: 94723 - DNA, 454 bp, Heterodera glycines
  SCN-specific regions: Sequence locations=1-200,222-454
ccactgactatttcgacctgttaaagtgcttggatttcatcattctgacgaggactaatttgaccgggctgaactcgcgggcaggccgatgtgctgtatgcgagatggacaaagtcagcctctcatgccaattggcgtgtcgaagtgcgcttttttctccgactctcagccgcaataaaaaacagaagcgcattgaaatggtttgccattggggacacggagacgaaatccgaggggacagaggagtgctgaactgtctgaagagtacgcaccattggttggcacaaaaacaccagcagctgaacaactaacagaacaaagggccgatctgtcgcaatttgaattttaatacggtagcggaaaataattgtgatatacggtagcaaattgccaaaccgaaaacgcattaaatgcagaaaaaaaatccttttgttctctttccaatggatgttaa

SEQ ID NO: 94724 - DNA, 458 bp, Heterodera glycines
  SCN-specific regions: Sequence locations=1-458
ctatgtttctggcgatgtgtctgctgttcgcagcggtgactttggcaacttcaaatgacaacgaagaaataattgccgacgcaaataacggagacttggcgatgactgctgtgaatgcaactcgtggaatgcgcttgaagagatatgcttcgtgcaacacccatttgagcttgtgtaaccagttcatgtgcaaccaatgctgcaatggatgtaacagttttggatgtttcggttttatgtgcagcgattgctgcgcataaaggggatcaaagccggcgggctcggaaatccgctgctgagcaacagagatgaaaacgcaatgacggattacagtgttttttggccccgctcctcatgactttacggattgtctccatctttttaaaaaaatcgtcaccaatttcggattacagtatttccgttcttgaaaacgcaataataacaaatgacaccaaaca

SEQ ID NO: 94725 - DNA, 554 bp, Heterodera glycines
  SCN-specific regions: Sequence locations=1-554
tttttctaccgactttggtcgtcgtcagcgcagcaactgtgcccattctgccacaacaattgctcagtgccaatgatcaaaattcaaattcattaccaaatttaacaaatgttcttgctgatgaaatttcgctgagtgccattgattgtgccgcgttgccaccggcactttggtgtaccaaatttgtccgttacaaatgcggcaccagtaatttgtgcacaaagcatgacgatgccgtgcgttacaaaccgttgcacatcactttgctttacgaaagtttatgccctttttgccaacggttcatcagagacacactgttcaatgtgtacaatcgcttcagaacacacattaaattggagctggtcccttatggaaacgcaaaaacaaatggtactcatttcacgtgtcaacatggcacagaagaatgccgaataaacaaatttgaatcttgtgccatcaattacatgaatgacccaatgccttttgtgtactgtttggagacgttactttatgaaaatgtgaaatttgatgacgcaacgaaactttgcttcaat

SEQ ID NO: 94726 - DNA, 524 bp, Heterodera glycines
  SCN-specific regions: Sequence locations=1-29,51-232,254-524
gcccatttttctgctctggacttgctatatttttcttgtccatcatcttccccattatgcccaagctgctaatgaaaatcggctaattaataatcatcatcctccccaaattactaatgaaaggctaattaagaagttgtgttttggaaattgttttaaaccgttcacagttcaagctaaaaaaggtcaaaagtttttgctcgagtttgaaacacagccagaaaaagaaacgttgaaacaatgtgcatacattagcactggatggtcaggattagaagactccgacattatcacttttgagaataaaaaagaagatattttgggcagagctagcgtacatttattgcgtgaagttggtgcaaatgctactgaattagaatttccggctggaatactgcggtgttacatcattaatcgaatcagcggtgccgtgaaagtaactgatttcccgtacccgcacggattagcatgacaaaagaatgcattttttgcttccgatgaatcagttttctgatcgtgttgct

SEQ ID NO: 94727 - DNA, 274 bp, Heterodera glycines
  SCN-specific regions: Sequence locations=1-274
aaaggggaggagaagcgcctttcggagcaccgccgtcgcattggtggcgaaatcgacgcgaccgaacgaagtgcgaattccgccggtgtttccgattcgttttccaaagatgccgaagaagagaaggccaaagacaaggaagaggcggtgaaggaaatgctggggcagctgaaaaagcttggcaatgtgttccttcgcccttttggtctatcgacggacagtttcgaattggtgaagcagtccgatggcggagggttcagtgttcagatgaaaa

SEQ ID NO: 94728 - DNA, 133 bp, Heterodera glycines
  SCN-specific regions: Sequence locations=1-133
tttacttgggtcagttgagccgcccgaattgagagaagtgctgaaatgatgccgaccatctcctcattttcgatgaacgcattctcatcattatggaaacttttgcgcttaaataaatacaaatagaattaaa

SEQ ID NO: 94729 - DNA, 521 bp, Heterodera glycines
  misc_feature (295)..(295): n is a, c, g, or t
  misc_feature (329)..(329): n is a, c, g, or t
  misc_feature (346)..(346): n is a, c, g, or t
  SCN-specific regions: Sequence locations=1-521
caacattgtgccgtttcgtcgtcgttgctccgttcgtcttccaaattgtgccgtcgccgagttgttttcaaatgccttggttgtcttcagtgccggtgatgattcggatggtcgtggtcgtgttcgtctgtgccgtcctttccgctgctgctgctggttctgatccgagcgatgtcattgacatcgaaagtcttgaactgtggcgtgtatcgtgtgcgggccgaaactgtagccgccgttgctttggatgggagaatcccgttttttgtgccgactccatccagttttgtaccancggagtggcatggccgatatggatgatcgcttcntcctttgggctcaattntgtccttattgtccttgtccttgtccatttggctgtggtccgtgtccgccgagacttgccatttgcctcaattagggtctgtgaccaatgtcagcgccgtgttagtgttttgtccagtcgtattgtctcctcaatgtaatttctggttcatcgttggcacggccttaacacatca

SEQ ID NO: 94730 - DNA, 561 bp, Heterodera glycines
  SCN-specific regions: Sequence locations=1-115,138-561
acttggccactgttattattggtgccgtcttgccgatgttccgtacttggaaggttttgaagagtcgcaaatcaagacaattaattcctctctcaaaatattggattgttttcgcagcatgggtttccttcgaatctgtggccaatttgttttcgttgccctatttcattccggcttactcctttctgaagttttctgttgttctttacacttatctcgtcggttacgagcacatttaccaaaaagaatatgagccgaaccgagaagttttgatggcttcagctcaatattacgcgtcaaaagccactcaacatgcattagcttatgcttggaatacgatcacttcatgctctccaagatcgaaggcaattacgacccaggcgaatggtcaaaggaatgccgaatttcgctctgttgtacgaattgttgaacttgaggaacaggaggaggatttcgtcgatataatagagcaagatgagcaatttgaggacttagaggccgattctgacaacgaaatgacatctaattcgccgattcactgatttacgatctctcataaca

SEQ ID NO: 94731 - DNA, 464 bp, Heterodera glycines
  SCN-specific regions: Sequence locations=1-382,406-437,459-464
tccgtttttgctataaaaatgaccgttgaaactgtcccggccgatttgcgcaatttgcgtgcgtgtctcgtgtgttctttggtcaaatcggaggaccaattcatggcggatggctgcgacaattgcgaacgctttttgaatatcaaaggcgacattgacaagtgctacgagtgcacgagtgccaactttgacggaataatcgccgtttgtgagccgaacgactcgtgggtgtgcaaatggcagaaaatcaaccgaaaatgccctggcatttatgctgtatccgtgtcggggaatctgccaaaacacgtggtggccgagttaagccacatgggcatcaagtacaagtcgggccaacgcgacaaatcggcgaaatgatggacgaggaggggaagagggacagatgttgcgacaatttttgtagttttatacagaaaaacattatttattattattatttactattg

SEQ ID NO: 94732 - DNA, 297 bp, Heterodera glycines
  SCN-specific regions: Sequence locations=1-227,252-259
tcggtacaaaaaagcgactcggcctctttggcttttggattcatcgccggggcgggccttgagctgttcaaaatcaacttctcatgttttggcatttcattctacaaagtgttcaatgagaagcagttgtcccaagaactgacggaattcgaagagaaattggccaatcggaactcgatgttgcgcagccgaattgatcagtttcaggacccaaaatgatttttgtttataatttaaaaaggataaaattggaagaattaaaaaaaaaaaaaaaaaaaaaaaaaaaaaaaaaataaa

SEQ ID NO: 94733 - DNA, 492 bp, Heterodera glycines
  misc_feature (396)..(399): n is a, c, g, or t
  misc_feature (401)..(402): n is a, c, g, or t
  misc_feature (406)..(407): n is a, c, g, or t
  misc_feature (410)..(410): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (421)..(422): n is a, c, g, or t
  misc_feature (432)..(432): n is a, c, g, or t
  misc_feature (463)..(464): n is a, c, g, or t
  SCN-specific regions: Sequence locations=1-321,343-492
agaaatgcactaagaaactatcaaagttagctactgtccatgtggagaaaagtgaccaaactgcgaaacgagtgacaaatgaaaacaaattgttgagttcgaaacaaaaattcaaacctgcaagtgaggaatttaagaaatgcagaatctgcaataagatgacacatcatatttcagcgtattattgtcaaaactgctcgtatcagaaaggcatttgtccgatgtgcgggagaaaacaaattgagacagcaaaatacagacaaagtctgacataaacttgtttctgatacctattcaaacgagatattttgtattcatttgaaatcgcaagttttcgtatttcctttgttagtagatcaatatttttgtcatattggtaaaaagtttggttgcggnnnngnngggnnggngnggngngggnngggggaattnggactttgggtctttcggggcgagtgctggnnctgtcctcgcgtggcggccgcccccgct

SEQ ID NO: 94734 - DNA, 512 bp, Heterodera glycines
  SCN-specific regions: Sequence locations=1-446,469-512
tcactaaggatgaggtcgccttgcacaacagtgaaaatttgacttggataattatgaatgacaaagtttacgatgtcacaaagttcctgatggaacacccgggcggagaggaagtgcttctccaatgggccggctatgacgccactgaagctttcaacgacgtcggacattcggccgacgcgaaaaagatggccgatgattatttagtgggcgaattgaaggaggacgaaggccaaacgaccgctggggtttcactgccggaagaggcgaaaagggacgaaccgacggagtcgtggcggcaaattctgagcagtccgacttggtccaactttcggattccggttgcgctgtcgttgggcgttttctgtgcgtataaattgggcacggccatctacagacaaatggcctcctaacaaatttcatatttacaccggttttttgttgtgacaaaccgatttagtatttttatgtcatttaatattggttttattgcatttaatcagtagtttgaa

SEQ ID NO: 94735 - DNA, 434 bp, Heterodera glycines
  SCN-specific regions: Sequence locations=1-398,431-434
atgcaccaaagcgacacgggaagttcgactcctggagactctcctgtcgaccgaattgagatcactggtctaatgagtcttgccgaatttgtagaaacgatcgaggctgaattccccgaacaaattcttctcaagttgtatgctgattttcgtggccataatttgaaaatgcctgtcgaagttgacgaaccggatgatccgcaattcgaccgtttcgatggtcaggggcatctgctggtggaggacatcgtgtttgatatgatacacaaaacgaaaagggaccatcaccacgatatcccgtttaaggcgcagtatgtgaacgattttgttgccaacgtcagttaccgattttagtgcgtcgttggacaaatgttgttgtttcatatctctatttccgtatttaaaaatgaaataaaattgacaaacttaaaaaa

SEQ ID NO: 94736 - DNA, 575 bp, Heterodera glycines
  SCN-specific regions: Sequence locations=1-4,26-465,487-575
aagtgatgagaaattttcttcttttactatgttttgctataattttgcaagttctttgtgacgaacatgaccatatttacagtccaaatgctgaagttgtgctttggatgaatacggttggcccgtacaacaatcgtcaagaaacatacagttatttctcgctgccattttgtcaaggttacaaaaaaacaattgagcattaccatgagactttgggcgaagcactgctcggtgttgagttggaattttccggtttggacatacgcttcaccgttgatcagccaaaaacggagtattgcaacacgaagctgactcctaccgacatcgacgcactgatttttgcagttgaacacaattattggtatcagatgtacattgatgaacttccactatgggccctggttggcgagaaggacaaagctatcacttacatttacacacacaaaaaatttgaactcggctacaatggtaaacaaattgtggtggccgacgtggtggcagaaggcaagcgcgagttgaagccgaacatggtactttacaactgggatttttctacaaccaaacttttgaaagct

SEQ ID NO: 94737 - DNA, 639 bp, Heterodera glycines
  misc_feature (514)..(514): n is a, c, g, or t
  SCN-specific regions: Sequence locations=1-165,187-639
cttcgtccatcatcatcattaccttcgcggttaacatttctgctgttctttttactggtcaatttatactacctagtcaaatccgcaagtaattctctcatcaatgacaagtgcatgacttgcaaatttttgtcgaaaacttttttaggaggactggaaaaaactgagaaacttcattttggtggcggaaatactgactgggaagagcgaaatttgggcagatttaaaactagtgaaactcgtttcgttgaaatgttggactacgtttgcaaaagggattcatctgctgagattggatttagtggaattaaggatttgcaatttaagtgtcattctctgctggaagcccatgaagaactgcttggacaatggttttttgagcatcaagagaacggaccaactctcgggaaatatctttgcattgagaatcttaaactttgttgtgacgaaggctattttggctcggattgttctccatgtcctggaatgaaactctcgggcaaaccttgtttcnggaatggacaatgccaaggcaacggaacacggaatggcaatgggacgtgttcttgccatgcggggtatggcggcaaaatgtgcagccattgcgattcgtcttattttgcagttcgcaaaattgtc

SEQ ID NO: 94738 - DNA, 432 bp, Heterodera glycines
  SCN-specific regions: Sequence locations=1-376,398-432
actcaaaaaattgaaaaagcaatgcgcaaaggtgaaaaagatgaataaatgcgcaaaggcaaaattcaaacacaacagcacgaagtacacatgcgcatgggattacgtacggacgtcgccaaggggagggatcggctgctgttatccgtccgtggaaagctgcgaaaatctgcgcagtatggggcatccaatttaagtttttgggccaaaatcatgcagcccgtacccattctcgaacgatcggacacggtggtttggccagaacgcttttggtcctcaaccccgcgacagttgtcgttcagggcctgacaggataaattttaatccgatttcctcattattggctaaatttgtaccaaacatttatttccatttcacttttctattgattgttgcatttttaatggattaaaatctgattttttaaaaaaa

SEQ ID NO: 94739 - DNA, 582 bp, Heterodera glycines
  misc_feature (552)..(552): n is a, c, g, or t
  misc_feature (562)..(562): n is a, c, g, or t
  SCN-specific regions: Sequence locations=1-294,316-353,375-416,438-582
tggagccctccgacattttgtctcaatgggtcgtcgcttttcctggtcatttggaagaatcgactgtcaggtgggaacattccgataaacggacagttgccggccgttcgccaacagcaggaccgagagacactgttcccaatgtcttgtgttatcatcttacctggtcagcgagtgaccatcgacaaaatgtccgaatttatttcgcgcgaacttctcagtgccaatacacagcctcccgcccgtcgttatgctgccattgaaatgacaatgaaacagattggtgctacttcgtcgggttttttggccaattttggtgtcagactcagtgccgagtcaaccgttaaaattggagtccatcaaatgccaaagatcaaattcggcaacactgtcacctctttccaggacagagttcgaaaaaagcaaacaattttaaattaatctttttttgaagatcaatccggctgttcggtttttggagccctccgacattttgtctcaatgggtcgtcgcttttcctggtcatttggaagaatcgactgtcaggaactntgtaacgcanatgatacgcatgggccaaca

SEQ ID NO: 94740 - DNA, 154 bp, Heterodera glycines
  SCN-specific regions: Sequence locations=24-96,136-154
ctttctcttcctcttctttttctccaatctctcctccgctctctttggcacttttttttgtttcacttttggcattttcctctcccattttgacattctctccctttttccttctctcatccctttcagttcctcccattcattctttggttcg

SEQ ID NO: 94741 - DNA, 518 bp, Heterodera glycines
  SCN-specific regions: Sequence locations=1-110,132-183,206-346,368-496
gttttggcacgggtggcgaaatggatcaaaaagaatgcgcaatgtgtggtgagaaaatttcgctaactgatcgtctgatggttgacagagaaacaatccataaaaattgctttgcttgttgcttttgtggggcaaatttaaagcccggtcacgcggccatggaactgtcgttctacaaccgttatggtccacgatggtactgctcgggttcggcgggcggttgtgcgttgacgcccgtttctgaaaaagatgccaaacttaaggagaaagggatgaacacgaagaagttcaaaaaggcgaagaaatgagatacgtcacgtacatacaaacaacagtattcccagactgtaatatttaaaattgattacggtagtgatgatactatatttttcgaaatcggactttgccaagaatttagttggttctctttcatttatgaatatactttggctattgtaatttgatgataaattaaatccgagtttttataattaataaaacaatgcaaaattaaaaaa

SEQ ID NO: 94742 - DNA, 465 bp, Heterodera glycines
  SCN-specific regions: Sequence locations=1-465
catcctgcccaacgttttgccgttcgcccaattgccaaattcgtcgcttcgaattgcacttgggcttttggtgctcattttgctgatcggattcttcccctccaccgacgccatccagtgttattcgggcaaccaattttccatcgtcgaatgtcccagcctttactgtatcaagcagacacttgggctggatacggtgcgctattgtgatgggacgggcttttcctcaatttgctccacctatcggacaatcgattcttgccaaactgtgccgagtctgggctatgtttgctgctgtcctgatcagttgtgtaattcggcgcagaaagtgccaatgaatgccctttttggcatcactttgctcggcatcgctttggcttcattaaacgttgccatgcgaacaaccgaaagaatgttctgatgaatgggcaagccgctcatttgagaagttccatccacttaaga

SEQ ID NO: 94743 - DNA, 137 bp, Heterodera glycines
  SCN-specific regions: Sequence locations=1-73,95-102,124-137
cccgggccgagtgatgatcactgatcagaacagcggaaatgaattgattgattggttattgatgcgattatgtgacccaatgttggcctttgctatttaaaaattgtatttgattgttgctcataagttcataaaaa

SEQ ID NO: 94744 - DNA, 245 bp, Heterodera glycines; identical to SEQ ID NO: 83432
  SCN-specific regions: Sequence locations=1-192,223-245

SEQ ID NO: 94745 - DNA, 337 bp, Heterodera glycines
  SCN-specific regions: Sequence locations=1-337
tcggtgcaacaagccaaaaaagtggccgaacagctcgagcgggaaaagcgcattcgccgtcttccaatgtcggaaacaattaacgacttaattcggtacacccaggagatgcagaaagacgactatttgttcaatggtttcccaaccgacaagttgaacccgtaccgtcccaagtcaaattttcaatgtctcgtcatctgacggattttttccatgtttgatgaaaagaatgatttgtcatgatgtgcctacaatattataattttcgtagtttttttttatgctttcaacaatttcttttggatcatgttttggataaaacaatgctgcttcaaaa

SEQ ID NO: 94746 - DNA, 524 bp, Heterodera glycines
  misc_feature (499)..(499): n is a, c, g, or t
  misc_feature (512)..(512): n is a, c, g, or t
  SCN-specific regions: Sequence locations=1-41,63-342,389-524
cgtctcccacgccaatgccgtcacaaaaatttcagcggatgtcctcaaaatgaactttatgaagaagacgatcactcgcattgagcgtcaaaaaaaacagaatgaaagggaacggacgaaggagcaaatttcggcagggaaattggaagtgttgccgcctcggcattatccgacagtcgaacacatcgacgacgacccgaacatcacattgggcggagtgatgaccgaatggcgttactccgttctcatggacaacctccgctttggccgcttctcatttaaaggacaaaaccccgaagttgagaaatggatgcaatttcacgaacgaagacgcaatggaatagaggacgaagaggaggaggaagaagaacgggaagaggaaggagaaaagcgaaggagtcgagaagaaggcgaactcagtgacgaggaaggggacggaagcatagtcaaattggtggagaagtgagaaataaggccgaaaaagaagggacggacgcanaaggcaaacgcanaagatgggaaaa

SEQ ID NO: 94747 - DNA, 446 bp, Heterodera glycines
  SCN-specific regions: Sequence locations=1-446
caaattaaagtagatcaggaagaaagcaccaaactttgggattggccattgcaatcccatgacgaacttgtgtcaatctacgatggtcgtgacagatgggaagttggcttggacaccggatttttcacgcccaacgaaatcgaagtgaatcggatgggccaaaatttgttcatccactgcaaacatgaccagcgcgagggcatgctgggcacaacatcgcgtgaggttcagcgcaactataaattgccggatgatgtggacccgaaaagcatccgctccaacatcacacgtgccggcattttgcgcataacggcacaaaagaagcgttgaattggcgcaaatttggacaaaaatgccaaaattgatcaaaaaatggagtaataacatttggaagaacataataaatcaaatatattaatcattttatgacataaacacatgtaaaa

SEQ ID NO: 94748 - DNA, 544 bp, Heterodera glycines
  SCN-specific regions: Sequence locations=1-94,118-316,340-400,426-544
caagaagcgccttttccgagaaacgatagaattgcctgtcgctctgaaaacctactacccactgaagagacaccctgtcgtaacgcaactgttatactgaagcacatcacctcccccgaaaacgaatgtcggcatccttggcaagcccgaacctagcgaccatgccaacgcctgcgcaatctcattcgtgactggacacgacctgaagaagctcatcaaggacagcaggctgatcggaaacctcaacaaaagctactacgctttccttgcctccgaatcactcatcatacaaatccctcgtattcttggtcccggactgaacaaggctggcaagttcccaagtgtggtgtcacactacgacatgctgaacgcaaaggtggatgaagtgaacgcgaccgtcaaattccagatgaaggaggtgctctgtcgtgcgggcgcaattggtcatgttgagatgtcgcacgactaactggtctagaacatttcgttgggcgtcaacttcctggtctagttgctgacgacgaattggccatatgtgcgctcg

SEQ ID NO: 94749 - DNA, 375 bp, Heterodera glycines
  SCN-specific regions: Sequence locations=1-268,290-338
gggccaacgaagaaattctgcgaggtctgtcggagctggattgacttatttgaggataaaattcaagtggaaaagttgatgatgcacaagcgttgcttcgtttgcgcaatttgcgactgtccgcttgagccgggcaactgttcccgagatgacgggatcatctactgccaattcatgtgcaacgaccgtgtgccagtgtggttttgttctgcccatatgatgttgggatcgggcgaaaaatgccaattgttgaaggaaaaatggatgaaggaaaatgaggaaaagcaggaaatatgacacaacaaatgattaatgcatttcattagtcatgtgatgacaaaaaaaatgtaaaaatttttttgtaaaaaaaaaaaa

SEQ ID NO: 94750 - DNA, 352 bp, Heterodera glycines
  SCN-specific regions: Sequence locations=1-352
catctcgacgcggcggtggtaataatgttgagggaaaggtttacgttgacggtctgccttaggacgcaacttccgaagagctcgacgacgtcttccacaagttcggcagaattcgtaaaatttgggtcgctcgtcgtcctccaggttttgcctttgtcgaatttgaggacacgcgcgacgcgcaagacgcagtgcgatcattggacggaacacgaatttgcggtgttaaagcgcgtgttgaactgtcaacgagccgctctcgtcgcgatcgggatgagcggggccggggaattagtcgcgagaatgaggaaaaatcacgcataagggaacattagtcacccaaaaagaaaaa

SEQ ID NO: 94751 - DNA, 302 bp, Heterodera glycines
  SCN-specific regions: Sequence locations=1-211,254-302
tggtagaacaattttattatgatgttcaaatggccttaaaatcgcatcaaaaaataccgattttggtaactgtatctgatgaatgacatcattcaacattgtgtagtgcctaatggaggcccattgtgcagtggaattacttgattcacagttgaaattcttttgaacacaaatggaaatgccgtttggaatgcctgtcgatattccctactaaaatttatttgaaaataattttttattcaaatatttataacacctcgtaaagtataaaattggcccatttgatgccgcaccaatgaaaa

SEQ ID NO: 94752 - DNA, 369 bp, Heterodera glycines
  SCN-specific regions: Sequence locations=1-336,368-369
ttaccgaaagaattgaaaaatggaaaaaatcgaagtaaaagaaacagatatgaagtcaaatctgatcgaccaaaccattgaaattgtgcgcgatggcctgcaaaaatatggccaagataaagacattgccagcttcgtcaaagacacaatggagcagcgcttcgccggcacttggcattgtgtcgtggggcgcagtttcggctcacgcgtgtcctatgaattggagtcattcacgcttttcaaggtcaaccaacacaccgtgctgattttcaagtgcggataatgggagaggaaaacaaattatatcaaatgctaatacaaatattcattttgtatatttgtaaaatacatttaaaaataaagaaaaca

SEQ ID NO: 94753 - DNA, 537 bp, Heterodera glycines
  SCN-specific regions: Sequence locations=1-336,358-537
acttttctcttatttaagtctttgtttggtcatcgggaaatgcgaatactaatattgggcctcgacggtgctggcaaaacgaccattctttactggctgcaggtgggcgaagtggtgacgacaattccgaccattggctttaatgtggagcaggtgacttacaaaaacttgaaattccaagtttgggatttgggcggccaaacgtcgatccggccctattggcgctgttactactccaacaccgatgcaatcatttacgtggtggattctgcggacagagaccgagttgggatttcaaaacattgcgcagtctttcaccgcgttgagcaacctcaagtccattctggtggaacagcttgccacttccgatggtcaagtggttgagtcggctaggatgctttgccaccttcaaaaagtgccctattttcgtctgactccccaattgcgagttgacattgcacttgacacggtggacaacgggacgctaattgacatgctgtgggacgcaaaagcatatgtgcgagaacaatgtgccga

SEQ ID NO: 94754 - DNA, 523 bp, Heterodera glycines
  SCN-specific regions: Sequence locations=1-523
aaaaaatgtcagctcaaaatgagtttatgcgggcggccgttgaggagggaattcggggcgtacaaagcggcgacggtggtccctttggcgcagtgattgtcaaaaacggcaaaataattgcccaggggcataacatggtattgttctccaacgacccaacggcacatgccgaagtgatggctcttcggggggcaagcaaagtgttggacagcttcgacctgagcgggtgcatactgtacacgagctgctacccatgtcccatgtgtttgggcgctgttttgtggtcacggattagcaatgttttctatgctgctgcgcctaccgatgccgcttcggtcggtttcgatgatcagaatttccacgaatttgtctctaatccgaagaaatacgaaaaactgatggcattggaacatttgccagtcgaagggcatatgaaagtgttcaaaatgtgggaacagagggacgagaagagaatgtactgacaaagggccaaccaatttattcaatttacatttctcatttg

SEQ ID NO: 94755 - DNA, 338 bp, Heterodera glycines
  SCN-specific regions: Sequence locations=1-161,183-338
cagcaaaaaattgttaaaaacgcgcgtccaaaatctgatcccaatggcattcactcccaacgcattgaacactttcaaaagtgacgcatcgatgagcaattaaccgaatgaatggacgcgcatttgaacagtgattgatcaaaccaattagagagttaatgatttaattcaatttaatttaaaagcaccgatccaatccccgaaatgcactaaaagcaatcgtttaaattagagcatgaaaatgtttgttaaaaattcactaatttttagccatttatttttggttttattgtatatttctttttccaataatatgcataaatatcctttgtttgaaa

SEQ ID NO: 94756 - DNA, 235 bp, Heterodera glycines
  SCN-specific regions: Sequence locations=1-235
atcgttgcgaagagcacccaccaaagcgaagtcaattgtggcatcggagacgcagctcacttgtcacgtatttgcaaccacgacaatgtgtgcgcaggagagactggaccgtcaaaggattgtctggtacattcaatgccgcgttcgcatggcacacttccaatccaacatcacctctcagtccgatccaatggacgtctactctgattggattgacacttgcgaggcggccaat

SEQ ID NO: 94757 - DNA, 220 bp, Heterodera glycines
  SCN-specific regions: Sequence locations=1-104,126-220
agcaccgaccaaagcgaagtcaattgtggcatcggagacgcagctcacttgtccgtcttgcacccactacaatgtgtgcgaggtgaaactggacctgcaaaggaatgtctggtacatccactgccgcgtttgcatggaagacttccagtccaacatcaccgctctgtccgagccaattgacgtgtactctgattggattgacacgtgcgaggcggtcaat

SEQ ID NO: 94758 - DNA, 199 bp, Heterodera glycines
  SCN-specific regions: Sequence locations=1-199
cggggaccaaacggagtgtaaagacgacaatgaattctgttacaatgtgacggcggaggcgggggtgattttcaaagcatcgaaggccgggtgttcatattacagatgcctgatatcccgaaataaatgcatcaacaccgaaatctccggagtgcccgtcagtttttgctgctgtaacactgaagatttgtgctatgga

SEQ ID NO: 94759 - DNA, 460 bp, Heterodera glycines
  SCN-specific regions: Sequence locations=1-460
cccaaattcgccacggtccgctgaagccgctctaacatgagccaaagcccatcataggcggtcacactcattgtcgatgtgtacttggagtgtgtggccatctttttggagccgaaataggccaaatggctatgctgtgagatcgaactgagcagaatggacggacagtttgagttcaaccagtaacagcaggacacgaacagggacaagttcatctgcgagatcaaaaatttggacaaatcgcttaccggagtctacaagttggtgttgatcagtgcggaaggccgtgagaacatcgccacgttcaatctgcccctggtgggcatcgaaaaatgcaattggactaatgtggccgcttctctgacaatggacccaatggtcgtgcgagaagtgccactccaacctctggtcccgatcagataaagcgcaagaatggcggaactcgaaccgatcgatcgac

SEQ ID NO: 94760 - DNA, 183 bp, Heterodera glycines
  SCN-specific regions: Sequence locations=1-124,156-183
atctgcggcttcatcacctgctctctgttgtgcgcgaattggtacggcggcaagacatgcttcttcgagggccgacttggatatgccagtggactcaacttcgtcatcgtgatcatcaacagctgatgaagaagcaaaggaagaaaagcagaaaataaagatggatgaagaagccgtgcaaaa

SEQ ID NO: 94761 - DNA, 468 bp, Heterodera glycines
  SCN-specific regions: Sequence locations=1-18,41-409,431-468
tgctgatagaaaataacacccacaatttgctgctgatcagtccacgcttcagcttcaccaccgacacacttttccttaccgtagtagtcaatttctaggcatagactcaccggctactgtagcgtcaaaagactacaacaaaacaacaattttatcagctcccggcgatcattgacgccgctaggagcaaagatcgtcttctcggcattcttcgttcttcgtccgttcttcgggcaaagatcgcttctttcaacatgacagtgccagcatagcagcagcagtgccatgcgccctctgtgccgaaaacactgacaggagagcctttgctggtcggtcttcgctccgctacgaactttggaggaccaccagcagtacgtaaatttgaaaagcattgcttttgaacaaatgttcaataatgtaaagatgtcaagcatttaaaggggattttgattttgagtcaaattaaaa

SEQ ID NO: 94762 - DNA, 274 bp, Heterodera glycines
  SCN-specific regions: Sequence locations=1-204,227-274
caacctgcttccaaatgttgaacaaataccgtaaagcaattcttaattgatccaatcaatctaatgtaatgacggcgagaagctcacttcatcttcggccccttgggcacgttcattgcgatcagatcaaatcccccaaccggcatcggaggcacttcccattgctcaatctctgcgcgcattttcgcatctgtccccacatatttcatcagttccacacactcgcgtttgatctgttctctcatttctcctaaaaaaacacaaattctgaaaa

SEQ ID NO: 94763 - DNA, 510 bp, Heterodera glycines
  SCN-specific regions: Sequence locations=1-18,44-510
gccccaagaatatctacaagaagtttctttgctgtttgtgtggccaacattttgatggagttggtccgttggagtcccatttggccctggtgcatgtgttttacttggcctatgaatgcgatctctgcaaagatgcgttgtttccttccgattttgcgttgcgagagcattacgttaaaatccacaacaaaacatgttttactataaaatatcgcgtctctcctgagttggaagagcgacgcgcattgctccgtcgtttggtcgatcagtcaatgcataaaacgggaagcggcacaattcagcagaacaaagcaccgaatttggagccgcccaattcatacacttctcagctgctgatggattgcacgtcactgctgcaaacgcaactgatggccagcaatcactttctgaacagtggcatcaaaaaggagaatgtttgggaggagagaaacgacggcgcaagggtcgaccatttggagggcgaaattgaaggaccaccaattgaggggg

SEQ ID NO: 94764 - DNA, 525 bp, Heterodera glycines
  SCN-specific regions: Sequence locations=1-379,401-525
cttgccaaattcacgccatttgttgggaaaagcattcgctatgaattgcataattttctacaaaattcttctctgttgtcaaagcgagtggactttttccacgtttacccaaaagcattctcagtgaatggttcttcttctggcgagcacagcaacagggtaattagccaatggcttgtcggaattgagcttcttcccgggaaaattgtggattccgagctcagaagcgaattgagtcaaatgttgggcaatttcgatgcaaaagttaaaaatgcttttaattatttccttttccatgctgtggaccttttctcagaatatgttgagaaaaatgaactcaaattacggcgatttgactaagaaatattttctgaatctcttttcacaaaaaaggggtgttcgtccggctattgcccaaatccaattcaatgtgatattttatttcttttttttaatgtaattcaatctgtttgtttaattaatgagcttgcaaaaggttaaaacgagcattttgaaaaaaaaaaa

SEQ ID NO: 94765 - DNA, 558 bp, Heterodera glycines
  SCN-specific regions: Sequence locations=1-558
cgccccccgggtggaagtaagcaactgatagtctgctcaataaatggcagggaaaaacggacattgagcagctgaccaggctttttgtggtgatgggcacgccgacggagcagagttggcccggctgggaactgttgccggacgcgaacaaagtgatgttcgacgtggtggagccggccaatgattggaccaaaattgtcccatcagtcagtagtgaagggctccaactgatccgatcattgatccagctaaacccatgcatacgttcgtccgcactccgctgtctacagcatcccttcttcacacaccatccacagtatgaccaaataccgtaccagccaccgttgttggagcaaatgggaggacgaagaaaagtgccggaaattgtgttcaatgacagtcgaagaatggagaagatgaagccagcaacaaacaagaaacaagcgcaatggcacaaaggttaaataaatatctgttttcgactgaaaatgatcagtgatcacataatggtcgattattaaatcggaatttaaaaaaaaatccactaattttttaaaa

SEQ ID NO: 94766 - DNA, 593 bp, Heterodera glycines
  SCN-specific regions: Sequence locations=1-74,96-252,274-593
gacacatttgaaatgcaattgcctacgatttgagtactgtcaatggtttccatgtcgcccatttgaacttgacgaaaaaccgttaccaaatgaacgcaattgaccaggcgcggctggtccaaaacctcacaaattggcaacggatgcatccgcttttcctccacggacacttcgctttctttgattttgagagattcggccttccccctcccatttggattaatttgcttcgcgagcccttcgatcgctttgtctcttatttttattttcttcgctacggcgacaattttcgggtcggacttcgcagaagcaaagcggggaacaacgagacttttgacgaatgctttcggcgcggcggcagagagtgcgacccaagcgcaatttggctacaaattccgtacttttgcggcactgcccatttctgcagcattcccggcaatgcgcaggcccttcagttggcaaagcgcaatttgctggaccattttctgttggttgggctgacggaacgcatcgaagagaccgtccttttgctggagcaacttttgcccgcctttttccttggcgccggcgaacatttccgcttgctaaatggt

SEQ ID NO: 94767 - DNA, 534 bp, Heterodera glycines
  SCN-specific regions: Sequence locations=1-534
tgcaatgggaaaggacaagaaaggtgattatgacccggacatctacggagattggcaagatgagaagaagccatgtgcctgccattgttcgtatctgcgtgccaaaaatttctaccgagttgaatgtgacttcatgaatcgcggtgtcaaaaggttggcaaatgtcggccgtgttgcgcttgggctgctctctcttccgacaatgtttattcctggtgtaaatatgctagttgctaagccacaagtggactctgtgggacaagacattactcacaccgctttggaagtgcgctacgaatgcggaatttgtggtcaaattgcatacaaaacttacgaaattgtgtgtaaagacgtaacgagtgacagatggggccgttacatgaaaacttacggggacgagcccatctttggcattcgcaccacggaatttgatggcattcagcgagtgtttgatggcatgtggaagaactacgatttcatcaacaacaattgcaagaattggacccgtgatatgatcgggtgcctcagttaaag

SEQ ID NO: 94768 - DNA, 588 bp, Heterodera glycines
  misc_feature (45)..(45): n is a, c, g, or t
  SCN-specific regions: Sequence locations=1-588
ccccccccagcccccgagtgtcaaatggcattcgaatgatcatcntcttatcattatggacatggacaaaatactcagtgatatgcgacaacacatatcgaatttgcaagacaaacttcacgtggcaaattctgccgttagcaaaggacaaattgtcaatgagaaaatcacactaatgaaggagtatcaagacaaaatcgcatcattgaactcgtgctggagagccaggaatagaacgcaattagtgcacaatttgcaacaggaaagtcgccaaatcattgcactcgaagaggaaaatcggcagcttcgatttgcactcaaagaaatggaggacggattgcatctgatcatgaacgactatcggaaaatgttttcgggttttatgagaggggaagaattggccgaagtggccaatgcccagcacaaaaaggtatttcttgctggggtgagttacgagcaatactttggaattgcacgtgccgctgagaaatttatggcgatatcagaaaacaaagttgcagaagacgatcaggttatcactcagctgaaactcgagaatcagactctcagggcgttgttccacggatt

SEQ ID NO: 94769 - DNA, 156 bp, Heterodera glycines
  SCN-specific regions: Sequence locations=1-156
caattttcagcgacaagaacaggaggaaaagaggcggacgaaccgaattcgacgaaaaactatgatattgaatagtgaagagtgatatttaccattatcccatcaatttcccctgtaattcttcggataaataatggcgaaaaaaaaaaaaaaaaa

SEQ ID NO: 94770 - DNA, 427 bp, Heterodera glycines
  SCN-specific regions: Sequence locations=1-365,387-400,422-427
tctaagattatttggcagcacatcattctggtaccttctgttactgctcgaactctacgatactgctaaattatgttattctggacgcaacaaaatgtactcatcgaaacagtgcagcggtggaagttttgatatcaattatgtgtgccaaaaatacacttgtgagggcggacgatcctcatttactttgcggacttgcgcaatgaaatcgacgggttgcatcgcgggcacacgaacttgcagattttcaggcggcaaaggctcgtgccagcggtgtgaaggcgatttgtgcaatttgtgaccaatcattttttgggaccgaactctgatgttgatcatgaagctttggtcacagacgatttaaatattttttagcattttgtaaacttttgaatgtattcaacctttaagacaaattttgagaaaa

SEQ ID NO: 94771 - DNA, 519 bp, Heterodera glycines
  misc_feature (489)..(489): n is a, c, g, or t
  misc_feature (494)..(494): n is a, c, g, or t
  SCN-specific regions: Sequence locations=1-519
aattgacgacgcatctcattacaccaacgaaatgctttattcaatttttgccggttggattggcgcaaatgctgctgttaagtcaaaaagtcgcgtggccatcgatcgttcgacaattggcccctttcaatgtgggcctggtctttgcactcgaatggccggcatttcgggcggaattgctgtcgcaatgaatgcgtacggcgcacactttgttctcgccaatgccgacattaatgatgaacgaaaaagagccatgacttatgcgatcaaccatcacttcatcaactgcattggaatggcgttggccggcgtcggtgcccattatccgacgctgacctcgagtatgtttctgatcagcactgtgctgttcagtgtgccttcctatttgttcgccatacgcaatgatcgccgactgcgcgccgtgacgccgtacggcggtgtgttggccatgctcgcttggttcagtttcgtcctttgatcgcttcccanaacanttgcaacaaattcggacggaaaaga

SEQ ID NO: 94772 - DNA, 433 bp, Heterodera glycines
  SCN-specific regions: Sequence locations=1-433
aattcgtcaaaatgcggtgcaattgcgagctcgcactttggccgacttgagccgatcctttgctgtcggcgacagttccccctctccgaatacggcactctcctacaaaatgcgttcttggtcttggcgcaccttccgacagtcgcgtttggacgatgtgtcctacgcggacgattggttccatttcggcacttcctaccgtacttttccggtcttggaaaaattcgaccgtcgtgattacgccgccataccgtacacttattggtcacgggcgtattgcaccgaactgtatccgtccgaccgtactgaaatataccggcgcatttacgagccgtacagagacgaatactcctacaaattgtggaacgcatcacgcagagcactgctcagcagagataatcgactcatgtgaagagaaagaaatattcttgct

SEQ ID NO: 94773 - DNA, 557 bp, Heterodera glycines
  misc_feature (512)..(512): n is a, c, g, or t
  SCN-specific regions: Sequence locations=1-8,30-356,379-512,534-557
aattctcttttcgtcaaaatgctttctcccttctcctacgatccgttctatcgccgttcgttgtggcctatggccactcatgttggcaacgtcctttcgcccttccgccagttggagcgtgaactcgaccacttcttcgaggggatgcagcccatgcttcgtgaccatgtcgctcagctgaacgtctcggacaagggcgacctcacttacaaagtcgatgtcagcggcttccgccccgaggagatcaacgtggaggtgattggtaatgagatcatcgtcaacggggaacaccgcgagcagaacgacagcgaatcggtccaccgtcagttctcgcgccgtgtgctcatcccggagggcatccaaaaggagagcatcaagtgcgagttggacggcggtcgcctgttcatcagcggaatgaaaacggctgacaaaggcagcagtagaaaaggacggcggaagtgaagacggactgactgtcggtcgaccgaatgatccattgacattgatctttntattttgatacttttgcaaagtgatctataaattatttttccttc

SEQ ID NO: 94774 - DNA, 409 bp, Heterodera glycines
  SCN-specific regions: Sequence locations=1-24,46-332,354-409
gaacgtttttccgtgttcgcttccctctttctctccgtcgtctctttggccttcgcttcgtccacttttcacaccgatttttggattctatcggacgtaatgcgaaggaatggcaccgaatcgaacaaaaaccaaatgaacagcggactcttccatggaatacgccaattggactgggcatttgggccaaaacggaaacacttttcggtgttggaggaactccaatccggcgttagctttatggaccgcaatgtttggttcgcccttttgctgtccattggcctcggcttcctttggaacatcgtcgatttatcagtgacggtgaaaaattgcacaaaatacggaaacgggggcaaaaaaattatgccggatgttggcacagttatcgttggaccgtaggccatttgct

SEQ ID NO: 94775 - DNA, 511 bp, Heterodera glycines
  SCN-specific regions: Sequence locations=1-46,71-376,399-511
ggccaagaattggttagctgagctttttgggactttgtcctccttctgctggtccatcaaattctttgctcttcgaagcaaaattgaaagaaaatgttccctcaatcagtctgatacttttgtgagtgttctgccggccgtgacacaacgccacgacaacgacggacgacgggtcaccaaacacacaaccaatcaaatcctcatccatcaacattcgcatcatcatcatgaacatcattcgtcccgtcacataacaccgttttttcctcatcagactacctcattcactcacttcactacctcctccacccctttcgccggctgatcagaagcattcttcagccgcttgtgtcacttctgctccgtctgtctgatcaccgacaaacggacgaacgaacgaaggatcaactaaaaagtgaggactttgagactgatcgggaaaaaactacaaattgagattggtaatttacggcattttttccatttccctaaagacttcaattttttaaaa

SEQ ID NO: 94776 - DNA, 524 bp, Heterodera glycines
  SCN-specific regions: Sequence locations=1-524
aagacggccaaatttctcagctttttggagcagttcacactgtgcacaatgttccgcatttttggccgtttcgtcggcacttatcccatcgcatttctgatcttctcattgatccttgcttcgctgtcaggcgatcccctgctgaccacagtgatgctgcgggcgcgcgaccggcacagcatgcaccggctccgttggctggacgaatgcgttcggatgcacgactttttgcgcctgaacatttccgccaccgttgggggacagttgactaacgtggtcaccttcgccatcggcgccttaacaccaaccccgggcaaacagttcaccatcctttggctgcacaagtcacaagcggaggagtgacaaagtgatcagagatggagagaagttacagaaggaccccaaggcatcgatagaacagttccaagcagcaattcacagtttccaagcagtggaccgtgaaatggaaaacgaaattcagcaacgaaacactccaatatttgtgaacaatgaactgatcagag

SEQ ID NO: 94777 - DNA, 279 bp, Heterodera glycines
  SCN-specific regions: Sequence locations=1-235,257-279
atgttatgacaacaaacagaggcatggcgattggttggaagcttttgacccgagacaacagaaaaaaattgacgcagattacgctcttttcgttgccggtcatgatccaccgccaaagtgcaagaaatatcgcgaggcagatgaaagaattttgagactgacacaaaattttaacccactaaacattatggaatttttgattggtgtttctcgaaattaccagatggatgcttagaattttatgaataaatttttgggatgttaaaaaaaaaaaaaaaa

SEQ ID NO: 94778 - DNA, 470 bp, Heterodera glycines
  SCN-specific regions: Sequence locations=1-193,215-344,371-425,454-470
tacccgaacaattcccctctcctttttcatggaaactgaaaacgctgaggaaacacagcaacaacgaccatttgcaattaagcgatggaatttggtgtctacatggagttgggacgtggagtgtgacacgtgcgccatttgtcgtgtccatttaatggaggcatgcctccgttgtcaggccgattcgaaggcgcaagaatgtgtggtcatttggggcgagtgcaaccactgtttccacctttgttgtatgtctctgtgggtgaagcagatcaaccggtgcccgctgtgccaatccgattgggctgtccaacgagttggaaagtgaagagtgaatgattggcatcacatttttcatttttaaaaatttaatccatccaatgattccaatttcaaagcgcataaatttgattatggtctccctatcaaacgcaatttttatttaataaatggatttgaggataaaaaaaaaa

SEQ ID NO: 94779 - DNA, 369 bp, Heterodera glycines
  SCN-specific regions: Sequence locations=1-369
gaagacccgccaaatgcggagccaatcgaaacggtggagaaatttgagagcgaagaagtggagaaagtgcacatgagcatgggggctgcgaagaagcggttcgaccactgtttgttggactcggaaggggcagatttctccgattcggtcggagtgagacgccttaagcggggattcaaagccagcgaagtctttgaatcggaaacaattggcagcgaggaggaggaaacactcgaacagaaatttaatcgcctcaaccgggaaatcagaaatttggcagccgaagttgaacaaagccagaacgaatctcctagcgtcaaaaaggaagacgtcgcggccctggacgagttgctaaaaacgatcgcttcg

SEQ ID NO: 94780 - DNA, 524 bp, Heterodera glycines
  SCN-specific regions: Sequence locations=1-524
tctccgctattgtattgcgagttcggccgcttttaccggtgccgcgctttacgttagcctcgtggaccatccgacgcgccttcagctggacaccgccactgcgcttaagcaatggaagaaatgctactcatggtcaatgccactacaggccggtctggcactttcttctggcattctcgcctttgtgaacattgtcgaacataaacaacatatttggaccttgggcagtgcgcttatgttggtcaattggccgctcactttgattttcattttgccattacaaaagcgtctgatggcagtcaatgaggcctctgccgatgagaaaacgcgtgccgacttagagcgctggggccatttgcacggaatgtgcgcgacattgggacttatggcgaccggcgttttcttggctggccgttttgtattaaaatgatagaaaaaatgatggcgatattctcagaaaatgattgcaatttctgcctaccaattctttggtttcacaaattccatcgcataaactcaatttg

SEQ ID NO: 94781 - DNA, 314 bp, Heterodera glycines
  SCN-specific regions: Sequence locations=1-201,223-314
ttcctccgctcatttgcaaagtcattgttcgtccggttggttttcgcacaaaggcaattgttacaccgtgatcgccgggggatggagtgcaaaaagtgcaagtgcaaactgttcaattgcaaatgcgacactaatcaccccaaaaattatcgaatcggacgaagaggaagccttcctcagagatttaatttcatttaatgcacccaaaaagaatggccaaattttggtgggagaaaacattgacatttttatatgcagaaaagcaatgggaaaatattaacacaattttaatgtgtcactttattaaataggta

SEQ ID NO: 94782 - DNA, 371 bp, Heterodera glycines
  SCN-specific regions: Sequence locations=1-155,177-209,232-371
cgcttgtctcattaatttcggataaaaattatgagcggagaatccacggctatgtcagtgttcttcaggatgagcgatggcgcagattatacgccgttttgaaggccaatttgttatttttatttgagtcgtccgaacgccttgaaatccccgtgctgttaattgtaatggaagactttgtggtcgaattggccgatgacaatacgatgggaaggcaaaattcgttctccatcaaattcaacaccaccggccacaattacataatggcggccaccgattatgacgctttgcagaattggatttctgttttgacttcatgctcatttgagtttatggaggcgacacgacagtcgctagagagtgtagaggaa

SEQ ID NO: 94783 - DNA, 340 bp, Heterodera glycines
  SCN-specific regions: Sequence locations=1-340
ccattgggtggatcgtcgctttcgagcccgtcgctttatgaacaccgaccccaacttctggtcccgttgcaaatggtactccgactattgggagccgtgtaattggcgttgcgattaataccaacattatgaccggcccctttggaactagtggaaaccggacatttcggacggaaagaatcagaagccagccatcgacatgtgccggaatggactcctctcttttgcctattaggaccagagacggataactccgggggcgttgggtcagaaggaaaaagactgggccgacatttacccaccggacggaaagtacggctcactccagtacatgtactca

SEQ ID NO: 94784 - DNA, 315 bp, Heterodera glycines
  SCN-specific regions: Sequence locations=1-315
ggcagttcgtacgaagcacgggtgccgtcggcgtcgcgtgttcagtgccaaaacgacgacgttttgtcccgacgacgttttgttctgacgacgtttcggccgacgacgttttggggacccaaatgtcgcgctttcatgcgtcttcatcagtcaaacttccgactcttttccgttccccaattttgccgcgtttgctcaaaaatcagtcgcctttccattgcccgattttgagcctttagatactgctttcatgtgcacttgcatcagctttttgtctgttaataacagtgaataaacataaaagaattttaaaaa

SEQ ID NO: 94785 - DNA, 445 bp, Heterodera glycines
  SCN-specific regions: Sequence locations=1-445
gccggcttatttggcgcccgaagtgttcgaaagagttggccacaaccaaagtgtggactattgggcattgggtgtgctcatttacgaattaatggccggagaccaaccattttggggcaaatgtccggaggacgtgtacgagcacattcaggagacgaaggagaacggactgcgctttccgaggcggacattcagtccaaatgcaaaagatatcatccgtggattgttgtgcattgaccctaaacaacggttgggctgtgatcagctgaagaaacacccgtggttcagtcagtacgaatggacggagctgtccaaccggaattacaagcctcccttcgtgccaacaatttaccacgaaggtgacaccggcgactttgactcttaccaagaggttgaacacatggcgccggccaagcagtgctatttggaccttttggatgagtgg

SEQ ID NO: 94786 - DNA, 434 bp, Heterodera glycines
  SCN-specific regions: Sequence locations=1-8,30-136,158-434
tgctgttttttgcctatttgcctccagcttggtctattggacatggcaattattttggacatcatgaggggttgggcgtgggcttggcacataattatgtcagcaaatatggcattccgatgaatttgagtgacgaacaattggatgaactcaaatggcgccccaaacggcacaccaaattggatggcacccaaatgatcaattcttcagggcagcaaaattgctcagatgagaattttattttgtccacattgctgagggattacgacaaatttcgcatccctggtggcggaaatgtgcgcgtggaggtggagatttgggtccaggaagtgtccaaaatcattgagatcaccagcgaatttgaactggacatttatgtcactgaaatgtggacagatccttttcttgcatttgcccatttgaatccgtgcaaa

SEQ ID NO: 94787 - DNA, 418 bp, Heterodera glycines
  SCN-specific regions: Sequence locations=1-381
atcacatcaattacctccctcaaaatgccacttttttccgctggtcatcccctgccgttgaaatcgttaggcccttttcccgaatttggccccaattattcctcgccatatttcactcgcaccggcacttattcattcccgaatcattaccatttgcaaaacgaccgtttctacagtgccttctttcgcgcgtcttaccgtagtactgactacagtcccgagagtctctacagtagtcggatcgcttaacgctgaatgaaaataattctgctgctgctggtggatgcgcaaaatgcaaagcaaagaaagtgactatttacaattaatcatttttactgaaatgataaaacaattcactaacatgatatacgaattgtgtaggttttttgaatgtttaaaaaataaacacatttaaaaa

SEQ ID NO: 94788 - DNA, 502 bp, Heterodera glycines
  SCN-specific regions: Sequence locations=1-188,211-348,370-502
cgatcgcgaccatctccaaccgtccacaattgcgaacattgttcattttcttgtcaacgatttacaacgaatgcagcgcatgacggacattctcacggatttccaagtcgactggatggaatacaaccaattgacatgggcagtgatgtttttcatcgtcgaggagtgccattctttgccgataagcgaagggacaattgtgatgccaacactgtcttttttgtttgccggatttaccaatccctttttgacgacatttcaggactttttcctgcacattgtctccgattccttcgtggacccgcgcactccaagttggcaaaaggaagttctcaccgttggcattgagtcaaaaaaggccatttctgattgattttcgttgaaaaaaatgaccaaatttattgctgtgattatacagaataatttatttgtatcgccgcattgatcaatgcaatttaaacgaatgttgttgtgttaattgtcaataaacaaatatgaaaaa

SEQ ID NO: 94789 - DNA, 548 bp, Heterodera glycines
  SCN-specific regions: Sequence locations=1-100,122-548
accgaaaaagctccttcgtctgaattggaactttcatttttgtgcgaggaaaatgaagaaattgctgccccaaacttaacatacgacgacaaccaatcgggcaaatggattttatcttttgaaatcggcgatgtgctcgacacaaaatggaagatggctagagacttatacaactctaaaaagttggatggaattgtcggcatgaaagtgtcgacaaattgcccaaggacgcgccgaggaaatacgggagtgatcatcatgtattgcggcccgttttatgaccgaaacaaaatgttggacattggcaacaacatattggctaaaatgcaatgcacggcgccaattacatataaagctgactttcagacactttcgggggtggaggaaaccctttacaccatcagcccggaaggatcgtcgtcttcttagaagagggaaagagtgatgttggccattgatgtcatagtgaaagatgaaaaaacggagaaattcctttctgatcccaacaaatccaatggaacaattttgatggaaattgaaaaagtgtc

SEQ ID NO: 94790 - DNA, 206 bp, Heterodera glycines
  SCN-specific regions: Sequence locations=1-178
tcgtggagctttaattggtctgatttggctgcgggtcgccacaattacaaatttattgacacgggtgtaaaaaacatcgattgatgacggctaaccagcaaattgcccagcggagaaagacgggaaatcggaaaaattaaaacattggcaataatcgactgactaatgataatattgcaaaatatataatatttgaaatttaaaaa

SEQ ID NO: 94791 - DNA, 567 bp, Heterodera glycines
  SCN-specific regions: Sequence locations=1-194,218-281,303-567
tgatgaagacggcacttgtctgatttcgttgggtttcgaaatggttaattggtgctgcttcaaattttggttttgctttcgacttttgcttgcttccatcgcgcacttcaattggtttgccgccatttatgtcaattgcattttctttacattgtggaaatcttatgacattttgtggttttggactcatttggctctttgtgtttgttttcctgcgcttcgaccgaacaataatctaattgtcttcgtcaaattggttagagcaaaatgcacggatcactccagcaaaagcttcaaggaaatttacgaattgatttattcggacacgccggacgaaacaaatgcggagagagagttgagaagaattgaaacgcaaaggaaggaatcgaaacggagggcacacgagcgaattgggaagcagaaaaagcaccaaaaacaaatgcaactggaagaggacgaaagcgcctcttccgacagtgacgatgactcatcaacaattgtccaaatgcaaggcatttatccgattttgagctattgtcagcagatggccctctgttgtcggctcgg

SEQ ID NO: 94792 - DNA, 367 bp, Heterodera glycines
  SCN-specific regions: Sequence locations=1-367
cctcaaatcctggccggttgatcattcccaaaatttcgacgaatacctggaggccaaagggttcggctggttcatgcgccaagcggtcaatcttgcctgcatcaccaaaacattttctaataattataactgcacatatgcatgcaaaatttaaaccatcaaaaagactgtggagtggcccagcttcaaattgcgcgaggagtaccaagccaaatatttggaccactcattgcctaatatcaccttccactacaacccaacaaccaacgagctgatctaaacgcacaaaaacgtggactccgcagataagcctcacatctacaagtacaacattgactctgacagatctctgatgatgcatatggca

SEQ ID NO: 94793 - DNA, 156 bp, Heterodera glycines
  SCN-specific regions: Sequence locations=1-14,38-156
acgcttgtactcgtagagaaacatttgtgagatgtaccaacgttcgctggcaagtatgtaattcgatagacagcaattgtacctttcgacacttttacaacttctatgaagttccccaacgtcgtacaaatttgcattgaaaaaaaaaaaaaaaaa

SEQ ID NO: 94794 - DNA, 405 bp, Heterodera glycines
  SCN-specific regions: Sequence locations=1-382,404-405
tgccctcctttccgcccaacgtttggccaagtctcctccaattttgtcctcaaatactccgtcacaagccatgggttcttcgatgttgacctccaccactaccacaatttcatcgtcctcttcaatgccaaacactactactgaaattggcattgaacgccgcacttcggcaacaaaaattgtgcaaaaaacgccacgatttttcttctggacattgagccaaagtgaaaagaagaaaagtgccaattctgtggattcatctccacgaacgcccgactcttcgcgcagtgtcagttttgagggagccgaagcttggccatggattgacgacgttgtggaagaagtggaatgtgaatgctttgaagaatgaatgagcttatgtgggttctctgtggataatggaag

SEQ ID NO: 94795 - DNA, 516 bp, Heterodera glycines
  SCN-specific regions: Sequence locations=1-516
gcgaaaacgggctgttttcccagcaaaaacaaagtggaaatcgactgaccagtgatcatttcgtgggggatgattttcggcatgtgatcagtcgtctcattttggtgctgcttgtagtcattctcgtcaatgtccgatattgccaatgcttttctctgcgacggttttcccacaaatgttcggcataaaatcactgtttcacccaaaactcacatttctggcagacaaatggcctccatcactccgcgaatgcgcgtcgcttcgacgttcttcgactgacttttgctgcccgaaacaaccaaagtgatgacgtcgtcaacgggcaccaatttccactcaaaattctttaaaacattaattaagccatatttatgcaattattttttccgttagcttactcggaaaaggttttccattcctctaccgaatttgcccatttgtgcaccgccggaagagcccatcattccaccgcggtactgactatgctgctgatgcagcggaatttgtggcgtcggc

SEQ ID NO: 94796 - DNA, 205 bp, Heterodera glycines
  SCN-specific regions: Sequence locations=1-205
agtgcggcgcgtgtgtccgagtttggccctggcgagaacggaattctctctccaattcgatttgtgccccgagaaatcgctgctggaacaaaattatcagtgcgccgaatgtttttcgcccatcggattcgacgacgactctgaaaaactgcctcggatttgcgatttcaccggccttttctgttgtaggcgctgtcattggaac

SEQ ID NO: 94797 - DNA, 297 bp, Heterodera glycines; identical to SEQ ID NO: 73338
  SCN-specific regions: Sequence locations=1-114,136-297

SEQ ID NO: 94798 - DNA, 377 bp, Heterodera glycines
  SCN-specific regions: Sequence locations=1-377
ccctaaacgaatgaatgcagtcattatgaatgtttacaacccaaatgcaactgctattatctttggtacgggaaaatttgtgtgcacaggagcagctaatgagaaagaatgtaggcaagctgcggagcaagtcaccgaacgaattcgatagtgcgggtattacgatgcccaaattcaggaatttaaagtacgaaatttggtagcaacagcagacgttggttttcatatacgcttaggacctctgtccgactttctaggcgccaaatattgttccttcacccccgagttatttcccggtctcgtgtatagaaaccaaaacccaaaaatatcaatcatagtattttcaagcggtaaattaaacttaacaggctcaaaaa

SEQ ID NO: 94799 - DNA, 269 bp, Heterodera glycines
  SCN-specific regions: Sequence locations=1-269
agctgtatgaacagcgcaaattgattagcatgtttgtcgtgctgatcctttttgcttttttctgtggactttttttgggttctgtgttgaacagcgaaggatcgaaggaaaagtgcgagctcttatgcaaattacgcggacatgataaattcaagtgtgagatgttttgcaaagtgcgtgatgagcatgaattgtaaggaattaatcctgaaaaatatgttaatctgttgttggtaattcataaaggtctttgttgtttaaaaaaaaaa

SEQ ID NO: 94800 - DNA, 571 bp, Heterodera glycines
  SCN-specific regions: Sequence locations=1-571
ccgtgcatttccttcacgggctgaaagagtccgccaatggatgctcttctcacgccaatggcatgcgattgacgcggatcgccaagatgtttggaaattggcgaagaaagtggccaaacatttgagcggatggtcgaagccgatccaccacccgcacacggactgtggtgatcatgttgttgttgtcaattgttccgccgtgagtatgcacgcgtttgactggaaacacacgcatttcttctttaaccggctgtacccaaagagcaaagcggacatccccgcctatcagatccacgagtacgacccgtgccgcgtcgtttggatgtgtatcggacgcgaattggcatttctgactcggaatcgagttgttcagcggcgttgtttcgagcggttgcatgtctttcccgatttggaggttcccgattctgtacgcaagaatatcaacaatcagcttcgccaagtccaggaagtgccaaagaaatcaacggagtacagtgccgaagaacgcgccggctttcctctgcttttcgcccaggagaaactttcttaaaattgggaagaacctttgagc

SEQ ID NO: 94801 - DNA, 583 bp, Heterodera glycines
  misc_feature (1)..(1): n is a, c, g, or t
  SCN-specific regions: Sequence locations=1-484,507-583
ntttactaaaatgtcttcattttggaatgtgtctgctgttctcatgctgatcacactgatctctttgcttgtcaacagcagtgaagcggtgccgttgccttcaaaaaagtcgtcgtcattgtggtcgaaacttttttcaaacgatcgtgaaagtgctaaaaaattgggaagcccttcttcgacatcggctgctggtggtgaattttcagtgcagtccaaaatgtttataccgtatgccaacaacggcaacggtggcttctttctaccgtacccgagtgaaatggacacagtcaaacgcagcaacacggaaggccatttccttgacccatatgatggtggctcatcgtggttgagcctcagcgatccgagccgacttgaatggaacttcaacagactgcgctaatgaggagggcaaagatcaacacaatgatcggtgaccaaaaatcagtgcgaagagaccaacgatcacactcccaactgatcatttattaaaaccaatcaataatttatgacacaaatcacacccaatcttacaattcagatggagcatgttcttaaacatacacttacataatattttgtt

SEQ ID NO: 94802 - DNA, 460 bp, Heterodera glycines
  SCN-specific regions: Sequence locations=1-460
agccatcccaatgccaccaccaccaacacaagacgaaaaggaccaacaaaagaaatcccaatggaaaccgctggagataggaacaacgaagattccggacccagaagaattgcctttcggaattgtacagactgcattccgagcttcagatcggatgcgcacgacctcagaagattcggccgagtcttttgacgcctatggaccggagtgggaagggaagggacggggaattgggaacagaagggaattcagttcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaag

SEQ ID NO: 94803 - DNA, 418 bp, Heterodera glycines
  SCN-specific regions: Sequence locations=1-130,153-342,387-418
cttgtaatcagaataatctacagaaaacttttgtctcacattgtgccaaacccagtgtgtatggttctgcgacaaatattcctacggttttggtgataccgtaggaattggcgtcaataatgctaattgatttttatgtttaaataatcaaaatcccgcaactttttcacagatacttctgattttatggttgatccatcttttgctgatggctcattttatccattcgttactttgtttgtctctggtgacaaaattgaggcgaattttgggcccaatttcaaattcgatttggcaactctctgaaggaagaattaattattcactaatgttttcgatcaatttgctctttttaatcatttttgtgtctttcttcttcaattaaaatttggttttttgaaaaaaaaaaaaaaaaaaa

SEQ ID NO: 94804 - DNA, 533 bp, Heterodera glycines
  SCN-specific regions: Sequence locations=1-212,234-245,267-507,529-533
tctttttatcgcaacaatcagttgccattccgtcatcaaccggacaattccgacagcgcaaatcgaaaggattacgaaaacaattcgaacaaagagagaaatgacaacggaaacaaaaacagttacaaggaaaagcagcgaaagaatgaaagtgacggagaggaaaacgaagaagaacggacacgacgacgaattgaacagagacatttgggaaaagggaaggaagagggagaaaagagttggacaagggagggcgaaaagggcacggaaaggcgggaggaaatggccaaaagtgaaagcattttgaacgcattgatcgaacaagtgcggcacagaagcgaagtttgtcacggattctaaggaaaaaaaattattgaagtcgaagaggcggccaaagcgatgacggcactaatttgatttgggtctgcttttctagcgatcagacaataaagtaaaaaatttgacaataagcggatccaaaccaaattactagctgacgtcgccacattgtgttttttgaaaattattaattt

SEQ ID NO: 94805 - DNA, 444 bp, Heterodera glycines
  SCN-specific regions: Sequence locations=1-444
ggcacagtctatacgctgctgcactttattgctctcgcattggtcgtgcaattggaatagagcgtgatcctttcctatacgagttgcagtgtcaaattgttgccgaatttggcgattgcttatctccaagagttatgttcgcgatgttggcactacatcgaaagatggtcatgccgatgctgacattttggccaatgctgatgttgtcatcatgaacaacgtgttcacattctttgctgaccacgctgaacaggtttcctgttggcaacatttgcgtgcctatttgcgtcctgacactctgttattgccactcgccctcgctggagttggtcactgcccatctctgtccgtcggcacttggctttgccttcgacggttggttacaagcgctgcacattggcactgcagcgatgagcaccgctgtttctgtgggaactgatacat

SEQ ID NO: 94806 - DNA, 530 bp, Heterodera glycines
  SCN-specific regions: Sequence locations=1-73,95-356,378-435,457 -502,529-530
ccgctccaacgcttcgtctctttgtctttgtactgctccaatttgtcgtccgacccttggtcattcattcaatgctttttcctcccttcgttttgctattggctcccattccattggctttttccatttggcccatcgttttggctgaacccgtttttgcgttggaccatttgtcactgcaaaaccgtgccaccgatgaaaagcattcgtccgcttccacctccccttcactgttatcgtccgtcgcgttgacaaagtgtcaaagcgactatttgtccgcactgatccatcgctgcatgataagaggagtgcccacagcgatggaggggcgcatttgctttgcggacgaagtgcaactcgcagacgtgcacaaattggtcaactacatctcggaggtgtgctgcctccttcgctgtcaggccaaaactttagagcgcctttgctgcagacacgcacaacagcaaggacgatgccgaaaggccaattgtctaccgattcgagaccaaaaagtgttgtgggaagaagctcat

SEQ ID NO: 94807 - DNA, 196 bp, Heterodera glycines
  SCN-specific regions: Sequence locations=1-109,148-196
tactggaaaaaagaagacgcgaaagcttcgaggacacgtatctcatgttcaccggcgggtgggcaagcaccgcggacatccaggcagtcggggtaacgccggtggacaacaccaccaccggatcaacttccacaaataccaccctggctattttggcatggccagtatgcgaaactcttatgtgctaaagaaccat

SEQ ID NO: 94808 - DNA, 528 bp, Heterodera glycines
  misc_feature (493)..(493): n is a, c, g, or t
  SCN-specific regions: Sequence locations=1-151,174-253,275-505,527-528
attttcttatttattgttatgataaacgcacttggttgttcaaatgcccagcttaaatgcagaagggatacggtagggacaataaacggtgttggcttgaagatgaacttttccgaagaagaatgcgagtcgacatatttctggcaatcggcatacaaatattgttatgcttcgcattgtttaagaggaaatgaatggcttacgcattatgggtgtgccaaaagcccggagaaaggtgcatgtagcgacaatgttgagaaggagatgaaagatttgtatggccttgctgtgagctgttcattttgtacaattggacgcaaaatggacgacatgagcaacaagaatttcccgctgtacaatacgaccaatgttgtaatgccgccatcaggaggagcagatggagacgatttttcatttatgtcgacaacccaacaactaacaacatcatataatttatctgaaatcgctacgattgtgccaaaaaaaatgaatntacatgaaatggtcacttcaacaccaacaccaaat

SEQ ID NO: 94809 - DNA, 403 bp, Heterodera glycines
  misc_feature (356)..(356): n is a, c, g, or t
  SCN-specific regions: Sequence locations=1-62,106-403
ttcacttttcgaaaaatgatcaaatattccttcacttcttcccaaatgtcttcagcacgtactcttcgtcactctctccattttgtgctctctgtgctccttctgctcgctttggccaatgtgctgacagtaaatgccactccgttgaccattctgacccgcgagatcagtcccgaggctgtggccaacaaattattggcgtcgttccccgaggggttggaccacatggaggaacagcacttgagagaggcgcgattctttggccaacgatgaaaaagagaagcgaagggacggacggaccttttgaagaatgatctctcaaattatgaccagttttttggcaattcattaaattntgattgttaaatggatgcaagaaatttctgccaaattggcaatcgaa

SEQ ID NO: 94810 - DNA, 444 bp, Heterodera glycines
  SCN-specific regions: Sequence locations=1-114,140-304,380-444
aaattctttcttttcaatggtcaaactgaatatcgtttcctccacttcttcaccggcggtcgcaacgccgtcagagaatcggagtaataataggcaaaagccgggcaacagatttggcggtggtggtggtggggctggtcggaaaatgaccactccgatgacgagaaagccgcgccaaaacgacgacgaaaaccatggcaaacggatggtacaatcggagcccagaaagccgttccaaagacagtatcagcaacaccaaactccggcctcggccataaaatcgattctcaagacgccaaacgatggaagatgaagaggaggaggatgacgacgaaaaagaggaagaagccatggatgacgacggggaggaggatgacgaatgatggaggaactgatggatatggcacagtgccaatgatacggaccaccatcgcagtgcttttg

SEQ ID NO: 94811 - DNA, 290 bp, Heterodera glycines
  SCN-specific regions: Sequence locations=1-67,89-247,269-290
ttcgacacagctattatttcatatcacaacagtttcattggttccaacattgataattgggccaaagttaacattttttaaaaatataggaagtagcatcaccaaaagcataagtaacagtgaccaatatcaaattgagccaaaaaaacactataaaattctcttcataattggaccaatcgataaaccaaagaaaaaaatggagtttgtcacggatgaaaagggaaaaatcaaatggaatttcgaaaaggaaattcttgaaaacaaattcacaccaaaaggattcaaaa

SEQ ID NO: 94812 - DNA, 515 bp, Heterodera glycines
  SCN-specific regions: Sequence locations=1-11,33-363,391-515
tgatcgagaataaccaatgttgttgtcagcaaatttccggcatcttcatttattgagaattttcaatcgaattgtccgattgtctcctcactgtgtctgccagacgacggaattattctccgaacggtttatttcaacttcctttcttttgcgtatgttcattactcattttgtttaattctaattctgtttttacattcattctttcactgttccaaaacttttgttcagcggatgcttttgcaccaaaaaaagtcgtaagttcctttcccatggcttctacatgttggaactgccccaactgttcctttcgaaattttgtcacccgtcgttcatgtcgtcgatgtgattattcgcggacggaagaagaaataaacaaaaacaaaacaatatggccatgttcagagtgcaattccattaattacattgacagaaaaacgtgccacaaatgcggagtgtcaaaaccggaaaacgtcaattcgaaccgaggcgaaaccgcagcggatgggtcttgg

SEQ ID NO: 94813 - DNA, 308 bp, Heterodera glycines
  SCN-specific regions: Sequence locations=1-80,112-308
tgaaggccctgaggggaatttcgccatgcacgaaaagcacatatgatcgagaggagaaggaggaactgcgcacagcgctgaagaaggaggaggaggcaaagaagaagctggagattcggaagaaaatgtccgtggttgtggaaagggtcaacgacgacggcacggagggatggtcggacaatgtgccgatcacgaaagcacggatggccgagctaatccgccatttctacaatttgggatggatgcgcgacaacggcgccggcatggcggtgcactttaagtgtccgaagaccgccgaacttctgatt

SEQ ID NO: 94814 - DNA, 387 bp, Heterodera glycines
  SCN-specific regions: Sequence locations=1-8,30-387
aaattgacacagatggatggactgtttttcgcatccattgcttttctaacaacagtgttttctgtgattggaattgccattgtgaagttgtggttagatgaaagaaattctcgcaaaagcaaagagactttggtggcaatggacgacagtgcaactgatggtaacatgcaaaacgaagtgatggacagtgatgaggacgaacaattgacagggaatggcgccgctgaggaagcgatgttggatcaagaagggacgacattttccgaaaaaagaatcggaaagaaaaaattggcgaagcttcaggcaaaggcagaagcgaaggcactgcgagaacaggaacaaacggaaagagaagagaggaaacaaagagagaaagaaattagaaaa

SEQ ID NO: 94815 - DNA, 321 bp, Heterodera glycines
  misc_feature (2)..(2): n is a, c, g, or t
  SCN-specific regions: Sequence locations=1-284,317-321
cncccgttgttcgtccgccaccacttggtgcagctgggccaggtcggggctgttgcgcagcatgttgtgcatttgtatctctctgtccaactcctcgtccattggctttcgctgggtcaaaaaacgccgtcctaaacgatttcttttaaatgcaatcaacgaacaaagaatgagtaatggccggcctaatgaagctatgcgaataagaagaggacagtgatccaattatgttatttttggtcagggtaattaattgaaggacttgacaaccgaaacaattcttcatttatttttcaattaaatttaaattaattatcaaaa

SEQ ID NO: 94816 - DNA, 488 bp, Heterodera glycines
  SCN-specific regions: Sequence locations=1-15,46-55,77-302,326-488
ccaaatttcgaaatgcttttcctctcttttccttccttcatcctccgccaaattcgcccctctttctgtcgctgcttttcctttctgctgatgttagccatgctttttgatctgatcagcatcggtcgatcacttccactaggctcaaccaacgacagaatttacttctccaacgcattacgtgaccccaaagatattgtgcttcaattggtcactgttccaccgccaatgcttaaatttgccgacttttccaataaatttgttcggttggaaaagcgtcggcgacaatttggtcctgttcaggccaaaaaatatgaaagaaattgctttttctctcctgttcagtgcatgttggttttcagagacggctccaagctttacggacagtaaaatgattgaacgatattaatatttcgataaacacttaacattaacatccgaatgttaaaagatacgctgctataaagaataaatatgtctttatttca

SEQ ID NO: 94817 - DNA, 320 bp, Heterodera glycines
  SCN-specific regions: Sequence locations=1-320
aaatttatttttgagtttcgaatcacttctccgagttcgaaaagtgtacactggaaatggcgcaaatgacgcgtttggcgacgggatggacattgggcactgcccaaactactcgtggctttgtaatgtgtgcatttgattgcaacgacatttggatggacattttcccgcattttgaccgtcctcaaattggcactgatttcgccacgttttgatgcgctggtggacaaacatttcgatggcaaaagcgaattgacattaatgaaaacttcgatttggcatctttcgtcactcgaatgaaataaaaaatttgtggaaaa

SEQ ID NO: 94818 - DNA, 399 bp, Heterodera glycines
  misc_feature (385)..(385): n is a, c, g, or t
  SCN-specific regions: Sequence locations=1-155,177-399
cggttccatgactcggttttggaagcggtaaaaaataaattactgcaaacacgcgaagaagcagacaaagcacacaatgaagtggagcacttaaaaagggagctaatggaggagagagagaaacgcaaattgcctgaccaaaagttaaagtacgctcagaaagaggcagaggaggccaagacggaattggtgttgatccgccagcggatcagtgaggaaagggccgcccgagaaaaagccgaaagggaactgagtgtgctgaagcaaatcttggaagacgatacggcacggagagcccaaaccgacacactgcgcaatttatacccaagaaaataatcgcaaaaacaggaatttgctcctcttgaattcaatgtgtttttattanaaaaaaaccaaaaa

SEQ ID NO: 94819 - DNA, 313 bp, Heterodera glycines
  misc_feature (225)..(225): n is a, c, g, or t
  SCN-specific regions: Sequence locations=1-313
aagagactctaactgctgaacagttgcagaaaatgctgttggatgctgagaaaagcggagaatattcatatgaagaacttcttccaattcgggaggaggcgaagggaatgattgaaaacgaagagcaaatggtttcactgtacacaacgtttatttatatgtcgaggcgcttcgccgaaagggaaaaaagcagtcccgactattcgagaacggaggaaactcttncacgagggttcgaattttcctcgaggaaatgcttcgataagtttttccgaatgccagccattcgaatttgagaaagaatttcgcctat

SEQ ID NO: 94820 - DNA, 397 bp, Heterodera glycines
  SCN-specific regions: Sequence locations=1-75,97-374
ttttactaaaactataaattaaacgcaaatgacaactaattaaaaaaacacaacaataaatcactaatcacaaagattcataaaggcaatgaaagatgaagaggaatatcaaaacaatcgtgttcggcctttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagagtattgttgaaaatattaattttgttgcgttgttaaaaattagtatatgttaaaaaaaaaaaaaaaaaaaaaaa

SEQ ID NO: 94821 - DNA, 179 bp, Heterodera glycines
  SCN-specific regions: Sequence locations=1-78,102-153
gtgataacaaaatatataatcgcgataatgaaaaggatgacaacaaatcggcagaagagacagagacagaagtggtgaaataacaacaacaacaacaacaattttctaattttttttttaattacacatgatattattccatggctgaattgatcctcaatgaatgaatgaatgaaaaa

SEQ ID NO: 94822 - DNA, 576 bp, Heterodera glycines
  SCN-specific regions: Sequence locations=1-540,562-576
gtttttattcgctttttaatttgggcacattttgcctatcgaccactcgccgaccccgacccgacgaataaactttggactagcgtgttcgaaacatgaataccatcatcatcgtctttctgattccaatttgctgcatttttctggcaaatttttcccaatttgtgcatgctgcttcaaagaatgtgtgcttcggatatgatcaccagttccaagttgaagcatattatgggcatgttatgaagcacatttttgatacaagagaatgccaagtcagcgggaaacaatgtgtggaaattaacccacgaaaatggactggattggctcccaatgaggaaatttctttccgacttagaaatggaacggaagttggtagagccattgtagcagaattaactgattgttcggtggtgttgatgatgaaaaagagaatatatttctcgtgggatatacaaactctacatatatctgctttcctctcctcagcaatcttctataatgatcaaactgaaacagaaaatttaaatggttggacctacaaacaatacttggagattggtcccaatatgtgggtag

SEQ ID NO: 94823 - DNA, 334 bp, Heterodera glycines
  SCN-specific regions: Sequence locations=1-60,82-161,183-196,235-334
attttttctttgtgtctctgagcaacaaaatggcaaaaaaaacgaagtcgtaaagatataaatgttctttaaaagatatttatttaagatatttgattgtaaggctcgcgagtgttatttcgggcactaaacaaatttgggttagggagagagcagcagccgaagcggcggccattctttacgacccggcgattggcaaaaatgtgctgttcaaagaagttgagcaggtgaaaggaaaggattcttttcccgacagagtgaagaaaatgtacaatatcagttgatcgaatttcaaatgcaaatggatttgataaatttgtccgtttttgaaaaa

SEQ ID NO: 94824 - DNA, 447 bp, Heterodera glycines
  SCN-specific regions: Sequence locations=1-314,337-393,415-419
gggatttggacgaattggaaacgtcaattgatcaatttcgaacattcctcaacgatcagccgcggatgcgcactttgctagccttaaagccagaggtccacttgctgttgaaccattttgtgccgttcgccagacaacaccaatttttggcacttttagacgagcagggtgatgaagcattgcattcggtgtggaggcgattggaacagctgtggaagacaatgcctgatgaagaacaaatgcgacaattgttggaacaccattttgtgtcaaattggcttctcgacacaggaaaaatcgacgaaatgaagcggaacaaaaacaagaaattggtgaccgacgtgagacggacgaagaaagcgatggagaagaacaattcgattttgaataaacacagttggatatgaggttcttctttgtttttacaggaaataaaattttaaaaaa

SEQ ID NO: 94825 - DNA, 215 bp, Heterodera glycines
  SCN-specific regions: Sequence locations=1-215
cagcaaaaaaaagccaaatcactgattttacatgcacattccttcagcaagtgctggagacaacagcagaacaacttcctttgccaataagagcacatttgtcaaatatgctttacccggatactaaaataatcaaaagtcaaattccgaataaattgtgcagtgtttgtggctttgacttattaaagggattggttgtggttgcacaaaaaaaa

SEQ ID NO: 94826 - DNA, 611 bp, Heterodera glycines
  SCN-specific regions: Sequence locations=1-129,151-425,447-449,471-611
tcgtttcattttcgctgttactttttgggttattcacaattcgcactgcaaaatcgcaatgcgagaaacattgcactaaaagcaaaccgatgggccaatgcaatgaggcggaagaagtgattctgcgcaactccgactgtgccttcatgaagaaaacggaaacggcattcgaatttgtggtcggaatgaatggccaaacggaggacaaaacggcgcccggggccaatgccaatggggcatttttgtgctgtaaggcaacccaaggaaccgcaacacttttcatcgtcggcgtggccaacaaacggctgatgttggccaaggacgtggtcaattacaaatttcataacaacatctcaatcgatgattttgtacgggaaaagcaagtgttggaaagtgtttcggcgcagggacaaaaagccggcattggggacaattatggagaaaaattcttccaggaccaaatggacgccaacaaaatgattcagaaaggctatgtgaagctgtgggccgccaacaaatcgttgcttcctcaaaatgtgccggatttacagaaagatacccggcctaaagtgacggcggcgacagaagaaatgattttggcactgaaagtg

SEQ ID NO: 94827 - DNA, 212 bp, Heterodera glycines
  SCN-specific regions: Sequence locations=1-78,103-162,185-186
gtcgtctaattcagtaaatacgcagcgaagagagcacaaacggcgcaatgatcagccaatcgccggcagtctcctggacggaagtgaacacacgcgcaacacaaccgccgaattgcatggagacggagatctatatgttatgttctcaataaattgacataaattggaaagaaaagaattttcttcaaaaaaaaaaaaaaaaaaaaaaaaaa

SEQ ID NO: 94828 - DNA, 529 bp, Heterodera glycines
  SCN-specific regions: Sequence locations=1-529
aaaaattcatcgggtgttggtcgtcgactgaacgatctccacgtttccatcttcaatttgttgcagcaatgggacaaagagaaccagaattgttgtgaacttttggaaagcatatgccaatgccgaattcaaatgatggaccgtatgaaagcgaacggaaaggctgacaatgaagcggatttacatcggcaaatgttcatcactgatgtcattcttcgtaattctgagcttctctgcacatcaattgcaaaattcgattcatttttgcttcgtctacgtaaatttggaccaaaattagccgctctgagtgatctcatctcatccacttcatctaacgacacttctacatcaccggatgaccctcatcaattgctacaattcagagccaaggaactgctcgacctttttcccattgttctggagatgtacgaacaggaactgtcatttaagcgggactcagtggttgatttggcagctctcgatgataaggatcttttcacggcgattatttcggcatggaaacatggca

SEQ ID NO: 94829 - DNA, 221 bp, Heterodera glycines
  SCN-specific regions: Sequence locations=1-81,103-118,151-221
cagggcctttgccgatttcatcttcgcccatgtaattctccatttggtggtcgtcaactttatcggataaaccaatgtgaaaggatgggaatataaaagtcattctaaatttaactgaccgtttattcgtttttctgttaatttattttcgtttaataatgttttgcataaatgggtttcgttgaaaaaaaaaaaaaaaaaactcgagactagttctctct

SEQ ID NO: 94830 - DNA, 328 bp, Heterodera glycines
  SCN-specific regions: Sequence locations=1-328
tgtgcaaaaacattgaacttgttaaagaacaacagaaacgacaatctgttgctgatgatgatgttgaaaaacaatgattgagtggccttattaatcaaatgatgcatgatgatgagcgagggattttgacttttatctgatccagtttttttatcgataattcattcattatctcatcaggaaaatgatggcctaatttttcccgatcatccccccgggtatattccattcttttttttgaacacacacttttatttatacactcacttgctatttatattttttcattcttcagaaaaaaaagtttaataaagtgatttgattaaaa

SEQ ID NO: 94831 - DNA, 416 bp, Heterodera glycines
  SCN-specific regions: Sequence locations=1-416
gatcgttcgtgattggaaacccgacgtggtttatttggtccaattcccacgcacccataatgtgctcagtccatccccatttgcactcaaattggagacatggcttcgcatcaatgggcttaaataccgcaatgtgaacaacgaattcacaaaggcgtcggccaaaggtcaaattccgttcattgagctgaacgggcgccaatttgccgactccaatctgatcattgatcatttgcgcaaccatttcaaagtttccatcgattcgcgcctcagcacgcacgaaccgcgcgttgggtcgcgcattcactattctgatcgaagaatcgctttttcggtgccttcagtacgaccatagcattgactttgggtggttggccaccgaaaatggttgggccgttcacatgagcggattcaaa

SEQ ID NO: 94832 - DNA, 317 bp, Heterodera glycines
  SCN-specific regions: Sequence locations=1-28,50-177,199-317
ttgttaattcgttgagttcagctcttagtttgttaaaaatggtgaactttaccgttgatgaaattcgtgcccttatggatcggaaaaaaaacatccgaaatatgtcggtcattgcccacgttgaccatggcaaatcgacacttaccgactcgctggtgtccaaagctggcattatcgctggtgcaaaggctggtgagacgcgcttcactggtcaagtggtcactgagacgcgagaacgaaagggattgaaggagggcattccatcgcttgacaatttctatgacaaattgtaatacgtggatttaaattatggtggt

SEQ ID NO: 94833 - DNA, 455 bp, Heterodera glycines
  SCN-specific regions: Sequence locations=1-146,168-455
aattggttaaacccttccccattttgcgctcacctccaaatcctcgcctatcgtcggctcgtccccctcgtggaccatcttcagtttcttccgttcttccaagttgcgctttgccttcaacagttttctctttcgtcttaagcaaaaccaatattctttttattttatgatattcgaaattgactcatcactttttcagcgttgccttttcttcggcttttgctgttctgatcagatcgtcgatctcttccaactctttgaattcagtattttcctccaactcctcgccagtatcaccctccaccatttcttcagccgattttacactttctttagacgctttttcctcctttttctgttcgtcaaccaatttcttacgccattttaaaatgcttcccagttcggcaggtccacaaacctaaacgggtttttttctgttagtgttcactatattt

SEQ ID NO: 94834 - DNA, 440 bp, Heterodera glycines
  SCN-specific regions: Sequence locations=1-440
atctcttactcctgtattattcgatcttcatctactcattttgtacctcgtgctgcagtgtaagtggcctatgcccttctgtgatttaatacagacaaaaaaacgctcacgttcagctagtgcataaatttgaccaaaaatgagcaacccaattaaaattgtgcgtgttcttgagattattgaagcagacgaagctgctggccaacctaagaaagtccgggctgtgtgtgtggacgatccaaacagagaagttatcatgaaagcaagcggagaggtccaaattgaccaacttgttggtttctttgatggcccggacaaaagacacattcagcgatgcttcacgaacaacaacaactgatttgaaggatttgataaaaataaatttgaaaaacgtatgtcatcctttttgaaagcgcaataaaaaaagcacatttctaaaa

SEQ ID NO: 94835 - DNA, 264 bp, Heterodera glycines
  SCN-specific regions: Sequence locations=1-264
taatcgccgcgaacgtggacaacgttatcaaatttgcgacctgggacatgttttacgaagcgcgtcgcattttgatggcggacctggaaatcgtctctacaaccgtggttacgttttggtcagatgactcgcttaaattgaagacgcagccgtatcagttcttcgagttttaaaggatgatccattgttcattcatcattttttgttgcaaataaagacttattacaaaaaaaaaaaaaaaaaaactcgagactagttctctct

SEQ ID NO: 94836 - DNA, 589 bp, Heterodera glycines
  SCN-specific regions: Sequence locations=1-547,569-589
gctccccagtctctctctctctctctgatcaaatgcattgtgtccgaggcaaaaagtgcaaatccgtgccggggatgggtccgttggccgtccgttcgtccgccattcccttggccacgctttgtttgctcagtgttctctttttggaccaaatgcttggcacaacggcgctccgatgctatcagacccaaagcactctgatgcaacccgtccaagggtcgcccaccgactgtcccatgatgggattgtcctgcattaaatcggtggattacagccaaggattggtcacacgcgcttgtcagtccaataattgtaccatgatgagtgggtacagttgtcagaacacttcctcctacccgcctcagacgttttgttgctgttacggcgacggatgcaattcgtctctgcgcctttcgtcgtttggcacttttccgctgcttttgggcagcgtactcagcgcaactttggcctttggaggcgccaaatggctgaaaacattcattggcatgtgaaggaaaggaaatgggcaaaagcaaggacaattagcaaaaaacagagtaaatttttgactttttttggaaaaaatcaa

SEQ ID NO: 94837 - DNA, 161 bp, Heterodera glycines
  SCN-specific regions: Sequence locations=1-73,95-161
taataataattaaactcatttttgttcatgagcatgcggcttcagcagatgaattattacttaaaccatacaagaaaatttcggcaggagaaacttcgcatgaaaattaccatacagcaaaggtaaaaaaaaaaaaaaaaaactcgagactagttctctct

SEQ ID NO: 94838 - DNA, 285 bp, Heterodera glycines
  SCN-specific regions: Sequence locations=1-285
tggttctattgaatttttttagtccaatcaagtgacaatacctgtttttttatacagaatgtccacacgggaattcagcagcagcagcatccgaatgtccagcctggaacaaaatcagtttcgtacaaccccggtgagaggtcggagagaatgagcagttctggaagtggaacgacctgagaggaggcgaatagaaaatgcaattaggttatgatggcatcattgttggatttttgtttatttctgtaatgtatggtttccgataaaaatcttgacagtgaaaaa

SEQ ID NO: 94839 - DNA, 384 bp, Heterodera glycines
  SCN-specific regions: Sequence locations=1-338,375-384
atgagcgacagttcaattcggagacttagcattctgagcattttgccaactgatatgagtcgtagccaccaccacaaaggcgcgaaaatggatggaagaattgtggttttgaagtgtgtcaacctgcttcagcaggttgtgatcgacggaagagcgagaactgtgcaatgaaacagtctcctttaactcatttatgattaaaatttgggcagtgcgacggacgctaaatgatcgcctttcactcacgaaagatgattttgagctttgaaaacttgagtttaccattggcactttttacagtaagccgattattttccttttattacagtaaccgagtgattaaattattttataatatgattaaaacattttaaccaaaaaaaa

SEQ ID NO: 94840 - DNA, 351 bp, Heterodera glycines
  SCN-specific regions: Sequence locations=1-267,290-351
aaaatgctttcattgtacacgatgctcgagttttccctgttggtgctgaacggcattgcaattataaaccgtgaacgagttctgaacaagtatttgaagaatcggcagcacagtttcggagcagaaagtgaacaatcggttgtattcaggctcgtcaatttaatttttgcagttcaaactgttcttagagtgcctctcatcgtcatgaatattattgttatcatcataaagctgttgtttggatgaaaatatgccttggccataatcatatatttatttgcagtttattcgttcgttccttcggttgtcattaaattttttcttgttactgactgataatcttaaaaaaaa

SEQ ID NO: 94841 - DNA, 386 bp, Heterodera glycines
  SCN-specific regions: Sequence locations=1-274,298-350,372-386
ttccgataatttgcattttgttgttggttgaaactctgatgcttccatcattgatgggagctccagttgtaattcgtgaaaaacgcactgtgaccggcaaagagttggccaaaggtgccgccatcggagcggccgcgggcgttgccgtcacaatggcggcggccggcatcaaaaaagctttggaccatcgtgccgagcaaaaagcggccaaagaaaaggcgaaaaatgagggccagatccaataaagaaaaaaaattggaaaatgaatgaattaatgatgatgatgatgatgatgatacatcacaatggaaattatggaatgaatatcttaatatgtttagtctttacggaaagaaaatgaataaaagttttacttgaaaaaaaaa

SEQ ID NO: 94842 - DNA, 411 bp, Heterodera glycines
  SCN-specific regions: Sequence locations=1-72,106-411
caagccttcgcattcctttcctctcccaacctccctttttcttttcctcctccttttttattcgttccctaatctctatctctctctctctctctttctctctctgatgcaaaagcattggcatttttattaattaagtataaccgaattaattgattaatattaatttacgattaatcgggtttgtgtgaattggtgattaatccgttccgttgccattgctctctttccccgtttgtccatgcttttgctcaatcctttcgcgccattttcccttcggcgctatcaaatttcaaagacagcaaaggaaaagaggcattttaccaaccaaaataactctgtgtccaattgacactctttcgccccctctcccctcactgtcccttaaataaatttcaaacactacaaaaa

SEQ ID NO: 94843 - DNA, 566 bp, Heterodera glycines
  misc_feature (268)..(268): n is a, c, g, or t
  SCN-specific regions: Sequence locations=1-566
gtggcaaaaatttcaagagacgaactgcttgagtttgtacgaaatgaagtgacatgtacaatcggaagtgcggatgcaccagtggctattcccgttcttattactacgtttagagaggacactaatgaagacatcctccagctggccaaaaagttgggttatccttcaattgaggcaatgttagactcggtggaattgtccgacattgttgagccgtgttttactgaccttgccaagggggccggaaatgaaaacccgaaaaaagttnttagttacaggattaagaacattccaatggttacgcatatcctctccagcatcgaagaatcagcacaacatagggacaaaaaggcggaggaacagcgccacttcgagattctcatcggcgatccgaagtataatccgaaaattttagcgggaaaagaacaattgctttctctgatttataatttgggtggccaggaacgcttcgtggacttgttagaactacgaaaattgtatgaacataattatttcaaggaattaaacaaagcggcactgaaagagtttttcccaacgggacagtt

SEQ ID NO: 94844 - DNA, 429 bp, Heterodera glycines
  SCN-specific regions: Sequence locations=1-429
cgtgcgcctatgaaataattaatggctttctcatctgctgcttctaccttttctatgccgtctttcgcgcgtctgttggcattttgccaagcgacaacagagacttaaggaataataaatttgctttttttcctttcgtctcctaaggcaacactaaatgagggcgacgaatggccgtcttggtaaccttgtccggtctccgctggcgcggaataaatatctgaataatggtgaagcaaaaatgcaacgccggcatagcagtgcgggtgaagaaatgccacgggctgtccagtttgatgagtcgtcggatcagtaccggtgtttgtgcggctgtttccatgttaaaactggcacttacctaatcgcaagtaatctgaaaatggcaccaaatttggttcccgaaaaaaaatttattcctgtctactcaaa

SEQ ID NO: 94845 - DNA, 539 bp, Heterodera glycines
  misc_feature (524)..(524): n is a, c, g, or t
  SCN-specific regions: Sequence locations=1-125,151-166,190-539
gcggacttacaaagaggagaactctttcgacaagcgccgcgcggaaggcgaaaagattcgccgaaagtacccggaccgaattcctgtgatcgtggagaagtcgccgaactcgcgtctgcgcgatttggacaagaagaagtatttggtgccagcggaactgaccatcggccagttttacttcctcatccgcaaaaggatccatcttcgccccgaagaatcgctctttttctttatcaacagcgttatcccccagacaatgacaaccatgggacagctctaccaggaccgccacgaggaggacttgttcatgtacatcgcttacagcgaggagaacgtttacggctgatcgtgagttgggtggtggagtgctactaatgcccatcgacatgcattgtgcatgtggccaacggattcacgttgaaatgctatgggaatagcgtctgcctttctcatccctttcattcatatttgtcaagtaatttgtgtgatcacgcatcgatgatgattatataaaatcgcttttntctgaaaaaaaaaaa

SEQ ID NO: 94846 - DNA, 208 bp, Heterodera glycines
  SCN-specific regions: Sequence locations=1-111,134-185
acggggtaaaatgcgcaatttgcgtcaaaatatcattgaacacttcactagtcaacccgttcaaagagtgtagtcaaatgctaccgttatgttgcgtgtttttagtcgatgaactttgaggatgggtcttcttattcttatttgtgtgttttctacccttccttttatttaaaggttcaaagattaaaaaaaaaaaaaaaaaaaaaaa

SEQ ID NO: 94847 - DNA, 324 bp, Heterodera glycines
  misc_feature (270)..(270): n is a, c, g, or t
  SCN-specific regions: Sequence locations=1-324
tcagttaaaaccgactgaagcatttctaactattggccttactattcgtactcgcccttctaccgacacagccaaacttttgaccagtacaaatacggcctgatgaatgattggtactttaaaacaccgtaccactgtcaaagctaccgtaactcggcctccaattacttcagcccatatttgtggcgttatgagaacagtctgttccctaactgaggacactgacagagagatatttgctgctgatgaacaatttttgcctgaagtatntaaaattgactaatagagatacaaattgaattcattaaatatacaaataaaaaa

SEQ ID NO: 94848 - DNA, 351 bp, Heterodera glycines
  SCN-specific regions: Sequence locations=1-351
tttcaaaagcccgttgtgccaatatgtgaaaaagatgtgccgccaacagacaaaattgtcgtggacagactaacaatccataaatcgtgcttcaaatgtgctatttgtgacaagccactgcaacagggttcatgcaatttggagcgcgggttggcccgttatggcactttttggctgtgccgggaacacagcctgattccgcctggtgagaaggaggatctgatcgttaagaaaggctaccaagtgaaaaccaagaagaagtgatcggaagataaatgtgatcattggtggcctattgctcagcgattgatcatcgattgcattacaatagaaataaatgcatgcaaaaaa

SEQ ID NO: 94849 - DNA, 477 bp, Heterodera glycines
  misc_feature (273)..(273): n is a, c, g, or t
  SCN-specific regions: Sequence locations=1-477
atcttttgttaaattttgtttttctcgtcctttttcacttggaaatacaaggaacgttactacgcactttggttttacaaaaattgatgtagcagacaagcaggaaaaggttcgtactgtttttgcgaatgtggctacaaaatacgacctgatgaacgatgctatgagcttaggaattcatcggttgtggaaggaatattttgtgcagcagctgaacttatcaaaagactcaacggtgttggatatggcaggccgtacgggcgatgtggcgtncgaattgtacaagaaatgcgcagacaaccgatcggcaagggatcaatcactggtgccgatatcaatgataatatgctggaaacaggaaagactcgagccaccagagcactctccccatctgaccgagcccgactttcatgggtccgtgctgatgcggaaaatttgcaatttgaacacaacacttacgacttctacacgatttca

SEQ ID NO: 94850 - DNA, 260 bp, Heterodera glycines
  SCN-specific regions: Sequence locations=1-136,179-260
tacgaagagaaactcaaaaaattcgaggaactcaaaaaaatcgctgcggatttggaagtgctcgatcaaaagcttgatctttggaaatatgccagtcgttccttggcggatttgcagcgcgcacgcaaagctgacgagcagaaacaaaaagaaaaagtgctcactgttcttttttatggctatttagttatcgctctttccattattgcctattctgttattcgtgtgatcaccatgtagaaatttgaaaagtttgtaaa

SEQ ID NO: 94851 - DNA, 517 bp, Heterodera glycines
  SCN-specific regions: Sequence locations=1-186,208-517
acactacggtggcagtgctaagcccgagcatttatctggtctttatcataaaactgttgtacgacatacaaataaatcgcagacagctgagtgctgttgtcaccgaattgagcgctgtgcagagaaagacctttttgcaagtgtttttgatctcgtcgatcaacacaatgactggttcaatttgtttgtacatgcaatacaatgaagcaagtcaatggatgatcactcttgccgaatttgcttggtttcacgtccacggctttccaccggtcatttatttgacgctgaataaaactgtgcgccaagattgccttaaactgtacatgaaactgttcaaccgtaaccgggtcagccacattggcggtgttacggtacttcgaccaaatcgcccacaaccacaacaacgacagaaccatctgagcactgaatcgcctggctatacataaaattccaaagtttgaagtttgaaatgcattggacaaaattttcgccggacgaatttttgaacgattctaaa

SEQ ID NO: 94852 - DNA, 572 bp, Heterodera glycines
  SCN-specific regions: Sequence locations=1-119,142-572
ggattttcgacaaagccaataattattgacggaaaagatcatttgcttggacgtttggccgctgtcacttcgaaacagcttttgcttggccagaaaattgttattgtgcgatgcgaatccatcaacatttctggcaacttccaccgttccaagctcaaattcctcgcatttttgcgcaaacgctgcaatgtgaagccatctcgcggacccttccactaccgtgcaccatctcggattttctggcgcacggtttcttttcatatttaggctaggctaagcgtaggcttgtttgggcctaggcttaggcacaggctttgtaaaaaaaaattttattgcacgagttgccattgactcctccggtaaaatatgatagaaaccaagtaaattttgaatcttattcatttaggttcgtggaatgcttccgcataaaaccgcacgaggtatggaagcactgaaaaagttgaaatgttttgacggatgcccgcagccgtatgacacaaagaagaaattcgtacttcccaattctcttcgccacatcgcattgaaaccgcgacgcaaatattgcacagtcg

SEQ ID NO: 94853 - DNA, 526 bp, Heterodera glycines
  SCN-specific regions: Sequence locations=1-392,414-473,502-526
attcgaatgtcaaccatcccaatgccaccaccaccaacacaagacgaaaaggaccaacaaaagaaatcccaatggaaaccgctggagataggaaatcggatgcgcacgacctcagaagattcggccgagtcttttgacgcctatggaccggagtgggaagggaagggacggggaattgggaacagaagggaattcagttcgccatatatgaccagttcggggagacgaatgagcatctcatagcgctaagatggacgtgcactgccccaggagcgaagaatctcattgggagaggaacaaatggggcaggagaagccgaaaagcatcgtggagaacaaagacttgtgagaattaatgaagggtcagcgaaagattttgggcgatgatgagtggcactgaatgaaggcaaaggaaaagaagccattggaggaaaactaagtcggaatggatcaaagggttgaaaagggaatgacaatttatttatttgtatattttatttcacacttcttctgatttttcaataatg

SEQ ID NO: 94854 - DNA, 232 bp, Heterodera glycines
  SCN-specific regions: Sequence locations=1-232
gctcgccgtatcgccttcacccttttctgtgctcgatggggaccgtgtgccgactgtggacattagccaaaacaccgccgaataccgcgaattgatccccgaggaggtgacctagttctaccacgagctgaccgaggatgacaaaaacgcacttaatgaagtggcagaacgccacgaggaattccggacggaagagcaagcaatggaagcgctgaatgaaaagagtgggaag

SEQ ID NO: 94855 - DNA, 258 bp, Heterodera glycines
  SCN-specific regions: Sequence locations=1-213,240-258
tgtatctgaatgcctaatccgagcactttctttttaagggttcgaatgaagacgggcaatcgaattcgttacaacgcaaaacgtcgtcattggcgcagaaccaaactgaagctgtaagcgcaaatgaacaggcggaagacggcgggcgatgatttgacttgttgctgttgattcatacatttttatggactgttgataaaggaaattgtcatcaaaaaaaaaaaaaaaaaaaaaaaaaactcgagactagttctctct

SEQ ID NO: 94856 - DNA, 211 bp, Heterodera glycines
  misc_feature (23)..(23): n is a, c, g, or t
  SCN-specific regions: Sequence locations=1-211
cattccatatctgagagatccgncggtgaaaaatctgatgaaaagtctgtgcgcttacagttttctgattctgtctgtccctctcggctcaatgtttctgctgaaaaattgcgttttctaatccattttctgttggcattcgcgcgactcaatgctttattcggcaattgttgccgctgtgatggttcacctggtgctgttcgtttggata

SEQ ID NO: 94857 - DNA, 358 bp, Heterodera glycines
  SCN-specific regions: Sequence locations=1-358
gaccaattgctgtcggagacggatgtccacctggacactctgttggcaccgccgctggggcgtggcctcttttacatgtccaaatttacgttggcgcgaaagcgatggaaacaatcgccggcggagaatgaaaaagttttggaccgttttgaagtggctcttcaacatgtgtacagcttcttcttgacctaaagaaactgcgatggcacaatttttaatatgtgatggagagacaacaaattaagagagattttttgtttgatttatatgtgcgactaaggaaaatgactctataaaaatagttcgaaaattgtatcttttttcttttttaaatataatcagtgtgaagaaaaaaaaa

SEQ ID NO: 94858 - DNA, 292 bp, Heterodera glycines
  SCN-specific regions: Sequence locations=1-148,170-292
caattgttgaggaagttcggaggcggaaggatgatcgtcaggcgtgtcatttctgcaattccgtttaagccccatgttgcgacaattgcagttattgcgggtattttcgcgtggatgcacggattcaaagttctgaagaggactgtaaaggaggccttcagcaaagacactttcgtgtaccatcaagaaatggaggattttatccagaaaattagcatagaacaacagaccaaatcaaagaattgttgatttttatattgtaacattataaacgaccgtttcgtttcaaaaa

SEQ ID NO: 94859 - DNA, 382 bp, Heterodera glycines
  SCN-specific regions: Sequence locations=1-382
gggtctggaaaagggtaatggacgcaatggcgttcgtggcgaggaagaagtgaagggaggaaaagaaattgctagcaagacacttaatattcaatcgaagcgtttttatttggacgtcacgcaaaatgatcgtggacgtttcatcaaattggctgaagtagctatgaatggtcgaaagaatcgtttgatcatgtcagtgcgaatgtgcaagaatattaacgaatagtcggggaagattgatgggcacgtgccatccgtcgaggaagtgaatgggaaagcggagaatgtgaccattcaatctgaatctatcgtgaccgatagacgtcgatattacatcgaccttcgcgaaaatcggcgtggttccttttagcggattactcag

SEQ ID NO: 94860 - DNA, 322 bp, Heterodera glycines
  SCN-specific regions: Sequence locations=1-40,62-201,223-322
gatcgaccggttccttcgaaattttttgctcaacgaacaaatcattcgcaagatggccgactctgtgccgatccgatggaccgcacggtttttgatccgatcgctgttcagggctcagtcggccgttcaaaatgcgcaactgcaggcgatgcaaaaagcgaaccgatttttgaacattttgcgtgaggaatatcgaaaagcaattggagagaagtgaaaggacggaaaaactcataggacggaggaagcaattaaacagagaatgtgtgatttgattctatagcaatttcaattggtgatgacgacgcattttccaaaaaaa

SEQ ID NO: 94861 - DNA, 73 bp, Heterodera glycines
  SCN-specific regions: Sequence locations=1-6,28-73
cggcaacaacaaataattaacaaaaaaccaaaacgacaaaaaaaaaaaaaaaaactcgagactagttctctct

SEQ ID NO: 94862 - DNA, 398 bp, Heterodera glycines
  misc_feature (373)..(386): n is a, c, g, or t
  SCN-specific regions: Sequence locations=1-226,249-255,277-355
tttttggctgggtcaattttcttcagtgcgctgacagtttcctgggtcctttgggacaacagaaatcagcagcacaaaaggacttcctccgtgcgctcaattttggcgtcggcacaacggcaaaagaatatggaggaaggagcggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgttaaaaaaaaaaaaaaaaannnnnnnnnnnnnnaaaaaaaaaaaa

SEQ ID NO: 94863 - DNA, 287 bp, Heterodera glycines
  SCN-specific regions: Sequence locations=1-239,262-287
gcgcggaaatcctcaaaaattcttcaaattgccaaaagcgtcgcaattccccgccaaaccctctccgagtcgacgtcatcgaaggccaattgccaaagttgttctctgctgcacaacatgcgcatcttcaggtactgctccacaaggcgcggatcagcgacggtttcgcattggcgctgaacaaaaggaaatgtgcgaatggattggcaaggaaaagaagtgaatgtttgatgcggttattaatttcatttaatttttagctttttgggactgaaaaacggccgatt

SEQ ID NO: 94864 - DNA, 392 bp, Heterodera glycines
  SCN-specific regions: Sequence locations=1-360,382-392
aaaaatgaatcgcttcggaataatttgcattttgttgttggttgaaactctgatgcttccagcagtgatggtgggagctccagttgtaattcgtcaaaaacgcactgtgaccggcaaagagttggccaaaggtgccgccatcggagcggccgcgggcgttgccgccacaatggtggcggccggcatccacaaatctttggaccatcgtgcccagcaaaaagcggctaatgaaaaggcgaataatgacggccagatccagtaaagaaaaaaattggaaaatgaatgaattaatgctgatgatgatgatacatcacaatggaaattatggaatgaatatcttaatatgtttagtctttacggaaagaaaatgaataaaagttttacttgagaaa

SEQ ID NO: 94865 - DNA, 497 bp, Heterodera glycines
  SCN-specific regions: Sequence locations=1-332,354-393,416-497
gatattgtctcattccatttttgcgtcaacgtctaatggtttgtcaaatttttggaatgtgttcaacaccgatgaccaagactgtgatgaatggagtgccgatgctgaggataaagaattcagcaataactatcagtggctccattggggaccgatctccgcaacattactcgttgtttttgctggcttttctacgtcccttgttcatgtcccttggtgggacatttctacaataagcggagctttggtgttcatgctttttcttttatggaactacttagtcttgcggtatttatacttggcctgtctgcttggtccgtaaggataaattataaacatttgtttacattaaattgggcacttctttcgcatactctcgcacacagaaaagcttaaaagccaaaatgttatcagttttctgaataggtatttctggttcttcacaattttccccataacttatacttgtcttctcaagggcgtatctggggggggga

SEQ ID NO: 94866 - DNA, 374 bp, Heterodera glycines
  SCN-specific regions: Sequence locations=1-325,347-347,370-374
tttttctgccttttttggtgccctctgcaacaatcatccaaatttgtggccaaatgtccaaggttcaaaattcggtgccatgagtgttggccgaagtccgatcactgcgtacctttcacggggcaccatcaactgcggcacaaaatatctgatcacattgcgaaaactgaacacatttctcgcataagcccacgaggaaatggaaaagtgcgaaaaattgacggatggaaaaacggatgaggatgaagcacgaaggaaagcagatgccacaatgaaacaatttgaagcgaaaatggaaatgattggcaaaatgttcgtttaagcagtttcttttttgaatgcccattcaacagaaaacatttatttgtaaaaaa

SEQ ID NO: 94867 - DNA, 445 bp, Heterodera glycines
  SCN-specific regions: Sequence locations=1-445
gcaaaaacaaagcggtgaccgtcgttaaaggcctcaccacttgcggtcagtcgcccgggcgaacaaatcgatggacaattacaacaacggttttgatttgacaaaaggtgtcgacttgaaaaccgcctccaaattcttcgcaaatcgtttcgcctgcggctgttccgtcaccgttgactcagccgacgaattggtcattcagggcgactttaaggtgaaagtgtgcagcccttcccacacattgccattttgttgattgaaggacaaactcttcgtagaaatcccgaagaaatggggcgtcgatgaggaagtcattgaggatttggacgaccaaaagaagtgaccactcccctttcacactgcttgtttttactttaatttatatactaattcattgctttgttgtcgtgccgaaaagataaatttgaattcatttaaaaaaaaa

SEQ ID NO: 94868 - DNA, 411 bp, Heterodera glycines
  SCN-specific regions: Sequence locations=1-109,131-182,204-286,308 -341,365-411
aaactttctcctgtaaacatcgactctaaaggcatttttaagtacattctcataaaggtttttttctgtgaagattgaagcaaaatgcgaatttaggcttctgatggcgcaattgaaagatttttggttcgtggttatggtcgttgtaaatttcacgcggatattttggaggaagtgcaggcaagcgaaggagagaaggccattgaattttcttgtgttggcggaggccggataaaacatgagccggaagccaaacgtatcttcgtctacggatattcccaggtgcagaattctcaaaaagatttttatcggttgtttaaggggtttggccgtgctgaccatgcgaaatctgtcgaaatcctgagggaacgttatccaaactacacaatcgaatggtccaacgaaggatat

SEQ ID NO: 94869 - DNA, 377 bp, Heterodera glycines
  misc_feature (274)..(274): n is a, c, g, or t
  SCN-specific regions: Sequence locations=1-341
atattcaaagttgttctcactggaggtccgtgttctggcaagacaacggggcaggctcgccttttaagtttctttgaaagcattgggtggaaggtgtacaccgttcctgagaccgcgtcatttttcctcggtcctggacgcattcgttttcccgacctgagtagtgagcaggctgctcaattccagacagatttgctcaaagcattgatacaaaatgaggatgtctttttcaaccaggccgaattcagtgaagcggaaaaaattatgatcattntagaccggggtaggtaacataaattagaaatttgagtaatactaccgattgtatcacaccttttttgaaaaaaaatttgttttcaaaaaaaaaaaaaaaaaaa

SEQ ID NO: 94870 - DNA, 524 bp, Heterodera glycines
  SCN-specific regions: Sequence locations=1-234,256-369,392-524
gccatctataaatctttggaccaaccttcccgaactcaaattggacaacgaattcagacgaacattcctcgcgacagtggccaattcaatgcaaaagccagtggaatcgacagcactaattgtccagtcgggaccaaactgttgccaaatcggaagtgaccctgccgaaccagcgatgattctgcaagtaaaaagaaaataaaaaaaggggtgaaaagtcactcagcgattttaattgattgtttgttgtttattataagatcaaatcaattggctgtgtcagcgcagatgaaaatgtaattcactgtaagaacatcagcgaattcgtccaaagtcgccttgggattccgcccgaccgcgtgatgattcactttcagtctttggagaagcacgaagtcgggaaaggaggaacgacggtggaaaagatgtgccagtaaattaaagaaggaaatggatggcatgttcaatcaccgacttagcaatgttaagaaatggagttaaaagcaaaacatttataattggaa

SEQ ID NO: 94871 - DNA, 325 bp, Heterodera glycines
  SCN-specific regions: Sequence locations=1-234,257-325
gaaacaattcaatgccattcggctgatgaaaagtcaatgaattcactttaattattgaccccctgttgcattgtttttatggacacacaaatcggaaaacaacaaatggcaaatggccgaaatcggacccaccgatgcgacgtgcacttcgccactgtacggactctccacgacggacggcacgccaagttcagtcaacgacagctgaacagaatcaacacattggcaaacagttgaaagaatgaatgagcaaatggcaatgttaaaaatggcaattaattaaaaatattaatgcgtccgtttataattaattcatccgcaaaaa

SEQ ID NO: 94872 - DNA, 346 bp, Heterodera glycines
  SCN-specific regions: Sequence locations=1-346
tccaactgtcttccgcttcatcaacacaatttgatatgagataagtcaatcgatgcagacattgcacgatgcgtcgctggtgaagtccctcctcaaaaaacgcgcaaatatcgtgccgtcgatgcgagaattctcgactcttacagggttacaataccatcaacaacatcaaccctgcttaccaaaatgatcaaaattaccatacaatgttaatcctgataatatcttcaattttctcgttgaatttctcaaaaattatgaaatacgcccgtagtcattcttcaatgttttgttattttttcgttgaaaacacactgataaatatgttatggtgttaaaaaaaaaa

SEQ ID NO: 94873 - DNA, 684 bp, Heterodera glycines
  SCN-specific regions: Sequence locations=1-439,511-521,682-684
tgtccttgtcggtggcaagtcttgttgcattgctcgttttacttgccatctccagctatccaacctttgccagtcctatttcttcaagagacttaaatgatgctgctgaagcaggtccactccaagcagttgaaaagcgtcggaatgcagaattcataaatggcttactgacaatggagcgtctgaatgcgatgggcaaaaggtctccagtcccagcatcatcagatgatggagtcgggccgatgacactctggcgtaaacagcacccggacttatggacatggtgagagccaaggatgaagcaaatcgggggattatgggtcggcttaaaaaacaagtataaggtgaatgacgcatcatggaagttgggaatagataatgcgggggcgagagtgaaggggacggagattggggagagaagtgtggacatgtatgtgttggggacggagaggaggaaggagagagcggagaggaagagtggagtagggagaggcggagagagaggggaggtgcggagagtggagagaggtggagagagtagagagggagagagagaggtggagagtggagagtgagagagaagagtgagaaggagtggatggaggagaggagagagaggtgggggagagagaggtgagagagggagagggagagtgagagagagaagagtgagcgagagaggta

SEQ ID NO: 94874 - DNA, 2032 bp, Heterodera glycines
  SCN-specific regions: Sequence locations=1-177,199-439,473-495,517 -729,787-1081,1104-1144,1167-1571,1594-1634,1657-1951,2009-2032
tcaaaaaagctttatcctcgtgctatccttttttatttgctgatcttttgcaatttcggatagtgatcactgatcgcttctcatcgaaggagggaacaaatggcagttttttggggacgaaatttggatgaattggggaaactacaaaaaataagaacaataaggacaccggaaagtggggagaggggcggggcggggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatggataggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatggatgtaactccaatggcgcaatgtgcattcgaatgttttgtgttcaaggtttctgcagttcgcactaattatcgcagttggctgcgttcttcatcgatccacgagccgagtgatccaccgataagactagaattcattcttcaacagaagtgtaaaaaaataataatgaaaaaaaaagaaaaagctgggcggtgcccgagctgacactcattgagtcttaagccacgtgctaggccaagcacgggccctaccacgtcgtctcatcacggccacggacgtagcagcaagcacaaacacaccgctagttacggcacgtaagaccgggaacgaaaccaccatccccagtcagtgtgttatgtgcctgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactggga

SEQ ID NO: 94875 - DNA, 817 bp, Heterodera glycines
  SCN-specific regions: Sequence locations=1-15,37-217,239-817
atgagtcgaaatcgtctcccaccagaacttttactcgaaattgtcctctgcgttcgcaggggacacaacacgcctaacatttgtttctcttctcgcattttacgaactttcatggagcctcgagttgcgctgtggcggagagtttggatttctatgttacgcaaactatctgacgcttatttaaaggcacttttgacgtctatttggaactatgtgcccctggatgaaaattgccaaatgttttttggaacacttaacggagtttttcgtcaattggaagacagagaaattgctgccaattgtttgatcagtggtcgcggcggcatcaaagggcaaattcggctcgcacagggcgcggagaaagtactttctgtcagtgggcaaattcacagcccttccatcgagcctgacagaatggaagtacatgacctggggaacgtcaccgctggtagttcttctaccggtcggtctttacacacgttgtgtacttttgcctcggttggtgctgccaatgattacgttcccgctggtgttgtcacggctccgttggctctcagcggttcaaaaatcaattgcatcggtcgttctcttgtcgtttttcaagaagggcgttccgcattgggaagtggcgtaatcggttacgcgaaggacacgcgcattttctcggacgagtttgacgaaatctttcgtaatttgattacacagtacagaaatgtgaacgtctcagattgttggcttgttctcagagacggcacaagttcaaatccagattgtcgcgcgttcttcgacatgttggatgagattttggcgacggaag

SEQ ID NO: 94876 - DNA, 644 bp, Heterodera glycines
  SCN-specific regions: Sequence locations=1-644
agtttgagatgttacgcaaactatctgacgcgtaccaaaaggcacttttgacgcctatttggaacttagttcaacaaatacttgatgaaaattgtcgtgtgttttttggaacacttaacggagtttttcgtcaattggaagacagagaaattgctgccaattgtttgatcagtggtcgcggcggcatcaaagggcaaattcggctcgcacagggcgcggagaaagtactttctgtcagtgggcaaattcacagcccttccatcgagcctgacagaatggaagtacatgacctggggaacgtcaccgctggtagttcttctaccggtcggtctttacacacgttgtgtacttttgcctcggttggtgctgccaatgattacgttcccgctggtgttgtcacggctccgttggctctcagcggttcaaaaatcaattgcatcggtcgttctcttgtcgtttttcaagaagggcgttccgcattgggaagtggcgtaatcggttacgcgaaggacacgcgcattttctcggacgagtttgacgaaatctttcgtaatttgattacacagtacagaaatgtgaacgtctcagattgttggcttgttctcagagacggcacaagttcaaatccagattgtcgcgcgttc

SEQ ID NO: 94877 - DNA, 476 bp, Heterodera glycines
  SCN-specific regions: Sequence locations=1-156,184-401,423-476
gtgcatcgatgcaaaaaatttacgaaagaccggaaaaatacaatggtggaggacgcgtcgcgacaattccattttctaacggagctttgccaacaaatcacagtttgtattctttgcctgttcggtatccgaagggcctttgcggcttggccaatttgggcaacacctgcttcatgaacagtgccttacaatgcctaagcaatattccggaattggctacttttttcatcaacggagaatattccgaacaaataaatacccaaaatcctctgggcacccaaggcaaattggcacaagaattcgctgaacttctcaagaatatgtggtcaggcagatattgcacctttagaccgtttcgactcaaatgcgttgtcggaatgttcgcgacccgtttcaacggatttgcccagcaggattcacacgaatttattgcatttcttttggatggccttcacgaggacttaaatcggcggatt

SEQ ID NO: 94878 - DNA, 1188 bp, Heterodera glycines
  SCN-specific regions: Sequence locations=1-9,32-1062,1093-1188
ctccgtttcctttccaatgggccatttctttcccggcaccgtttccttcccaatttttctctttatgctcgggtccgctcgttgctggtggcattttggtgccaaacagcctcgggtgttcgcctcttcccatgcccaattgaccccgcccgaagggatcgaatcggccgacctccgaatgcccggagtcagtcctcaaatgaatgagtcgtatttgtgcagtgcgttccctttggactccgagagggaccattttatcgtgggtttcgagccggtgctctcttcacggcacattcaccacgtcattgtctacggatgcgaaatgcccggcagcgaagacaaagcgtgggattgcggggagatggcctcgccccggggcagctacagccattcgcccgtctgtgcctcccaaccggacattgtctacgcttgggcccacaatgcccccgagttgcttctccccgatggggtcgcttttcgcgttggcggttcttccgcggttcaattcctcgtccttcaagttcattatatgcgcgcggaggaggatgacacttccggcattcgaatcattcacacggatcggccacagccgcggcaggcggcgacgcttcttttggccactgacggacgaattgggccgaaaaggaaagaacaattggaagtcgcatgcgtcgtcgatgagtcggtggtgctccatccgttcgcctttcgcgtgcacacccatcgccacgggcgaaaagtcggcggatgggcggtgcgcgaagaaccaaagagtgggacggacaaatggacacttttgggacagagggacccgcagctgccccaaatgctccaactggtagccaaccaatcggtgaccatcacccaaggcgacgtattggcggcacgatgttcgatggaaaacgaagagaagcgggaaataaaaatcggaccgacgggggaagacgaaatgtgcaacttttatttgatgtattggaccaaaaatggacagactctcgagcaggatatgtgtttctcacccggcccacccatttaccgatggacgaaaagtgccggactgaaccacaccccaaaaaggaaatgaaagaatcaatgggagcgcactgcgcagatggggaggacgaacccattaaattatgcatcatcatcggttgatatatgtacaacaaagaaattcacatgttaaaa

SEQ ID NO: 94879 - DNA, 442 bp, Heterodera glycines
  SCN-specific regions: Sequence locations=1-1,23-276,298-377,399-442
gttattaaaattgttgtttttcaaaaaggatactaaaactgggataacccattcagagactagtcaaaaaaaaaataataggcttggactaccatactaattagaatttttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaattgttgtttttcaaaaaggatactaaaactgggataaccccattcagagacaagtc

SEQ ID NO: 94880 - DNA, 652 bp, Heterodera glycines
  SCN-specific regions: Sequence locations=1-460,483-506,541-652
caacaacaaaaaaattatgtctggtaaagtgcattagtacccgcttccttttggtttctaattcgccaacactcggaggaatgccaaagaaaagaccttctcttgcgcttcttcggagaggtgcgagtgttgtcccttcccccgagattcactcggcttcgtcgagtctcgaaagtgctttctctttccaccaacaaaacgtaaggacagcctttctgttcggcaaaaacaatgtcctcgcattttctggcgacagagaagcccctggttatttgtcgcttcatcatgaccaaaatcggatgcttattctcaaatggattccgaattcgcttctcctttcgaaacccgggggttcaacaacaaatgctgtcaaaagtccaagtcactcatcgcattgtgtgccggtgtcgattaaattcgagaccgtttcacatttgcacttgcataaaaatgagggcactctttcatcttcaattgtccttatcgattctgatggtgttcaacagttttgcttttcgttctctcttgagcaacattgtttctcctttctgaagacgttggaaggcgcacttttcccacttttcaaaatcgaccccccattaaattccattaaaatcgaatgcggtgccacaggtcgtccactaatgggaat

SEQ ID NO: 94881 - DNA, 1013 bp, Heterodera glycines
  SCN-specific regions: Sequence locations=1-302,324-353,375-456,478 -748,770-1013
cgaacattaaaatagggctaaacgagcacaaatgaacagtgagtgatttgaaattgtccaatcgaataaacaataagtgacgacattgaaaaaatcgatcactgctcattttgttccttgtttaatcaatcgatcattcgtccaacaaaaacccaattagggaagtgataatagcaaattgattgggcttcactcaattccctccctactgctgatccatcctaaaaatttggacggattgtctttttttaaacggccaacagtcaatttggcctttcactctttcggtctgttcattcgaattccccctccctcccctctttgtctgatgggattatccgatcccttccctaattgccttcccttttccttaattgccttttcgcttcgcttcgtccactttattttccttcctttgtttgccattgaatgattcgccttcctccccattttgttggatcatttttccgtttttattctgtgtgatctccgatgaaacatcgccgtcgcttggggggttttgccgggttaaaaagtgcgacaggaagtgcctacggggagaggcaacggaggcggtgggctgacccattggtgacggtggcgtcgaaaaatgatttgacggtggcgcccgagggaatggccgacgatggcaaatccaagtgggcttagagaaaaggcattgattttggcattacaacaaatcagtggcatttcgtgtcgacagacgcttttgccagccgacccggaggaaacggcagagagcaaagaggagacattggcacaacttctgaagagacatctgcgaaatttggtcggccggtcgttggcctacgcattatgacaaaaactgattgtcttcggcaatttcccttctcaggtgcatttcttcgttgaggattggttcatctccggcatgctcggcttcatcaccgccgctctttccatctccgtggacgttggctatgaatatttgaatcactgtatgccttttgcgccttctctttgttctctct

SEQ ID NO: 94882 - DNA, 1506 bp, Heterodera glycines
  SCN-specific regions: Sequence locations=1-151,173-1370,1392-1506
gtttgaggttaattattttgtccgtcctttttgtcccactcaaaaatgctcagtcgaatgttgtcctcggctgttgccgtccctcggatgtgtgaatcaaacaaaaaattgttgaggaaaggcgcgactttcgttggtcttctctgtgggcgaatggccaactcaactttcactgccacagttacccctcctcatcggctcttacgtccgttgcatatcaacgaaaaaaaattgttcggacctggtcccaataacatgccaccactcgtccaggagggactcgttcaaccgttgcttggacatatgcatcccgagttcttcgaaattatggatgatgtgaaagccggcatcaaatacattttccaaactgagaatgcgctgaccttcgctgtttcgggcactggccatgccgggatggaatgtgccattttgaatctgctggagcctggccagaccattttggtggtgcaaaacggagtgtggggcttgcgggcagcgaatttggcggagagacttggcattaaagtgcatcgattggtcgtaccggagggagaagtgattaatttggacgattttgccgaggctgtggataactaccgtccccaagtggcattcgtttgtcatggtgaaagttcgaccggagtcgtccatcccttggagcgttttggcgatatttgcaatgcatatgacgttcttttcctcgtggacaccgtcgcctccatttgtggtgcccctttccatgccgatgcgctgaaagttgattgtgtgtatgccgcaactcaaaaagtgttaaactgcccgcccgggttggctcccatttcattcagcgaaaaagcactggagaaaataacgaagcggaaaacgccgagtgccctcattttatttcgacgcgttagagttgggcaattattggggctgtttcgacgagccgagaagataccatcacacggcgcccatttcgttggtttatgcgctacgcgaaggtctttcagcagttgcccaggaaggaattgggcacatggtaaaccgacacaaaatcaatgcaaaacttttgtatgacgcttttgaccaattgggactggaattgtttgtccaaaaagagaataatcgtttgccatgtctcaccaccgtacgcgttcccgaaggtgtcgactggaaggcggtgcaagacaaactgatggcccaaggatttgaaattgccggcggattgggaccaacggcgggtaaaatatggcgcatcggaacattcggaatcaattcgaacccggaggacattgagtcacttaaacaagcattgaaaggagcactttacgaacaagaggaaaagggacagtcggaccatttcaaggcggccatctgatgacagagggaaaaatggcaaaataaattaagacggttaattaacaatgggtagatcattaacataatatatcttttggttattttggcacatttcactatgaacatgtcaatttttaaaaaggacggacaataaagttaaacggc

SEQ ID NO: 94883 - DNA, 657 bp, Heterodera glycines
  SCN-specific regions: Sequence locations=1-261,299-599,621-657
ccaagcttgaggtatttattctcgagtataacttggattttacaatacctaattgactccaaaatggaatggtattctggtgacgttactactgctctgaacatttaccaagagaagaaaggcattcttatcgtctatgttttttctgatgatgtaaattccacaaaatttgaccaaatttgggattcgtttgaccattcaattctggatcgcgtcccttatgttgctattcgacttgctaaggacactgaaggcgcaaatcaattcgctcaattctttcccactccggtttttcctgtctgttactttctcgggctcaatgctcaaccgctcgaagttctgactgccgttgaacagatgaccattgaacgtttgaacagttcgctcgctaaggctttttcgctatacaatgaccaaatgaaggaacaaggcttcgccacagatgcagtttcatttcaatcgaaaagcagtgagaatgacagtggcaaaaatacttccgaaaatgttcccgagcctctcaatgccacttcgaatgacgagaaactcgaatattatcgcaaacggctcgaagaaaagcacaaagaagacgccatgaaaaaggagcaggaggagcgggagaaggagataatgcgcagaaatgaaggcaaagcactcgct

SEQ ID NO: 94884 - DNA, 621 bp, Heterodera glycines
  SCN-specific regions: Sequence locations=1-52,78-91,129-252,383 -429,472-515,543-555,590-621
gcaccggctaacgccgtaacacactacggatgacccacattcaactgctgttcacgtggaacccttctccacttcagtcttcaaggatctcacttgaatatttgctactaccaccaagatctgcactggtggaagctccggccgggcccacgcccaaagccttcaacgcaaccactacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggg

SEQ ID NO: 94885 - DNA, 2141 bp, Heterodera glycines
  SCN-specific regions: Sequence locations=1-41,73-86,176-182,245 -258,288-324,352-568,601-609,653-1030,1056-1069,1107-1230,1361 -1407,1450-1493,1521-1533,1568-1584,1692-1692,1724-1730,1759 -1920,1951-2141
agaaaaaaaaataggaaaattgttgaaaaatacttcacaaagtcagactagagtcaagctcaacagggtgttgtttccccgctagatttgccaagcccgttcccttggctgtggtttcgctagatagtagatagggacagtgggaatctcgttgatccattcgtgcgcgtcggtagttagccgacgaggcatttgggtaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccactacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaagtgagagcctgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctg

SEQ ID NO: 94886 - DNA, 385 bp, Heterodera glycines
  SCN-specific regions: Sequence locations=1-16,39-55,95-103,125 -357,384-385
aatacaggtctgataaagccttttttgatcatttctttctttgatctttttgggcctgatcatttttgtttcaaaaattattttccataaatttatcgccaatcacttaaaaaattcataaaaaccaaatcctgtacgaaagaccgaaaaatcgccaattttaaaacaccacggcaaatttcaaccaaaaactgcccataacttttgtcaaagtcaaataaattagacattcttggtatcattcgatagccctaacatttctctattagctaagctaaatttcaaaaaatttggtcaagattgagcaaagttatggccaaagcacaatgtaacaggttttcacacatttttggccataacttttttaaaaccttttaaaattttg

SEQ ID NO: 94887 - DNA, 480 bp, Heterodera glycines
  SCN-specific regions: Sequence locations=1-100,149-321,378-480
tttaagttcttggatcagggacgatcctcagatatgaaggggaggtatagtcatacagtcacaccaaattatatcaaaaatccaaattttagtcgattggaaattaaaacaattattaaatttatataattttaaaagttttaaatttcatcagattttctcttgtctcataatttgaaaagcaatgccaatttaattcaaatccaattgaatcagaatttcaagaaaattaatttaaaaagggcggatttcttttagtagctcaatgacagagcttctgtggattggttggaggaatgggttcattcccattagaggctcggcattttccatttttattttgagtaattaaataaatatttaaattattttattttcagttttggcttaaaatcaaaacaaatttctcatcgtaaaacaaatcaaaagaaagaaaaagtctgaggacttcattcaaatttggaaattatttaaatttta

SEQ ID NO: 94888 - DNA, 990 bp, Heterodera glycines
  SCN-specific regions: Sequence locations=1-39,63-325,347-814,837 -919,941-990
tgagatttcgttaatttatttctgtcactttccgtttcttattctctcgaattgaaaatggttctgttgggtgccattgaccaggggacttccagcagtcgttttctcgtcttcgattccgaaaatggcaatttggtcgccggtcaccaattggaagtgcagcagcaattcccgaatcccggctttgtggagatgtgtcccgagcaaatatttaagacgacagtccgatgcatcaaaagcacttgcgaggaactgaacagacgcggcattgacccgaagaaagaaatcaaagccatcggcataaccaatcaaagggaaacaacaatcgtttgggaccgagagacggggtgccatctgagtaatgccatcgtttggttggactgccgaacgcatgagctttgtgacgaatacattcagaggacgtcgacacgggacaaaaaccatttcaaagcgaagaccggcctgccaattcacccgtacttttgtgccctcaaacttcgttggcttctcaacaatgtgccagaagtaaagaaatcgctacaaaatgggactttgatgttcggtacggtcgactcgtggcttatgtggaaattaattgggatccatgccaccgacgtgaccaacgcgagtcgcactttgttgatggatttgcagaaccgcaaatggtctacagaaatgtgcaccttttttgacattccaatggaaattctgccggaaattcgaagttccgcagagatttacgggcaccttcagaaaggacctttggaaggcattcctttggccggctgtctcggagatcagcaaagtgctctgcttggtcacggctgtttgcaggcgggcgaagcgaaaaacacttacggcaccggcacttttatgctttgcaacacaggacaaagggcgtacatctccaagaacggacttttgaccacaatctcttaccaattcggccaagcgtcgcccgtttgctacgccctcgaagggtcggggtcc

SEQ ID NO: 94889 - DNA, 729 bp, Heterodera glycines
  SCN-specific regions: Sequence locations=1-529,552-729
ctttaatttaatcctttcttccgcttcgaattagcaaaatgatttcgtccaccgccgtgcctcgcccccttcgctcttcgaatcaacaaaaacagcagccaaacgcactgaccaaacagaacggtgctcatcagcagaagacgcctatcaaagccagggaagacagcagaaacaggaacgacgcattgggcgcacagaaaccaaacggtcattcgccgcgtacgccgagcgttccgccggtgaataagcgatacgctcacgtaaaaagcaaagtcgggtcaatcactgagtacactccgtcgcccagtcgcgtgaagattttccacgagtctgtccgagtcagcgccactcccaaagtcggctcactgcaaaatgcgtcccatgtgcccgccggtggaaatgtgacgatcgagaacagaaaactcaacttccgggaggcagcaaagccacgggtggaggacaaatcggaagtgccaattccaaagagtgagaaaaagattgcgactcaaaagttggaatggaaagcccagcccaaagtcggttcgttggacaatgtgaagcacaaacccgccggggggcaacctcaaaatattccacgagtcggtgcgggtgaaatgcgagtccaaagttgggtcccttgacaacatcggacacgtgcccggcgggggcaatgttaagatttcggattacgcacgcagtgtttcccgcagcggtgatggctgcagacgt

SEQ ID NO: 94890 - DNA, 462 bp, Heterodera glycines
  SCN-specific regions: Sequence locations=1-462
cctcgagccgagaccattcaatcaaaaccaaccaaatccccactcattagctcattatgaaatttgcccctctggctttgcttgtgatccttttggtgtctttggtcgctgccgtctctgctaattccaacaacccttttgatgcggacgcggccgacaacggtggcatgaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaaaactgaggacaaaatgccaagaatatgtgtgatcagtgacaaattcaaacccaatgccgcgccctttcgattgccaaagtgcaaaaatgccactgataaataaacaaagtgaattaaaaaacaaaagaaaaaatacata

SEQ ID NO: 94891 - DNA, 689 bp, Heterodera glycines
  SCN-specific regions: Sequence locations=1-14,48-160,183-333,358 -632,675-689
ccacctttgagttattcctgttgtactaattaaaaataacatgtaaaaatggcagcaaaggaactgttccttgctcagcagcccgacctgttcaagccgattcaatccatcaatgccgtgctcatactgatctgtctcggctcctccaccgccgtgccgggcattggcgtcctttggttcatcggcctttgctctctgatcgtctcagtcaccgccacggtgatctttctgctgaaccgtgaaaatggcttgtccggcgtcaccatttccggcgcttttctcccctggggcgtcattgaatttgtctattcgtctgtcctcacgctgctctgcggggtgggcttttggctttcattcggcttcgcctcccacgtgccggacaatggccattcggccggctatattttcgcggggattttcctggtggcccaagtggcctgctatgccatccctgtgctgatcatttacgatcggagccgaacggacggtccggcagccgccggacacgaacaaatcgccaacgtacatccgtttggggtcaccacggacggatgtgagcagcactaccagtcaatgcaacatgaacgtcccattgtctgacattgccaaagttccgttcgcattgactcctcccattttttggcccaatttcaccattttttgtttattaattattaaacagtaattgc

SEQ ID NO: 94892 - DNA, 503 bp, Heterodera glycines
  SCN-specific regions: Sequence locations=1-401,423-503
gtttgaggggttccagagagctcgtcaacttgagacacacattgaagttttacgccgcaaaattgaattattgcgagaacagaattatcggttgttggagaaccgtcttctgagagaccagaaccaacttctgagcgatcagaaccaacttctgagagaccggaaccaacgtgtgagcgagcagatccaacttctgagagacgccgctaacgagcgccggcaggctggcggtggcatcgacgagggtgccaacgtcggtggacaggccgaaccaagtgaccgtgatgccactagtgccgaaggacagcgcgagccgaacggtggtggcaacgatcgtgatgcgggtgccaccaactgactggcatttacaagaccgagagaagcagtttcctgttgatgtaagaacataaacaaatgaaaaccatccactttttgttgcagaaaatgtattagtaagatcatacagaaaaatttaatagcaataaaaagatgtgtgtgaaaaa

SEQ ID NO: 94893 - DNA, 160 bp, Heterodera glycines
  SCN-specific regions: Sequence locations=1-160
ggtgcaccaatatttgagcaaattgcgccaaaaatgctagtgctcgcctaattctaagcctctgccacgcgatcagcatcaaataagcatcatcgacaccgagggcaagcaccaaaaagggcgtaacacaaagcagtgacccttttaattgggaaaattt

SEQ ID NO: 94894 - DNA, 603 bp, Heterodera glycines
  SCN-specific regions: Sequence locations=1-603
gttcagttaagccattctttcacttttgctcactctcatttttcactgaaaaaaaccatcgccaaaaagtaacatggaaaccaagcgcaacaactacaacaacatcgactcgttgtggagcactttgtgtgacctcggctaccaaacctcgcagggattggcctactccgtcggcatgcccaacttctcattcggcgccttcattttgctgtccgtcatgacttggtgctgctttttcatgccgcccgtggctgtgttcttccgcggctatctgcgcgacgggaacgcgtgcactgagcatgtcatttacaacatcattttgtgctttttcctgtgggtgcccggcatggtgcacgccttttggtactgcttcagcgacatgttcagcgggccgaagaaggagggcgccgggtacagcaaaaatgcctgagcagaagagcactggcgagcggacgaacgcagaaatgagcattttttgaaaaatgacgtcatcgatcttattaatttttgacacctaattaagcgataattaattatctctctcacccttttttcatcttgtaaaagtttcaccattaacctatcttttggttgagaaaaatt

SEQ ID NO: 94895 - DNA, 476 bp, Heterodera glycines
  SCN-specific regions: Sequence locations=1-476
gcatttggttcccaagacggcgtcgtgtcctttgttgacattcgtcaggtcaatcggcagttacccgtcgccttcaaagtctctcaacatccgatcagtcggatcaaattccatcccatcttcgccaataatttcttctcttcctccgattctggcctaatccattgggatgccagtgctttggcccaaggagcgaatttaaatccgccaacaaacggaagagaaatgactggccacgaatctgctgcggacatgcggacgaccggagaaaatgaacacaccaacatttggttgtctccccatgcttcgacgagcgttaatttgcgagtgcttattgacgaggaccctcttctgctgagctctttcgacgttgtgaacggtgcgatcgtcgccgcttctcatacggctgaattggtgtttatgagcaatgataaatttacaaattgaaaaataatcagctgactggaaatctcatt

SEQ ID NO: 94896 - DNA, 388 bp, Heterodera glycines
  SCN-specific regions: Sequence locations=1-102,125-388
cgccgctccgttctctctgcccccgccaatttttgctcatcactgtcattttgcgacatttgtaaccgaaaattcatctctccacgcggggtggcacttcacaaaggcaaggcacacaaaggggagagcagcagcaaattggtcaagccgaagaatatggcgaagtgccccatcgccacccgcgcagtcaaacggggccgtccccgtaaggttggcgtagtgccgccgacgtttgttgacactgccaaaaaaggacgagcccattccattgccgccgtgccgccgattggccatcaaaaccttttgagtggccgtcaccgcaccaaacccacaaacgccgccactgctcagcagcaaccaaatggcaatgtgcaaattccgaagttgc

SEQ ID NO: 94897 - DNA, 351 bp, Heterodera glycines
  SCN-specific regions: Sequence locations=1-351
gtttgagataaaaatgcgcttcttctttcttctgaccattgctcttctctccgttgttcttctcctttccccaagtgcactcgcaaagaaaagagcccgccgttcgatgcccgttaacgctgccatgccggaatggaaaattttgtccgctgaagtggaaaacgatggcacagcataagaaggaggaggcaagctttggatcatcggcatgatcgaagaaggaatttgccaaaatgatgaagaataaaccaatgaatgttgtggatttgtagaaattcattcaaatgccgggaataaaaatagttaaattagctcatcaatgacaaagcacgagcaaaaaaaccactcaac

SEQ ID NO: 94898 - DNA, 483 bp, Heterodera glycines
  SCN-specific regions: Sequence locations=1-483
aaatgttcaacaatcacgccaaccacttcatgccgaatttttgcattcccccacctccgccaccacaacttcctcaacctttgaattcggctcgagttttctttccgccggttcctcatcaccatcatccggcttattaccttcaacctcaacatgcacatcctcatatgaaccctcagttcttcaatttaagcgttccgcctcctccaattacgcaaaatatcagcagtttgatcgcagcaaatattaacaactatccaactcgtcatccgctcaatggcacacatcaaataaccacatcggaaaggttcagcaaaacgttccatactgggcatgcgaatggtttcacatcgaaaggcaatggagcgccgctcagcaggtcaagaaagcgatttcttgaacaaattaccaacgaagaaggcacctcgggagaacttcgaattgaattggacacagcgcccaaaaatcgtcaactttcgggac

SEQ ID NO: 94899 - DNA, 406 bp, Heterodera glycines
  SCN-specific regions: Sequence locations=35-406
cctcgtgccgaattcggcacgaggagattcaaaagcgtttcaattaaatgatgagtttattggccagtaataatgcgtcgtccaatgggacaaacgctgctgccgttgcacctttgtcgccgctagcttcgtacaaggagcagcaacagaagcacaaattcaaaaagcctaacccgctagaccgttttctctacaaggttgttccggctcagacgcatcccttcacccagctttgttacaccgctctcatctttggcttatgggcgcaactcgggcgttatatgcgatgattctacgacgaaagaaggatgactaattttaggcttttgactctatgtgtgtgtatcgtcgcaaacacttgaataaaagttaaaaagtaaaaagaaacaaaacagacaaataaaat

SEQ ID NO: 94900 - DNA, 466 bp, Heterodera glycines
  SCN-specific regions: Sequence locations=1-466
ctaaaaacagtggccctgattgtaaattaccactaaaatggcgacttcttcaaattcgaccacaacagtcgctgagccgttgccgacaaaaacttcgatgaaaattgccgaattgcgcagccgcgttctgatcggcgatttgccagccgactttttgcgcattccgccggtctcttcctccgtaaatctctcgtccgcccccgaccaaattgttgcccaacaaccgcaacagattgtcgtcccttatggccatccgtacgctttcgtcaatccggcggagcacttttattccttcgttccaccgcacacgcgggggcgaattgcggtgaaaattgtggaggcgaaactgaccaaaagttacggtttgcccggcgtccgaatggatccgtacgtccgacttcgaattggcaacactttgttcgagacgcccacctgcgtaaatggcggcaaatcgccgcattggaat

SEQ ID NO: 94901 - DNA, 1225 bp, Heterodera glycines
  SCN-specific regions: Sequence locations=1-771,793-1225
tttccctttttctctctttttcattttcccttttcatttccattccaagaattccctccacctttttctccaatttcttaaatgatgtccaacgcaaccaaaaacattctcggcactccaacaatcgtcgacaatgttagtttcgaccccaaagtgagcgccaatttccttcacaaagccatcgaagagaagcgaaaggatgagattatccatttgctgtgcaccatttccaaccaacagcggcaagaattggcacgcgaattcaaacaattgttcggcgaagatttgtccgccaaactgaagaaggcactctctggcgactttgaggaactgattttggctttgttggaaccgccagctgtttacgatgcgcagcaaatgcaccgcgcgatgtccggcctcggcactctccgagggatcggttctgattgagattttggtcacgcatagtaaccgacaaattgatgagatgaagcgcgtgtacgagcagctgtacggccatccgctggagaaggacatcgtcggggacaccagcggcgcattccaacgactgctcgtgtcgctgtgcaacgattcgcgcgacgaaagttggagctccgacccgatcagagcgaatatgacggcacgtgctctgttcaaagagagcgaggtggagagcggggtcaacgacgttctgttcaaccaagtggctggccaacgagaatttcattcagttgcatttgattttcgaggagtatcagaaggtcagcggtcatcccattgagcaggcaattcagcaacagttcagcggagacacgagggacggttatttggcggtggttgagtgtgtgcacaatcggcacgccttcttcgccaaagtgctccaaaactcgaccaaaagcttcctcggcattggcaggcgcgactcggacttgatccgactgattgtcactcgtgccgagtgcgatatggtcgagatcaaagagcagttcatgcaaatgttcaacactccgctggagaaggccatcgaaagcaactgttccgggccgtacaaagacggacttttgactctggtcaaagggaattgatcggcggaagaagcgatctgaagatgattgatcattggcattggattgattgatcggatttgccactcgctttatcatttattttgcttgcatttggtcagtgtcaccaattgtaaaggtcaaacgttggagaatgcaaataaagaaagtccggcgct

SEQ ID NO: 94902 - DNA, 637 bp, Heterodera glycines
  SCN-specific regions: Sequence locations=1-637
gtccatttaagcttaataaaagtttttgcgaaacaaaatggctgatgagaagaatatggtcgtggagaagaatacttcatcttcaacttctgctactgactcttcaccagacggagggaactatatcaaagaggaaatgctccagagagaggttttttgtgagtgtcttggtggcgaacgtgtttcggtccgtgcttcgcttatgtttcagagccaaacctttgccaatatgtggaagtctttgaacgtggacaccaatgagttgcctgacgattttgtcttcccgatgacgagtgttgcagttccggtctttaaaaagattatcaattggatggagagtcacgtcggacagcaagtgcctgagtttgaagaggacccaaatactcgcgaacgcaaatggttcgtccagactgacttcgaaaaggattttttcaaggtcgaagttgaagagttggttgactttctgaatgctagcaactttctcaatttgcaatctctctatcgtcattcgtgtcaggctatggctgctttgctcaaggaccgttctcctgaggaaattcgtgatctgcttgggattgaggacgatctgactgaggagcacaaggcggaaattcgtccgcaaaatgtttggtgcaac

SEQ ID NO: 94903 - DNA, 462 bp, Heterodera glycines
  SCN-specific regions: Sequence locations=1-306,329-401,424-462
tattattttattgcgccttttcctaaaattcaatttccaaaaatggttgccaagccttcttccagtcatcctctgctgcttgtttttggcttctttcgccctctgctcgcccaatgctgctgatgtgctgaaattcaaacgagaagctgcgatcagcagttgtggagctggacagtttgaatacgggggcggctgttgtacgacatgcacaagcgatgctgattgtacgggcgggaagctttgtgtgccaattctcaacttgctcagcgtcagtctgtgctttgccccatgcggaaattaagacagaaaagaaagcagcagcaaaagagggctctgatagtgtgataaattgataggattaaatgaaagattgggagttaattattacttaaatgcatttaatagtgattgattgatcaataaatatttttcggaaaatgatgccgaagcaaccgtcaaaag

SEQ ID NO: 94904 - DNA, 466 bp, Heterodera glycines
  SCN-specific regions: Sequence locations=1-15,38-47,69-309,336-439
attcattttattattttattggcccttttcctaaaattcaatttacaaaaatggtttccaagcttcttccggtcattctctgctgcttgtttttggcttctttcgccctctgctcgcccaaggctgctgatgtgctgaaatttaaacgagaagcggcgatcagcagttgtggagctggacagtttgaatacgggggcggctgttgtacgacatgcacaagcgatgctgattgtacgggcgggaagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatcaataaatatttttcggaaaaaacatccccctttcaccaactaacata

SEQ ID NO: 94905 - DNA, 746 bp, Heterodera glycines
  SCN-specific regions: Sequence locations=1-223,245-746
atttaagtagggatgcgatttttggattttaactgcgcgcctaaagtgtatataaaagcaacctgcttcattcacattcacttttgccaacaccaccaactgttcactcgtaatttctgagaaaccgacagtttgctcacgttcaacaacagcgccattctcagcaacatcgcacaaaaatggcacgccggcgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaggtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatatattatgcaatgtacccaccccccagtattgtatgtgtatgtattattcactatgtgctttatatgtatacctggtcaataaaatataaccccattc

SEQ ID NO: 94906 - DNA, 348 bp, Heterodera glycines
  SCN-specific regions: Sequence locations=1-230,252-348
cataaatggaccaagaaatgagtgcgggaattcaacaaagccgtccttctggaaagatcaatcatgaaatcttgatggaggagacgcgtcgaattccaattttaggcgaagtcgttggccaattacgaaatatttatggttcttcgttagccgagcagttcaaaaacgaactcattatcgccagccaacttaatcgtggaccgatgaataatgggatcagcaacccgcacatggacatgcttcttggtgttgatgagaaaattagcgatcttttgcaccaattgtaatcacacagctgatttactctcacaatgttgttgccgataaattgtatgaattcgaaaaaaa

SEQ ID NO: 94907 - DNA, 240 bp, Heterodera glycines
  SCN-specific regions: Sequence locations=1-94,116-240
gccaagttgtgacaatccgaagccggagatttgcactgcgcgcttttgtgactgttcatgcgactgtgtgaagggattgttccgcgacaaaacgaaaaaatgtgtgcccaaatgtccgtattgaggaaggaaattgatactaacgatgtaatgatatcaaattatttaatcattcattaatctaagaaatagcaattatttaaaaattgaaaagaattagaatttgttagttttcaataa

SEQ ID NO: 94908 - DNA, 426 bp, Heterodera glycines
  SCN-specific regions: Sequence locations=1-389,415-426
gtttcgtttatagttcatatttatttggtaatcgcatcatggaaatgaccggcggtgaccatcagctcaaccattttgtccagcaactccaagcagaaattcagaagcagggattgcaggaacagattttgaaaatgaataatcgatgtttcgacctttgcatcaccgattcgcgtcttccgagtaaattggacggaaggactcagacgtgcattgccaattgtgtcggtcggattttggacgcaaaaacactgatgtttgaacatctccaaaaacgttctggcagtggcggagccatgtgaacgatggccaacccactgatcaattgctgtcgctgtttttgttattcttgttgccttttttgtcttccgtttatttgacgaattggcactatttttaattttacaaaataaatacttattcaaa

SEQ ID NO: 94909 - DNA, 380 bp, Heterodera glycines
  SCN-specific regions: Sequence locations=1-380
cccaagtttgagcttttctaaaaattaactgctgccaaagtcttcatcatgtcttcaaagcctctctacggaaaggatgttcttacggaaggttcggagatctcgcgtgaattggaggcacgtcatcgtaaacgtaaggaggaggacaagcccatctggtacagcaaataccttataaatgacccgaaactcggcacccgctacttttggacttttgctggggtgaccaccgttctgttcggtgcatacattcgccgctgtcttcgctgattggacaaaacgatgggaatgtcttattttcggaagtgtatatgttatttagacggaataaattgttaggatatgaaatgactatatgcaaagacttagataacaaaaaa

SEQ ID NO: 94910 - DNA, 490 bp, Heterodera glycines
  SCN-specific regions: Sequence locations=1-310,332-490
gtttgagacacatttctaaacgctcaaaatgactgatattcaggcatatgctggcccatttatagtgaatgacgtcgtttcctattttttaaaggatggcgtctggtactaccgaaacgcgttcattccgatcaatttggagtgcaagcagccaccgccggcggagattgtcaaagagtggattgacaagtacggttccgcagcgccaaaatcgacaaagcaggccaaacaaaaagtggccacaccattgaaaaagtcgtcacacaaaccgaagttgtccagtgccgacaaggacagcgaaatgctcaagaggaagaggaagcatgagcagatgctttccaattcttcaacttcatcatcatccacatccaaaccgttgcctgtctctgcacaaaaagtggtgtcgtcctcggcactgccaacgccgggtgcgccgtcgccaaacattcccaagcaaaaacagccggcaaaaccctcctccgctccaaca

SEQ ID NO: 94911 - DNA, 520 bp, Heterodera glycines
  SCN-specific regions: Sequence locations=1-197,219-520
aaagaatctccaaaatccctaaacttcgaaaatggcagaaaccgccgagacaatcaacaccacgatctcatcgccgccaccggaatccgaaagctccaccactatttctgcaatgacagatccaacatctcaagaagcagcctcaaaagacacagatctgacgaaagaagccgaatcagagaagaaaccaggaggaatctctctccgaatctggccaccgactcagaaaactcgcgacgccgttctgaatcgcctgatcgagaccttatccaccgaatcaatcctctctaagagatacggtactcttaaatctgacgatgcaaccaccgtcgcgaaacttatcgaagaagaggcttatggtgttgcttcgaatgctgtgtcgagtgatgatgatgggattaagattcttgagctttattctaaagagattagtaagaggatgcttgaatctgttaaggctagatctaatgctagtgttggaaatggaagtgtggaggatgctaatactgatgctagtgag

SEQ ID NO: 94912 - DNA, 219 bp, Heterodera glycines
  SCN-specific regions: Sequence locations=1-116,138-157,182-219
caacagcagtcaaaagtggcgaaactaaggacatcagccgggggttttctttttccaatggaagcgggttgcactctccaagagccgatgatcagctaacatttttcatccatattttgttgtattatttattcattataaaaggctcaacattttgattatataaaatttttatttttttccaactcaaaccatttgctcaaataaaaagataagctc

SEQ ID NO: 94913 - DNA, 1023 bp, Heterodera glycines
  SCN-specific regions: Sequence locations=1-668,690-1023
taaatattgcacatttttatcacatttaaatgtctctgtcagtgttggaccaaattaagcagcattcgaccattgtggccgacactggcgacttccacgcaatcgaagtgttcaaaccgacggatgccaccacaaatccttcattaattctcgccgctgcaaaaattgaaaaatacaaggaattgatcttaaaggcagtaaaatatgcgaaagaaagggcggcggggcaatcgaaggaggcggtgatagaattggcgagcaacaaactttttgtgcttttcggcaaggaaattctgaacattgtgccgggtcgagtgagcacagaagtcgacgcgcgactttcctttgacaaagaaggctcaatagccaaagcattgagtctgatcaaactttacgaagaggagggcattgagaaggagcgcattctgatcaaactcagctcaacttgggagggcattgaggcagcgaaggttctcgaatcccaacacggcattcattgcaacatgactttgctgttcaacttttaccaagccgtcgcttgtgctcaagctaaagtcacgcttatttcgccttttgttggtcgtattttggattggttcgttaagaattccgacaaaaaagagttcgaccgaattactgaccccggtgtgcaaagtgtgaagcgcattttcaattattacaagaaattcggacacaaaacgcaagtgatggccgcctcatttcggaacacggaggaaataaaaggactggtcggatgcgatcttatgacgataagccccgctttgttgggtgaattagccaaagattctgacggcggttggaccgatgatgaccgtgcaaaatgcagacaaaagccgaattggagcagattgaggtggacgagaaaatattccgctggcagatgaacgaagacgcaatggcggacgaaaagctcgcggatggaattcgccgctttgccgtcgatgctattaaactcgaagagttgattcgatcgaacctttgaattaaaaagtatttgttgcc

SEQ ID NO: 94914 - DNA, 641 bp, Heterodera glycines
  SCN-specific regions: Sequence locations=1-12,34-641
gtttgagatacttaaatttaaaatttgcatttcaaatggcaacaaaaccgctcctctactgctactggcgcagctcatgctcctggcgagttcgaatcgcattgcatttgaagggcattgaatttgatcagcgcattgtcaatttgttgaacggtgatcagaacaaagatgaatttttgtccaaacttccgttcgccaaagtcccagtgtttgtccatgacaatttagtgctgtccgaaagtatggcaatcattgaatatttggacgaaaaattccccgaacccaaccctttgttcccaaaaagtgccgaagatcgtgcacacgtgcgggcacttgcgcttcaaattgtcgcaaatacgcaaccgctacaaaatttgggtgttctcaagcacctttctgaagagccggccaaacgaaatgcctgggctcgtcattggatcgagcagtcattcaatgtttttgagaaagcattggccaaaacggcaggcaaatatgcctacggggatcagatcagtttggccgacatttgcattccgccacaagtgtataacgccaagcgctttggcgtcgatatggcgcaattcccgatcattgcacgactggacgaaacactagcggaagtgccggcgtttaaagtgccg

SEQ ID NO: 94915 - DNA, 396 bp, Heterodera glycines
  SCN-specific regions: Sequence locations=1-396
gggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccactgtccgcctccccgcaccgcccccggctactgagtgtgatcagtcgaccatcgagaattggagaagaacccccactgatgatccacgaggctgctgtcctttcgtctctcaccattttcccgatcattttggcatttccaaaacgctgatcggacaattctcaatgttatttttgtatttgtgcaaaatttcgttggattgttctgtcgcacaaaaaaatcaaagaataaattgatcggagctca

SEQ ID NO: 94916 - DNA, 756 bp, Heterodera glycines
  SCN-specific regions: Sequence locations=24-41,64-209,234-756
aacccggcggagacggacaacccggaggctcaggacagcccggagcaccaggccaggcagctcctcgcccgtacccgccaagcggcggatgcgtgccgcaatgtgaggccgcccagcccggactccccggcccgcccggaccccccggacccgagggacagaacggccaacccggacagtcggcaccacccgcgtctcctggccgccccgggccccagggacctcctggacccgatggacagcccggcaaccccggagagtctggccaacccggccagcccggcaaactcacccagggcccgcccgtcgttggaccgtcctggcccatcaggaccccctggccagcccggacagcccggcgagaacggacagcccggccagcctggaaaccccggcccgcaaggataccctggcgacggcggaagccccggccaacccggcaatcccggaggcagcggcgagcccggacagcccggagcacagggatccagcggccaatgctaccactgcccaccgccccgcaccgcccccggctactgagtgtgatcagtcgaccatcgacaattggagaagaacccccactgatgatccacgaggctgctgtcctttcgtctctcaccattttcccgatcattttggcatttacaaaacgctgatcggacaattctcaatgttatttttgtatttgtgcaaaatttcgttggattgttctgtcgcacaaaaaaatcaaagaataaattgatcggagctcaaaaa

SEQ ID NO: 94917 - DNA, 747 bp, Heterodera glycines
  SCN-specific regions: Sequence locations=1-6,28-67,122-127,160 -160,186-368,390-441,465-558,581-747
gcaagagactcacattgttctcgggattgcctcggtgtgctcgctgttggctatcatcgccacagttgtcactctgccatctctgtactcggagatgagccaaatgaacagcaaagtgcgcaacggagttgaggccttccgcgtcaacaccgactcggcatggactgacttgatggacgtgcaagtggtggtgacgccgccgtcgaagccccgtgcgaaccccttcaactccatcttccgtgccaagcgtcaactgcccggacactgccagtgcgctggcctccaacaaccaagctgtccccctggtccgcccggcccggccggaccgcctggacagcccggacagcctggaagcgcaggacagcccggacaggctggacagcctggccaacccgctgctccttgccctccccagaacatcccctgcccacgctgccctgctggcccgcccggccgccccggaggacagggaccgcccggacagcaaggagcccctggacagcctggtacgcccgctcaaggtggaggacctggaacgcctggcgcgcccggaccccaaggacagcctgggcagcccggacgccccggagcctctggccaacccggacagcctggagcgaacggagttgtctcgcgccctattcctggcccgaagggaccgcctggagcgcctggccagaatggaaaccccggaggccaaggtcagccaggacagcccggaggccaaggaccgcccggcccacctgg

SEQ ID NO: 94918 - DNA, 845 bp, Heterodera glycines
  SCN-specific regions: Sequence locations=1-71,98-101,150-151,210 -469,493-734,756-845
ccaagtttgagcgctaaaatgcaagagactcacattgtctctcgggattgcctctgtgccgctctctgttggctatcatcgccacagtcgtcactctagagcatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgttttaacggacaactgcccggacactgccagtgcgctggcctccaacagccaagctgtccccctgggtccgcccggcccgtccggaccgcctggacagcccggacagcctggaggcgcagggacagcccggacagcctggacagcctggccaacccgctcctccttgcccgccccagaacatcccctgcccacgctgccctgctggcccgcccggccgccccggaggacagggacccgcccggacagcaaggagccccctggacaacctggtacgcccgctcaaggtggaggacctggaacgcctggcgcgcccggaccccaaggacagcctggacagcccggacgccccgggagccgctggccaacccggacagcctggagcgaaacggagttgtctcacgcccaattcctggcccgaagggaccgcccggagcgcctggccagaacggaaaccccggaagccaaggtcagccaggaccagccaggaggccaaggaccgcccggacctcctggcgcgcccggtcagcccggccagcctggaaaactctggccagcctggacagcccggagcaccggga

SEQ ID NO: 94919 - DNA, 673 bp, Heterodera glycines
  SCN-specific regions: Sequence locations=1-5,29-221,245-555,577 -611,633-673
agaatatggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgttaaaatagcccaaaaacgtcatcataagaaaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggtttcaggaggccgccgaactgtacttggtctcattgttcgacgacaccaatctttgcgccatccatgccagtcgagtgaccataatgccgaaggacatgcaactcgtgcgcaaaattcgtggagagacttttcttaagccgttgtcctcgcagtactgatcgaagaaaatggtggtggttgatttcatagtcgatgacaatttgaatatgatatttttcgcaaatctcttttgtattctcgacccattccattttcactattatcctactttgtccaaaccccaaaatctttctgataaatcagctttactgc

SEQ ID NO: 94920 - DNA, 478 bp, Heterodera glycines
  SCN-specific regions: Sequence locations=1-67,89-478
cattcgttttgccattttctatggcttaattacacaaaggcacttgtcaccacacattcactaattacccaaatgctttgttttgccacctcaaaatgttttcctcaaagcttcgaccaatacaaaagccgatcagtttcactgatcttcatctttttgctgacgattcatcttttatttgcggaaattgcttcggaaaagtcatcaaaagaaacatttaaagattctctggtgcaaaattcgccaaaaagcgacctcaactttctattccaacaacggagcactcagaaaacagctttcatcagacatcattatgcttcttccgtagcaaatggccaatctggacaacattctcggcaccggcgacggatacccaccggaattattggcaaattaattgccaaattaagcggaaagacgggaaaaattgcagcgactgcaagcaaaagcgatgatatttttgttgggaccgcaaagg

SEQ ID NO: 94921 - DNA, 228 bp, Heterodera glycines
  SCN-specific regions: Sequence locations=1-198
cattactcatgttcgactcagcccgatggagaaacttcaggacgaaatgctggaagctgctaaagaacgtggaacccgcgatgctaagggctattgggttggaaagcaataggaaaatggatgtaatttgatgtgttaactgttctttagcttgcgttctcatataatgtatacgtggagcaaataaaagcagattttaaaaaaaaaaaaaaaaaaaaaaaaaaaaaa

SEQ ID NO: 94922 - DNA, 724 bp, Heterodera glycines
  SCN-specific regions: Sequence locations=1-643,665-724
cctactggatcttttgcgctatcgggagtccagaggatacctttcttttttataaaaattttcgtttcatttttatttttagaaaagataaatttgacttctttacaatgactgcttcatcccgtcgtttgcaaaaggaactttccgaaatgcgtgggaacaattcgggcgctgttcgtgttcttgaggttgatgagtctaatttgcttcgctggagccttatgctttatccggaccgtgaaccatacaacaaaggtgcttttcgtgtgaatgttgattttccaactgagtacccattcaaaccgccatccgtgacattcgcaaccaaaatttaccatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcagaagactacacgaaaaagtatgccgaacgtcgcgactgagtttgtttggacagatggagttatttgtgcatgaaagtcccgctggtatctacgaataatctctcgccactcaaattgttcaatttataaattattgtgttttgtctgtcgttgattattttgacttttttgtatcgatttaaacttgaagaaaa

SEQ ID NO: 94923 - DNA, 383 bp, Heterodera glycines
  SCN-specific regions: Sequence locations=1-383
cactgctcaaaatacaatgaaaactgctcttgagttggcaaaaaaaattgtttgtggtgtatttattgcacacgtttttcgccaaaaagttggccgaattcttacgggagtaggtgattccatgctgccgactatccacgatggcgacattctatgggctcgagtttgggatccgaacgatgctttacgaccgggggacgtcgtgtgtttagttgaccctctcgatgcagaagagtatgtcataaaacgcatttccgctgtccacaaagactgcatagaagttcgcggcgacaatgcgaaaaagtcgttggactcgcgcaaatatggccccgtgccggctggacttgtccgctaccgcgtgtctttgcgactcctccccttaa

SEQ ID NO: 94924 - DNA, 791 bp, Heterodera glycines
  misc_feature (684)..(684): n is a, c, g, or t
  SCN-specific regions: Sequence locations=1-120,151-762,785-791
ctttttgtgactctaattccgtccgtcccttgccctttaacttccaccaaatgcccctcgtgcacaattgcatcgcttgcactcgccattccctcttaattgttttgggcctcattatgataatggccaattgtggacaagcgatgcggcagcaggcggtggccgtacgtggccaactccgttgtgggaacagacccgcctcgggggtcaaagtgaagttgtgggacgaggacgacgggcccgaccccgacgacgtgcttgacgaggcgtttaccgactcttctggctccttccaaatgagagggtcgacacgcgaactgacaaacattgaccccgtgctgaagatttatcacgactgtgacgatgggataatgccaggacaacgcaaagtgaaactgcgcatccccagccaatacatcacaaacggagggttggccagacgaacttttgaagtcggagtacttaatttggagacagtctttgctggggaggaaagggacttcatttgaacatggaggggaagaagaactggcgaaatgaaagctgatttattatcacatacagtataaccagccattccatttggtattctttgtataccacattcgtattcagcaaaagaatgtagaaacaataataaactatacaatgtatcaaaacaactataactagaggatctcgatngatcgtgggcatagaaaaatagaaaaagttcccttcgtttttaccacttatgctagtagtgtatgtagcacccctctaaaagatccaacttacttcacttctgtcga

SEQ ID NO: 94925 - DNA, 778 bp, Heterodera glycines
  SCN-specific regions: Sequence locations=22-392,434-729,751-778
gtaaacagctaaatttatttccgactgtgttccaaatcggttataaaacaaacagttatgaccacaatcgataacaaaaagagtgcttttgccctgtccttggccggtttacaaagttcctcgtacacttcgtccgaattgtacactctgtccacatttggcaacgaaaagcgtccgcgcggtgcggcgcgcaattggcgctccaacgcttccctttcacgcgcgtctttttgctgctttggcaattggaaattgttccctttagcgaatgcctgattctgctgatgacatttattatcaatgctaatattacgctgacaatgaacgattgaaaatgcggatgagacggactgaggaagaattcggagagacgaataaatgtataagaaattggccatcccctcgtgccgaattcggcacgaggcttttaataccctcgcactaattgctctcaagatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcggcggaccatggggaggaaatttcggaaagaaatgagaagggagcaaaatgtggtgatcaagacgaacagaacaagccatttgattgaatatttgtgaaaatagtcaatgtaacaattagaaagaaataaaattacaatttaccaaaggacagaaggaaacaa

SEQ ID NO: 94926 - DNA, 927 bp, Heterodera glycines
  SCN-specific regions: Sequence locations=1-58,80-709,731-927
cattctcggtctcttccccctcaagattcttgactacttcttcttcttatgtaaacaaacaaaataccaaacatcccccaattcgattcgccatttttcttttctttcttttctcatttacattgcgtttccgcaaaatgtcaaatttgaattttgaagacaatttgcaacgcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagacttcccctccatggaacaattgggtgacggactttcgcaagtgatggagcagttcaatctgagcaaatgcattgcccattggggagagcgcgggtgccgacatcgtttgtcgttttgcgatgagcttcccccaactcgtcgtcggtgccgttttggtccattgcatttcgacaacccacggaatcattgccagcatcaaagagcttttcaccaatttgctccttaatgatggtgaaatgactcacagcgcgtggaattggcttttggtccacaaatttggaaatcatgaaatggacaaagaaaagcgcaattacgtcgatgccatcaaagcgggcggaatgaatgaatacaatcttagcagatatttgtacgcattcagtcaccgcgacgaactcacagatcggctgaaggatcaactgggcaaagtcgacgtc

SEQ ID NO: 94927 - DNA, 517 bp, Heterodera glycines
  SCN-specific regions: Sequence locations=1-12,37-275,299-517
ccttcaatagatgacccccgggctgcaggttttccaacaaagcgtccagatcaattaacttgacaattaatcccttgtccctaattttcgccaatttttgtcctccaaatgatttgtcccaacgaatcggagccggacactgccaatggcgagcagcacaaaaattcagcggcaatgaatggccacggatttgtgccctcgggcaatgccgaaacggagggaaaagccgacaaaagacaccagcagcaaagaaaactgtacaaagcagacgaaaacccaccatttctgctgacctttttgtttggctttcagcaagtgatggtgtccctgtccgtgctcgtatccatcccgtttctgatctcggacgaggtgtgcccaggaagggaccgtgatcagctccgagtgcgtctgatcgccgccacttttgtcacctgtggcattggcacaattttgcagacggcgtttgggatgaggttggctcttctccaaggcgtcgctttcgcttacattccatcga

SEQ ID NO: 94928 - DNA, 422 bp, Heterodera glycines
  SCN-specific regions: Sequence locations=1-363,385-422
acaaaaaggaagtgccaaccaacgaaattttgcattgtgaaggcggccaagtcgatttttccatcgatgatagccatatcattaaatcggagaaaggtgagggagaaaaaggcgacgaggagctgatcccgatcggatcgccggtctgcaagaagccgagagatgcgggccacagatgccatggccgagctggcggaccaatcgcggccaaaaaccttaagtggtattttgacacggagacttttttatgtttggcattttcgtacaacggctgtggcggcaacggaaatcatttcgactcgcccgcagattgttgggacaaatgcaaacttggtaaagctgagacaaattttctgtttattgactaaaattctggtttttaaattttccatgtggtcatataaattttcgttcttataaaa

SEQ ID NO: 94929 - DNA, 357 bp, Heterodera glycines
  SCN-specific regions: Sequence locations=1-307,331-357
taagaacattttgaattataaagttctacttcttcaaaaatgctccgttttttgcacgccggctgtgtgccccattgtcgcatcaaagcgtccatttcgacggtaggcgagcgaaagtatcatttgttggactcggtgaagcgggacacactgtctcaaaaaggctcagggacattaacatctccaaagaccagatgctggacgtgcgaaaagatgtgggagaaccagtgacggattgatcgcccttttggagattattgaatggacaattgatctcttctcgttaatttgatgtttctttccgacgaaaatatttatttgtttgttttgccttcagtcggtataaaattgaaattc

SEQ ID NO: 94930 - DNA, 394 bp, Heterodera glycines
  SCN-specific regions: Sequence locations=1-35,57-253,275-300,323-394
ttgcttgtctgtaaaaccattcagtttcaaatcgtattttaattccaaaaatcaacaaattcacctcccatttttacaaaatgtcccccctccgtttcttcgtcgccctttttctgatcactttggcaattttggccgggacccacggcactgttgagaactcagtggatggtgggccaaacatggcatcgccgattatccgtgaacgccgttggggccatggcggcggaggccattggggctgaagaaaatggtgggagagataatggaaaatggagaacggaagaagcgataaacgatgaaaaacaagaaaaaataatttgtggtagaagaaaaaatgctgaactcttaggtcgaataaagtttcaatgaaataagaggacaatcaaaaaaa

SEQ ID NO: 94931 - DNA, 618 bp, Heterodera glycines
  SCN-specific regions: Sequence locations=1-493,515-618
caagtttgagaataattcttcaaaatgaccaaatttgtttgtgttttgttgctgctttttgcttggactctccaaattgtccatccttccgtagttccgtccgatcaaatttatatcatcgaattcaaccgcgacaattcgaacaatcaacaggacaatgatttaaaatcggccaatggagttgaagacagcaaaatgaccaatggcgtcatttcacaagactctgcccaagttgtgacgaccaatggcacgaccgagttggaaacggacccactcactgtttcagtggaattgcaaagaggcggacgtgctgttggcaatcagttcaacatcaatttcactgacatcagctatgtgttggtgtgcagtgcaagattccgcatttcattaccaagcgatacaactctgcgaagtcactcgaaaatgactgccgtgccgaacacatctgatcaattcacgttgcctgatggagtgcatttgtacccgggtctttctcacactgctgaagtgatcttgagcggaaatggacagcctgaagtgaccattctggacacattgactgtgctgaccactgaaaaatgtccgaatgatgtttgaatgaagcgctgaaaaatttcg

SEQ ID NO: 94932 - DNA, 750 bp, Heterodera glycines
  SCN-specific regions: Sequence locations=1-156,178-179,201-405,430 -462,484-750
tccagcaaatccctccctttaatcatcgcctccattattattatcctcttccatttgacgacagttttgtccgatcacctctgatcaccattattcgtgcgtcttcaacttcttcatcattctgtcgcccgtttcgattcccctttccccaaccatcacaaaaactccaccaaaatcattgtttctccactacttttgtgtagcgaatgttccgtccgacggagctgattttttacactaacaatagcaccagtaacagcagcaacacggaggaacaactgttgaccctcatcattttcaaggagtacatccgaaagaaacagcaccaattttggaacgggacgacggcacggaagaggaaaacaacagcaaacgaagaagcaacgtcaaacagaacggaggatcaacggaaagagagggagacaaaggagcagttcatccggacattggatcaacaccaacaacaacagaacgagcagcaaaacggagataaacggttgagactactaacaaagcaaaagcataaacaccgacaagttcaacaacagaacaacaacaacagaagaaggagttactgtttgctgttgaggctcatcagacagtgacgacgacgacgtcgagcagtacaaaccatcaccaaaaaaacaaattgttttcattgttttttgttgttatttgcattttgttagggttcatctacagcatcagcctcacattttcttcgctccatccacccaaacaacaaaaatt

SEQ ID NO: 94933 - DNA, 497 bp, Heterodera glycines
  SCN-specific regions: Sequence locations=1-469,493-497
ataaaacgaacactcctccaaagctttgtgcgctcgtcccccaatcggccgaccgaattccgagtggttgtacactcgcgcgcgaatatttctacgacggctttcatttggttgaaattcccttcgcggaaaagtcgcgatcgatggaaaagcgccttctaccgccagatggcggagttgggacatggcaattggctaatccggaccaagtggaggcggccaagcagttcgtcaaaaaattgaccaacaccaaattctctccggacgattttgcaaatcccgtgcttcaacagcattacaaagctgtcgaaatggtagcattggatttgccatttgacagcgaacagttcaaaaaagaggcagcggaaaatgacaaattaattccgtacttcaaaaatccaacttttgagcagagagttgccaaagaattggaagaattcgcagggatttgtgagacaattgcagaaacaagggagaaagggaagaggaaaagtgca

SEQ ID NO: 94934 - DNA, 600 bp, Heterodera glycines
  SCN-specific regions: Sequence locations=1-193,219-234,258-578
ctcaaatttccaattgtttcttaaattaagctgctaactaaattcgttaatcgaagcgacaaaatgaagtggacttacaaagaggagaactctttcgacaagcgccgcgcggaaggcgaaaagattcgccgaaagtacccggaccgaattcctgtgatcgtggagaagtcgccgaactcgcgtctgcgcgatttggacaagaagaagtatttggtgccagcggaactgaccatcggccagttttacttcctcatccgcaaaaggatccatcttcgccccgaagaatcgctctttttctttatcaacagcgttatcccccagacaatgacaaccatgggacagctctaccaggaccgccacgaggaggacttgttcatgtacatcgcttacagcgaggagaacgtttacggctgatcgtcggttgggcggcggagtgtcggtttggcccgtggcgcataaaactcccatcgatgggagggaataaccagcgaatcgtcgtcggcttttatgtacctttttcatccctttcattcatatttttcaagtaatttgtgtgatcacgcatcgatgatgattatataaaatcgcttttttcaaaaa

SEQ ID NO: 94935 - DNA, 1171 bp, Heterodera glycines
  SCN-specific regions: Sequence locations=1-50,73-150,172-457,479-1171
gtttgagtcgcttttcaatttcaattttccaaaattccaacttttgaatgctttcttcgccacacaattttaaagttgcaattgtcggcgctgggcccagcggtctcacagccgcaagacaagctctgctctacggctacaaagtgcgcatttttgaaaaggaacaaaatttcggcggcgtttggcgcctcgccatctcagaaaatgcgcaaagacggcccgtgcctttgcaaagtgtgatggactgctcaaaacagctgtgtgcctttagtgaactcgccgttgctgaacattttcccacttttcttcgcccttctgacgctgtcgcttatttggagtcgtacgtgcgaacattcgaattggcacggcacatgaaacttggcacggaagttaaaacgattcgccgatcggagtgttggcaaaagacagataattagcgggggattggcaattaaaccaatggattaattaattaatcccttttcaagccgatggattgtccaatgggcggacagtgaacagccgaacaacggcccatcggaaggacagcgactggtcgaggaactgttcgatgccgttctcatctgttcgggcgcccgcctaaggcggtggcgccccccggagtaccgtatggagagggcgttcaaaggcacagttatccattcggaacagttcacacattcgtccgactttcgtggtcagactgtgtgcgttgtcggccttggtaactccgccgtggctatttccattgcattggcacacacagccaaacaggtgtttctgtgtactcgtcgtggtgaatggatattaccattgcttcaatccgacggacagaagccatgggattggcctttcagcagccgatggcatttttggggtcgccgatgggtgccgaaatgcctccgaaatttttgttgggaaatgagtgcccaatcagtatcaccagactgttcacaaaacaacggaattgggcgaccaatgcatcgattgctgagtgccaatttgacatttggagctgaacagctctgcccactgcttgcttccggccgaattcgaattcgcccaaacattttgtcattgtccgactcgaatttggtcgaattcgccgacagaactgttgaacaacacgtggacgcgctggtcatctgcacgggtttcgaattcgacttta

SEQ ID NO: 94936 - DNA, 817 bp, Heterodera glycines
  SCN-specific regions: Sequence locations=1-817
caattaagcttatcaatttttaccctttccacttaaaatgacttatgtttcggcccaagcgcacaatgttttgtcggacattgacaagaagttgcatgagaacaatgcgttcaccaatttgctgggcaaaattgagaccaaaactggcctcaaacgtcttcacgtctttggagccttggtcgtcctttacatgctttaccttctgttcggtcgttgggctcagctggcgtgtaacatcaccggctttctctacccagcttacatctcaataaaagcgattgaaagtcaccagaaggaggacgacacccaatggcttacctactgggtggtttttgcgctgcttaatgttgtggaattcttctccaacaccattctgtactacttccctttctattggttgatgaagtgtgctctgctgttgtggctgtacttgcccagcactttgggtgctcagctgttgtacacgcgcattattcgtccgttccatcttcaacagcacaagaacattgacagcatgtacaacaaattggctgggggtgcacaaaaggcatacgaagagcacgtgaaagagacctgaacaatcgtcagaacaagaagatgaagaagtacactttttgacatcacctctctctctgatttcgtatattacaattcttgacaggaaactttacccattttttgctgtcttaccaatatttgcgtctcttttgtcgtttgctgttcatttggctttaaaataatactctcgcgagacaattttgctatgctttgattatctctctgatcaatttgcagttaataaacttatgctagtttg

SEQ ID NO: 94937 - DNA, 561 bp, Heterodera glycines
  SCN-specific regions: Sequence locations=1-291,314-449,471-561
tggagctcacaccgcggtgggcggccggctctacaactagtggatcccccgggctgcagattcggcacgaggagcctgattttctgattctaatttccaattttcgaatacattcctttcagtgatgcagccgcagtcaaagcgaaagattcaggtttcttttctgatcagaaatgggtcggtcgagtcgaagcatcgcggcttcgtcaacgccctccaatttgacccgacgacgcgcagtctcttttcggccggttcagattcggtcattcgccagtgggacacttcggcgccgtcgggcagcgccgcctttctccgctcattggagcaccactgtgactgggtgaacgacaaacggcaaattgtgacgcgggacagtgatgggaacgtcgaactgtgggatgtgatgcaatgcggcagggtgaacaccttcccgatgggcaccaacatggaggaagtgatcaaggacaatgtgcggaaggtgtggatcccgagttggttcggcgtggatgccaagtgcggggtgttggaaatcactttggacgagagcgacgcgttctc

SEQ ID NO: 94938 - DNA, 698 bp, Heterodera glycines
  misc_feature (646)..(646): n is a, c, g, or t
  SCN-specific regions: Sequence locations=1-86,125-533,556-698
agatgtcagacagaaaggacagtgtgacaggagggaaacgaatagagcaggaacttgctgaggacggccgtcctgtttacatcgtcgtattgaccattttcttaaaagggtttttctttttgtatgacttgctcgtctttattccgttcaaattatttgctgatcctgaactgaaaaaggagcgctctcgtgaacaaaaggccgttccgattgatgggaatccggcttcaccatggcgacacgtcgacaccattggcactgctctgtacaccgaactttttgaggactgtccgacgctcggcaaaatttgggacaaagcggcagagttgcaccgtgggcacaattgcatgggaacgcgcgacattcttgaggtcatccaagaacgacagtcggacgggaaaaccttccagaaattggcacttggcaaatatagctggatggattacgaacatgttgatgaagtgatcgtggaagtcgcttctggactcgacaatttgggcattgagcaaggacaaaaagtagtcatttacgccgagaacaggaaaggaagggatgatctccggcatcccctggcttcaaattgtgcccttccaattgtaccggttaattccacgcttggtgacgaggcaattgcttttgccttggncgagtgtgacgccgttttggcgtttacttcacgtccccttctgtcgaaagtt

SEQ ID NO: 94939 - DNA, 1959 bp, Heterodera glycines
  SCN-specific regions: Sequence locations=1-290,313-604,626-1627,1649 -1959
ccaagtttgagtttgtttatttggcattgcattacttacaactattaatcccgctgtttctgctggtcatttatggtcaatattctcacaatccgatggaccatctgcaccaccttgaggaatggcgcatggccatgcgcgcgggtcttgatgctatggcagccgtacaggctcctcctgctgaagaggatgttggtgaaaatggagatgacaacgcagcagcaccccacaacttattggcgtgggatggcggtgttctattggaagcagaaggcggtttcgtaccgctctaacttttacaaaaaatttaaaatgccaaaccaaaaggacggagtgacaggaggcaaacgaattgagcaggaacttgccgtgtttgaccttcccttttacatcgtcgcattggcctttttcctaaaggcgttcttccgtctgtatgacttgctcgtcttcgtcccattcaaattatttgctgaccctgagctggaaaaggaacgctctcgtgagcgaaaggccatgcccatcgatgggaagccgacttcgtcctggagacacgtcgataccattggcactgctctgtacaccgaactgtttgagggctgtccgacgcttggcaaaatttgggacaaagcggcacagttacaccgtggacacaattgcatgggcacgcgcgacattctcaatgtcgtcgaagaacagcagccggacgggaaagccttccaaaaattggcacttggcaaatgcaattggatgaactacgaacatgttgatgaagtgatcgtggaagtcgcttctggactcagcaatttgggcattgtccaaggacaaaaagtggtcattttctctgagaccaggaaggagtggatgatctcggccatcgcctgcttcaaattgggccttccaattgtcaccgtttatcccacgcttggtgacgaggcaattgcttttgccttggccgagtgcgacgccgttttggcgtttacttcgcgtccccttctgtcgaaagtgttctcttccgtcaaagactgtcctcagctgaaacgcgtcgtttacttcagcgaactgcacgcacttgccgaggtcgccgagaaagcgcctgatgcgataaaggaagcgttcaaaagtatcggacgcgaactgtacagctttaacgccctcaaggcactgggccattcgcaagcaaaactcgagcggaatgtgcagccggacgacttggcgatgatcatgtacccgagtggcacccccggaaagccgaaaggagggcttttgtcgcatcgcaacatcatcccgaccgcttcgggacagagcgctgtcatttcagtcagtaccagcgacacaatcattggctatttgccgttggcccacattctcgaagtgtgcgccgaaatcatttgcctgtccaaagggtgccgagtcggttactcttcgcccagcactttgcatgaccgtgccgtgaagattaagaggggaaccactggcgattgcgtcgaactgaagccgactttgatcgcttgtgtgccggcagttatggacaagatcttcaaagcagttttggacgaggtcaaagaaaagtcgcccattcagcgcgaaatttttcgcatctgttacgaacggaagcgcaaccgatttgaaggagggtacaaaagtttggtgatggacagtttggcttttgccaaaatcagcaaaatgctcggtggcaaccttcgctttgtgatttctggcggtgctccgctcaatccggagacgcagcggttcatgaacatttgcttctgttgccccgtcgttcagggctatgggctgacggaaacttgcggtggcgccactttggcggatgaacacgacctcagcaccggttcggtcggaccgccgcttcggagttgtgaaattcggcttagagaatgggaggaagctggttatttgcccacaaattcgcctcctcagggcgaagttctgatccacggg

SEQ ID NO: 94940 - DNA, 485 bp, Heterodera glycines
  SCN-specific regions: Sequence locations=1-485
taagcattaactaaaataattttcttattatgaatctcggacggtgtagcatttgcactttaagctttgacttaaacgatgtttcagctctcaaatgtgggcatacgtatcattaccaatgcatcgacaaatggattgcgaattccaaaacttgtccaaattgccggacatcgaatctcaagcgcgacatattgaagcttttctttgatgagggcgaaaagtcttttagtcaattggtgcaagaaccggccaatgcagaacttcttgctcaactgaaagaggcgcaagacgtgaaatgctttttggagaaaaccattaaagagcagcacgagcgactgacccttctggaatttaagctgaagcaacaaaagaccaaaggcaacgaattgaacatgcaaattcaaaggaaggcacaacacatcgccactttggagtcacagctttttgaccagaaggttctgaaggaaacaaacgaaaagtacaaa

SEQ ID NO: 94941 - DNA, 335 bp, Heterodera glycines
  SCN-specific regions: Sequence locations=1-177,201-335
gtttgagcttgtcatataactattatggagcatgttcaggcagtggttgaccctggcaaaaagtttgccaaagactcaattcgattggtgaaaaagtgcacaaagccggaccggaaagagtatcagaagatcgcctttgcaactgcgattggattcgccattatgggcttcatcggattcttcgtcaaactcatccacattcccatcaacaatattatcgtcggcggaggataagaaaaaggagaaaatgaacaaaaaaagtccaccgttttttcacctgtgaattgttttcttcacctttgatttgttattgcacataaacaattcgcaattcc

SEQ ID NO: 94942 - DNA, 324 bp, Heterodera glycines
  SCN-specific regions: Sequence locations=29-81,108-324
gccattaattattattattattcaaattgaaatttgagtgattgcaaatggaaatattaattacattgagatgggatggacaataaataatttaaaaataatttaaagtcattcagtcaatcgaatggtcaatttggctttggttgttctccttctcctccgcgtctgtttttatgccgcgggcgcggcggaagggcggtctttttaaggaacggtcatttggtgcgcgagacggacgagggcgtccacatttcgcgctttgcgcgcggacgacgcgagtttgttggcgcggtcggcgttacggtactgattggtgccaaggtc

SEQ ID NO: 94943 - DNA, 510 bp, Heterodera glycines
  SCN-specific regions: Sequence locations=1-223,256-445,498-510
gtttgagataatataaaacaaataaaacaatatggaacgcacattcatctgtttgaggcccacaaatccgtcgccggttggacgagtgattgcccgctttgagtctaatggactcaaattgatcgccatgaaaatgattaacgctacacgaaatcaagcgactgagcattacaaagagtacagagacagaccgtttttcaacaaactgatcaactacatcacgtcagggccagttgtggccatggtctgggaaggaattgactcagtcaagaaaagtctgcatctgctggagtcggcatgtttctacaatttgaggaatatggatgagtgccgtgacattgtgcgccatggttcgtgcaatgtgcaggacgcacaacgcaaaatcaacatttggttctcaccaaatgagttgcgcattaattccacaagcagataatcccaagcgaaattattatttttttcatttttattttaatttatattaaattgaataaaatcatcatttaaaaa

SEQ ID NO: 94944 - DNA, 512 bp, Heterodera glycines
  SCN-specific regions: Sequence locations=1-41,63-475,502-512
caagtttgagatccattttcataaaaatgcataacttttattttcctcttctttcctttgtcatctttgtgtatttagcccatttctcagacgcaaccaaacaaaaatttcttggcggcgcccatggtaacgatgtggacaatttggatgcaccaaagcaacacattctcggcggagttggtggtgaaaaacagctcaaaccggacgatgcccagccaagaagaatgcgtggagcatggccatggattccacctcggaacgacaccaatggccaagaacagcgaaaatttctcggaggagcgaaggttgaaacagtgatgatcaaaccgccggaggcggatgatcagaaacagcagcaaaccattcttggcggagttcatggaaacgatgctaattgaatgaaaaatgtgatcggatatacacccgtccctccctcatttaaaaacatttgcaatttgacgaaatatccataaagataatgataaatatataaataaaaactgtcacggaag

SEQ ID NO: 94945 - DNA, 575 bp, Heterodera glycines
  SCN-specific regions: Sequence locations=1-268,296-328,355-575
gctcgtcaggaggcccatcaaataaggggtcggattcgactgctcattggtgacagagatttggaattggctgccaatccatcgccgacaacaaatgaagacgttaattacggattccgttttatctcggaaaacaatcttaacgccgacgacaaccaacaaatccctaacattattgcctttggacgagaaaatggtgaggcagacgatgaccaaaacgagaacaatagcgaagagggaagagagatcgaacaaacgcaaaacaccaccggagaagaggaagaagaagacaacgcaaccgacgacaatgtcggcatgagttccactgaaagtgatggccaagacaaaatgaaagccaacaacggaaaagggacttgtaaaaatgaagacgaatccaagccaagtccaacggttgaaacagaacagaataaagtgcatcagtccgcttctgaaactgtgataagtcaaaaggccaatgccaacaattcggaggaatgtaaggaaagcaatggagagaacggcacgcgcatttcaatgaaacgacaacggcgttcacattcagtggacagttcgcc

SEQ ID NO: 94946 - DNA, 344 bp, Heterodera glycines
  SCN-specific regions: Sequence locations=1-344
cgaggaactcactttttggctgggtcaattttcttcagtgcgctgacagtttcctgggtcctttgggacaacagaaatcagcagcacaaaaggacttcctccgtgcgctcaattttggcgtcggcacaacggcaaaagaatatggaggaatatttggagcagcagaaactttatgaggagtacaaaatgtcagtttctgacggtcataattaaacaattatttgatcattcattttgtcattaattgatcagtcgttgttttgtttatgtcgttattaagaagtgatcttttgcttttctgctgtaattgacatgacttttaataaacttattcaattcaaaaa

SEQ ID NO: 94947 - DNA, 696 bp, Heterodera glycines
  SCN-specific regions: Sequence locations=1-696
cttcttttgcacgggagcagacggcgtaaattcggacaatgagcggcttctccgagggcactttccatcgcaattccacgccgaataacacattggccacgactgcggtgccggcaaattataaaatgtcgatgatcaatgatcggaatttgtttggcaacactttgctgtccatcagtccgttgcacgacgaccaaagcaagagcgggcgattggtgcctttgctgatgcgccatcaaaaggaggccaagtcgatcaaccaacagcaggcttttctcggtcgttccacttccgtgcgcgacagggccgcccaactgcgcaagcccatcgacttggacgaggtggccatcgacgcggcgcccttccaattggtcatcggcacttcgctgtaccgagttcacacacttttcgcgttgctcggcctcaaccacgcttatgtcaccaacagaggccgtctcgtaggcgtcgtcgcattgcgcgagctccgtgccgccctcgcccacatttacacccgcggcgctttgccgaccgcccagtcgatgtcgcgacttcggctgaacagcttgaactttggcctctgttcaactgatcgaagccgcgcgaacagcggcgtagaaggaaacagcgacaatctgaacggaagttcgctgaggacagccatgtcgccaacttcgctcagcggcccattgacacaaa

SEQ ID NO: 94948 - DNA, 635 bp, Heterodera glycines
  SCN-specific regions: Sequence locations=1-13,35-45,67-230,252 -306,328-464,486-567,609-635
tagaaaacttagcaaaaaatggccgacttcgaagggcgtgtcaaagcttaccgcttcgtggcttacacgaccgtttctttctccatcatctcacttttgtcggtgtgcttgacactgccaatgctgaagagttacgtgtcgaacgtgggcatgaaaatggactcagagctcagctcatgccagcacaatgccaaagacatttggtccgaagtcagtcagctgaaggggctgcctctgctggtcgccggaaaccgtacggcgcgtagcgcatacggtagctgccaagagtgttgctccggtggtgcccaaggccagcccggccaacctggacagcctggacgacccggaaacccgggggcacccggctcaccaggacagcccggacaaaccccgcagacgccttgcgagcaagtgcacccgccgccatgcaccccgtgccctggcggtcagcccggaaacaatggcccaccgggacccccgggagcgcctggatcacccggtcaacctggtaccggaggaggacagccgcaaccgggagagcccggcccacctggccccaatggccagcctggccaacccggacagcccggagcgcctggacagcccggacaacctgccagcccaccgcagacgga

SEQ ID NO: 94949 - DNA, 788 bp, Heterodera glycines
  SCN-specific regions: Sequence locations=1-25,47-57,79-168,195 -477,499-718,741-788
ccaagtttgaggtagaaaacttagcaaaaaatggccgacttcgaagggcgtgtcaaagcttaccgcttcgtggcttacacgaccgtttctttctccatcatctcacttttgtcggtgtgcttgacactgccaatgctgaagagttacgtgtcgaacgtgggcatgaaaatggactctgagctcagctcatgccagcacaatgccaaagacatttggtccgaagtcagtcagctgaaggggctgcctctgctggtctccggaaaccgtacggcgcgtagcgcatacggtagctgccaagagtgttgctccggcggtgcccaaggccagcccggccaacccggacagcctggacgacccggaaacccgggagcacccggctcacccggacagcccggacaaaccccgcagacgccttgtgagcaagtgcacccgcctccatgcaccccgtgccctggcggtcagcccggaaacaatggccccaccgggacccccgggagcgcctggatcaccaggccaacccggtaccggaggaggacagccgcaaccgggagagcccggtccacctgggcccaatggccagcctggccaacccggacagcctggagcgcctggacagcccggacaacctgccagcccaccgcagacggagccccctcctccaggcccacctggagaggctggtgcacccggacagcccggtcagcctggagcccctggacagcccggcgcgtccggacagcccggcccgaagggaccgcctggaggcccaggacagccaggcaacggcg

SEQ ID NO: 94950 - DNA, 890 bp, Heterodera glycines
  SCN-specific regions: Sequence locations=1-153,180-227,249-300,322 -583,607-656,678-733,755-890
gctttgcaaaaaaaaatggccgacttcgaagggcgtgtcaaagcttaccgtttcgtggcttacacgacggtttctttctccatcatctcacttttgtcggtgtgcttgacactgccaatgctgaagagttacgtgtccaacgtgggcatgaaaatggactctgagctcagctcatgccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccggaaaccccggagcgcccggctcaccaggacagcccggacaaaccccgcagacgccttgcgagcaagtgcacccgcctccatgcaccccgtgccctggcggtcagcccggtaacaatggcccacctggacccccgggagcgccaggagcacccggccagcccgggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctgggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaaga

SEQ ID NO: 94951 - DNA, 1027 bp, Heterodera glycines
  SCN-specific regions: Sequence locations=1-168,190-195,225-442,464 -471,494-498,548-1027
gtataattgcttaagttaggccggtgtttaggcctaagctttcggctaggcctacgcttaggcttgattgggtctaggcttatgattagcttaagctttattttgtaaaatatgagttgccttttgtacaagttgccattgagccattttccgattatacaaaacatgtagaagccataaaaatctcatccctacttattttatttattaagtaattaatttttctctattttcagtaaatttatgagttcaaagcgcaaattacaggtttcttatttaaaagattggccattaaaaaattgacgaaacccaactcgtacttggccaacacgtactgccccaactcgtactgtttgacaaaaaaatcgtcataactcttgcaaagtcgactaaattaaactttcttggtgccattcgataactcttaaagttctccatctacatgaagcaaaatattagaaaattttattgcttttcaaaatttatgaccaaaaatggtaaaaaaatttttgttaattttttcaaattttttattctttaattttttcacatttcaattaattgtctcccccattggttcatttccaaaaggtaataagcggctaagagagagaggcgtgcgttgttccaacggccgcgccggcggcacggcgcggggtcacgcaagaattcggcacaaattacattccctctgaattggtccaacggcagacactccgtgagacgcgcaaaagcgtggatatcggctgatttgcaccgggacaaccaaaagcaggagaatattttgctgtccgtgctgcgcaattgggctttcctgaggcgcgtcctgtattacgcggtctgtgcagttgccatgggattggacatgattcacaccatcaaaattttcggtcgaattcacataactgagacagcactgaacgcgttgaacagtgcgtgccgtgtggaagtgggcagcgggccggaacattcacggcaccttgttgagaagggaatcaagcagacatcgctggtcgtctccgaggag

SEQ ID NO: 94952 - DNA, 494 bp, Heterodera glycines
  SCN-specific regions: Sequence locations=1-86,109-494
ccaagtttgagtaacaacaatgaaaagcttacaatagttctgctatatatataacttacctattgctttcgcacatttttcacaaggatttattgaaaaacaaagaaatgaacgtgtcaggccccgcgattgatcaaagtgaaaaaaatcggaaactacttcaggatttgcaaaagaccaaacaacaaatgatgatgaggggtgccagtgctgtgagtcgttccgcccaatcgccacttttgccttccgcttcatcgagcagtttgtcctccctacaacaagcatcgactgatagtacgcagggaacattcgccaccagtgggcaacaacagcacggcactttagcgaataaatccaacacaatgctcgccatggaaatgatccaaaaatccagtataatcttttacccgaccaactccaattatggcaaccaacttctgcccgggtttccccgttttttggctgactgataaaacattttacggagaaaaaaa

SEQ ID NO: 94953 - DNA, 171 bp, Heterodera glycines
  SCN-specific regions: Sequence locations=1-171
gccgtacaaagacggacttttgactctggtcaaagggaattgatcggcggaagaagcgatctgaagatgattgatcattggcattggattgattgatcggatttgccactcgctttatcatttattttgcttgcatttggtcagtgtcaccaattgtaaaggtcaaacgtt

SEQ ID NO: 94954 - DNA, 669 bp, Heterodera glycines
  SCN-specific regions: Sequence locations=1-263,285-422,444-669
gtcgcatattggcagcggtgggtctcacaaacaatagccaaatttattaaaatgtctgctgctaatgatgttgctgcaactgctaatgatccatcaactgtcgtttgtgaagagaaaaaatcttccgccgctgaagaggaactcattgacgttgttactgttggggaaaacaatccgacggggagtgccgggacaaaaactggggagtccgacgaagtttttgttgtggaacaaatcaaaaacaagcgaagtgtgaacgggacggatgagtatttgatcaaatggaagggttacgacgacgagcaagatgacacgtgggaacccctggaaaacttgcattgtcccgaattgctcaaggaatttgagacgaattattgcccagcaaagacaaagcgtcgcaaaaaaagtagcggaaaagtagccaaaaagagaaagatttccagtgactcaacactaccaacaattccacttgtgctgaaggatcgttaccacatcggagaagatggagcagttcctgaacatatcattggggtcatgaaacacgaagagtccggcaaaatgatggctcttttgacttatacggacgacagagaagcgacggaatttgtacctacggaaatactgctggagaacaaactaaccgcaaagatgattttgaatttctaccag

SEQ ID NO: 94955 - DNA, 1009 bp, Heterodera glycines
  SCN-specific regions: Sequence locations=1-247,269-541,563-924,963 -969,993-1009
ccaaataagatatttaatccatttattggtcctttattttcgttcttgttgtctgctgattatgggcaatgaacactcaaatcgctcaaagggtcatccgtcatcttcgtcttcctcaaaaaaggatagtccggcgactcgccttcaaaaagcgctgccgtccgcgctaaaattcggctcgaatgatctctcgtcgagtgccttacgacgccttttggaacagtcgaagaaaagtcgaagtttgcaactgaaaggggccggcatcaaaagagtgccgtcgggaattgtcgaggaggtccattctttgctcagaattttggagctgtcgtcgaacaaattgcgcgaattgccttcgaccatcggcactttcagcatgctcaaacagttgtacatcgccaacaaccgtctgaccaatttgcccgacgaaattggctgtttgaagacattggaattgctcgatgtttctggcaatcagctcactgaactgcccgacccattggccgcgtgcaattcgctgacccaaatgaacgcgtccaacaacaaattcagcacatttccctccgtcgtgacgcgactgctgcggttggaggtcatcgacttgtcggagaattcgatcactgaacttccggacgaaattgccattctgcgcgccactgaactgatcattcggcgtaaccaattggccttgctgaacgcctccaacttgaccaaatgcgagcacttgaagattcttcgcgtggaagagaactgtctgccgagggaggcgttcactgccgaacttctcgaaaagtccgagctgactctgatcactcacgagggcaatcttttcgcggagaaggaatttcaggcactccccggctacgacgcgtacgaacagcgttttactgcgacacgccgcagacttttctgattgtgcgaaataagaaaataattataaatttctaaagataatttttatttttgtacttatttttgctttccaaaatgtttttaaagacatttggtggcc

SEQ ID NO: 94956 - DNA, 617 bp, Heterodera glycines
  SCN-specific regions: Sequence locations=1-564,586-617
gagtcgaccatattccaatatattaaaatttcttaactatgtcgacctcttcaaagttgacagtgatcaacaccattgcgacaatgcgacaattcgtgcgcaaacatcgtaaacagaacgccaatctttgcgtggcattagtgccgacaatgggtgcccttcaccaaggccatctccgactggcacaccaggcacgccaatggcataatgacaaaaaagaacaaaatggcaccactgatcagtgcgcctctccgcccctggtgatcgtctccatttttgtgaatccgcttcaatttggcccaaacgaggactttgaacgctatccgcgcacattggaagcggacttggccaaattggagggcgtcgtggattgtgcatttgtgccaaatgccgtggaaatgttcggggaggaaaagcaaccgctgaatcacaaggatgaggaggatgggatcggcattaaatccggacgcattggacgtattttggagggtgtcacacgtccacagtaccatgacggaatgttgctgcatgtagccaaacttttcaacattgtgcaaccaaatttggcattttttgggaaaaaggatgctcaacagctgttcgccatccaccaattg

SEQ ID NO: 94957 - DNA, 387 bp, Heterodera glycines
  SCN-specific regions: Sequence locations=1-387
cgtggatctacaattaaatatcttcgaattccggacgaagtggttgatctggtgaaggacgaagtcaaggaagtccgacgtcagcaaaaagataaccaacggatgaagaagcaatttgcaaagggaacaaaaggtgccggtggtccatcagctggaggcggcagacctcaacagggcggacgaccgggcggtgggccgtcacgaggggcgtacagaggcggggcacatccgtcgggaggccagccaaggagaaactgacaatgcattattttcgccatgttttgttgtttgctagatctccatttggaaccaattaacgctggaataaatttccaaagactttatgacaattacaaaaaaaaaaaaaaaaactcgagggggggcccg

SEQ ID NO: 94958 - DNA, 921 bp, Heterodera glycines
  SCN-specific regions: Sequence locations=1-898
gtccaattaagtttctaatggcctctcctcctcataacatagacttaaataacaaaacaacggcaaaaatggcggtcaaatggcaaaaactgttgactgacttgacttcgtcctgctctcggctaatttccagcgaggcgttgggtttaccgccagcgctaagcggaggcccaaatctccgaaatgaacggccgtcggcggagggcccttcgaaatgcatcaacgaaattcgcacaatcgcagccgaattaagccccgaaatgcttcggtttggccccgtcaacccttcccttctatgggcctcgagtttttgtgctccggtgtacgagcagaaggatctgttcgaaatgcacgtgttcggcctacgctccgccggccattccattccgttgcacgaccatccgcggatgtacggattcattcgtccgctgcacggtcgcatacgaatctgcactttttcatggttggagcccgaagaagagcagaaaattgtcactgagaggaggaaacgcgcgggaatggccaaaggagcgtcgggagtgatcagacgaccggccaaatttacgggcgaactcatcttggacggggcctgcaaagacccgccgattgccatcgtcgagccgaacacagcaaatgttcattccatcgaggcgttggaggacggcgccgctttcttcgaccttttggtcccgggttacaacgacagtcgctcgtgtaattattacactctgtcggatgacaagggcaatggtaaaattgggatcggagacttcgtttggttggagggttcagaagaagtgcctagagaatttaccatgcaacagcttcgtttcgatccattccttatgtcaaataccaacagattcgattgaaaatgtcggaaaaatagtggcctaactaatttattttattacttttaaa

SEQ ID NO: 94959 - DNA, 478 bp, Heterodera glycines
  SCN-specific regions: Sequence locations=1-149,172-478
taaaaagaaaaaaaatgttgttttatgaccatcacacgagaacttgttgttttttcaacgtgcaaaagtgcgccttcacattcgcactcatcggttttgtgctcaatttggtcgcattggtcccaatatttttgccatattcgcccacttctcaagaaaagccaagcatttacattggcaaatgcttgcacatcctgttttctgcgatgctgtttttgtcaatcatgttggcctacaaacttcgcaaagcttggctctatacgccataccttatttacacgggaatttcgttggctcttgcagtttttggctgcttaacctatttgtactttctgattacggacccacaatcactgcttgacgacaattggcgaaaagcacacccgggcaaagcaacgaacgattcagaggctcgcgcaattgcgtcggcttggcttgctttgatgttggtttatttgctgttcagcggttggattta

SEQ ID NO: 94960 - DNA, 431 bp, Heterodera glycines
  SCN-specific regions: Sequence locations=1-431
acaaaagaaaagagtaaaaataaaatcatacgaaaatacaagaaaaaaagagttagtcatcaaaggtcagtgttaagtgagtttaaagtctgagtctttttggaggaggtgtaaaagcagtcggggaaatatgaacaatttcggtcaacaaatttcacaaaatccatgccgtaggagaggcaaacttgcaacagagcctcacagtccgattgtgcccgatgaaattgcggggcaatggagaaaaacctcttgaacatgttctccagtttgaaattgccacgtccgcacaacaaccgcctggcatggttaccattgaaattccattcaccgcgattgttgctctcaaaaaatttggcgtcaatgcagcggcgtttggccggcgaccaatgcgttttgcgcatgaactgtatcgggtgaacatcctcatcaaa

SEQ ID NO: 94961 - DNA, 360 bp, Heterodera glycines
  SCN-specific regions: Sequence locations=1-360
gtttgagctaaattttaaatttttcaaaactgattgtgagacttcattcaaatgcagcaacaacagcccgttccgaagtgtggcaatgtgaaatgcccctgtggagacgcgtgccagtgcggcactgactgcaaatgcggtgcgaaggaggccagcaactgcgcgaacgagaagtgcgtttgtgagaattgcaagtgtggcgccgactgcaagtgtggccagtaaacgacaccgaagaatgggccggagggttgtgataagaagagcaaaagacagttaccttatttaatttgatcgtgaccgaccataattttgacatgtttattttaaaatgctgattgatacaataaatattataag

SEQ ID NO: 94962 - DNA, 617 bp, Heterodera glycines
  SCN-specific regions: Sequence locations=1-318,342-588
caagtttgagataaacttaaaaatattttatgatggaacgccgaaacagcaccaaaaatggcggtctgtcccccacccctcaagagacgaccattaatttgcccgtttcctccaatcgaagggcttcgtccgcttcgattctttttgcccaggcgagtttcgacacgggcctcgacgtgagccgcgcctcgcaattgtcgtcccagcggaatgtgctgagtacgcacgtgatggacttgggcagcggcagaccgtgcagtggcatccaatgcaaagcgttcaaatgggacaaaagccattcggaatggattcaaatcggagacacggtgaccaatgcgcaggggcgcattccgctggtgcaccccggcacttcgctgtccaaaggcctttacaaattgcgttttgccacgaaggaatattacgcacgtcaccagctgaagtcactgtttccgcaagttgacgtggtcattgaggtggacgacgccagcgaacattgccatgtgccggtgttactcaaccatttcggctactccgtttataagggacactgatggaatattccctctctcattaattctcattttggtgtatattaaaaacaaataaaataaataatt

SEQ ID NO: 94963 - DNA, 571 bp, Heterodera glycines
  SCN-specific regions: Sequence locations=1-11,34-314,388-486,509-571
ctttttagctttgctcttaaaattctttctaattgctctgcgttaataatttggcacaatggtttgtgtttctaaaacgccgcgttctctccccaaaaaacgacggcaatcgactgagcaaaacaccgacactcctccaaatgaccatcccgaagtaaaaaaggccaaaatcgaggatctgctaaaaaagttctccaatggagggttcgatcagttttggaatgaaggattccaaccggaagaggaaccatcgcccgacttttgcaattgggatttcggcaaagagccaagaaaatgcgttttttgcattgcgaaagaagaggaagaagagtgggaagaagaagaggaagaggacaaagaatgagtggaagagagagaatgagaagacggggggagccgcgaaacaaaaagcaaaactttagagcacatcgaacatctattattaattcttaatatcaaatacacgaaaaaacaaaaacttaaaagaataataataattaatttaattgtgaattatcataattaagtttgtaattttttttgttctctctaaaataaaacgatttattcc

SEQ ID NO: 94964 - DNA, 731 bp, Heterodera glycines
  SCN-specific regions: Sequence locations=1-549,574-731
aggacgagccatggatgccggcggagaaagtatacacaatcaaaggccgtggtacggtgatcaccggcaaattggagcagggcactctgaaaaagaacgacaaagtgaccattgttggactgggcaaaaaattggacaccacaatcgccggcttggaaacattccgcaaaacagttgatcaggcggagcccggggaccaattgggagttctcctcaagggccttggtccgaaggacgtgcgcaggggaagtgtgctgctcaaacagggccaagacgcacattttacggacaaagttcgagcgcagatttacttgctgaaaccggaggagggcggctccaaaatgccgttggcccacatgttcaaggagcacatgttttcattgacatgggactcggcggccaccgttatgttgcagggccgtgacttcgtcatgccgggcgagactgttgagctcgagtttctgttcaacactccccaatttgttcgtccccaacagcgtttcactctccgccatgacaaaaccacaatcgcctgcggcgtctttttggaggctcttcccgagtcggagggcgaaattcccgacaaaaagtggaggaaaatgcaaatgcgaggagtgatggaaagggttggtttcaatccgttcggcaaccgatcgtttgagcgagcgtgcaaacctgactataccaattcgccgaaggacaacccggccgaggcattgttcaaaagcgaa

SEQ ID NO: 94965 - DNA, 529 bp, Heterodera glycines
  SCN-specific regions: Sequence locations=1-529
ccacttttggtgaggaagttttcggcaatttccgcttggttgcgctccaattgagggacttcgtttcgtcgcgctctgttcaggaaaagttgggcgttgtcaacagttcccttgcacccataagagacgcggccaacgccactgaacagttcatccttgacgagcagcgcaaagtgttgccccgtgccgtcgccatttccatgggcggcatggccggctttgtggcggccatgcgaaagggcggacggatgcgccgcacattttatcctttgattggactgctgacaatgaccgccttttgctacccaaatgagacggtgcactccgtccgcgttggcattgcccactcgcagagcgcatggcacaacttcaagcaggcgcctgaaccgaagagcagttgactgatgaacaattcaaatttgtgcatcgtttttggccattgtcaaggggtgacgaacacacacattttaatgttgtaggatttaaattttaaattctgtttttcggtctgataaataatttcaattaa

SEQ ID NO: 94966 - DNA, 628 bp, Heterodera glycines
  SCN-specific regions: Sequence locations=1-558,582-628
gttgttttgccattgacactttcagcaaacaaacaaaaaaaatgggcagcagtgcctccgaatcgccgccaccgccaaaacttgtcgccatccaagacttgcccatttacaaggccgagtccgtcccggccgcacgtgctgcacggcccgtcgacaccattggcaggccggccacttttggtgaggaagttttcggcaatttccgcttggttgcgctccaattgagggacttcgtttcggaaaagttgggcgttgtcaacagttcccttgcacccataagagacgcggccaacgccactgaacagttcatccttgacgagcagcgcaaagtgttgccccgtgccgtcgccatttccatgggcggcatggccggctttgtggcggccatgcgaaagggcggacggatgcgccgcacattttatcctttgattggactgctgacaatgaccgccttttgctacccaaatgagacggtgcactccgtccgcgttggcattgcccactcgcagagcgcatggcacaacttcaagcaggcgcctgaaccgaagagcagttgactgatgaacaattcatttgtgcatcgtttttggccattgtcaaggggtgacgaacacacacattttaatgt

SEQ ID NO: 94967 - DNA, 750 bp, Heterodera glycines
  SCN-specific regions: Sequence locations=1-89,111-721,745-750
gagcagaagacgaaagagcacgcgatgcagtccaagcagcaggccacgggaattgaaagccaaggaaacgatcatccgaaaacagtttcgacaagcggtcaaaattcaaacgcgccaattcaaagcgtaccaatcccaaatgctccaaatggcgccccgggaggagcacagagaactgctgaaccgactgaaggaggaacagagtcggaagatcgcctcccttgcggaccaatacgaagcgaccattgaaacgatggtcacggaacaaacgatcaaattggacgcccaacaggaggaggacttgcgacagctgaccgaaaaactgaacagggagctgagcatgttgacggagtaccaggagaaacagcgggttgaactgagcgcacaaattgagcgcgagcgagtgcaactgcaggaccgcgtcaaccttcggcttgctgtgctgaaacagaaaatgaacgaagaaaaggtccattttgagcggaacagagagcgacagttggcgcagttgcacgaccgacaggcgcaagcgttgagtgccttctccgtcgatgagagacggaagaaaagttccatgggaagtgacgggggacggaacgacgcgtcgtccacaaatttgtgaattgggcccagcgggcattcgttgccttttctctccttttgtcgccttcaattttcaattgtttcgacaatttttacttatctttttctttctccaacgaatttttgtatgtttttgtctttacttat

SEQ ID NO: 94968 - DNA, 626 bp, Heterodera glycines
  SCN-specific regions: Sequence locations=1-29,51-374,397-580,604-626
attttaaaaaaacttccaaccaattctcttttcgtcaaaatgctttctcccttctcctacgacccgttctatcgccgttcgttgtggcctatgaccaccgttggcaacgtcctttcgcccttccgccagttggagcgcgaactcgaccacttctttgacgggatgcagcccatgcttcgtgaccacgccgctcaactgaacgtcacggacaagggcgaactcacttacaaagtcgatgtcagcggcttccgccccgaggagatcaacgtggaggtgattggtaatgaaatcatcgtcaatggggaacatcgcgagcagaacgacagcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgaaccatcccaattgagatgaaaaagaaagcggccgtggaacagcagccgcaagcggagaagaaatagagggggacaaatggagacgacggaccgatcgatccattaatatgggtctcctcctttggacattttaaattattttcaacaataaagcgttttttctaaaa

SEQ ID NO: 94969 - DNA, 214 bp, Heterodera glycines
  misc_feature (214)..(214): n is a, c, g, or t
  SCN-specific regions: Sequence locations=1-214
gatgaattgatcggagaagtgctcaacttaattcacgcagaaagcccggaacagtgaccgtcttgatgcttttaaatgcacttacgagaaaaaaaacaattccgcattttggtctcacttattatgctcattttatcctctcaccaacatatgacactgtccaatgcttcttttttttgcatttataaacggtgagttggatcagaccgggtcn

SEQ ID NO: 94970 - DNA, 478 bp, Heterodera glycines
  SCN-specific regions: Sequence locations=1-142,166-478
aaagttgctcgtccaacgccaacttcgctctcccacgaggcgtacgaaccgcaactgatggcctgagtggacatttaccggaccaaatgcaatgccaggcatggcgcaacggcaaaatcggcggtgccgacggttgacgaactgttcagggcacagcttggtcatttctacgctcagattgatggcattgtgtttgaagattttgtcaggtccgccgtcctcggtcagcttttacgcctccatctgtcttctgctcgttggccatgcgttgcatgggcaccgactggcccttctccgccgtttgggccccgcttggctaggccgagtccgcgaacagttggccgactgccgagccatggacgaggcggacaaagcggcacaatagcagcagaaacagggccaaaaaaggcacaaaaacgggacggacatgccgaggacgacgatgggatgagtgcggaattgagacgacaaatgactt

SEQ ID NO: 94971 - DNA, 436 bp, Heterodera glycines
  SCN-specific regions: Sequence locations=1-436
ccaacggcaaaatcggcggtgccaacggtcggcgaactgttcagggcacagcttggccatttctacgctcaaattggtgacattaagtttgaagatccgccgtcttcggtcaatttttacgcctccatctgtctgctgctcgtcggccatgttttacaagggcaccggccgacccttctccgccgggtgggccccgcttggctgggccgagtccgcgaacagttggccgactggcgagctatggacgaggcggacaaagcggcacaacagcagaaacaaagccataaaaatccgcaaaaacgggatgaacacgtcgatgacgacgatggaatgagtgcggaattgagacgacgaatggctcaatcggtggagcaacaacagctgttccgaatgaacatgtttaccttccaacttgacgaggcggaacgacgtgttc

SEQ ID NO: 94972 - DNA, 420 bp, Heterodera glycines
  SCN-specific regions: Sequence locations=1-420
ccaagtttgagatttataaattttcctgccctaaaaatggtagttgaaatgtcttccggtgctgcaacaactgcttctgccgctgctgttgctggaactgctccgtccgctggccctgtgccctcatgcatttgctcgtccacctcgcagctgttgacagcggccggcatggacggcattccgccggccaaaacgcccgcaaattcgggcccggacgcaaattttcttgccgattcgttgggcgtctcaccgctataccgccaagaagatactaaacgatggcaaaccgccgccaaagtgtaccagtcaagccgtagtcaaatgcacagtccaacctccggcacttgtgcaccgcagcactttcattttggcgaatcgctgacggcggagggccatttgacgcaaaaaattcgccaatgc

SEQ ID NO: 94973 - DNA, 1280 bp, Heterodera glycines
  SCN-specific regions: Sequence locations=1-334,363-384,413-814,840 -1039,1089-1217,1240-1280
atctttttgcatccccgtcctgacatcatggacgatttgtgccgtcgtgggctgctgaccacggaacaaaccccgcacgagccgtcctccgcagacaaatttgacggagcggatgaagcggtgttggccctggtggacaaataccgacgcacttgcggactgccgaccgccaagcgcagtgcgccctcaccgctcaattcgctgctgtcgccaggcaaactgccgcccgccggaaagccgccgacgccgtacatcccaacgccaggcggttccgctgggtacgcgccggccgcgttgctcaagcaacaacagcgcaacgcctcctttgggtatcactcgaacagcagcagcagcaaccaggacgactggcaggcacttcttcaaccaccgcctccaccaccgccgccgatgccttcgttgtcgtcagtgcagactgcgcttagcggtgggacaccgcgcggtattctgagccacgcgtcttcggctgctgctgcggcgcataaacgtgacactttgcgctcacccgggacagaggcgcgacgaccaaagaatcagacactgttcaaaaatgcgctggagcaaatccgtaaaatcaatgaggagtcaaagtcgggcagtggcactgtgccgtcagcgacttctgtttcggatccgtttccatcatcatccattcctccacttaaaacgccgtctccacttcgtccattgatctcaaccatttctgcaacttcaactgaacaacaacatttgccagcacctcctgtgcctcccaatcttccgcgtgacccacgactgctcaaacatggcaatgccaccgctgccgccgtcgttgttgttgtagacaagccaaaccaacaacaacaagttcgatgtgccacaattcctgtcgatgctcgccccaattctgtcctatcgccgccttgcgacccacgtctgaagcgcatcagtgctgaagcattgcctgtttcgtcgccctccgtccttccgccactaccaaagttcaaggcaacggtgcccgtgttgaatgtcaggccggtgtcctctgctgccgccgttgttgtaccaccgccgccgccgtcaccaccgccaaatgtgtctgttttcaagcaattggtgccatctgctgcttctgtttcgacgacggcgccggcaccaccaaatttgggtttcaaacgcgcatatggccttgtcggaatggtatcttccggcattgatataccgccaccaccacctccgccagaacttgcaccgccggaggagaaaaagatgatgttgcagcc

SEQ ID NO: 94974 - DNA, 474 bp, Heterodera glycines
  SCN-specific regions: Sequence locations=1-32,54-76,99-305,327 -338,360-474
ggacaatcaccgaaagctcatcagagttaccgctcctcctccgcagaggcaacaacaacaactgatcaatggcgtagtaatgtctcacaatcaacatttgcacgtgccgaacacggcaattggtgggaggacgacgacggtggacatggccataccccaacggcagcagttgtccgacagtgaagtgttgccggtgcatcatcattgtctttatcgaattgaccacccacaaattctttcttcgggcactgcgacagacttttcggtccttcagaatttcccggcggccaaacctcgcaatgccgtcaatttgaacaataacaacatgcaacaatttgtgccaacaacagaatcgttttcgtcgccttcctcgtcgtcggcgccaaacactgccattgagctgacattgatgaacggcgaattgtcgatggactcatccgctaccatttctcagtttcatccaattgtcttgga

SEQ ID NO: 94975 - DNA, 459 bp, Heterodera glycines
  SCN-specific regions: Sequence locations=1-459
atttggttgtctctttcttctcctttctctttctctatgttttccatactctctcctctccttccatctgttttaatttaccgttcgattcgttcactttgcgcagtttcccctggttcagatgcaacttcggtgcgtaaatgatgtccttcaccaagttggccatgtcttctcccaattgtccgctgtgcgtccattcgtccaccagcaaatcgcataagcggatgaacgaattggcaccgctttccagcagtacgacgccacggcggaagcagtgtttgagttgcagcaaagggtaaatgctcagcagagagatgtacggcttggaaaggcgcgtgccggcgccctcaacgcactgctccaacttaatccatctgaccgtgccatattagagtgcttttccatgctggataatgccgaccggtgcgtctgttgccaaaagagcgtttgctgaacatt

SEQ ID NO: 94976 - DNA, 1090 bp, Heterodera glycines
  SCN-specific regions: Sequence locations=127-128,200-204,502-583,605 -993,1030-1090
ccgcctggacccagcactgaaacacccggaccgcctggacccagcactgaaacgcccggaccgcctggacccagcactgaaacgcccggaccgcctggacccagcactgaaacacccggaccgccttgacccagcactgaaacacccggaccgcctggacccagcactgaaacgcccggaccgcctggacccagcactgtttttcccggaccgcctggacccagcactgaaacgcccggaccgtctggacccagcactgaaacgcccggaccgtctggacccagcactgaaacgcccggaccgcctggacccagcactgaaacgcccggaccgcctggacccagcactgaaacacccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgccggaacttcctctacaaagacctacactgttccaacaactccaaaaccacctccgtgttgttatggctgtgactaccctgtcgactgccacacttctgggaaggattgcgactattccccgcttcagccgccttatcaaagcgacccttacccggttgggaagtgcgtcttcaaaaatgtcacttgcgccgctccaaacaccggcaaagtgctcttcatgaagctcaacaatgaccccaactccgtcgtttcgtcttccgtctcaccgttcaacaaagtcacagtcattttgcagtgcacctgcaaaccgtacttcgcaccttattgggtccaagtgggcgttgacggcaacccggccaagcaggtcaacgtcaaatcggcaacctgcggacgtcactgttactagaaaatgatgaccactcattgtccaacaaaagaattaagcaaaaaggaaattaattagaaaatcaattagagaaaaatttccttgcgcattttttaaattgtaattttctttattaataaatatgtagtagaaaagaaattgtcgagtagaagaatatcatattattcgatataataattttttg

SEQ ID NO: 94977 - DNA, 696 bp, Heterodera glycines
  SCN-specific regions: Sequence locations=1-601,624-696
catgaataaatggcttctactattacgcacgtggtcttcgaccttgatggtgttctgatcgacactgaacgtcattatacaacggccaacgagcggacgttggagaaatttggagcaaaattcactcgagaaatgaagctcaaaatgatgggacgcaaaaagacggaggcggtcacggttttgctgaaggatgcggggatagcggatcgcgttacgatggaccaatacattgcggagtacgacaaacacgtccttcaaatcatgcgcgctcttacggaggaattgcctggtgccaccaaattgatcgaccatttgtacgcccacaacattccaatggccatctgtacgggatcggacaacgaggagtttgcaagcaaaatgcttaaatttgacgaatggcttaagaagattccgcttcgtgtgctgtgcgggagtgatccagaggtacgcattggcaaaccgaatccggacgcatacgaagtgaccattggacgttttgctgccaaaccgacttcgccgaagaatgtgctggtgtttgaggactcaattaacggagtggaaagcgcgttgggtgcgggatgcacggtggtgatggtgcctcagcgtgagtttctgccgaatgattggcccgagaaagaactccgttcgcgtccaaattttgccgccttgctcgattcgcttgacaatttttgcccg

SEQ ID NO: 94978 - DNA, 420 bp, Heterodera glycines
  SCN-specific regions: Sequence locations=1-41,64-420
ctcggaggaaaatgtgccgaatccgcttttgttggagaaggaagtggtgccgaaccagcaggactcggtggaaaatgtgccgaatccgctttgttggagaaggaagtggtgccgaaccaacagaactcggacttaaactcatgtgccatggaatccactcacgtttcgtctgccaatcacttttttgcacagtactgtgccgaaatggttgaaacacttctcgggaaaatgtcggacaaggacgccttccatttgcgcaaggagatgaatgatgttttgacgaaatacgaggccgccaccatcgacgacaaatgagaagagggaagattgattgattgtctgccagtgatttttatgggtttctgcgcttgaattttttccatttgaacgtcaatttcgtcagtaaagcaaaatatattt

SEQ ID NO: 94979 - DNA, 615 bp, Heterodera glycines
  SCN-specific regions: Sequence locations=1-38,60-104,134-141,165 -317,341-615
cacaattacctaatttctcatttccccggtttctttctcttagtaattccctttgatacgccgccttttctccgtccgatggatgtttccctcttccgtttgccttctcttccccattttttcccttctcttccgctgtgtcccttccttctcctttttcttttgtccaatcctccgattttcgcctccgattcggctgcttttccgacgtcttcatgccgtaacatccaacaagcttgtgccgctcaacttttcttcttccctccgttgccttccgtacaggagacggtgccggacgtgccgttggcacagcgactggaggaggaggaggaggaggaggggtccggtgaaggcgcgggtgctgtagacgccggcggatggcattttgtgccaatgtccggccctttgtcttttcctctatacgacgaatttgtgccgacaacgccatcctatgattacaacgcggaaccgctggagatgagacaagtcgacatttgtacatgtccggagaatgatcagtgcagtttcgacactgaaaggaccgtcaaattcagtcctcaaattcgagtcgctttctgcaggccgttggccgaggtgttcaagtcgaagtgcaaa

SEQ ID NO: 94980 - DNA, 423 bp, Heterodera glycines
  SCN-specific regions: Sequence locations=1-423
agattatgaaaagtgatttatattcacaaattgatagaaaatttgaagaatcttctacttcgaatgaagggtcagataatgagctcgtagctgatgataatgcttctcttaattctatgtatatgaagcttgatttcctggaccgggttaaagccgagatcatcttcaattcactttctgtcgacaaagagccaaaacgaagtacaacgagacgattgatgagtttggatggcacaattatcactgcaaaattttcttccgatgatcagaaatcattgatacgaagcgccaataattttttcgacatgtgccaactgagcaaaagttgcatcgatatggcgcgaaattatgcctacaaatctcccaaaatgaagacagttcaaattccgacgaaaaagaaacataacaaataaaatttttatg

SEQ ID NO: 94981 - DNA, 618 bp, Heterodera glycines
  SCN-specific regions: Sequence locations=1-618
gagaaatatccggcccgcaacaatctcgagcaccttgcgatgctcacgtgtacggaggaaccgcacattgtgcgcaagacgggaatcatttgcacgatagggcccgtttgtcgttcggtggaaatgttggttcaaatgatcgaaaatgggatggacgtcgcccggatgaacttcagtcacggggaccacgaatatcacggcggtaccatcaaaaatgtgcgtgaagcagctgccaaatgcaccaagaaacgcaacgtggcgattgcactggacacaaaagggcccgagattaggacgggacttttggcagggggcggttcggctgaaattctgttggagaaggacgcgtccattcgcctgaccaccgactcggcatttgagaagtcgggcaccgccatcaacctctacgtcgactacaagaacataacgaaggttgtgaccaaaggatcgcgcgtgtacatcgatgacggattgctgtcgcttattgtggaagaaattttcgacgacgccatactgtgcaaagttgaaaatggagggaaattgggcagtcgcaaaggggtgaatttgcccggaacaccggtcgatttgccagccgtttccgagaaggacatcaaggac

SEQ ID NO: 94982 - DNA, 1707 bp, Heterodera glycines
  SCN-specific regions: Sequence locations=1-427,449-653,680-729,751 -884,907-1707
gtttccgtcaagagcaaatcatggagaaatatccggcccgcaacaatctcgaacaccttgcgatgcttaagtgtaccgagaaaccgcacattgtgcgcaagacgggaatcatttgcacgatagggcccgtttgtcgttcggtggacatgttggtccaaatgatcgaaaatgggatgaacgtcgcccggatgaacttcagtcacggggaccacgaatatcacggcggtaccatcaaaaatgtgcgtgaagcagctgccaaatgcaccaagaagtacaacgtggctattgcactggacacgaaggggcccgagattcggacgggacttttggcagggggcggttcggctgaaattctgttggcgaaggacgcgtccattcgcctgaccaccgacccggcatttgagaagtcgggcaccgccgtcaacctctacgtggactacaagaacatcacgaaggttgtgaccaaagggtcgcgcgtgtacatcgacgacggattgctgtcgcttattgtggaagaaattttgggcgacgacgccgccatactgtgcaaagttgaaaacggagggaaattgggcagtcgcaagggcgtcaatttgccaggaatatcggtcgatttgccagctgtttccgagaaggacatcaaagacctgcgttttggtgttgagcagggcgtcgacatcattttcgcctcgttcattcgaaacgccaatggcatccgcaccatccgagaagtgctgggcgaggcgggcaaaaacatcaaaatcatcgcaaaaatcgagaaccaggaaggtgaggacaatgtggacgaaatcattgcggcgtcggacggcgtgatggtcgcccgtggcgacttgggcatcgaaattccggcccagaaggtgtttctggcgcagaagatgatgatcgcaaagtgcaacatggccgggaagccggtcatcaccgccacccatatgcttgagtcgatggtgaacaagccgcgaccgactcgtgccgaggtcaatgacgtggcgaacgcagtgctggacagctcggactgtgtaatgctttcaggcgaatcgaccaaaggcgattatccggggggatctctgaaaaccatgcaacaaaatttgtctggaggccgaaaccgcctttttccactcgaggtacttcgaggagttgttgcagaacacgcccagccccaccgggccgggcgaaaccatcgcaagcgctgccgccaacgccgcgaggagatgccgggcaagcgcaatcattgtgctgaccaccaccggaaagtcggcccaggagtgttcccgcttccgcgtgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtggtcattgtcaccggatggcaagcgggtgccggctccacaaacacaatccgtttgcagaaagtcgaataacagagggacgtgtccaatgagcttttgaagacttcgcgtgaccgatgaaaactttttttaggaatttacgcttttgtgacttttgttttcatatttttgttgactcggtgtttattctcaaataaagaaccttaggctttaaaa

SEQ ID NO: 94983 - DNA, 1022 bp, Heterodera glycines
  SCN-specific regions: Sequence locations=33-472,547-547,746-1022
cctcgtgccgaattcggcacgagggtccaattaagcgtccctacccaaatgaatattgtgtgtccgtctcaccctgaagcggatttggtcgaagatgccagggccggcgatttgatttgtactcgctgcggtttggttgttggagaaagactaattgatgttgggactgaatggcgttcgtttagcaatgaaagttcgggaaaggacccctctcgcgtcggtgcccctgagaatccgcttctttctggctccgacttatcgacttcaattgccgtttctttcggatcggacagtgatagagctttggcaaatgcacagaggaagcttttgagcagcaccgatcgacaaatgacacaggctatgatggttattcgtgaaatgagcgagaaaatcaacttgacccggacaatccaagacagagcggctaaactgtacaaggaggtcctcgagtcgaaagccctccgcggaaagaacaacgaggcacaggcggccgcttgcctttacatcgcatgtcgtcaagagggggttcccagaacgttcaaggaaatttgtgcggtgtcaaaagtgtcgaagaaggaaattggacgctgtttcaagctcatccagaagaccatggagaccaacttggaccacataaccagtgccgatttcatgtcccgtttctgtggcaatctcagcctgccttaccccgtccaagtcgctgccactcgaattgcgaaaaaatctgttgaacatgacctcgttgctggtcggagtccaatttccatcgccgccgccgcaatttatatggcatcgcaggcgagcaatgacaaacgcacggcgaaagagatcggtgaaattgccggcgctgccgaagtgaccgttcgtcaaacgtaccgtctcctcctgcccaagggttttggagctgtttccgcctgactttcgcttcgagacgcccatagatcagttgcccacttcctgaaaaggcgcaatttgggcttttcttttgaatgcgtgtcaattcgttcattttttccgttcat

SEQ ID NO: 94984 - DNA, 363 bp, Heterodera glycines
  SCN-specific regions: Sequence locations=1-1,24-247,279-299,324-363
ccaaaatcattcattaactaatcaatcaattggtcagtccctctcacaatgctcttctccactccaatgccactctttctcgtctcttctgtctttctcttcgtttttcttctcgtcgccatgtttttggccaatccgtccgatgcgcggcctcaatttggctcatttgccgattcgatgaccagcggaacgattttgagtaatatgtggggaaaaaaagcgatgagaagcggccaacagcagacggagaaagaaagaaaattaaagaaaactgaagagaacaattggaaataatcaacaattaataaataattgttaattttgtataatcaatcatcaattataaatggttggtaattaaaa

SEQ ID NO: 94985 - DNA, 1401 bp, Heterodera glycines
  SCN-specific regions: Sequence locations=1-60,82-289,311-1285,1308 -1401
caagtttgagcaatttcttttctcttccaaattcactttccatttgccctccttccctagccaatttgtcccccttaaaaatggcactcgtctccaaatggcgttccgaccctttcgggcgttctgactggcccagcctttggcgtgatcgcttttctcgcgactgggacgattggccccgcgattggccacgcccgggagaactgatggaacgtttccgttcccgcgacttcgaccgcgaccgttggtggcgagattggcccactgattggccccggatggacgcaattgtgccaagattttcttcacatttggaccgtttcgaccgtaattggcgtgacgaccccttttggcgcgatttgtacccgcgttgggccgagcccatctttaaagatggcatcgacgtcaaaactaacatcaccaacgacagtaaccgtttcgcagtcgaaatggacacttaccaattccgcccggaggaacttcaggtgaaaacgatggacgacactttgctgattgagggacggcacgaagatgttcgagacagagacaattacaccaaaatgtatttcgtccgcaaataccaattgccggccgatgtggagtcccactcgatcagcagtcacatcgacagttctggccgtctgagcgtcgaggcccaaaagcgttggcaggccgtggaaggcgaacgttccattccaattgagagcggctcgcgtcgtcagggcgggggctacgggtcgcgctcgagctcatactcgccgcgcgatcgctactacgccgactcaggccgagggtcggccaacgattattacagggctgagagccgtctgaacggagcggcgaacggcggcggtggttacctttcgccaaacccgcgatcggacggatatcgaacggaattcgagaaacgcgagacggacgcgaacggaatgcgacacgaagcgagacgggaggaattccgcgaggagttccgtcgcagcggatcggccgctaatgttcttccaccggcctcgcctatgctgcgcaccgagtcgcgtttgagcggcgcggtcggcgccaatgcgtcgtcaggcgaagaacgccgcgaatcgtcgcacttccgccgaacggcttcagccgcctcgcgcgagtatcggtcgggtggcgctttcgctggcggagaaaatcttttgcggccggcggaggaattgggcgggcgaagttcggcatttggcactcgaaacgtgccaattcaccgtggataaagacaatgtgagggggaagcgcccgcatggacgacacataagacgaacgaacagacaaaagacgaaatcactcccccccactcactcatttgccttagagtgtcaaagggcagactgactgataaataagcccgatcactttttattgcttcaaatt

SEQ ID NO: 94986 - DNA, 647 bp, Heterodera glycines
  SCN-specific regions: Sequence locations=1-131,154-188,211-647
gtttcataagtgactaataatgtcgtcgtttggcactagcagtggaggtcgaattcgacagcgtggtactgttggaggtcgtggccaattcaacttgtccggcatggtggaaccacagcaagcttttcaaccaccaacgacacacccagccgactttagcgttagccgcggtcgagggcaccgttatctgcaaaatccattggaaagtctgacccacccgtgcaaacttgaagtggccatggccacccccgctgaagttgacttgtcgccggccattcgtgaaatcaagaaggatacgttttccgttggtgtcactccgaccacccttacatccgttggaaagggtccgtgcgtttcgtgtcagcaaagcgaagaagtcaaccgccagttgatggccgcgcttctgaaggaccttggaacttcgctcgtcaatttcgccgcgaaattggagcagccgtcgaaatgattggacaaatcgaaggacgaaaaagtgacgaagcgaaagacggaccgactaaagacccatttttaactgtgttcagttcctatctaaagtccttatcaattttatcataatacgtatgtttcacctaacttctcataatgacttaaataagaaaactaagaataaatccctatcataaaaa

SEQ ID NO: 94987 - DNA, 481 bp, Heterodera glycines
  SCN-specific regions: Sequence locations=44-192,214-481
cctcgtgccgaattcggcacgaggcttggctttgctgctgctttcgatgaccattttcagcactttccgtggcttttttcggctctcttcgcttggcttcttctcctttttcttcttttggagctgtttccttccttttcagccaatttatctcttcagttggtaagccctcgccgtgctctgatcgctttattccgtgcccccaacccaaccgaacattatttggcctttctcgacatattccgaatcggtgccatctgttgggtgataagcaatcatctcggcagtgaaggacgtctcgatgtgcttttgggacttccgcacggcgaacatttcaaacagtccgtccattcccttcccatctttggccccatttttggcaattctgctctcggtgtggaagtttttttggttctttccggctttttggccgcccgctcgtggcatcgtcggtggcaatccgaccttggcttttggccaa

SEQ ID NO: 94988 - DNA, 817 bp, Heterodera glycines
  SCN-specific regions: Sequence locations=1-524,546-817
gtttgagtagtgccggcaaaatatgttcaaacccaaatcgcttctccgccttttcctcattcggaaatgtgtcaattatcggtcaaagacttcattttctggttccgaatttattgaaaggcgagcccggctattggaattggttggaaaagcacggcccgactttgatggaaagaagcccttcgctttgctattggccaaacggagaagtttcagtgcccccgacgtgccccacgtttaccgccaatgttcccactttcgctacctttgcggcgttgacaggcctggctatcgactgctcatcggacccaaagagagcgtgctgttttgtgcccttcagtcggctcaccaaatcctatgggacggtgcgtcgccaagtgatgctcagctgatgtgtgcttccggtgtcgaccaagtcctcccgctcgacgagttcgacgcgtacatggcgggcacagttcgcaacggactgctcgccttggatttgccttcgatggccgatcacgctgccgatgcgcctgcacaaatgaagaaaatgtggaaaatgttgtcggacggcgtgtggacgcacgtctcactcaatgagcacgtggacacattgcggtggcgcaaatcagagacggaaaaggcgatgatgcgacggacatgcgcagtgggaggggaggcactgaacgcgatggtccgggaatgtcgtaaagcaaccaatgaatctcatattgtcggcttcctcgagttcgagtgccgtcgacgtggtgcccacttcctcgcctatccccccggcgttgccggtggttcaaatgcgaataccatccattac

SEQ ID NO: 94989 - DNA, 804 bp, Heterodera glycines
  misc_feature (786)..(786): n is a, c, g, or t
  SCN-specific regions: Sequence locations=1-158,182-587,609-804
gacaaaagtggttcgtcgttttgtttcacttagcacattcattgatgagtgtttttctgaactccgtcagaaggctgtccgtcatcagttcagccatgaaatttcttagacaacaagaagcgattgacatcgaccgggagctgttcacctcgtgcggtttcagcgtggaccaactgatggaattggcggggttggcctgtgcccaggcaatcggtgaaacgttcgaaaaggggaacgttctcattttgtcagggcctgggaataatggcggcgatggactcgtttgtgcgagacacttgaagcattttggattttcgccttcgattctctgtccaaaaccatcacaaaatgatctgatgcaacgattgatgcttcaattggaatgcctcggcattcccttcgtcgaatcattccctgaccccaattctattgagaagttcaacttcctcgttgacgcaatcttcggttttagctttcgtcccccaattcggggagccattcaacaaaattttgaagcaaatggaaagtgtccaaaatcgtgtcccaattgtgtcaattgatattccttcgggtcaacccaaaggttgggacgtggagaaagggcccccggatgaaaagagcggtttgcccattctgagccctttggcactcatttcactgactgccccgaaacaatgcgcacaattttttaaaggagaatatcattttttgggaggccggtttgtgccacctgccttggtacagaaattcggacttgaaaatatgccaccatatgaaggatcttcncaatttatgcgtcttaat

SEQ ID NO: 94990 - DNA, 1067 bp, Heterodera glycines
  SCN-specific regions: Sequence locations=1-1067
atttgttcaaatgaattctttctgatgtgtttaaacaatgcatggttcttcaccattaacagaggctaatctgtgcatgaaatttgagtcttctttttcatggaaggattgggttaggttacgtgacacttggaatgccgttgttacgtcgcaatcgcagattcacaggcattctgaacagctcgacaaaattgtttcggaggaaagcagttacagaaattatgcatctgacattcaaaatcgacaaattatgatccaaattgtggaaagaaatgtgaacaaagcgagggaattggtacgaacggcgcgatatcagttgaacgctttcaattcggcgctgagtcaaatgagtgcaatgtttaaatcgcaggaagagaacgattcccaaactgagcacggaatattggagctgaacaaccaaaacgccgaaatgcgcttggagttgagccgacttcgcaatgagttggttttccgacgtcgacatatgctcaaaagcctttacgaagtgttttttctgccgaagctgaagcgctcttcgattgcggcaccgctcgtcttcagaaggcaatgcttttgctccaacttcgatgccattcgctccttgcatttcccttctgtgcctgctcgactcgggcacaatgatgccgagttaagttcggccgctggttttatcgttcaacttttactcgcaattagccatattttggacattccgctcaaacatttgctccttttcaatggttctcgttccgcaatatttagtcgttcttctttggaacgctttggacctcttttccacttcctctgcaaagagtcaaaggaatccgctggaccaaacgatgtacctgctcaacgaaggcatcgtcccacatgagggccaagactggcggttgtgtctgagggggaccgaccggaccatgcagcctagtgcgaagagcggggactactctaagcaaccgaatgccagacggtgtcgagcaactcgcgaaaaggctacactacaattaggaagaagaatacacctaatacgcggcgcgggaggaggggcggccaaaagcaaaggaaaa

SEQ ID NO: 94991 - DNA, 346 bp, Heterodera glycines
  misc_feature (346)..(346): n is a, c, g, or t
  SCN-specific regions: Sequence locations=1-275,297-346
aacagatcagccttctgtcaatgcatttcggcgctgagcaggtgaacagacgcatctacggcttcaaggccgactttttcgcaaccattgccaattcgttggcgactgaatgcgtctttttggacggtgcgtcgcattcgcaacggatgccatcgaagcgtgggccgaactcgtggaaatgatgttcagcagtgtccgcgatggctattacgcggaggtgcgtcgaaggcgccggtgcagcggcggcgcctccggagagaccaaaagtggccaaaatgaaaagatcataaaatgaaacacatttttttcactttgttgttgattaagagaaaacgaaatttttcan

SEQ ID NO: 94992 - DNA, 564 bp, Heterodera glycines
  SCN-specific regions: Sequence locations=1-43,65-564
gaatttcatatctctgaattaacctcggcaatgcattctctcgcctttatttccttcgctttttgcctttcactaacggacgcttttcgtactcaatcgtccggcgtccgggggacacttctctgtggaggaaaagcactcgcggacacaaaagtgaaactttacgaccacgacaaagggccggacgcggacgatttgatggggacgacgacaacggacgagcagggacgattccaagtcagcggaaagaccaccgaactgaccaccatcgacgtccaactccgcatttaccacgactgcgatgatggcatgatgccttgccaacgcaaggtgaccttcaacatccccgattcgtacgtcacgtcgggtgcggtgccggcgaaattctttgacattggcacagtgaacatgcaaatcatattcgaccacgaagagcgatcatgcattcattaattgacagatctttatttttttattgaacaatgaatgatttgtgagttattctgctaaagagtccgttcttcggtctttgggcctttgcctcagaatcaaatttctgtttgg

SEQ ID NO: 94993 - DNA, 653 bp, Heterodera glycines
  SCN-specific regions: Sequence locations=1-653
aagtttgagggatttgccattttaaagtgcacagccaccaaaagccattcgtaagacgcccgcccaatgccaacttttgcagaacttttcgaactcagcgcaacggatgtcgtcctcgttgttctgttcgtatacgtcgtctacaaattgttcttcgctcgtcgccatattccgcctccccccgacgtgccgcaagtcgaaccgttggagaagcaggacatgacggtggagcagctgagacgctacgacggagtacaagacgaacacatttgcatggcaatctgtggaaagatttacgacgtgacaaagggaagggactattacggacccgagggggcgtacggagcattggctgggcatgacgcaactcgtgcactgggcacgatggatgtcaagcaaatcaaagacgaatttgatgaccacgccggaattgacccatccgatttggaagaagcgaaagagtggcaacagcgcttgtcattgaaatacccgttcgtcggccgacttttggctccgggtgagcaacacacggagtatgagactgttgcagacaaccgtgagggaaattaaacagcggttgacgcgtaagaaattcacacattccttcacttcaatttttccaccttttcactttgctccataaaatcactatc

SEQ ID NO: 94994 - DNA, 624 bp, Heterodera glycines
  SCN-specific regions: Sequence locations=1-379,402-598,620-624
cttggttggtccaactctactcaattgaattaagcaatgattgattgccattgccatttggcggatgaaagttttaatgaggacattagtcaggtgattgaccgagcgaagcaaaatggtgtcaaagctgctttagtggtcgcagaatttaaggatgattttgagcgaattttggaattggcccatcaatttcccgattttatctttccatgtcttggaatgcatcctgtgcaacgtggacacatttcatgcagtgaagaaatgtacaaaaatttcgaagtggacaaatggattcgcactcattcagatcaactgatcgcagttggcgaggttggcttggatttcaagcctcaacatttgaagaacggagacgcggacaaggaggaacagcgcaaagtttttcgtgcacaaattgaactagctaaagaattgcagttgcccctaaacgtgcattctcgttcggctggtacgcctgtaattgaatggttggccgcgcatggggcgcaaaatgtgctgttgcacgccttcagtggcaatgtgaaaaatgctcaaaagggcatcgaaaagggcttcttcttttccattcctccatcctttactctctcaaaagaaaagagagcgatt

SEQ ID NO: 94995 - DNA, 1152 bp, Heterodera glycines
  SCN-specific regions: Sequence locations=1-158,180-1152
gtccaattaagataaaattcccatatttatgacacttgacgataaattaacttttcctccattagaagaacaaactgctcgcaagaggcgcgaacgaaaacatcaaaaagttatttcgtcaggttggaagaccaatacactcaattccatttgcttctctactgcacttttgctttgtttcgcccattttgaacaccttcaaacggatgctgattataaatttttcgaaattcaaaatatttcaatccgacttcaaaaagatttcctcgctggaatcgttcgtaatggtcattctatctcagccgtcatgttcttgttgcatattgtcgctaccaaattgtccgaaactcgtttcactttccttggtctgctggctgtcctttcatggccggccttattcttcgtacattatgaacagattcacaaccgagattatctgatcagtcgcttagcactttctgcctttacactgctcatcagcacagcacttctctttttaccaaaaaagccgaaacgcaagaaaagaccgaacactttttacagtgccttttccgttgccagcactcctctctcgcaacgttcacgttttactcgggactcatctgttacagattttgtacttgataattcaaaaagaatgatggattttgaggacgatgaccaatcgctttcttcaaaatattctacgaaaatcgtacttcaaatagaatcagaaataggtcgtttttggacaagtcgaatttactgtccaagtccgcttccaaaaagtcttccgcgccttcccttcgttctttttccgtttgttcttctaccgttccttcgcattcttttggctggcgtgaaaaaagagaggaaactccgttaaaagaagtaaatcagctcatcgaccaactgatgttgtacagcaccgacgaagaaacggcagagaatgaattggacgacgaagcgattggaaggcaaagagaaatggccattggaacggcagcgaaaaacgaaggcaaaacgatgctgagcactcgagcgatttcgccaggaaggcagtgccgacacggcaaacagcagggaccattcgcatcgctcactttcaacccggccgtgcgtaaaattgccgctggccatgccttcccttttgaaggcggtttatttggctca

SEQ ID NO: 94996 - DNA, 674 bp, Heterodera glycines
  SCN-specific regions: Sequence locations=1-227,249-476,503-553,590-674
gtccaattaagcgattcgtattgcctttaaaattcttgtcaccactcaacatcaagtttatgggtgcaatgagttcttcgtcttctgccgccccatcggacccgcagcaaaaaagcatttatgaattttcggccaaagacattgacggcaatgagaccagctttggcaaataccgtggcaaagtgctgttggtggtcaacgtagcgtcgaactgcggcttcaccgactccaactacagtcagctgaagcagttgctggacaaatacaagtcgaagggactcgaaatcgcggccttcccgtgcaaccaattcaacaaccaggaatcgggctgcgccattgacatcaaagactttgtgaccaaaaagtacaacttcgagccggatctctacgacaaaattgacgtcaacgggcccaatgagcatccgatctacgcctatctgaagagcgtccaaggcggcatcctcggctttgatgcgatcaaatggaactttaccaagtttttgatcgataaaaacggcaaagtggtggagcgttatgcgccgaccaaagaaccgaagaacattgagaaggaaattgagaaattgctggaggcctgatttgatgaaaaaaacttgagcttttcagacttatatgcccatagaataatttgtaatctaaataaaattcttatgctt

SEQ ID NO: 94997 - DNA, 476 bp, Heterodera glycines
  SCN-specific regions: Sequence locations=1-476
atttacgttttagtaataaaatgccaaaattttcgcggaaaatgctgagacctccacgaaaaaggattgccaagaaaagtgatgacaaaaaatcgacggaagacgaaaaaaagaagaagaagaaacggaggttgcccaaaacactgaaggagtgttttgagtgcgtcgacgtcggttccatcgttttgtgcgcctcctatttggacattccgccggagccgatcagcagcagcagtgacgagaaaagcaactggaaaagaaagaagcaaaagggacagacgaaaaaagaagggcccaaaattgtgacggatgtccacgaatttgggtgcattccatggcgactttcgcttgtgcaccagcttcgcaaggacgacaacggaggctattccaaacacattctcaagttggcactgcactcggactatcgtaaggacgtcgcatggcgtgccgatgtgtccggcactttgacgatgaaa

SEQ ID NO: 94998 - DNA, 663 bp, Heterodera glycines
  SCN-specific regions: Sequence locations=1-663
gtcgattcattctaattttctttgcattgtcaaacaaacactaaaaatgcgtggtccttttatgcgtggcactatgccgctccgtcggactttttattatcttggccagggaaaaatacatttgcgtgaggaagtgaaggtctttgcaattgctttccacaatttcccaaacgtggcccaggaaggggccaaagaattcgtattttggcactgggcccaactccaattcaagaaccctcacgttcaattcgtgaaactcgcggatgtttgtgtgacgccatttgtgcaagctttcttaggcgatggcagagaagttgtttttgatttggagtgccgtacgagggagcaaataagcgaagcattaatcggaacattgggcatgacagagactgtacggaagcgaatgaaaatggacagttacaaaagggagaacccggccgaattcggctgcgactgcgaaaggcaatgcatttgcgaaatgcaagggcagcacccgtgcactgccattctttacgcgccgaagcatttgcgcgggagttggcgatggaatcactccacttacaatcctgaaaagcccgttccgtttccgcctgtggagggctacgactgatttgcgtttgtttcgatgctttgttttgataaacatttgtccttttgattggt

SEQ ID NO: 94999 - DNA, 481 bp, Heterodera glycines
  SCN-specific regions: Sequence locations=1-160,182-481
gagaattaaaatcaccagatataaaaccccctgaagagctccttcaggttttttctaatccatcccgccgttccattcgtttggccgatgaagcacggcaatgcgcgtaccaaaacgagatgtctcgtttagcgcgaattattcaatctcaacaatggacgatttcctctcaacagaggaccatcgaatcgcaacaacggacaatcgaaatgttggtctcccggcttcctcggaatgatggagcggcggctccgcccaatggcgacgaacgacgtgacatgggaggagcgcccaacgaacagcagcatggccaaccgcccattcttcaaattgacaatcgtccgcacattgcgcccgagcccaatggtcgaggaggacaaaatggaggcggacatgggcaacgcccaaacggaaatgccaacatcgttcgtggccaaaatgtcgtaccagtggctcctcccccatttgtggctcaacgaca

SEQ ID NO: 95000 - DNA, 600 bp, Heterodera glycines
  SCN-specific regions: Sequence locations=1-45,67-552,593-600
agacagtatggcacaactgttcgaaaacattggcgttcgacgcaaagttgatgacaaattggtgaacgggcaagaggcgctaaagggttgcgaagtggtggcgctttatttcagtgcccattggtgtccaccgtgccgcaatttcacgccggtgctcaagaaattttatgacgagttgaaaaagtcgccggagacggcgccctttgaaattgtttttgtgtcctttgatcgttccgccgatgatctgagcaactatttgcgcgaatcgcatggtgattggctgtacattccgcttggaagtgagcacatcgaaacattgtccaaaaaatttggcatcagtggcattccggcattggttgtgctgaagcaggacggcactttggtcaccaaggatggtcgagcggatgtgcagaacctatcaccatcaaatgcaatggccaaatggcgctccggctaagagaacaccccttcactggggagactgatggaagaaaatcaaaaattttgatatggatggacacattaatacattagtagtgatatatcgaaaactaatttttacaaattaaatttttaaacaaaataaaaaaatcttttgtt

SEQ ID NO: 95001 - DNA, 534 bp, Heterodera glycines
  SCN-specific regions: Sequence locations=36-456,479-534
cctcgtgccgaattcggcacgaggctttaatatataggatgtacatccgagagttagaatccccgggtgagcttcctctggtttggttaaatgcgctctcccgttcttgctttcgtccgactaaagatgaccaacttgtatcgcttgttgagctgagacaggccgcagaacggatcgcggtcgaaaacgcgcagttgaaccgggtcaatgccatgctcctaattttaattcaacgtcccgcaggagttctgcctcatcaggctgtgcccgtcgctggtgcttttggccaacaacaaaaccaacagccggccaatgcttttcccattccaccggttgtacctgttgtgcctgtcaacgcgaacaacagacttcacaccgatgaacttcaattggaaatttctcgccatgcacggaccttgaatgagctgtcggtcgaatacgctcgtttgatgcacaccaacagaacccttgttgaacaactttttgcaggtggtgcaccgccttatgttcatcaacagtttgaaccggtcgatg

SEQ ID NO: 95002 - DNA, 673 bp, Heterodera glycines
  misc_feature (669)..(669): n is a, c, g, or t
  SCN-specific regions: Sequence locations=1-206,228-673
gacaacgggaaaaaactgtcgggtttggtcgaattaggctatcggaagagagtgctgcagcggttgggttacgcgactgaggaggacaccatcacggaaaagggccgtgttgcgtgtgaattgagttcggccgacgaattgctgctcacagaaatgattttcactggcgctttcactgatctttcgccggccgatgccgcggctttgctttcgtgtttcgtttttcaagagagagcaccgattggcaaactaagcgattcactaagtgaacatttgcgcactatgcagggcatggcaaagaaaatagcaaaaatctcgattgagtgcaaattggaactggacgaggaaaagtacgtggagtcgttctgtcccgcgatgatgaccgttgtctccaagtggtgttcaggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgttttctcagcgtccctttatctctaatttgcgatcctttttttgttaatacatttaacatgttgcgcaaaaataaatattcattanttta

SEQ ID NO: 95003 - DNA, 338 bp, Heterodera glycines
  SCN-specific regions: Sequence locations=1-1,23-338
ccctgctctccaacggacgaattcccctctttgctggcgttctgatcaccatggtggacacgttcacttttctgctgatcgatcgctacggctttcgcaaattggagttcattttcgccgttctgatcagcacaatggccatcacttttggctttgaatttgtcgtcgtcaaaccggacggatgggatttgatggccggcactctgttgccctattgtccgggctgtggacgtcaagaattcctgcttgtgtttgagtggggttcactacgttccccatccctgatgatctatttactgtttttttcaaaaaattttccaagaaaatcatgaaaattt

SEQ ID NO: 95004 - DNA, 479 bp, Heterodera glycines
  SCN-specific regions: Sequence locations=1-479
gttgctttgattttctgtccttttggccgatgagttacaattatttgttcaaaattgtcgttgtcggcgaccacaactgtggcaagtcgtgcattttgttgcgcttttccgagaattccttccgttctgaccacgtgagtacgctcggagtcgatttcaaattgaaaaccatcaaaattggacgggacaaaattcggttggaattgtggtatttcaatgtgttaactctccgtttcatttgcatcaaaatgcttatcgttaggcatggaaaggtatcggaccatttacaattcgtattaccactcggcccacggagtgatgtgtgtgtacgacttgacaaacgaaaagtcatttcaaaatttggaaaattattggctaagacaagtgaaggaacacgcgccacaaaatgccgtcctccttatggtgggcaacaaagccgacttggactccgagcggaaggtggactttgaccgtgccga

SEQ ID NO: 95005 - DNA, 955 bp, Heterodera glycines
  SCN-specific regions: Sequence locations=1-168,199-468,490-553,575-955
aaaatataaaagacgagcgatcattaagccaaatcatttgttaaacaaattcaaaattgacttttgaactgccaatctccaaaatggtgcttctttgctgttcccaacataaaatggaccgctcattgcccaattgcctcagggggtgccgttgtggcattttggtcggcagaaaagggaagaaaaatgtgccgaaaagcagcggagaggagggaaaagcggagcaatcgcagcagaggaacgaacggaaacagaacaacgaaaattattattgttcagtggaagagatggcttacgatgcgatgtacgacgaaaaaatgccggcggatgaacgggacaaaacgggcacagtgcttcaacgagttgcgatggcacttcagggaaaggccggccccgaacaataccaacagttcaaatgaaaagcggtggaagagaagaggaaaagccgttttgggtggaaaatacaccaaaaaatcaaacaaattggaatttttttcaattttttgttccagacaaaataagcatcacaaaagtaacaaattaaattaattggaaaatgtttttgctttgctttgtattgctaataaataacaattacaatttgctatttacaactccgcttcatcagagatatgctcaaagtaaagagctaataaaacttgaaaatgaaaagggaccaaaaataaaacagaagaaaaaataaacgaaagataaaaaaggataaataacgaaggatatggcaaggaaaatattgtcggatggactaaccaacggagaaaggcccgcaaaagggagaaaacctaacggataattgagttaatggtataattaaaatttaaaatgaaaaaacggacggaatggaaaataatttacaaaacgaatgaatgggcgaacgatcgtccgtttttggctatgtacaaacaaataattgcgtgattcatacaatgcgtcgtct

SEQ ID NO: 95006 - DNA, 719 bp, Heterodera glycines
  SCN-specific regions: Sequence locations=1-6,462-476
ggtttgagcgaatactctttattcattataatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctaccctccatcttgccctgcgtcctcgtggaggaatgcagatctttgtgaagactctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggtcgaaccctcgcggactacaacatccagaaggagtctactctccatcttgtcctgcgtcttcgtggaggaaagaa

SEQ ID NO: 95007 - DNA, 742 bp, Heterodera glycines
  SCN-specific regions: Sequence locations=22-742
gaattgaaatgccaatattttttgcaaggcctcttgcggcagagaaaaagcttccaattctgaataaaaccccagagccaacagagtcacaaaaggacacgttgagtgacgacggccaagacaaccaggacagcggtgcctcaacttcctcacagaccaacctaatcaaaaatgtgcgaattcttcggaaagaggcggcggaaacatcgctcgagccatacattcagtttcaatgttttgcgcatttcgcaatttcccggaaatgtgttaacgaattgtgcgctgatgtgtcctcggatggcgtcgatgtccacatttttttcgaggatgactttccgcgtcttccccgcattggcttctcctgcctgtctttgcaagagctttacgaagaccgtgctctgctgagtgaaaaaaacgcaacgccagaccaactcagtttcatccaattggtgcgttttgtggacaacgggttgaacgaaatacccaattggctgttggttgctccgaagcggggtcaaattttcaccatttctctggacttggccgacggaaacggagtccgggttcgcttctcatttgggagtgtgagtccgactccgtggtacagtgtgcgttatcctccgtataaatcagacttttctctcgtcatcgaagtggacaaaaaggcggtgttgaggcggtcgtacgaagaaagtagcacactgagcattttgagcagctttggactgttggaacgaaagct

SEQ ID NO: 95008 - DNA, 472 bp, Heterodera glycines
  SCN-specific regions: Sequence locations=1-326,349-389,412-430,452-472
aaaatttctcccaaaatgcgcacgtcccttttgatccccttcagccttttctctttgatcactttgctgttcattgtcagctttagtgaagcggacatcgaagtggacagtttgatgccacgaacgaaaagacaatgctgtggaggatgtggctatagtggcggatacggtggctatggaaacgacggtggtggacaatgctgtgatgcttgcggccagtgcggcagcggggggtacggtagcggggcgattataatcactaccggaggcggtggatacggatatggtggttacggtgacggatactgttacagttgcggtggtggaggatgctacggatgctgtggttgagaatgactcgaaggcacatcaattatataatgttcttttgtgcttttattttatttcacaattacatataaaaagagctcccgcgggtttgcgggtcgctttgatcaaattcttcaaaaaa

SEQ ID NO: 95009 - DNA, 1710 bp, Heterodera glycines
  SCN-specific regions: Sequence locations=1-555,624-642,690-707,914 -955,990-1038,1098-1212,1236-1267,1324-1324,1536-1552,1619-1710
ccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgccgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcatgcgcgtcactaattagatgacgaggcatttggctaccttaagagagtcatagttactcccgccgtttacctgcgcttggttgaatttcttcactttgacattcaaagcactgggcagaaatcacattgtgtcaacaccttttcaggccatcacaatgctttgtttttattaaacagtcggattccccttgtccgcttcagttctgagttagctgttgattgcatagaggatctcccacgatccgaatctcgccagtcctgccgtccacagttgcccgcagccagcaagacagcttgaaacttcacgta

SEQ ID NO: 95010 - DNA, 619 bp, Heterodera glycines
  SCN-specific regions: Sequence locations=1-34,56-273,295-619
gtttgagttttagcaactataaatatacgccctgctgatgacaacgcccaatttgccttacggtgcaagagaggggagcggccagttcagtacgggcaccaatttcagtcccccaccaccgccgtatgacgccggcgccagtagtccatttgaacaaccacaccaacagcatcagtcaccatcgccctacggaatgatgtacagcggtggcaatgtgccgtcgccaccaccgccgtcctctccttaccaccaataccaacagcaggcgccgccgcaaatgtccccgccgttccaagcaccaattggggacccacaacagcagttcatgtacgacccgttgttgaacactgcgcgtcatttgggtggtcaatttgcggagcaacaaaagcaaaagttcacccaatacctttcgtccacgtcgttcaacctgaagtattattttgcggtggacaccaattatgtgcggcgaaagttgggcatcattctgttccccctctttcatcgggattgggccaacaaatgtgagggcgatgcgcccgtgttgccctgtcaggatgtgaatgcgcccgacctgtacatttcgatgatggagtatattgcctatgtgctggtgactggt

SEQ ID NO: 95011 - DNA, 381 bp, Heterodera glycines
  SCN-specific regions: Sequence locations=1-18,59-70,92-193,215 -282,310-334,362-381
atgccttcccccatccgccttttctttcttttcctgtttctgcttcttctcctcccatttttgtccttcgccgctttgtccccccgagagaagcgccaattcagcttcaccgatggcttctcaagcggcacaattttgcagccgggcggcggcggacttttgagttggtggcggagatgagccaacggcggaagtgaagcaaaacaatgggaaagattttgggttgtgatttgatttatgacgaatgaatgacccaccgatcaaccgacttaccagaccataattcattcattcattcattcattcattatgccgtgccaatatccccccaacccatccttttattgtaaataaaaaatttaattcatttctactgttttt

SEQ ID NO: 95012 - DNA, 311 bp, Heterodera glycines
  SCN-specific regions: Sequence locations=1-102,124-124,146-311
cctacataccactcgcctgcctcgcactccgagtcgcctatgtaccgcgttccgtttccctttcgcttggttgtgtcagggtgagtcggctctctgtgggccatcatggccacaccgcacggccgctgaactcgcagtgcatgcatgccgcgtttcgtttgtgttgatgtccgtcatctcgcagccgatcgcggtgatctcggtgtctcacggccaagcgaaagcttccagattggctgaatcaatcgtaacaacacaactgctcgccacaactccctcttttgctttcccaatcgtagacgccccacatt

SEQ ID NO: 95013 - DNA, 306 bp, Heterodera glycines
  SCN-specific regions: Sequence locations=1-211,233-306
gtttgagtcatttcttctgagcaaatacctaaattcgaagtctaaaaatgtttatgcctatggaccacaacattcaacaacaggtccaggcctccgcttctaggaaggcccgtgacgactttttcacgttcatcgcttgtggcttcatcttggagatcggcactcgcgcacttcgttatgttggattcgattcttttctcgtctaatttcgcaggaattgtttttcaattttcgcaggaattgtttttcaattgaaagtcgtaaaaaataaacattgtttttgccaccacaacatgaaccaaaaaa

SEQ ID NO: 95014 - DNA, 688 bp, Heterodera glycines
  SCN-specific regions: Sequence locations=1-538,560-642,671-688
gccttgtccccgtgctggtactgcttgcactgcttggtgggctcttgcacaccggtgcgcaggagtccatttccacgcgctcaacacgtgcggagggcacactgatgtgcggaaaggtgccggcctcaaaggtgtacgtgcggctgttcaagaccaactccgatgaaatcagcaatgcgttggcaacagcggtgaccaatgatcagggcaaattcatcattgaagggaacaccgccaattaccaaggctcggaagcaaatattgacccgttcctgaagatctaccacaaatgcgatcagaaggaaggcaaaaaaggctaccgacggatcacacttcgttacccgagggaatacgtcacaattggacgcgttccacgacgaaattacagtgtcggaaatttgaatttggtgctccaatatccaaatgaagctcacatcgacgagctcaaaggcatttgaatgaatgaggaattttttgaaaaaaaaacgatggaaccgttaattgactaacaattgaaatgcgtaaaaaacagcttgggaataaatgaaaattttatttgattataattccttaccgtcgattcattttgactttttcccaattaattaatgatacaaaatgcagaataaatacttaattgtcaaaaaaaaaaaaaaaaaaaaaaaaaaaacctcgagggggggcccgg

SEQ ID NO: 95015 - DNA, 630 bp, Heterodera glycines
  SCN-specific regions: Sequence locations=1-80,102-105,128-594,616-630
gtccaattaagcttttcctcgtttaacttttcctcaaccttttgcctctctttcctcccaatttttcttttaccaatgtattctttccgttttttcctcttcgtctttttgttcatccattttcgtttcattggcacggcacaaattgtgaatggtcagcagctggacagcaattcggagcagcttcagtctaaccaaacgtacagtgtcaccaacgtcgaccgcatgtccaatgcgttccattcgccaacggacaatcagacgacttctcttctcggagacgaaaccctcaaacccagcgacaacgaagcgaactgtacgactacggaaaatggttgcgagttgaacgatggcaaatattcccttcgtttggtgctcattcttttggccgtccccaccgttctgctcattatcattgtgatggtcggtttcatcagccacaaaaagaaacgtcgtaacgaattccatttggacaacggcgccgccaccatttgagaaaagagtgacgatacgataaaccattgaaaatttggtatttgtttttgaaaatttggtattttgtttttcttgcaatcgatcagcatattcccgtgtcttttctttatggataaattgtcgatctgaaaaaaa

SEQ ID NO: 95016 - DNA, 550 bp, Heterodera glycines
  SCN-specific regions: Sequence locations=1-149,192-192,228-310,355 -439,463-550
ggagctccccgcggtggcggccgcttttcaatagtggatcccccgggctgcagtaactcaaaaacgaggcaatctcaccatgctcaacgccacccgctccgccgtccgcgccgttgcgcagcgcatgcccctggcccgcaccatggcctcggccgcccccgccggcgccgttgccgctggtcagatcaagtcggtcattggtgccgtcgtcgatgtccagttcgatggccccctcccgcccattctcaacgccctcgaggtccaagaccacaacatccgcctcgtcctcgaagttgcccagcatctcggcgagaacacggtgcgcaccattgccatggacggtaccgagggtcttgtgcgtggccaaaaggtgctggacacgggtgcccccatcatgatccccgtgggccgcgagtgcctcggccgtatcatgaacgtgattggcgagcccattgacgagcgtggtcccatcaacgccaagaacaagctccccatccacgccgacccgcccgagtttgtcgacatgaccaccactcccgagattctcgag

SEQ ID NO: 95017 - DNA, 656 bp, Heterodera glycines
  SCN-specific regions: Sequence locations=1-41,63-656
gtccaattaagattaaatggactcaaaatcaaatgatttcgaggcacgacgaacagtttgggacagcaaagttcctgtagagtttacgttggacaactcagagtccgtcttggcttctcatcagtcctgttttatgatgctttcccgtgtttcatatttcccggtttatctcgacaaagcattgaaagttttaaccagcggtgacgcaagcgaagaacaattactaaatgtatggcttcaatttgacggacaaattctcagatggcattatccgattggcgtcctttacgacatttaccatgggaatgctggcgatggccaaacaactccatggccaattactgttcatttaaaaaattttcccgatgaactcattcgatgtcggacgaaagaaacgctaaaattttgctttttgcaatctctgaaagaggcgtgccaactcaaacttcgttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgagtcatcatattcatttcgtcaattgcttttacattccaaaa

SEQ ID NO: 95018 - DNA, 411 bp, Heterodera glycines
  misc_feature (410)..(411): n is a, c, g, or t
  SCN-specific regions: Sequence locations=1-368,391-411
ctcagtcggaggcgcggcagcgaatcgccaacaaaggcaaaaagtgtaaatgaaaaagaatattcccgaataataaataatgcaggacagttttggaggagtgttaccaaagtgtcaggacaaagtgtcgacaaagggacaaatggacgaaagacaaagcgcagaaagggattggtcgagaggccgaattggacctgccgaaagtcggtcttcgagcgcaagtcacctgcccacggcaatcggacagaacgccaaaaaagtcgctgaaaatgtcccttcggccgctaaaaaagcgggcatttcgtggctgggccgtctccgtcggaaggagggacaaaagacaaacgaatgactcaaatggccccgcttttgtctttttattgaaatgagagaataaaatgcaaatgttnn

SEQ ID NO: 95019 - DNA, 1045 bp, Heterodera glycines
  SCN-specific regions: Sequence locations=54-576,599-1045
cctcgtgccgaattcggcacgaggcaaataagcaaataaaaataagacaaaagctgaattcgaaacaaacgtgatgagcgtcgaagaatcgccacttttaagggaatttaagacatttctgcaggcgactcttgtcgcattcggaagcgatggggcacccttttcgctggtgaatcagagattcagtgaggattgggttggctcgccttctctcaaggaatacgcgaccaaattaggttatgtccatccaaatggcatcttcaaattgttgcagtcaatccctgatcaggtgacaatgatggtaaatccgaccggcgaagtcattttgaagccggtccctatggaggaaacacgcgacaatttggaaaaaatcgacgcaacaaacaaagaactcaaagctgagagaaagcgtcgccagcagtaccaacaggggcctcttccagcgtcggtcattgcgcaattggcggcaggcatctgttggcccccgccggtgcccgcgcaaccgttgtcctcggttttcaacgcgagcatcgagcgtaccgcacccctcgccacttcatctatcgctactattagccgaccaccgccgccgccgccgatgacaaagaaattcaacccaaatttgattccgcttggaacgcctcggtttgcgcggtgtgccagtaccagcaacatcgctgcggacagcagcgccgacagtgggcccagtgcttccggtggaccgactccatcgccgatggtattccatccaccacaccagcagccgcaacagcaaccacaacgttcgaaggtattctttgggcagcgtaaaaaaccaccacctcctgtcgccgtgccccgcaacgatttcggcgatttggcgcctcctgtcgccgtgtcccgcaacgatttcggcgatttggcgcctcctgtggccgtgccccgcaacgatttttgcgatatgccgcctcctgccgccgtgtcccgcaacgatgtggcgcaaacgttgtcctcggtcttcaagaggaacgaaggctattatgaagaggactttcatgcgttggcg

SEQ ID NO: 95020 - DNA, 497 bp, Heterodera glycines
  SCN-specific regions: Sequence locations=1-497
ccttgttgtagtcgaaactccactcttccccacccacccacttttctcaccatgtcgtacggcgattaccagcagcgcccccgtggctgcttcaactgcggctctgccgaccaccaggcccgcgactgcgaccaaggcgtcaagtgctacaactgcggcggcaccggccacacctcgcgcgactgctccgagccccgcaaggccaagacctgcaacaactgcaaccaggagggtcacattgcccgcgactgccccgatgcgccggcccagtctgcccgctcgtgctacaagtgcggtgaggtcggccacatttcccgcgactgcacccaaggccgtttcgccggcggtgaccgcatggccggtcgcaactgctacaagtgcggcgaggccggtcacatctcgcgtgagtgcccgcaaaacgctggtggcgactcgtcgtggggtggcaactcgggcggctcgtcgcgcgcctgctacaagtgcggcccagagggcca

SEQ ID NO: 95021 - DNA, 962 bp, Heterodera glycines
  SCN-specific regions: Sequence locations=1-45,68-189,226-962
gttgttaataagtgccaatgactttccctaggaacagtttgcttcgttctccaagaattcgaccaaatttgctcaatttttccgcgtgtttctcctcaccttctgatggcagtgctccccgattggaaggttcttcaccaccaccgttggcatcttcaattcgcttcccccactttgtttctcgtcagaaatttactctctcttccacatatgaaaagcaagactggttcccaaaacacatggtcgttcaactgaaagtaatggagggaaaacttcgaaccgtcgatttggtcattgaagtgcatgacgcccgggttgccctgaccggaaggaatccttcgttcggtgccaaattatattcagtgcgaccgcacattctcgtctttaacaagatggatttaatcaacatgaaacgctacaaggaacccatcgaagagtactaccggaatgagcagaacattaccaatatttgctggacaaattgcaagaatttgacaaacaaaacgcagtttcaaaatttgatggacaaaatgttggatttgttgcgaaatgaacatcgcttcaacagaacagtgaagacggaataccaagtgatggttgttggtattccgaatacaggcaaatcctcgttgataaacgcattacgcaatgtgaatttggactttggaaaagctgtgaaagagggcgcgaggcccggcgtgaccattcgggtgcaaaaccgtgttcgaattctcgatcgtccgcccacctatctgatggacaccccaggagtgcttaacccatgggctaacaacattgacgcggcgatgaaattggccatttgcaatttggtgttggatacgaccacacggcccaatttcgtggccgattatttactctattttatgaataaatatcgcgacttttcctacgtcgactttctaagaatcagagagccatccgacgacatcaaacaagtgctc

SEQ ID NO: 95022 - DNA, 681 bp, Heterodera glycines
  misc_feature (596)..(596): n is a, c, g, or t
  SCN-specific regions: Sequence locations=1-6,31-681
taatagattattaattaattaaattaatttgttctgtactgaaatgacccgccccttctgatcaccactcattcgcacttttgtcacttcgactcaccacttgcttttctgatggaccctcccgatctatccgagactcagccgaccattccgaaaaggggccaccaccaccggcgtcgcgtggatatctccgcctcgcgtttgccccgcgctgtgctcgtccgcatctttgggcatttgagtgtggctgagttgggtgctgtttctctcgtttgttgcagttggaaattcatcgtcgactcaaatgacttcgatctgtgggctcgccatgctcgtgctcagctgccggagagcgcgctgtccgacccgtatttgtttgtcaacatttcctcccacagggaaatgttgagggcatttaaacacgcctggaatccatcggactgttctcgaaatgcttttgtccgcaccaatggtttcaccgtccatcggcaacccattgcacagagtacggatggaattcggggcaaagttggcgtttcgagcggggcgcactgttgggaattttgctgggaaggcccactcggaactaccgctgntgttggagtggcgacaaaacatgccgcgttgcattgtcccggctatttgccggtaattgggagcgacgacccaagctggggatgg

SEQ ID NO: 95023 - DNA, 831 bp, Heterodera glycines
  SCN-specific regions: Sequence locations=1-744,766-831
ggcaaacacatgctgcttttgggtgaacagttcccggactttggtgccgacacttcccatggcaaaattgacagtttttacgaatggatgggcgaagaaagttgggccattctcttctcccaccccgccgattttacgcccgtttgcaccaccgaattggcacgtgccgcgcaactcaccgccgaattcgcgcggcgccatgtcaaagtgatcgcactcagttgcgattcgtccgaatcgcatcgcaattggactgaagacatagccgcgtatggcaattcgaaagggaacggaagtgagaagatttcgtcggcagccgattttccctttccaatcattgctgatcagcagcgtcttttggcaattaaattcggcatgattgacccactaaattccgatttgtccggtgtgcctttaacggtcagagcagtttttatcgtcgacaccaaaaagcgtcttcgtctgtctttgctttatccggcaagcaccggacgaaattttgacgaaattttgcgagtgcttgactctcttcagctttctgacaaatttatggtggcaacgccggagggatggaagccgggctccgcttgtatggtcgaaccacgggtgacggatgcgaaggccaaggaaatgttcgccggcgttgggggcggagtccgaccggtggaattgccctcgggcaaacggtacttacgcgaagtgaacgacccatcggccgggcaaagcgaagtgccacggagtgactgaatgaattactaaatgaatacggcacattcacttcccattcatttgttcattaaataatcggtcaaataagaattatttcccaaa

SEQ ID NO: 95024 - DNA, 814 bp, Heterodera glycines
  SCN-specific regions: Sequence locations=1-4,58-82,106-162,217-814
gttccgttcaatgctaatcagctaattgctcactaattaccccaaataacaaaactgtgcctgcttctcccaacaatggcccccaaatgccttccgctcgaacttttgttcgaaattgtgccttttatccctgccgaaaaagccgtcccgaatgcgctctcttcctgtcggctgctgcacaaacttttgctgccacgtgtcatcaaatggaaagagcaactgctaaccgatttgatgagtttctcggcgatcgtcaacaatctctcggcgaaagtggacaatctatcgggcgtcgtcaacaatcactcggtgaaactggacaatctatcgggcgtcgtcaacaatctatcgggcgtcgtcaacaatctctcggcgaaagtggagacgattgagaaaaaaatgggagaaacgactggcaaggcgccaaacgaacaaaaagagcgaggaaatggacacaaagcggtgatgggcgcttacaacgaaaacaatggcaccatcgaagtgccattacatggttacaacgtcggaaaggcgattgttgaaaggattttgaacacggaaaacgggacggtgcatttgcacggaatgcgcgaaccaatgtcactggcaaaggccgtcgaaattggcttttttgacaacctgtcgctgactgtggttgacccgaacactttttctaaggctgtttttggacgaagcattggaacggaaagtgctggactcaaatggccgattgcagcaccagcaccggcaactgacattgggcgaagcgaatcggcaaagacttgtgcgtcttgagaagggcaaaccaactagt

SEQ ID NO: 95025 - DNA, 381 bp, Heterodera glycines
  SCN-specific regions: Sequence locations=1-381
gtttgagacttccatttgacttttgaccattttctccgtctttccctatgcccgccgtcccttccggctaccaagtggtgcagcagggccgtcaaggaccttcgtgcatggacaagctgaagttgggcttcgccatgggtgttctgatcggtggctcgaccggcgttctcatcggcactttcacatcactaaggatgggcctccgtgggcgcgagttgctcagacagacgggcaaaatcgcggcgcaaatgggcggttccttcggcgtttttatgaccgttgcgcaaggcattcgatgctgagggacggccgagagagaacgttttgtgctttttatattttatttagctgttttttgttggcctaataaattatattctc

SEQ ID NO: 95026 - DNA, 531 bp, Heterodera glycines
  SCN-specific regions: Sequence locations=1-531
ataaggtgcactctttaactatttctattttcgcttttggtgttgctaatgtctcaacgcgaagaacctcgtcctcaaatcaaagcgaagctcaagaactcacttatcgcttttcatttgtttctccttgtttccggtgttgtgctcttcagttttgctttgtggcttcaatttgaccctgcccgtgaatttcttctccgtctcgtccacttctccgagtccactccctttttcgagatcgctgtttacttaatgttgggcacatcgctcttcatttttattgccgtcgggattggattctcgggaatttggaagttggagcggtgtttgcttagcggattctctgtgcttcttctgctgttgatacattgcaaattgctcatcctttttcttttggttgcctatcgttttaagttccctgatgacacagtaatgactgagtacctctgtaaaatggcccaacatcactaccatcgcgacaaatgggcgacacctctgatggattccgtccaattctatcacaaatgttgc

SEQ ID NO: 95027 - DNA, 482 bp, Heterodera glycines
  SCN-specific regions: Sequence locations=1-61,83-482
gtctcaaaagtgctcccaatcgcgcactttgagtgcatttgaaattgttccggtacgcggctgtaaactctccaaaagttcttcccgtcggcctgagttttgcgagtgttgtcccatccctcgcagtggccatcgcgtctttgctgactccgatttcatttacgtatttggcggatacaacccatttcactctcctgacagcacttacactgatttttggcgcttcaaccgtctcacccatttatggcaaaaatgcggcctttcctcctctgacccaacgactcagttgccgaattcgttggcttcttttgcattggcttcatcttctaggcccagcgagtgttttatttttgggggtaccggcattcccttcggtctcgccgcttcaaatgaattgcatcgaattcgaattgatttgcttgggaatgtcaatgttcggactgagccgaaacaaagctatgaacagagacaaaacacagcga

SEQ ID NO: 95028 - DNA, 381 bp, Heterodera glycines
  misc_feature (377)..(378): n is a, c, g, or t
  SCN-specific regions: Sequence locations=1-318,340-381
cattgttcccgtaccatagccgttcattgttcccataccgtagccgttcattgttcccataccgtagccgttcattgttcccataccgtagccgttcattccgtagggcattgttcccgtaccatagccgttcattgttcccataccgtagccgttcattgttcccataccgtagccgttcattgttcccataccgtagccgttctttttgtagggcattgttcccataccatatccgttcattccggtgccgataccgtatccgttcggtatgttcccgtaaggcgatgttcctcccgtaccgtaacctccatacggatttgtgttgctgctgctgctcccttgctgacctttttaaaaaaatatttttgcattannaac

SEQ ID NO: 95029 - DNA, 336 bp, Heterodera glycines
  SCN-specific regions: Sequence locations=1-336
ttgagattcaatggaactggaaccttttgtgaacaaatgtgtgtccattatcactggcgacgggcgaaacattgtctggactgcatgaaaggctttgatcaaactgtaaacattgtgttggaagattcacatgaacgggtgtacagtatcgattctggagttgctcaaattccgcttggactttacattgtacgaggcgataatgttgcggtgatcggagaggtcgatgaaacaattgacaaacaattggacttggaaaagatgaaagcaccaccgttaccggcaatttggattccttaaaatatctttttcgtttaaataaatttgacggatttt

SEQ ID NO: 95030 - DNA, 513 bp, Heterodera glycines
  SCN-specific regions: Sequence locations=1-513
gggctgcaggatttccagcacgaggataaggtcatgcgtcaagcctcgttttatgctgtcgcgcggggaagggctgtcggcgtattcaacacctggcaaaagtgtaatgacagcatcaatgggttttcgggggcaaagtttaagaagtttccaactttggagcaggctaatgacttcattgggaagcatcgtgaaactctgaattctggcggcaaagtgatttcgaagaaagggccccccgttcgtacaatgattgtaaaatcggctgctacgacctttgctgagagacgtttgacacgtaatacggcaatgtttggggttgaggcatcgaactcattggcagcatccaacttggtttccgtggacgatggatttacgactgttgtctatacggacggcgcttgtagtcggaatggatttgtcggtgcaaaggctggcttcggcgttttttggtctgatggacaccccgacaatgtctcagctccggtcaatggcccagccaccaataatcgt

SEQ ID NO: 95031 - DNA, 215 bp, Heterodera glycines
  SCN-specific regions: Sequence locations=1-64,94-215
atttgaatgagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagcct

SEQ ID NO: 95032 - DNA, 670 bp, Heterodera glycines
  SCN-specific regions: Sequence locations=1-30,52-670
aaacaatggcggtgagtcatccgcagcaaaaacagaacgggcgacacagcggtggcggcacagtgccaaaacacattggcatcggtcggctgccgacggaggacaacggcaccactagcggcgaaaatccgtcgcatcagttggacgatggggacgacgttcaccaattccaattgccgctcgcttttcggtcatcgctggtccatccatctacgacaactgcacaaaatgttcaccaccatcaattgcttcagcagccgcaactcaacatcatcgttccctccatggaatgtgtttccgtcattcatcccaaaagagagcaacaattctccgcctccgttgaccaattcttagacggcgaagacgacctattcaagacggagccgttggatttgtcgctgtcatcggcacgtacaaaggcaaacgaaaacggcacaatggtagggaatggcgcaacagtcgctggcggcatccagcgcagaaaacggacgacaaacaaaagacaaatggtggaggaaatgtgcgaaacggcggcgacggggagaaaagtgacgccaacggaagcggagaaacggacttcgcccccctccgccgttggtatttctttgcccccctccgtcgtccctccgtccggcactctcttcactcccctcgcttctccttccgctgt

SEQ ID NO: 95033 - DNA, 643 bp, Heterodera glycines
  SCN-specific regions: Sequence locations=1-643
ttctttttatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtcaaccttggatgtgttcccaagaaagtgatgtacaacaccgccatacatgccgagtttctgcgggaccatgctgactacggcttcgactcaatgaacgtaaaattcaattggagcaaaatcaaaaattcccgtgacgaatacatccgccgtctgaattccatgtatcagaccaacttggaaaattccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaagtatggcacgagcagtgatggattttttggctttgagcaaatgcccaataaaaccgtcgtggttggtgccggatacattgcagtcgaattggcatcaattttggctgaccttggctctgaacccatctgctgatccgttatgatcgtgttctgcg

SEQ ID NO: 95034 - DNA, 1611 bp, Heterodera glycines
  SCN-specific regions: Sequence locations=1-56,90-270,292-481,503 -1146,1174-1505,1527-1611
gatttgtgttgttcgttttaatatttttcgtgtccactgattttactgtgcatcgaaaggacagaaaagaaggaaaaggcgggcaaaggaccgaccgaccgaagacgccgccgccgcaatgcccggcggatccttcccgccccttcccccgacgacgtcagccaccgccaaacccaccaaacagcgtcaccaaaagtcctcttcttcctccgcttcgcattcgcctcattccgactccgtcctcttcctgcacacctccgtcaacagcaccaaacagcagcaacaggaacaacaccggcaacggcccgtctctgtcccaccgtcaattggccctggcgtttttgcagaatttgacagcaccgaaggcggagcagcaacagccgctgatacgatgaattttctcactgagaagagttcgacaacccccgcaatgtccgctttgctcggccgacagccgacgatcaccgaagacgaagagaatgagcgggaggaagacgaggagcccatttcaatgcctgattttggtgctgcggtgacgcgcattgtttccgatttcggcgctggtcgtgtcaaaagtgaggcgcacgaggaagtgattatgatggaggacgatgtccgccaccaacaacagcagcaaatgccgcgttttgctggcaaattaattggcgacggtggcgaatgtcgcgatggaagtgccgaaggcgccgcccattcgatacatttgaaacgggaggaggaggacgccgcgggagccgaacaacagcggcagagggaagaagcggaagacgcggcggatttgggcgcggacgcactcaaagcacggcgagcagcgcggcagcggaaacgcgagccggtggtggtcgggtgccgcacattggagaaggcaatgcgaacgacggccgaagacagtgacatgtctccgctggagcaattccttctcggctccacgctgctctcccgtctctgttccttcttcgaaatggcatttgccgaagcacagcgccaacagcgcgggaaattcaaattgccaatcaaagactacggagttggcactgacggagtgatgagcgcgacatttccgagttaccccatgcccccgtccctcgcttcttcctcgctgcccaatgcgctcggttcgcccggcgaccattctgtccaccagcagtttcacccctccacccattgtatggttcgtctccaactgttcgtctgtccgcagcagttccgtttggtctccatgttggactatgccaccggcccccaatgtccggctgagtcggacgtgcgcattttcgagcgatatttcgcccgcgaagtcgtccgtatgaacaacgaattggccgtgttcgctttcgtcactctgtgccgtttttgtcacccgccaattttcgcctcctttgcccaactgatgatggcccaaatggagtcccaaccccggtggccatggcgtgtcgaattggaattggtacacaatgccgaggaatcggcccaacccacgggagcgaactctcatcagcagcagcagaagacgcaaaagatcgtcaaaaacagcattcaggtgcccgacatgtgcaaacgctttgtgtttgtgatttggttgaggccgcaatg

SEQ ID NO: 95035 - DNA, 480 bp, Heterodera glycines
  SCN-specific regions: Sequence locations=1-74,98-330,352-480
atcgttccgtcaattacattcattctctattattgttttcaacaaatatctcttgcatttccatttcattgcctttaaaaaatttcaaggatggttcagagaaatttgaattgacccattctctcagaattttccaattgtttaaaatcgaatattaaagtgggtgatttgttggaaattatttcaactggtttcatgcctcgggatttgtgacacgtttctctcaattcgctcggtttattattaattaattctttcccagaatgtaaaagtgaaatttatataaatataccaacataagtaataataatcagtttatttagtttttgatttgtacattcttttgtttttctgtgtagaaaggtttgtgtgcattgcaagtgcgaccgaaacgaacacgagcccagcagcaaccaggcactgagtgtgtacgaaagactcggcctcaaaccctcgtcggacatggccaaagtgctgcag

SEQ ID NO: 95036 - DNA, 591 bp, Heterodera glycines
  SCN-specific regions: Sequence locations=1-541,563-591
attccctccaatttcgttccatcgttttcaaaatgatgtggatgttcttccacactcaaatcaaggacacggttctattcaaatggtggaaagtcgaaactgtcggaagtcttctgatcacttgtttggtcatgtattttggtgccatttgcttcgaagccatcaaatggcttaggcttatgcttgaacaaaagtcgcgtcagccgaactccgccaattccgccggactcaacatgacagaccaaaacaaaacagtgccaatgactaatcgccggtacgccgaatcgctcctctcccgggtccatcttctccagagtgttctgttcacggttcaactgctgctctcctacctgctgatgctctgcttcatgactttctctgtttggattggaatggccatttgtgccggtgctgccaccggtttttggctttttgggaggagagtgccaatgttggcatttgcatcgagcggagcagcggggagcggacagggatatgcgagcaccggccgaacggaactccattaaaagccatgcattcattttccccaattaatttgcatcgaataaacgcatttggccaagtgccccg

SEQ ID NO: 95037 - DNA, 488 bp, Heterodera glycines
  SCN-specific regions: Sequence locations=1-124,147-488
gtccgttatctcgcaatttttgcaaaaatgaataatgcgatggattcggtccccgcgcggattgtcataattgggacaagtaaaatgcgcctttccgaaagattcaacaaattgcaaaaggctcccccgcctcctcttcctcaagctcagcaacagaaagtgtttttgaagagggagggtatcaatggggtcgcaattggccccgtaatttcacggcctcgggttattgatgaacgggacagaccagataatcggattcaaagcagcaaatcttttcttcacgacgattacatggacaatgatttatatggcgattttgtggagccgttccttcgacggcctcaaatgggtggttttcgcagtgcaaatttatacgagggatttcaaccggcgccagacccactgaagttgacattggatgcctatgatcagtattcgcggttccgtccgtctcatcgccggtccattcattctcgcataactgaaac

SEQ ID NO: 95038 - DNA, 482 bp, Heterodera glycines
  SCN-specific regions: Sequence locations=1-12,39-278,300-482
ccaagtttgaggtaataattttttaattaattatttttggctaaagtttaattatgatgaatttatttaaattccgagacatcgttttattacggaccattgcctttcctccgaattttgtattaaatcgtggaattaattaccgggaaaacagcaccatcggatcaaagcaaagtattggaaatgcagacgaattcaaattgcgcgaatttggccaaaaatacctcggcaaaagagaagtgaagttcacagagaaattggaatttcgaagcagtgccaatgaagtgccaatgccaatttaccaatgcattaattcgcgaggagaatttgttgacggaagcgaagagtgtcctctgccgaaggaaatcgcagttaaaatatacaaagaaatggttaaattgaatacaatggacaaaattttgtatgaatcgcaacggcaaggacgaatttcattttatatgaccaattttggcgaggaggcc

SEQ ID NO: 95039 - DNA, 582 bp, Heterodera glycines
  SCN-specific regions: Sequence locations=1-39,67-452,480-582
ttcataattgtcaatttttttaatcttcaatgaatgcctaccaacagcagcaacaacagcaacttctccaggcttactacagccaattccaaccccaaggggtggcaggtgctgacggacaagtgccggccaagtacaagagcacactgtgcaacatttggttgatggagggcatttgcacgcgcggaaaacaatgccattacgcacatgggatcaaagagctgaactacagacaagatgacacaatgagtcgcttctacaaaacatctctgtgcactttttaccagcagcgcggcttttgtaacaacggcgaccaatgtcggtgggcccatggcgaagccgaacttcgcaagggggcagacggttcttctaatggactggcgaattattacgctgcgacaatgcaagcgatggccaccggtcagcagaacgccaacggctcgtcagccgaagcggcggcggctgccgctgctgccggttggaattgaattgattctcgatcatttgtataactaaccgattgtcaaaaattgttaagaatgcataacatttgggcaaaaatgtatctttcaatttgaaaaa

SEQ ID NO: 95040 - DNA, 588 bp, Heterodera glycines
  SCN-specific regions: Sequence locations=1-7,29-588
gtcaaatcttacaatttttatattatttgaaagcccttcacaagcaatttcaatggaccatcttatcgcattgatcgacggtgcttgccttcgcatgcaaagtagtgcccttcattgggttagtgacagtatcaagtcgaagtccgagcctaagaagccggagaagttcaaaacgcagctgtgccatcactacagtcagaatggattttgccggttcggttccagttgttggtttgcgcatggggagaacgaacttcgctctgtctctgctggttcgtccttttcttcgcccatcgggagccgtaaaccgcgttcgttgttgccacgcccgcctccgccgctgatgttcggttccagttgttggtttgcgcatggggagaacgaacttcgctctgtttctgctggttcgtccttttcttcgcccatcgggagccgtaaaccgcgttcgttgttgccacgcccgcctccgtcgctgctgttcaacattttccccaaaaatccctgattttcccgagaatgctttttttccgcactcaccgtttttaatttttgaaatcaaatttacattttttattgtcaaagtttttc

SEQ ID NO: 95041 - DNA, 371 bp, Heterodera glycines
  SCN-specific regions: Sequence locations=1-58,81-371
caagtttgaggatttttttctcgaagataattcaaatttccattaaaatttacaactcagtctccaacaactgttttgacaatgtctgctgtacaattcaaacagtcatttgacaaagtctgtgccaccacagccaacgcatttcgcttcagcctccaatggtgttttgtgccgctggtcgttattcttggctttcgtcgcggtgccgagccgttgccgaacggcgaaattgtgccattgtcgatcgcgtcactcttttggggctgaacttttggcgtgtgatgtttgacgccgacaaaatatattttcaataataaaacgagcaaatgtttttttgttagtccttgaataaacaatttttcctaaaaacc

SEQ ID NO: 95042 - DNA, 514 bp, Heterodera glycines
  SCN-specific regions: Sequence locations=1-123,148-240,263-364,386 -399,421-462,484-514
caagtttgagctattcagttctgatttgcaatttgttttattaccattctcaacaatgccgaaagcttcgaaaaacaaggaccccaacatgccaaagcgtgcccaatctgcctacttcatctggatgttggccaacagggagaagatcaaaaagccggggatgagtgtggctgaagttgctaaagccgcaggtgtcgagtggggacgcatgtcagcagcggacaagacactttgggaacagaaggcggcagacgacaagaagcgctacgagcaggaaatgactcagtacagagctcgccagaagtagacgattgggcagtgaatgacgttttatctttgacttccttttccgctgttctctcctatatttaaaagtcaacaaaaatcgaccttccatttgtcgtccttttcgacattctgatttatttctctcagtttaacttttattctgatcatgtacgtatacattgcatctggaaaatgatgatcaaataaatggaaatcatcaaaaaaa

SEQ ID NO: 95043 - DNA, 426 bp, Heterodera glycines
  SCN-specific regions: Sequence locations=1-426
cgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgcctcgtcatgaacgcgcggctccatcaccaccaccagtgaaaagggaacgtactccggaaccaccgccacgccgactttgtgttcgaaatctaagcagaaatatcacaaaagcgcacatggaggaaatcttcgctctgtttggggctctaaagtcctgtgagttgccaatggaccgtgtgcatgtgcatt

SEQ ID NO: 95044 - DNA, 1166 bp, Heterodera glycines
  SCN-specific regions: Sequence locations=1-329,352-1166
tccatttctaaatacaaaatcatttctcctctttgatcagctgattccttccaaatgccttctgagtacggcattgaaaccgactcagtgactcttcagcgttttgtgctaaacgaacagaagaaattcccggatgcaaccggcgacctgaccactcttctgaccagtctgttgaccgctgtcaaagcgatctcttcggctgtccgcaaggcgggattggcacaattgtacggagttgcgggaaatgtaaatgtgcaaggggaagacgtgaagaaattggatgtgctgagcaacgaactgatgattaacatgttgaagtcgtcatacaccgtttccactttggtttctgaagagaacgaacaggtcattgaggtggaagtgagcggcacccaaggcaaatacatcgtcacgttcgacccgctggacgggtcatcgaacatcgactgtttggtgtccatcggaaccatcttcggcatcttcagaaaggcgagcaacacttccaccaaggaggaggacactctgcagacaggacggaaaatggtagcctgcggggtacgcattgtacgggtcggccactatggtggtgctgtcgaccccgggccgtgtcgatgggttcactttggacccgagcattggcgaatttattctcacaaatccggcgatgcgagtgccgaagaagggcaaaatttacagtataaatgagggatatgccaagaaatggtccaaagggatcaccgaatacatccgatcgcgcaaattccccgaagagggcaaatcggcgtacggacagcgctatgtcgggtcgatggtagccgatgttcaccgcactttgttgtacggcggcattttcatgtatcccgcgaccacagatgcgccaaatgggaaacttcgcctcctttacgaatgcaatccgatggcatttgtcatggaaaacgccggggggaaggcccactcggggaaatgcccgattttggacatacagccgaagtccatccaccaaagagcgcccatctttttgggctcgaaggaagacgtggaggaattgctggaatacatccgaaaacacgaccaataagaaaatgagacggaacgaaagacaaccaatgaacaatcgagcaaaatgataattatctataacaattacatggaattggcagggcatttaa

SEQ ID NO: 95045 - DNA, 524 bp, Heterodera glycines
  SCN-specific regions: Sequence locations=1-524
gtccaatcaaggtgatgcaatgtcagaaggactgtgaagaggcgcgccgacaaagggaccgcgaagtgaacaaaaaacggaccattcagcaatttgaggaggaggagcgtcgtgcgcgtgcaattgcttccgccgcctttgctgaccccgtgccgctgacggcggacgaacgcggccatgccgaactgatgaagcgcatttcgccgatgcccatgcgacgcatcatggtctccgccacgcagaatcagcagaaaaccgaagctgcggcgcgtgttgtcgccgcttacgaccgcacggcgatggcggcaccggcaccgcaatttgttcagcagccgagggggcgcacttttcccaccgctttgtcagtgtttggcgaatgcgtgccaaataattgtcgtcgtgtcggagcaatgccctcaaaaaacatcgtcggagttcgcctaacccagcagaccaattctgtggcaaacgcttcgcaactgaagcgaacttttcctggaaagtgagaaatattgaaacgcaga

SEQ ID NO: 95046 - DNA, 636 bp, Heterodera glycines
  SCN-specific regions: Sequence locations=1-442,464-636
gtttgagagagtaaataacaacttataaaatgctttcacgacttttcctccaaccgaacaaccttccgtctattcgatatttggcaacttctgcgttttccaaagctcgctatggtttccggccttccggtggagcaggacaatatgcatttcgctttaaagaagcttttgctgcgcgtcaggttgcgccgactcttcgtgaacgccttctcggccctaccactggcaaaccatttatcgtcggaacttacgcacttgccggggcttcagtttttggcattggaatgttgtgctactacggacttaccacgactgtcgacagcgctgctgttcgttccaatttatggcctgattatgttcgtcagagacttcagtcgacctacgcttatttggctggtagccttgccttgactgcgggtgctggagtggctgctgcccgtagtcctggaattttggctcttaccagcgctccatcacttctggtttggtttggttctctcgctgctattattggttctggtatcgttgttcaaaaaatcgactaccatggcaactcggctgccaaacatttggcttggttggctcattgtggcattcttggtgcagttttggctcccctttgttttgttggtggac

SEQ ID NO: 95047 - DNA, 662 bp, Heterodera glycines
  SCN-specific regions: Sequence locations=1-7,29-662
gccatccatttctttttctgttcaatgtcttcgtttttcatgcatcaccagcagaagcggtcgcaccaacaagcggccgccgtcactctggcggacattcgctggatggaaccgatggccgcgactgaaagtgccgctacttcttcaacaccggcaaagcggctgttgacacgactcggcacaaccagagtgggccgctacgttcaacagttggccatcgattacgcagcttccttccgcgacatcgtcgttggaatgcgtcagcgaccgctgcgagccgtcgcttgcggcgccgccttggcttcgcttgtgttcactttaaaatccaatccggacgaaattgcgctgcgcgcgcgtttggctcagttgcgtcagcaaatggtgctcatcccggcgtccattcacagcactcgtgccgacgaacggctcgagcagtacaccgtcctgttgaatgggaatcggcttgaactcgtcgactttttgctcttctctgtgctcgttgagcgtccgtttgacaaaaagaatgacttttacgctgcccacgacaaaacattgcgtggatggccgtggaccgagctgtggcggaacgcgtgggacatcggcgcgctcggccgtttctgggccttggagcggtcctttgacaattgcgacgttcgccacga

SEQ ID NO: 95048 - DNA, 644 bp, Heterodera glycines
  SCN-specific regions: Sequence locations=1-644
agtccttaagcttatttcattaattttgatgtcaagcttgctatgagctttcaatggccttggcattttgattttcctccatttttcaccatccaaccaaacctttcaactcgtgacaaacaactaaaagcttggggacgacttttgctcgattattgccaagcaaatcgtatttacaccactgatttggacgaaatttcaaagtcggatttattcaacaatcgtcgactgaatagacatttggatctgtcagggattcgggcagtgttcgactttctcgaacttcaaaaacacgttgagtggaaggataaggacaagacgcgctgcaacatttattggcgtagaccataagagtggggccaattgctttacgagtgggcaaattcaattggattgttgaacactgtggtcacattgtacgagttgacccaaggcgaatacgtcgcgaaagaatctttttacggtttggacaaagacgtgctgttaaaagggctccaacatttggagaaccaaggcaaagctgtgctgattgacattgacggcgaaaagggcggtgtcaaatttctgtgaacaaagctttgtgttcaccgttctatggccatggaaaagggttcgaattttttgcgcaattccgacattgttga

SEQ ID NO: 95049 - DNA, 609 bp, Heterodera glycines
  SCN-specific regions: Sequence locations=1-9,32-400,424-609
ataagacagaaaattatttaacttattccttaaaccaaaaaatcatggttcgtcgtggtggtcgttcttcttcaccaaaagctagcgctccggttcgaagtgtgaaaagcacttctcctgctcgttcggccgttccgtctcgtcctgctggtactcaaccaacttccggtgcaacggcaccgcagcagaaagggcctgggctgctcggacaaatggctgcaactgctggaggagtggcgattggttcggcaatgggtcatgccatcggtaatatgttctctgggggtaatgctcaagaagtcgctgctcagcaagatgttcctgccaattcggacaactttgaaaccaccaagcagtactcacagccctgtgagattgagtggcgccagtttcttgagtgttctcagaaccagagcgatgttagcatatgccagggattcaacgacctcttcaaggaatgcaaagctcgctttggccgttagaccttgaaggaaggaattagaaccaatgagaaacgaagaggacgatttatgtgttaactgtccaacggaacattgctattattgatatatgaattaggtgttgggacataaagcatttcttgcgcta

SEQ ID NO: 95050 - DNA, 947 bp, Heterodera glycines
  SCN-specific regions: Sequence locations=1-592,614-947
ccaagtttgagttttcactgttttttgtccacaaaatgccttcgtccgcccaaagaaagcgtgccgaattgcactggggtatcatcggcttggggaacatcgccaatgattttgtgcttgcgatggcttattgtcaacacccgaacaaagtgaccgccgtggccacttccaattccgtggaaagggcgcagcaattcatccaaaaggttggcctgaacagcgaacaggtcaaggcttatggcaactacgagcagttgctgcaggacgccgacgtggacgtcgtttacatcgccaccattaacagcacccatttgccccttataatttccgcacttgaacaccacaaaagtgtgctgtgcgaaaagccaatggtttattcaagtgccgaactttccgttgtccaaacggtgcaaaaaacgatcaatcgaagggagggaaagaaactctttgtgatggaaggcttttggtctggtttctttccgagttggcagaaaatccgacaaacggtgcgcgacggacagatgggcaaccccaaattggtctcggtggatttcagtcaaaaattgcccgacaaacggcgcgacctttccaatggcatttgtcccctggtggacatcggctgttacaccgtcgatttcgccacttttgtttttgagggcaaaaaaagtgatcgacgtgaaagtgatcggagatgtgtctgctgaggacggtgttgacaattgggcctgtattgccttgcgctttgagggcggcggtcactccgtttgccattacaatggcaatttgtcgaccaattcgaatgcttcggtgacttttgaaaatggcagtgttttggaattgccggaacgcttttgggcgtccaccgatttgcgcagtcggagcgaattgcaaacgcatcgaaagggccaatggcacgacgaacattttgcattcccggagagaaaggg

SEQ ID NO: 95051 - DNA, 462 bp, Heterodera glycines
  SCN-specific regions: Sequence locations=1-309,334-410,459-462
attttaattaaaattatccgaaaatctccatactaaaaaaatgaattctgcgacaatgttcactctgctgttgatcattggcactgttcttgcactgacaattggcatgccagcccccggcggatctgatgaaagtgtctcatcgatgcgccaaaagcgcggctacggaatgagcaacggaggcggaatgggcaatggatttggaggcggaatgggcaacggatttggaggcggaatgggcaacggatttggaggcggaatgggcaacggttttggaggcggaatgggcaatggttttggaggcggaatgggcggcggaagcggcggtggctatgggtacggtaaacgtcgctgatgaattactgtgttttacattatgacgacgacatttgatatgctcagatttatggaaatttttattcatttgtatttataaataattttaagtttatataattccat

SEQ ID NO: 95052 - DNA, 602 bp, Heterodera glycines
  SCN-specific regions: Sequence locations=1-602
gtccaattaagcctttattttttcactttccactgactgtgccttttcgtcttcaattttgttcatccaaaatggcggaggaaaccagcaaaaccagtgaaaacatcgctgaggacaacggcatcaaagcgctcgactctttgtttgccgccgtcgcccacgcctcaaaatgtttggcgtccgctgccggcacgcccaacttctgcttggccacgcccgcctttctcgccttcatggtttggtgctgtttcctcatgccgcctgtcgctgtgcttttccgcagttaccgccgcgacggcaacgcgttcactgtgcaggcggcgtacaacgtcattctgtgcttcttcctctgggtgcccggcatgttgcacgccctttggttctgtttcggtgagacggtgcgtatgtttcgtcgtcgcgtgccgccatcggacgacgcacagaaaaacgaataagggaaaagcatcgaaggatgacagagagagacacaacggcaggcaccgattagacactaattagacgataatttatatgtttttaatgtttttcttaaattcttaagtgtttttatttgaggtgcataaaaaaagacacattcgaaa

SEQ ID NO: 95053 - DNA, 475 bp, Heterodera glycines
  SCN-specific regions: Sequence locations=1-159,184-475
gtccatttaagccatgaatgagtgccattcaccagtttttggaatggagtgcactttctgccgagttaacgttcaaatttgaaaatttgcgcaggctcctttatttgttcgtcgattcgctgtttgggctgatcattttgacttttgccacttcgcaatggacaaacatttccaccaatttttgggccgcaattcatttgtacatcgaacagttggaaacgctgatcacttggctgaccaacaaccccgcggggctgaaactgaacgacgcgctgaacacctttctggccaactttttcttctaccatatccatttgtggaaaacttatgtcaccgtttttgaacactcattgactaattggttgctaattgtcgccttcggcgcattgggcttttcggtgctcgtcgcttttctgtctgactttcttcgcgtgcttaccgtgcacattttctgcttccacatttacacgcacag

SEQ ID NO: 95054 - DNA, 1008 bp, Heterodera glycines
  SCN-specific regions: Sequence locations=1-98,120-203,227-521,543-1008
attaagtatgaatttgctacacaaagaatggtatacggaattctcgcctgacgatgcccaacgaattgctggcactggggacgggtgttccaaaatgatgaagttggatggtgccgaactgtcaggggcctggactgggcaagcattttctttgaatgtggacaaaattcttttctccgaacgttcgaaatttcaggacgttcttgttttcaagagtaaaacatttggtaatgttttggtgttggactgagcgattcaaacgacagacagagacgaatttgcataccaagaaatgttagcacatttaccaatgtgttctcatcccgacccgaagcaggttctgatcattgggggcggcgatggcggaattttgcgtgaagtgcttaaacatccctcggtggagagagtggtcatgtgcgaaattgatgaaatggttgtccaagtggccaagaaatttttgcacggattggccacttcttttgactcgccgaaactccaacttcacattggagatggtttcgagtttctaaaaggacatgaagcggaattcgatgtaattatcactgattcttcggacccaattggcccagccgagtcgcttttcggcaagtcttattatcaattggtcagaaacgcgttgaaagaagacggagtgttggcgagtcaggcggagagcatttggctccatttgccactgatttccaaattgatgaattgcgcgcgcgatttgttcccttcggtggcttatgcttctgcgactgttcccacttatccttcgggcactatcggatatttgctcgcctcaaaacggcagatgcatgttctgagtgttccgcttcgtcccctcaatgattccgaatgccaatcgatgggtctgaaattttacaatcgccttttacactcggcttcttttgtgctccctaactttgccgaagaggcgctcaatcagcagcaaaacagtggaagagaccagtgaaatgaaaagggacgacggaagcgcattaattt

SEQ ID NO: 95055 - DNA, 452 bp, Heterodera glycines
  SCN-specific regions: Sequence locations=1-191,213-403,427-452
gtccaattaagctgctgaggaacggttcttacaatcgcaaaatgatcagaagaaacttttgggaaaaatcagtgaattggagaaagaacagaaacagctgcagaaggaaaacatcgattcggcatgcctttgtgatttccattcgtcagctccgtttggccatcgaaattggtgacccggtgctgatttcgcgctgcttcctttacatttcactcgcatttgcccaaaaagggcaattccttacggcactcaaaattgtgcgtcaggaatggatcagaggcattgagcttaagtccgcttttttgctgaattgcacccgcggcgtttggtccactatcaaatggctgatgatgaacagaaaagtgatgatgcttaaataatttcgcacacatattttttcctttaatttattgttttgtgttttggctaattaatcaaattaattgacaaat

SEQ ID NO: 95056 - DNA, 642 bp, Heterodera glycines
  SCN-specific regions: Sequence locations=1-642
ttaagattcaataaaaaattttaatgcatttgtcagtttgttcattattgctaaaaaggcttccttctacacgcttggccactacgcttgctaatgttagggcaaaaaatgtgaagcagccgtcgactgagcggataaatgcaatttctctggatgatttcccaattgcttatcctgattttcttcgctccgaagttcttgatcgtagagacccgttgtttgaacaactcgtccaagcagacatgtttgaaagacgtatggtaattgacatccccgaattctatgttggttctgtgttagctgtcacaatgtctgaccctaacaccgtaagtaagcagcacagattcgttggcatatgcattcggcgcgaaaaacagggacttcagcacacttttacacttcgaaatgttattgatggcctcggtattgaaattatgtacgaaatatacaacccaacaattttgcggattgaaactcttttgctcgagaaaagactggacgaggacctcacctaccttgcggatgctttgcccgagtacaccactttcaaattcaacatggaaccagtgagccatacagcaggaaaaccggttcccgtgaaccccttaaaggtgaagctgaagcctccgccatggacacttc

SEQ ID NO: 95057 - DNA, 632 bp, Heterodera glycines
  SCN-specific regions: Sequence locations=1-632
aggccaaggagtgattttggtgtacgatgtgtccaatcggccgtctttcgagaatctcgaccatttgctgttggaggtggacacttactgcaccaaaagtgacaccgtcaaaatgttggtcggcaacaaaatcgacgcggagcgaagaatggtctcgcgggaggagggccttcaatttgcgaagaaacaccgaatgcttttcatcgaggcgagcgcaaagacgcgcgaaggagttcaatgcgcatttgaggaactcgtggaaaagcaatttcgacatggtcagtctgtgctctaaggatgaacatactcagtttttgtctttgccgcgccgttgcgccgtgtacgaaattgacactgcgcagtcggtgttgacgccgagtggaacccgctatcaatttggcgacgacctcgccatgctgcgcgctcgcttgcccgcctgtgtcggcctctatcgcccgcagggcattgtgtgcattggacagttggtagatgaactcaaccgtctttctttgccgcggctgcccgactttccgttgcacaaatttctgttgccgctcactgaacagcaggaggagaagctcaaggagcacacgcgacagatcaaaccgccacgttacgacgcagtgacaaac

SEQ ID NO: 95058 - DNA, 551 bp, Heterodera glycines
  SCN-specific regions: Sequence locations=1-168,190-349,372-415,437-466
caagtttgaggttttaaataattccgctaatatttgttaattcatttttggcctttctctgctcaaatgcgactcgttcagcttctccatttggcactgcttgttcagcttttgctggcgcctgttcttttggccgttggccaaaccgatgaaaaagtcaaacgaattcaaaagagagaggggccccccgaggcgaatttggtcgacaaaagtgcggtgccggccgaagggaatggcatgaaaatacggagacgacgcggcaccaaactgaaggcaatggcaggcggtgccgcggcaggactcggcgcggcacttctctacaaagcatttaagggcaaaggctaattgaatgagggaggagaagcagcggagaagggagggaatctccgaaggggtgataatccgaaagatattcataaatgaattaaaaataaattaacaaggaaatacgaaataacattcaatgaaataataaaattcacttttatttaaattaaagataatacttattgcatttaaaaagttattttacttattaaattttatttttc

SEQ ID NO: 95059 - DNA, 177 bp, Heterodera glycines
  SCN-specific regions: Sequence locations=1-177
gtttgaggaaattctctctaacttggattttgagccatcgcgttgaaaagacagatgatgaaaaacgactgggacccattaaaaacgaagtcggacattaaacagcggctcaaccgtctcttcgggcggttcgaccagtactcagaatttgcagccaaacctcggactcctgaccat

SEQ ID NO: 95060 - DNA, 228 bp, Heterodera glycines
  SCN-specific regions: Sequence locations=1-228
cggcacttcgtacagtaggacatgccgacgaaactaccggatgctttgcccatcaaattcacactgagatggccatgatgatgccaaattggatgttcgaaattgcatcaaagctgcaaatcaaaagcattgaaaagaaaaatagaggaaattcctgagaaaacatttccataaaaacattatttttttatggctgtcgcatgtgctgaataaatcgctgtgttttac

SEQ ID NO: 95061 - DNA, 532 bp, Heterodera glycines
  SCN-specific regions: Sequence locations=32-493,516-532
cctcgtgccgaattcggcacgaggtggtcgtattttgtacgctgtgttggagcattcttttcggcaacgcgagggggacgaaaagcgatgctatcttgaacttccgcccctaattgcaccgatcaaatgctcaattttgcccatttcttctaatgagcgacttgacccaataatctttgctgttcgggaccaactgacctctcgagaaatctcttctaaaattgatgacagttctggttccattggtcgtcgctatgctcgaactgacgaaattggcataccatttggcattacggtggactttgagtctgagttgcagccgtggactgtgaccttgcgaaatgcgccaacaatgcaacaaattcgtgtttctgttagtgaaattggtgaagttgtcgggcatttggtgaaaggcaaaatgaattgggagacagcaatggccaaatacccaattttcaatgccaaataaatatttgcatttcatacatattgtattttattgactttctttttgttgggattataagtttat

SEQ ID NO: 95062 - DNA, 932 bp, Heterodera glycines
  SCN-specific regions: Sequence locations=1-727,749-932
gataatttgccaataagcaatatccacattaaagcaattgaatagtctgataattactaaaatgaacaattacgaattcgccatgaattcgcctcacatggaaatggccaaattcaaggagttcatggacgactctagtgaagaatttgtcgctttgtcaccgatgatacaaaaccagcgagattggagcccatattcgaaccaaggagggaccgtttgtgtgttggttggtgacgattttgtcgtggtcgctaatgacactcgtctgacgggcgatgctgaaattgagattctgtcgcgcaagtgcgagaagacgcacattttgaccaacaaaatcataatgacttcttgcggattttacggcgatgtgctccaattgaggcgcattctcgagctacgtattaaccacttcgagtttatctaccagaggcccatgtctttggaccagtgcggtgaaatgctttcccgtactctttactcgcgtcgtttttttcccctatttcacggggaccattatttgtggaattaccagtgatggccgtggtgacctttacagttacgacccggttggttgtattgaaaccaaattattcgaagcaagtggaaatggtggaagcactctgagtacatttttcgagaaccaatgggcttactcgacggtcgcacccgaggagcgtaaaaacatgccaaaacggactttggagcgtgctctttcggttatccgtgatgcttttcgtgggctgtcagagcgcgagacaaccaccggcgactctctcaatgtgtattggttgcaggcgggtgacgaaaaggttcatcaggagacttatcgcctgcgtggagattagccgcttttctgtgctgttgttggaaataatccgatcattttttgtctccgtcggcatatttttttcttataaattctgccatttaaa

SEQ ID NO: 95063 - DNA, 938 bp, Heterodera glycines
  SCN-specific regions: Sequence locations=1-938
aggcaaacacgtaaaattgcaatttggcaaaatatttgcgtattttgtatcagtggatgtgtcggatttccgatttctaacctttttgggctcgaaattctgttttccataattttttgagggcctcggcacttatcactgtttataattccaaaagcagtaaatgggtcataagttgctgaatactgcggaatgccttggcatttccgttttgacatttgcacaattttctaccaactcggcctttggccaatgccaatttcgcgaccagtcatcgctttgttcgtttcggctccccactcattcactaatttgtaagttcacaaatgctaagcttcaccacctttttggccaatttggcctttaactcggccaatcccagcgttattcactctttgcatgcgatgaatattaattggatttttgacaatttgccgtataaaagggagggcaaacgaaggcaaaagcacacgccgtccacaccattcaatcaaaaccaaccaaatccccactcattagctcattatgaaatttgcccctctggctttgcttgtgatccttttggtgtctttggtcgctgccgtctctgctaattccaacaacccttttgatgcggacgcggccgacaacggtggcatgaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaagacaaaatgccaagaatatgtgtgatcagtgacaaattcaaacccaatgccgcgccctttcgatttatttccgatggaatgacaattccaaacttttttttaatttgttaaaattaaagagtgcatggtaataatttaaattcgtt

SEQ ID NO: 95064 - DNA, 496 bp, Heterodera glycines
  SCN-specific regions: Sequence locations=1-192,220-335,369-371,415 -436,458-496
tatcacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggaggaggaggaggaggaaattacggtggtggagccccgggtggaaattacggcggttccagcggctcatacaatggccatcgcgcacgccgattcgcttgataaatgacaaataaagaaagtggatgatgatgaagtgttgttataaataaaaagtaaacaaaacaatctatttttaattactttattttaaattgtttttttaattttttagctattttagtgaatgttcgatgtttattttaataattttcctttttaataaatttgagttcatttcggaagaagcgcgcaa

SEQ ID NO: 95065 - DNA, 379 bp, Heterodera glycines
  SCN-specific regions: Sequence locations=1-262,284-379
aattaagccataatcgtttcacaatgttgattttcccgcacatcaaattttcgacactccttaaacgcgcgactgtcaacagctcctattatgtctcatacgctgcctatggtgcctctgcttttcttgtgttggtttacgttacggaatggaagcgtttcgcccgttatattcccggactccgttcgcagatcaaatcggacgaatgaatgaatgtctcgtggggtgtgcggaacggtcgactaattaggcaatgatgatgacaatggctgctgttgttgtgtttaagcatagaattctgacaaaagcacgtgtataaatcacaaatccctttttttctcgaatatttgttgagtgatcaaatgatatttaatcaaaa

SEQ ID NO: 95066 - DNA, 840 bp, Heterodera glycines
  SCN-specific regions: Sequence locations=1-177,200-777,817-840
accatagacgctggttgacggatttggcttcggccaaaaattccgtatcacaacaatgacaatctgattaccttcacacatttcgatgtggacatggctttgttggtgttttcggaggctgtcgacgcaacttcggttatgtccctaattggaacaacggcgcattcgttgcttgcgatctctccgttttccatggctcctcagtcgtccaaatggtgccgtgccaaagtttggcttgcctctggcggcatttccttttctccgtccgccggtgtttttcgtgccggcagtcctcgctttgtgaacactgattttctgaccaagtacttttcgtcgtctccaagctgtactcggacattgccaagaaaagcactcacttcgttagtgtcaatgtgcgaggaattaattgcggaggagaacaatccgtgggaagtgtcggcactgacgagtgcccgtttagcacttgacggaattacgcaggaaaccttcaaattgacggaacaaaattgcgagaaattgaagcagttcgacccgcaacgttcggcaatgtatgacgaaatgtttgacaaagtccgaattatccacgaactgaccaaaaacacttccgacacacccgagcaaagccaattggatttgcttatggaggcgaaaagcgatcggcttaatctgaatggaattggactgatcagcctgctccatcttcggcctctgtccggcttagtccaggaactcaatctgcagaacaaccgggtcacttctgatcagatcactcaactctgctcatttgctgcgctcacttccctcactttggatggcaatcccatcgacagactccctctg

SEQ ID NO: 95067 - DNA, 390 bp, Heterodera glycines
  SCN-specific regions: Sequence locations=1-345,367-390
ttgacattggcactggcaaagtgacggactacgtgaagtttgatgctggcaacatttgcatgatcactggtggacacaacattggtcgtgtgggcattgtcggacatcgcgagcgtcacccgggctcctttgacattgtgcacatcaaagactctgctggccatggccattcatttgccacacggatgaccaacgttttcatcattggcaagggtgccactccgttgatcagtttgcccgcttccaagggcatccgtttgtccattgcggaggagcgtgaccgccgtcttgcgcagaagcagaaagtttgagcctgatcccgaagaacccatttttctgtcatggatgttattgttttgtttgttggcataaagaaaaagagtgttaaaa

SEQ ID NO: 95068 - DNA, 917 bp, Heterodera glycines
  SCN-specific regions: Sequence locations=1-407,436-874,896-917
gtttgagttaaggattttgactgctttctttattctgttcttccaaaaaacatggcgcgtggacccaaaaagcatttgaagcggttggccgcaccaaaaaaatggatgctggacaagctgggcggcgtttttgcgcctcgtccaatgtgcggtccgcacaaattgcgcgagtcgttgccgctcattctcttcctgcgcaaccgtctcaaatacgcccagtcgtacaacgaggcgcgcatgatttgcaaacaacggctgatcaaggtggacggcaaagtgcgcactgaaatgcgcttcccatgcggaatcatggatgttatctcaattgaaaagaccaacgaaacttttcgtttgttgaacgatgtgaagggacgatttgtcatccaccgaatccaaagtcgtgaaggccagtacaaactgtgcaaggtgaagaagcaggcggtcggtgacaagcaagtgccgtacattgtcacgcacgacgcacgcaccattcgctacccggacccgcacatcaaggcggatgacaccgtggtgattgacattggcactggcaaagtgacggactacgtgaagtttgatgctggcaacatttgcatgatcactggtggacacaacattggccgtgtgggcattgtccgacatcgcgagcgtcacccgggctcctttgacattgtgcacatcaaagacgccgctggccactcattcgctacacggatgaccaacgttttcatcattggcaagggtgcaactccgttgatcagtttgcccgcttccaagggcatccgtttgtccattgcggaggagcgtgaccgccgtcttgcgcagaagcagaaagtttgagcctgatcccgaagaacccatttttttgtcatggatgttattgttttgtttgttggcataaagaaaaagagtgttag

SEQ ID NO: 95069 - DNA, 479 bp, Heterodera glycines
  SCN-specific regions: Sequence locations=1-120,143-479
gtattttaatgcgtcttgagaagtgttggttttgttcatcaacaatttatccgggccacggaattcaattcgtacgtaacgacgcaacggttttcaagttttgtaggtcaaaatgcaacaaattatttaaaaagaagaagaacccgcgcaaattgaaatggacgaaggcatcgcggcgaattcggggaaaagaattggtcaacgatgttactcaagcgatggaaattcgcagaaacgaaccgacaaaatatgatagaaacctttgggaaactgcagttgaggcagtaaaggaaattcacagcattcgacaccgtcggtacggagagcacataaaaagcactctgaagccgggaaaacaagcggtgaagagggcaatggtggagaaggcgcgcaagaaagtgcatttgataagggcgccagttgccatgggcgaggacgacgagaaattggaggtggtcgaagacggagagcaaaagacg

SEQ ID NO: 95070 - DNA, 696 bp, Heterodera glycines
  SCN-specific regions: Sequence locations=1-312,334-582,605-696
attaaattaacaatgttttcttttgtaaaaatgcacccatcgtttttattccaccgaaccgttggtaaaaaaactaacggtgattggctcgggtttgatgggcgcgggcattgcccaagtcagtgcccaggcaaacgtaaaagttgtgctggtcgaccaaagtcagtcaatcgttgagaaggccaaaagtggcattgaaaacagcatcaaacgggtggcgaagaaacaattcgaagacccggggaaacagaatgaactcgtcacccgcgctctttccaatatttccctgtcgacggatatttcgcaggccgtgtcgggcgccgatttggtcattgaggcaatttctgagaatttggacgtaaaacggaaactgttcgcagaagtggagtcggctttgccacaaaatgggaaaatggccacaaacacttcttctctgacattggccgacattgcggccaatttgaagcgcaaagattcctttggggggctgcactttttcaaccccgtcccaattatgaaacttctcgaggttgtccgctttgatggcaccagcgaagagacattcaacgttctgatggactttggcaaaaccattggcaaaacgaccgtcgtttgcaaggacaccccggggttcatagttaaccgtttgctggttccttttatgctggaagcaatgcgaatgttcgaccgcggcga

SEQ ID NO: 95071 - DNA, 565 bp, Heterodera glycines
  SCN-specific regions: Sequence locations=1-444,488-565
aaggagggtttgagtcaagaaactattaaaagtatggctgcaattgagaagcctcagattgttcaacaacccgtgcaagtttttggtcggaaaaagacagcgactgccgttgcattcgcgaagaagggcaaaggcctgataaaggtcaatggacgtcctttggagtttattcagccagaaattctgcgcatcaaacttcaagagccaattctaattgtgggcaaagacaaatttgcaggcattgacatacgaattcgcgtcaaaggcggtggacacgttgcacaaatttatgctgttcgtcaagcacttgccaaatcggtggtggctttctaccagaagaatgtcgatgaacaaagcaaaaaggagctgaaagagcaatttgtcgcctacgaccgcaatttgttggtggccgaccctcggcgccacgagccgaagaagtttggaggacctggagctcgtgctcgctaccagaagtcttaccgttaagatctatgggataccattttttgacgatcctttttgttgttgatgtaatgcgttatcattaaaattttgttggaaaaaa

SEQ ID NO: 95072 - DNA, 571 bp, Heterodera glycines
  SCN-specific regions: Sequence locations=1-41,65-134,158-571
ctttttcattcgttttgctaatgggtcctgctgctttgctgcttctcctcccctccctccttctgctttttctgctcatccgtgctcttcttgagcttatccccgtctcgcggttggataagcgttctgtgctaatcaccggctgcgattcgggctttggcttcgacttggcactgcgatgtttgggtgccgggatgcgcgtttttgccggctgtttgactcagacaggaattcagtctctaaagaaaagtgcccaagaaaagggaattgccgtggaacttttggaaccaattgaattggacgtcacaagtgacgaatctgtggcaaaggcattggaattcgtggaacgaaaattaggaccgggaaaagggcttcacgctttggtcaacaacgcgggaatcagtggcaacgagagttgggacgattggctgattccaaaggactacgaagatgttttccaggtgaacactctcggcacaattcgcgtcactcacgcattcaaacgactcgtaaagcgcgagagggagtcccgaattgtgattatggccagctcctgcggccgcgtggcact

SEQ ID NO: 95073 - DNA, 478 bp, Heterodera glycines
  SCN-specific regions: Sequence locations=1-133,157-203,225-478
ctcccgtttctttgtgtttctgtgataaataaaaatgtcttctcattcttcttctgttgtggttgataattgttgtccaccatcacaaatgacaacttcttcttcccccgctgcctttcgttcttctgcgctcgcttttcttcagttcctcaacaaatcggtcacccctttccatgctgtcgaatcggtcgaggccattctgaagagtgcaaattttgttcaaaagtccgagtatgacaagcttcaaattcaaccaaaggatcgtttctatgtcaaaaaaagcgagacttccatttttgcttttgctgctggcggtgcctttaaaccgtccgaagcgggggtttccattgtcgtcgcgcacactgacagtccttgcttgcgcattaagcccgtctccaaaaagacctccgaacaatttcttcaagtcggtgtttcgctgtacggcggcggtctgtggcgcacgtggttcgaccgcgac

SEQ ID NO: 95074 - DNA, 917 bp, Heterodera glycines
  SCN-specific regions: Sequence locations=1-23,54-110,135-215,253 -260,292-292,316-345,415-415,493-493,628-881
gtttgaggacaaatggttgccgccaatctgaagctttccctgatttttgtggccggcttttgcctgctgttcatcgccgactccgatgccgggaagtcgtgcaaaccgggagaaaagggaccgccaggccctccagggaagccgggaaacaaggggaagcccggcgtgtgcaagcccaaatatgaaacaacttccaagtacggtacgactacttccaagtacgacaccaccacttccaagtacggtacaacaacacccgaatacgatacgacaacatccaaatacgatacaacgacttccaaatacgacacaacaacttccgactacggtacgacaacttccaaatacgatacaaccacttccaagtacgatacaaccacttccaagtacgacacgacaacttcaaagtacggtacgactactcaaaagtaccgtggcaaacgctttgcggatgccgtgctcgttcgggctgctcgcgctgagtacgacgccgattgcccggccggtcccccgggagatgccggcattgccggaccgcccggccccccccggcgagccgggcaaatgctatggcagcgggtccaaagagtccaaagaaaaggagtacaaacccagcaagcgcagcattgacaacttcgagcatggcttgcgcgtcgccaggggctacaagcaagaagtcggaccccctggccccgcgggaccgcccggccctcccggaccggacggaccgcccggagaatgtgaatgcaaatactgaggatgatgctgaagatggtccacgatgtgagctcaaccgttttgttcctttgcctgattatccatcgatgtgtgaaactgtagcattagtagtactgtattgtcgatggaataaaaattttattaaagaaaaaaaaaaaaaaaaaaaaaaaaaaaaaaaa

SEQ ID NO: 95075 - DNA, 481 bp, Heterodera glycines
  SCN-specific regions: Sequence locations=1-141,182-195,228-368,405-481
gaaataacaaattcgggcaaatgggactgcatcattcttcacgacgtagatttggtgcctgaacatgatcacaatttgtaccgctgcttcaaggaccatccaacccactttttccggcgttttgacgagaataattacgcgtaatttattttattaatcatatatttatttaaataataaagaaacttacccctaaaaatatgaaaattggaaaaataatttaaaattcaaggctttcaattttcccagaatattcatattatttttgggaagactggcagttctgggtccataacttatgacagaatggtagccacaataagacatgaattcttaactcaatattttggtggatatatatgattacatttaaaaacaaatccaaaaactaattaacgaaataattaattgcattttataattaagtcctcttccggacaacaactttggcgaagtgtccggcttcaccccggaacaatat

SEQ ID NO: 95076 - DNA, 495 bp, Heterodera glycines
  SCN-specific regions: Sequence locations=1-3,29-190,212-234,257 -395,419-495
agctaattaatttatttaatataaatttgttccaaatgtgctgcatcaattcaaaaatgttgctgctcgtggcggcatttgttgttctgttgtgcctgctcaatcagaacgtcggagctgagaaaatcattgtactgtataatgggaaaaagtacgatctgaccgagttccacaaaagccatccgggaggtgaagaggtgttgaaaaaagtgaacggaaaggacgtgaaggaggtgaaaataatgtatttggagggcaaaaagggagtgaaaacggaccatttggtgcagcacaaacacagcaaacatacaatcaacgaattcttgccaacgttcgagatcaaacactaaattacaacacttcgccaactgcagaatgttagctgaatttaaatgaatgaatatttaataaaaatgaatgcttacatatattgacgcttgtgtattgttacataaatgttaattgaaataattagaataaatatttgccttaaaa

SEQ ID NO: 95077 - DNA, 535 bp, Heterodera glycines
  SCN-specific regions: Sequence locations=1-96,119-535
gtttgagataaatttattaagaacaatgcgttcagtaaaacatggaggaaaaaaaggaatgcgattcagatacaaattgtcagcagttaagaggcaaaacaaaaagcagaagaaaaagcaaaggaacatagctggatgctctttgatcaaaaaagcatggcaaacccaactatcatcgcggcaaaatttaagtgcaatgggactggtctatgatccaaatgaggcattgaaaaagaatcctgaattcgccatggaaatggaccaaagcgaaattgaagtaattggattgccagaagccaaagctttgggaagcgtgaaggaacaaaaaaaggcgaccaaatcaaagaaagcatgcccaaagttgaacaaatctgaggccgagtcgtcgaaagttgtgttggaacttcagcaaatcgcattggaaggagcccagcaaatggccgagcaaaagcaaaggaaaagagaacgggcgaagctgcagcaaagcgacatcgaattttgccagaaaatgttgcaaaggcacggagagaattat

SEQ ID NO: 95078 - DNA, 602 bp, Heterodera glycines
  SCN-specific regions: Sequence locations=1-111,134-261,284-602
attatcaggaaattggtcgccgatggggatggcactggggatgaccggcgaattgtccaattattccaattgataattatgttgagcaaatcaaacgctgatacgaaaagtattactaacaaaattctaatcaacttggaccaaattgaactttctttccaaaaacaagcacagatttccgccataaccgaaattgaaattgcaaattatgaacaactttgcaccgaaattgatgaaatgatcacccaaaataacaacaaaatggatgcagtgaaaagggaattggcagaggcaaaacaaatccgaaaaaaccgacaggaatatgacgcactcgctaaacttatcaaagaaaagccgagcagagtcgaaacttcgaaaaggctgaaactgcttcaggatgagttggaagaagcatacgccaaacaaaagatgctcgaacaacggttgattgaaaagaggaagaatatgtacactcttgctgttctgctggacaacctcgaggaaatgaacaaagaatccgaggacgtgcccatgtcggaaggtgacgatgccagtccggccggagcagtcccatcgtcgtccgctgggtctttaaagtgaaa

SEQ ID NO: 95079 - DNA, 718 bp, Heterodera glycines
  SCN-specific regions: Sequence locations=1-639,669-682,704-718
tgagagtttcccaaaaaacaattctgcccaatatggtcacttcttcgccagacattcagcttatttttcagtcagttgaccgcgatcggtccggtcaaatcagtgccgatgagcttcaacaggcgctgtccaatggcacatggaagccgttcaacccggagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttgacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtaagtcaatgatggctaaacaatgagcaaaagaagggggaattattgactgatgaggatttgctaatacagtaacccacttatttttgtatgttttctgttaaacattatttacatatcactttcaattttacgacatttttgtttgaataaaaatttggaaacttaaaa

SEQ ID NO: 95080 - DNA, 686 bp, Heterodera glycines
  SCN-specific regions: Sequence locations=1-133,155-470,500-686
cgttacgtcgcttacagtcctcgcgccaaagaaactcacctaaatacgagtcgaatatttcttttttaattggcgtgtggcttcaaaacagaaaagtgccaaattattttcgaatttgagaaatgaattccaattcgttgctcttctctctgttcactttactgttgagcatcgccgccaatggccatttttgcttcggaaaagccatgggccagcagcgctcgcgacgagtggcggctgtggacaatggcaattttatcgtcgtggacggatccgtcagtgttgtcaatggagtgatctccggcaatggctgttattaccatgacggaaaagtgacggattatggcaaaacgcggacgctgaccggcgcagaacgtgccaaactgaagaagttcatcgacgaaatgcagcagatgagcgtaaagttcgcgcaggaaatgcaacggatgttcagcgcgacttttccgttcggtccgcccgcggcgccgcctccgcaatttcatttaccaccgcaagtgccgtgcttctgctcatcgtcgtcgtgttcaaagtttagagaaaaggcaaatcggatgaaataaatgatggaggaaaatgaatgtgatttggcataataaaactggctactgtagatgggctttaccatatagccacatgtcctaatgatactgtagcttttatttatt

SEQ ID NO: 95081 - DNA, 477 bp, Heterodera glycines
  SCN-specific regions: Sequence locations=1-477
caagtttgagctgtcccttccgcttcctgcttctcttcctcgcccttgtaattaaattccatcccctgcgctcgttttggccttccctcccacaaatgactgaagtgcctcccaacgcgcgtcaatggacactccattttggtggattggtggaagcggtcaatggcgcacacattgaccccagtggacgcactgatctactcaaagtgttggacagagccaagcgggacggcagtttgcaattggatggtggcgaaataacactgttggaatgcgattgcgatgcagtgagagtgagttcagcgaaggtggacgaaagcagcaaacctttagcattcattccactccatcagctttcttctgttggctttgtccatgaaccaccacaaaacattttggcactgaaagttggtgacgtggatgagaacaagcccgatcagtttgatctgataattctttacacttcaactgaggaaa

SEQ ID NO: 95082 - DNA, 935 bp, Heterodera glycines
  SCN-specific regions: Sequence locations=1-121,143-356,378-398,420 -883,920-935
gagaaataatacataatcaattaataatgtgtcgatttcaatgcgatcaacaatgttgtcccagcaaacaaacatacacagcaaaggataagctgaaaacggaggagcagcaattctcacggaacaaaaatgtgaaatttttctcgcccgactcttctgatgaaagtgaggatgacgagcatcataatcatcatcatgacaatcatcatctgctgcggaccaaaacgaacctttcgaattacaactttttacaatcatgcgaagacaattttttccgatcattcgatgccacaaaaattgccgacaatttttgccatgacagtgactcatcgctgtcattatcatcagcagcaactgaggaggaggactcggaggagtacaacagccagcagagtgacagtgaggaggacagcagcaaaacaacctcatcatccattgacgggtcaacgacgacgttcaaactgaaatccattttgtcaacaagtgccaagaggagtccaacagctgagaagcatgcttacgagaggcgtgtcagttttgcggaccgctggggcatgcaattgacatcgtttcgcacaattccgaaccgttttgctgatcggttttatgacgaattggagctggacttcaatgaagttaatttctccgacaacacatcatatttttggtgccaatcgcttcagcagcagagaaacaatttgcaaaactggtcattagatgaacaaggagaggtagcctgctgagaattgcttaaattcggctggtagatgaacagaaaacagatgggctatgacggacgggcaacactttaattaattaaccctgcgcaacattctacacaaattttcattgattttgaagattttacctacgtccatttagcatttttttatctatttttttattagtataaaaaaatctttttaccgtaaaaa

SEQ ID NO: 95083 - DNA, 690 bp, Heterodera glycines
  SCN-specific regions: Sequence locations=1-285,308-390,412-690
gtttgagagagcatctgcggaatggctgacgaatttgccaagccgaaatttgacggcaaaatcttccaaaaccccgacagcttcacaacatggaaaaacccgccttcggcaggagacccgagaagttggcgggacttcattaaatggaaatgggatgcaaagagcacgaaactgcccaatttgaaagtgcttgaccagactttgccggtgttaaagcctcggttccaaacggattctcggctttcggccacttggctcggccatgccacactttttgtgcgcattgacggcatttcagtgctcacagacccagtttgggcgatgtttgccactccttcgttccttcccttcttcaaattttgcccgcgttttcgtccaccgccgtgtaaaattgaggaattgccaaagattgacattgtcctcatctcccacaaccattacgaccatttggacgtcgtcgccgtccgtgagttggcacaacactttcctcacatcatttgggtcgtgccgttggggcttaagcaattggtgcaacacgagacgaactcaaaagcagtgcacgaaatgaattggggtgaccgtctggaactgcaattaaacgagagaacctttgaagtgttcagtgtgccggcacagcattggtcacagcgaaacttaattgaccgaaacacgtcattgtggagtggttgg

SEQ ID NO: 95084 - DNA, 472 bp, Heterodera glycines
  SCN-specific regions: Sequence locations=1-472
gtttagttttgatggaaggcatcgatcagcctgtgacaaaaacgtgcaccatcgttgaaaaggactacgaccaggacgagctgttcatcttccgtcctctcaagttcaacacctgctcagtcgtcaaactttccatcgaacccataaatccgtcagaactgccaaaaatgctcgactcgctgcgtaaagtgaacaaatcctacccactgctgaccacccgagtagaggaaagtggggagcacgtgatgctcggaacgggcgaactttacatggactgtgtgatgcacgacatgagaaaggtgttctccgaaatcgacatcaaagtcgctgacccggtggtgtccttctgcgaaactgtcgtcgaaacttcgtccctgaaatgttttgctcaaacacccaaccaaaagaacaaaataacgatgattgccgaacccctcgagaagggattggcggaggatatcgaaggcgaaat

SEQ ID NO: 95085 - DNA, 586 bp, Heterodera glycines
  SCN-specific regions: Sequence locations=1-83,105-586
gccatccggaacatttcaaggcgaaagttctgtggatgctgcgcaagttaaaagccaatcgtgaacgcccgccttcactaatcttcattattcgcgatggactggacgaaggaaaagtggacaatgcgttgtccagtgagattgggctgtttcgcgaaagctgttctcagatcagccaatcgtggaagccgaaatttgtttattgtttggcggacaaacgacacaacagacgctttttcgaggtcgaggaacggctgccggacgcggcccagccgcgcaatgtgtgcaacccgcaaccgggttccgcggtcgatcgcaagttgacccgttcgggtgttctcaacctctacgttcaagcccatcatcccgtacgcgggacagcgaagattcccgagtttattttcccatgtaacgaagtgtgtgctaccaaggaggagttggaggcatttatcaacggactctgtcactcatggcaaattgtgaaggcggcgacgtcactgccggtccccgtttaccaggcccacgaacttgcgaagcgtggaaggtccaattacatggagctgaggagaatggcgcccgaacgaat

SEQ ID NO: 95086 - DNA, 460 bp, Heterodera glycines
  SCN-specific regions: Sequence locations=1-460
gtttgaggaaatttaagcttttgcattcttttcaaatttactttgacttcaataaagaagaaaaatggcttcatctggctttagcgtctatgttggcaacattccgtacaacgcaactgaagcggacattggcaatttgtttagtcagtgcggagtggtcaccaatgttcgcattgtgtacgaccgcgagaccaatcgcccaaagggctttggcttctgtgaattccaggaccaacaaggagctcagaatgcggttacaaatctgaacggagccgagctcaatgggcgtgcgctgcgtgtcaattggaccaacaaataagaaggttgtgcttgaactggacggatgatgatggatggattgtcatttttgaggatcgttttgacaattttcatttttctttgttgattggttttttgaaataaaggaatggttcgttaaaaaaagaagaggagagggaga

SEQ ID NO: 95087 - DNA, 303 bp, Heterodera glycines
  SCN-specific regions: Sequence locations=1-90,112-303
gacaaggacccgctgaaggagttgaagatgatgaggcggcgatttatccagctgacgaaacgcgtttccgaattggaaacgcaaaatgagcagaaaaatattgagaggaaagtgctgctgggcattgtgagtacgtcgactttgttgagtgtcgttttgtttgttcgcacatggctgaaccgttaggagggacccgtacaggaaatatcggaatgtccatatgttaatcccgtgttatttccttttctgtaccaacgaacttaaaatttttgttttattttcgcgaataaatcgttaacaacg

SEQ ID NO: 95088 - DNA, 376 bp, Heterodera glycines
  SCN-specific regions: Sequence locations=1-297,319-376
tgtaattagtaacagttaattgcctttgtctaatccttttgccattcatttggctttgaatgctttccttttgtcccccctttttttgctcgtcggttgttcagcgttatttctaagaataaagcgattggtccttttctcacgcaaacgttcgatgctttttgttggtcctggggaactttgtccgattcccggccccgcctcaacgaaaagcggacacatggccaaaggaaggaaagcgaagtcggcccagaaccaaccatcgaattgagctaatcgaataaccaaattctgatgcaattttgatttgtgcctaatgaatgtttttacccttttcataaaataggttaacgataaatgagcttaattatcaaaa

SEQ ID NO: 95089 - DNA, 648 bp, Heterodera glycines
  SCN-specific regions: Sequence locations=1-518,540-648
taatgtttcacattcaccgctatgacaaattgcaatggtgtggactggcgatccatcgtcgcactttgagtttgaccgtcgactattgtcgttatcgccagcgccgtccgtccatttcttttccgtcttccgccgttcgctcatccgaccattttcgcttcatttgcaacaccaccaatcatcgctttttgccattgggggttgggcgtctcaactcaattttgcattcgactgtttgcggagttggcccctctaatttttcagccggttttgcaaatcatttggttcaacatcgctttctttcttcaaagtctgatggtttgaacgtcttcgaaccgaagtggaagaaggcaattctagttgtactccttgtctctgctgttatcgttttgataatactggaggccagatcgaatttggcgaccgacgaagagggggaaggtttggaggagcaccggcggaaggaagaggagaagcggaggggccgccaggagcggatggcagctaatcggctgcctccggcagagccggaggccgaggaagagccggaggttattccatggcaagcgcgtagcgcggatgacgatgatgatcatgatgatccggatgcgcccgacaattggcgaaaccggacaaactgaagaaata

SEQ ID NO: 95090 - DNA, 624 bp, Heterodera glycines
  SCN-specific regions: Sequence locations=1-585,607-624
ctccaacttaagaacataaaatatttgcctttcagtaaaatctttcccggaatgtctgcggataaaacgggcgcactttttgtgggcgatatcattttagccgtcaatggcgagtcattactcaatgcgcggcatgacgaggctgtccgtgcacttaaacaagccgggaaaatggtcaatttgcaagtgcaatatcgacgcgatttgcacctccgtcgggagaatatgctgcaccggctgagttgggaggagagtcgggtcggtgcgtcgtcggctgggccgacggtgaacggacaaagtgcgggagaagcgttgcgaagtttcggactcaaattggcatttgtcacgcgaaacccactcgaggaggaggacccggagaatcggaccatcgaaatacgctcgcacagcgctcgacacattctgacgttgaggtgttcgtctgccactgaagcggacgcttggttcgaggccatccattcgtgtgccgacactctgctcactcaggcgttggcaacagtcaatttgatcctcggacaaagtccgcaagtgctccgcatgggttggatggcggagcaggacgccgccattggttggagggccgtttttgtggcattgactgtcaac

SEQ ID NO: 95091 - DNA, 1325 bp, Heterodera glycines
  SCN-specific regions: Sequence locations=1-362,387-1325
caacaacccttcccctccctcccatgttgtgtgatacgctgggcactgacaaaaacaaacggactcttttggtctacggccatttggacgttcagccggcggcgtttgaggacggctggaacacggaaccgttccaactcatcgaaaaggacgggaaattgtttggccgcggttccaccgatgacaaagggcccgtgctcggctggctgaatgtcatcgaaaccatgcaagggcttggcattgacatgcccatcaacataaagttcgtgttcgaggggatggaggagtgcggctccgacggattggacgaatgcctcgagcagcgcaaagattttctctccggcgtcgacttcgtgtgcatttcagacaattattggctgggcaaacagaagccgtgcatcacttacggccttcgcggtctttcgccgtttgccatcgaaatcagtgggcccaaccaggacctccattcgggcgtttacggcggcacaatccatgagccaatgaacgacctttgctggttgctcagccaattgactgacacaagggcgaacagtctgatcaaaaacattgacaaaatggtggccaaactcactgaggaggagcgcaacacttacaccaaaattgactttgacttgaatggattcaaaaaagacgttggcgttgagaaactcacttccgaagacccgaaacaaattctgatgagacgctggcgtgagcccgccctgtcaatccatggcattgagggcgcattctccgggaagggctttaagacggtaatcccttccaaagtgacaggcaaattcagcatcagaattgtgccggatatggtgccggaagaagtggacaaaatcgtcgttgattttgtcagcgaagtttggaaaggtcgcggctcccccaacaaaatgaaaatccttccgttgggcggcactttggcatggctcggcgacttcaaacagccgcactttcaagcgggagtcaaagcgattaaaaaggtgtatggcgtagagccggactttaccagggagggcggctccatcccagtgactctgaccttccaaaatctaacgggaaagagtgtgatgcttttgccgatgggcgcttcggacgacatggcacattcgcagaacgagaaactgaacgtgaccaactacgtgaacggcatgaagatgttcgcggcctacattttcgagtgcgccaaaatatgaactggcagaaattatttatcactcatagacattccatttattttccattccatcgactttctaacttctaattacttttaaaacccttgttaacttcgaaaatatatcactttctcactt

SEQ ID NO: 95092 - DNA, 120 bp, Heterodera glycines
  SCN-specific regions: Sequence locations=1-41,80-85,107-120
ggttaaccataatggtttccttaaaatattagcccaaataaaaacaaaatgattatgtaaataaatttctttattccttttttggacaagaaatgcttaggaaaattttttactaaaaaa

SEQ ID NO: 95093 - DNA, 481 bp, Heterodera glycines
  SCN-specific regions: Sequence locations=1-153,180-246,268-481
ggaacttggaaatcattcttcaaaatgggtcgcgttcgcaccaagactgtcaagaaggcctcccgggtcatgattgagaagtactacccccgcctcaccttggacttccagtccaacaagaaggtcgcctcggaggttgcttccatctcgtccaagcgtctccgcaacaagattgctggtttcaccacccacttgatgcgccgcattcaaaagggtcccgtccgcggcatctccttcaaactccaagaggaggagcgtgagcgcaaggacaactacgttcccgatgtgtctgctcttgagcagaatgagctcgttgttgacaccgagaccgctgcccttttgtcgtccctcgacatcaagcttccccaaatccgcaccgtcgctgtcaccgcccaaggtgagcgtcaaggccggaacgccgttgtgggcgccaacttccgtggcgaccgcggtgaccgcccccgtcgccccaagacccagc

SEQ ID NO: 95094 - DNA, 474 bp, Heterodera glycines
  SCN-specific regions: Sequence locations=1-296,319-474
gtccaattaagcaatgattgattgccattgccatttggcggatgaaagttttaatgaggacattagtcaggatgattttgagcgaattttggaattggcccaccaatttcccgattttatctttccatgtcttggaatgcatcctgtgcaacgtggacacatttcatgcagtgaagaaatgtacaaaaatttcgaagtggacaaatggattcgcactcattcagaccaactgatcgcagttggcgaggttggcttggatttcaagcctcaacatttgaagaacggagacgcggacaaggaggaacagcgcaaagtttttcgtgcacaaattgaactagctaaagaattgcagttgcccctaaacgtgcattctcgttcggctggtacgcctgtaattgaatggttggccgcgcatggggcgcaaaatgtgctgttgcacgccttcagtggcaatgtgaaaaatgctcaaaaggg

SEQ ID NO: 95095 - DNA, 480 bp, Heterodera glycines
  SCN-specific regions: Sequence locations=1-480
gtaaaatatggcttctccgttgcgtctccctcaacggatcggtgcccaccatttttggcacaatttcgacaattttctttttgacgccgacggcgtgttgtggcgggaacaacagcccctcgagggggcggtggaactcatcggaacgctgctcaaagcgggcaaaaaggtggtggtggtgacgaacaactccactcaaagttgtgccgaatacgtcaaaaagtgccaacgaattggcttcacagaccttgacgagcagaacattgtcagctcgggcatggtgttggcacatcagttgaacaaaatgaagcgcagtgccgagtttgggtcgacggcgcatttgccggtttatttgttcggctcggtcggactgcaaagactgctgaaggagagcggcatcgacagctttggcacggggcccgacccaattccggcggacactgccactttcgtctccgacttgccaaaccttgacttggg

SEQ ID NO: 95096 - DNA, 219 bp, Heterodera glycines
  misc_feature (219)..(219): n is a, c, g, or t
  SCN-specific regions: Sequence locations=1-20,42-191,214-219
aattgtcgaaccggaagagcaaaattcaccgcaaaagaaggagtacatctcgagacttcgcatgccaacaatcttcactcgccgcaacacgcgaaaggacaccgaaaagaaatgaacgtcttccacagacaacgcgctcatcgcatttttgtacgaagaagcgatgaagaattctaacatttaactcatcttacacaaacatataaatatatacacacn

SEQ ID NO: 95097 - DNA, 911 bp, Heterodera glycines
  SCN-specific regions: Sequence locations=1-389,411-500,522-884,907-911
gaccagcaaaactcatgcatgattcgactgataatcgacgaaccaaccgaactctgtgcgactcttttccaacaacatgctcgtaccatgttggaccaagttgacattatgctgctgctccatagacaggacggcgaggctacgcctggtgaattgatttgccggtcatcgcgtcgagttttgccgtgtgtgcgaattgatgacacttttttgcctcgtggagagtatttgctctgtgcccattcattttcaaaatttggagaacaaatggtttcggggactattgtcatacacagttcacgggaaattcaaaccatgaaactgcggaccacaactctcgacgacttgcgtcagtcaatgtgttctttgctgctcaaagaaggcgtcctccaaaattcttctcctgggattgccacacgttatctcaccaatgaatttgctggtttggtgttaatggtggacaattacagctcggacaattgtttgaaggtccattccgattgtcaaaactcaacaaatgttctttccactcgttcttctttgcttgcgttcgattccatccctccgctgcatcgacaggttgtcactcttttgacgcacttcgaaccctcccaatcttttatggtcactcatcgatgggtttaccaccaaacaaaattcccacaactgcgcgactttgtgccctgcactgaatttgcttccgctcagaattttccaccgttacaaacggaaacaatcggttatttgcatggcccttttccggtctataaatgatttgttcacatcttctaatttcgtcaaacatatcttttctatttcttttgtggatttattttttcccatcttcagcatctcatacatatcacttccattgtatattttcctcctttcatcaatgaatttattgactt

SEQ ID NO: 95098 - DNA, 468 bp, Heterodera glycines
  SCN-specific regions: Sequence locations=1-468
gcgaatcttcagcagcaaacgcacggcccaattgctggcactgactacgattcggcagatgaatatgtggtgattgaacaggaggaagaaaccgacttggaaaagaactcaactttgccggagacggtggctacgaacactaattcgactcccagtgacgtgcaaagtgtggcagcatcagtcggcactttggacgcggtcgctgacattggcaatggcctcgacggagcaaaactcagtgtttcgtctgttttcccacagaatgcaatgagcggctcgaactattcgcaaaatggcttcaattcttccatttttggatccttcgtgatggaagaccaacttcgcgatttagtccgttctgaaaatgagcagaaccgtctaatgttggacagcatcaaaaatgcaattggcgaacttacgaagcaaaaatcgaataacaacgaactgaatgcgctgatttcacaacaa

SEQ ID NO: 95099 - DNA, 986 bp, Heterodera glycines
  SCN-specific regions: Sequence locations=1-986
gtttgagaatccttcgggccatgtgactttaataaattttgccggtgtgaaatttgccattgcaccctcgatttatcttcttccttttctcactttcgttttgccatgcttttcctccctccctcccttttccttttgcttttcctcctccatcgtccctttgccaatgccctcggctgtatgtccgccgtttgtgccgccggcggtccctccccctcttcccatgccgtcaatcgcatcattcgttgcgcttccgactctttttgtggccattttcgcgctttgcggcgaaatgaccaatttgtcgaggcggtcgacctcagttgtcccgaattcgccgtggtgcgcgctcctttcgatggcgaaatttcggcttatcgtccgatgggagggagccgagcgcaggaggggacaaagggcgaatgtgtgccggatcagggagttcggatcgacggccgaggccaatggcagggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgcatgtgcaccggccaaatttgcgagacaaatcgcgcaaatgccctcgagggactcccatttaaatttgacagccgtttcaacggagtgcgcgggtgggaaatcgtttgtccgaatgttcggcccgaagagccgaattcgtcgggcgaatcgcctgaacaaagtgacaacagacaaacaatgagtcccaaaatttacagtcccatcgaaggcgaagtgatcggtcgcgtgcggctgagtgcgtcgagcaactcgcaaagctattcgggctgtgccaacgaaggaatatttgtagttggcacgggaaaatggacggacta

SEQ ID NO: 95100 - DNA, 907 bp, Heterodera glycines
  SCN-specific regions: Sequence locations=1-43,66-136,159-178,200 -569,591-875,901-907
aagtttgagaaaaaaaaattcttccatcaatttttcttattagcattttgccatccatacatattaaattctcaaaaaaacactaaaaactctaaaaatgtccgaccagcagtccggctcttcttcctcttccgccgtactcacttcccccaccccttttccaccacaacaacaaaaaccgccgctgctccgccgctgttccatgtcggaaccgcacttggacattgtgccacactttttgaaggattaaaaaagcgtccacccgtttgaccgtgtgttgtccggcctgttcgacaaaggctccacattctccgtgaacagcaccgattcggtcgaccaccattattcggcaaaaagtgatcgtcacgatcacccgttctccccgaccaatcagcagttgaccaagggcaaaagtgccatcggaatgatgagtaatagtgccgccgtcgccccttcctcggcggacggtctgctgcgcaagtcggccaccagtgcgtcggcactgtacagcagttctccacaacatggcacgacggccaaccatttcccgacaattcctgaggaccagggcctgaccatgtcggctggtcgtgacaaaatgccacagacagccgcctccgccagtccgccgaaatcgggcttcatgaatttcttcggcaccggcggcttcctctcgcgacccgtcacgcacacgccggaggagaactatcgtctgatcatggcgcttgatcgttgattgattgatttgatgagttggagagagagagagtgagctgaagcgcgggcgggagagtgccgtgccgaccaattttttctgttttttttttgtgccgtggacggtcggctgtgaattttttggatttttgggatttggagggcgcgcgcgggcggccggcggcgtgtacat

SEQ ID NO: 95101 - DNA, 827 bp, Heterodera glycines
  misc_feature (807)..(807): n is a, c, g, or t
  SCN-specific regions: Sequence locations=1-63,85-256,278-539,562-827
ccaagtttgagcctaatttgatataacgaatatcaatggaacatggaagcttgccgcttcaactcattattttattcgttttaacgttgcaaatttcaactcagtcgccagaaatttcagtgccttctgatgttcaaattttgtcagcagtccgaaacgtagatttgaccactcaaattgtcaaggttaaaactgactttgagttgaaaaatggaagaaacgaggaattgagcagttttgtacatgccatgtcggctgaggaggctgcaagactttcttggatgtccgcttatgagagcggcaaagaatcgggcaaattacggatttctcgtgttagagtcaaaggggtctcatcggacatggttttccacaaaattgagtttctcgatttgttaatgtccggttccaatatcaaactttcggtggattatgctcttacggaatatttggtgccctctcctaaggacattttgcagtcagaaaaccagctggtcatcttttccggtactgctaatgttctcagcgcctacccagtgatgaaagaaaattgtgtctataaaatcggttcctcaaagcccatttcattcacggagatagcaccgagcaaacattcacaggaaaaaatttcctacggaccatatgagaacaccaaagcgtattccaagaaaccaattaccattcattacgaaaacaatgcaccatttttggtcgcttcatccgtggagcgcatcattgaagtgtctcattggggcggaaacatcgctgtggaagaaaacgtcgaaattttgcacaaaggagccaaactanagggttcattttctcgactt

SEQ ID NO: 95102 - DNA, 480 bp, Heterodera glycines
  SCN-specific regions: Sequence locations=1-21,43-480
gtttgaggtgtcccatcggaatgcttttcgcctcttccgtcttccgcttctttctccgtcctcctccaaagcgttattcgtccttcctcctgaacacaatgtggagccctctcttctgtctgctggtcttcgctggtttggccgcgtgttgcgtttcccttccacagattcaatacgtcaatgacaagccgtactatctgatgcagaacatggaatgtcgaggaggcaaaatttacgagatcaatcaggtccaggacatcgacgagtgcaaggcggcatgtgtaactcggaattgccgggcagtcaacctcttccagctgggcgagttccaattcaaatgcgaaattttggcccatgtccacgggtacttccctgcccaaggagccgcttgttacatttcttacgtttgaaagagagagggcaatgtgacagattaatgaaaagcgatgtttttgcatttttatttttttagtttttttc

SEQ ID NO: 95103 - DNA, 255 bp, Heterodera glycines
  SCN-specific regions: Sequence locations=1-104,126-255
actcaacgggttctgctgttgttgctgctaggacgggttgctaaacaaattcggggtcgattcgcctcctcttttagagtcctcgcctcgctttgttccatcggttgctccttctcccctattccgtccccgggcaaaaatcgcccttttatcagctccaaattgcttctgtagaattcagtcacgaattgcgacatgtgtacagtgccctcaatttgtattggcgtaatttgcggagtatcgccgggctaatat

SEQ ID NO: 95104 - DNA, 495 bp, Heterodera glycines
  SCN-specific regions: Sequence locations=1-47,69-495
tttcggcctaaaccacaaaactaattaacattaagctggaagcaaacaaaggaatttaaataaatgaaagacattgccactgaagaaagtattgcacagaggcggcttaacctaaaagcgaatttcatgcggcagctacaaattcggcgtggtgttcttcccagcgaaattcccccggttggagtcgccacaaacgcagtgcccacaatgggaagaaagtttcgaaagcctttggaaagtcgctttccaccagccaaaccccgttttggccttggaatgacagccgccgatttcgaagacaaaacggacaactgttcttcattagccaaagggccttcactgacagaaacaaatgccccaaaaggaaggaatgttcgtccaaaagcaattaactgttacatcaatccgtcgcaatccgtctccacttggccaacttcgaatgacacggactccgatgggcaaagtccctctccgacgagttcggcttccgtcacg

SEQ ID NO: 95105 - DNA, 699 bp, Heterodera glycines
  SCN-specific regions: Sequence locations=1-8,30-699
gtagttcgataattccccatttctggtttaaaacacccccccccccccaccttttcctttcgctttgtctcatcttacgcattttgcgcaatttgtcccacaccgaatcaactgatttatttgtcgtcttcgaatgggtttattataccatttctcaactcagcatcagcacctaattcacccactgctgtgatggaatgtgttcgtcaccttctccatcttttgctattactgaccttctctggccaattgttggtgacattggccgacctttacgatgactacgaacagtgcaaatcttctggccattttggggcagaggacggctcgccatctttggtgtgcgactcggagggacggttgacgccgcaggcgctggcccaactgaatggaattctgacggatatggggagagacgcggggtgccaatgtgcagatggatgtgacgggaaaccattttctgtccgattgttggtgaccagcggcgaacgtgtcgaacaatcgggtggcacaacggcactgaatgaaacggccgggcgaatttgggaaagcgaaaggatgggcacggagcagtgcgataacggaatgctaatgctgtacattcgggaccagaaaagaatggtcactttccaaggccatcgacggctccaaatttacagcgaccgcgacattgacaatttgcacgaattgacttctcgg

SEQ ID NO: 95106 - DNA, 1105 bp, Heterodera glycines
  SCN-specific regions: Sequence locations=1-303,325-567,590-738,760 -827,852-1105
atccgctggacgattcgctaagtgaatttgacagagcgcaactgcgcgaattggacatgtttgaggacaacagcaacaaattttgcgaagtcgaagatgaaaatcccgaacgaatgcattacgtcaacttggccaagaaccccgagcggtacaccggttacaaaggcaattcggcggtcaaagtttggaagtgcatttacaacgagaactgtttcaaacccgacccgaaattcgacaaaaagtttctcctccaaccgacgccaacggggatgtgtttggagaagagagtgttctatcggctcatctccggccttcactcggccattaccgtttcgattgcggcccacaattacagaccggcccccggcggtttcggcaccggcacttggtaccgaaatgttgaattttttgaaaatcgcttcggtacgaaatggggcaaagaagggcccgaacggttgaggaatttgtacttcacttacatgctggaactgagggcattggtcaaagcgacgccgtacatccgaaaaagtcaactgttctacacgggcaacgagcaggaggaccgagaaacgcagcaatccttggaacacttcctcgccgtgctcaaagagttccccaaccaattcgacgagactcaacttttctcgaatttccaagagtcccacgcccgtctgctgaaggaggagtttcgcctgcacttttggaacatttcgcgtattatggactgtgtcggctgcgacaagtgccgactttggggcaaattgcaaacgcacggaatgggaacggcactgaaagtgctcttttcggaccttccgcggaacggaaacggagggaaagcgaacggaaggaaagagcaaacggaaaacggagaaagtgcagcgaacggcggacttttcaaattgacaagaaatgatttggtcgctctgttccaaagctttggcagatattcctccagcatttgggagatcgacggattcagaaaagagttccgacacgacgaattgtgaattgtccgctgaatttctttttcgtttcgcaaatgtcccatttttcctcctcctcgtttcctctccttttgtacgatgagtccgattaatttatttct

SEQ ID NO: 95107 - DNA, 647 bp, Heterodera glycines
  SCN-specific regions: Sequence locations=1-647
gtccatttaagcaatttgttaaacaactttttgagcaataatatcaaatcatatttgaatggatccgtccgctccagcgaagaagcgtggccgaccaccgaaggcgggcggcgtagcgaaaacaattgccaagaaaccaccagcgaccacaaaagcggcgcccaagtcgccgtccaagtcaccagccaaatcgcctccgagttcaccaccgcagccggcaaagggctcgcccgccgcaaagaacgccgtcaagccggcagcagcgactggacgcggccgtggccgcccaaagggcaccggcacatcggcagcagcgaagaagaaggcggccgcaccggcgggcggaggcacgggcaagcgcggacgcccaccgaagaagacagcgcagaaggccaaggagagcgatacggacgagcacgacgaggggactgaccctgacgaatcggcgagcagcaaatcgccctgacttttgacgtgttgaatgtgtgacttttgctgacccttgcgcggatggatctctgtgtaatgatgataatttcaccacccccattttttgtttgtttgttttttcttttgatttcttccgtttattttgacaccctttttttgtctccctttttcccccttttattttctgtcgcattctc

SEQ ID NO: 95108 - DNA, 470 bp, Heterodera glycines
  SCN-specific regions: Sequence locations=1-470
ttgagttttcttttcgctcaaaagggacatgtcgccatcagcacaaagggaagtgttcgcgtcgcgcgtctttccctgcgattcattggcgccgctcacaccgaatggcacgacaaatgcaccggcgcccctttcgaaagtgtcgacagagtcctcgacgagtacagagacttgaccagcgaactttcgtccctttgcgatggctccaccgaactttcccccggcgaacattccgtcgcttttcacttcaaactgccgatggattccgtgtcgaccattgccaaagacggacacggcgtggtcaaatacttttgcgttgcgtcgttggatttgcccgacgacgggggagacaacgaaatcgttgcggagaaggaattcgctgtcactgcctatctgaacttagacgcgcctcattttcgagagcccgcccattcctccgaacaaattaccaaaggcggagttttttgcgg

SEQ ID NO: 95109 - DNA, 378 bp, Heterodera glycines
  SCN-specific regions: Sequence locations=1-198,223-236,258-378
gcgtttttttcacaaaaaattccattaaaaatgcaacaaaatcgtgaaaatatactcgtggatgagagaatcaaatcttacgtagcatatgaattcctacgtattatcatcgtgccctgcatgtgagctacgcaggaattctgattctctgacccaagaaatagaaaagtcactgctctgaattgttaagggagcagatgcacattttatataaattttattacctaccataataaaaaatttattttagattacttagtttgcgaaatgtcaatttttgggtgtgttggtgaaatgtccgaatttggattagccggcgaaatgtccatacacacctttctcattgtaatttttttgccatactgttaaacgaaaaaa

SEQ ID NO: 95110 - DNA, 480 bp, Heterodera glycines
  misc_feature (276)..(276): n is a, c, g, or t
  misc_feature (278)..(278): n is a, c, g, or t
  SCN-specific regions: Sequence locations=1-121,143-271,307-480
acagaacgatgtgtgcgtgctgaactgtcgcatcgacttgggcatctgtgtggtcaaaaagtgcagcctgactgtgtgccctcggcccaaggatttcgggtcggtgccatgagaagtgccgaagcaaatgaggaaaatgcagaatgatcagagagagggagagaagagcagaggagagatgaacagcagccaattcaaatcactggtgatcagtgctaattgcctaccaattgaccgatcaattatttgactgatcgaaatttttatttacaaacnanaaaaaaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggggtaatagcgaagaggcccgcaccgatcg

SEQ ID NO: 95111 - DNA, 426 bp, Heterodera glycines
  misc_feature (424)..(424): n is a, c, g, or t
  SCN-specific regions: Sequence locations=42-42,213-273,296-322,344 -353,399-426
attacataataactaatagcttcataagaaataacaaattgatttacaaaattcaatcacttggaatgaaaaggtttgttggcatttcttccgccgtttttctctgtcacttctttttgccgtacgattgttggatcagtagtgggaaaaagacgggtcgcattatgccaatgccttgtggctactgtaatgcttgctggcacctaccgtttccactttgtacgcgtcgtgtttggcgatgatcgcatcgaaaccgctgaaaaggtcgttcagaaaagcgaccacttggatgggcgttgaagtggaggaaatgcgcgtgaaactgaacaaaaaggggtgggggattatttgggatttaaaacattaaaaaataattattttttaaattttaaatttaagatttgagtataaaatacccccttanaa

SEQ ID NO: 95112 - DNA, 292 bp, Heterodera glycines
  SCN-specific regions: Sequence locations=1-240,276-292
aattggagattgggggcttaatggagattgggggataattagagcaaatacggtaggccattttgccgtaaattgtctcattttagtgcattttcctccaatctcttacaattagcaaaatctctcctcctacgcttgtaacttttcccatagttctctttgcttcttttctttcactttttatttctttccgtttcaaagccttttccgttttctctctctctctccattcattacgggtttttttgtttaattatttattttcatatattattgttgattatacggcatt

SEQ ID NO: 95113 - DNA, 838 bp, Heterodera glycines
  SCN-specific regions: Sequence locations=1-838
aaaaaatttcaacggaggataaggaggacgttgtatcttgcgcacaattgtggtaagcatccattgatggctcacatggcgaagaaagcttcgaatttcttaattggtgatttcaactctgttgactttgacaatatggcggatcaacttggcaaccatggatatgtttcgccttgcaacatgctcactgcattggtatacattatgcggctaaaagaatcaaacgaaagagattttctcgccttcaatccaactgaactcttcgtttcttcgttggtgttggcaaccaaataccttaacgatggcactttgcaggaatttgtttggaacgacgaatgggcatcagtttcgggccttgcattacccaaactaaacgagttggaaattcgcctgctcacttctttacgttgggatgtttcaattcaatccgaagattttgaaaaagttttggcgagattagaagggttcgttgccagcgaaatggcccagcaaaatggcgttatgagctacaatgaactttgcattctgtccaacacacatggcttcaaccgttccattctctgtttgctcacagttctactgaagtttttgtttgtgttattggcttttcatctcgctttgttagccggtttatccgtgctgaatatggcagtctcgcgaaaacaggaattggcggcgagtgacgcgtgcatttatcatcacggatgggatgattgttcgcatccaccaattcttttagcaaatgaacgaaaaatcgatgcgaacttgacgaaagttgttcacaaggatgatttttttgcatttgttcatgcctttagcatcagttgatttttatttt

SEQ ID NO: 95114 - DNA, 928 bp, Heterodera glycines
  SCN-specific regions: Sequence locations=1-735,757-928
ctatttttgacgattcttctatttctttttttcttctccaatgctgaacaattaacgtttgttggcggacattcattcaatgaaatgggtgaatttcgtgtgaaatttcgtcaattggaggcggacattgaggaactgaagggcaaaaatgaagcaattcaaaaaagattggtcgagttcgaacagaaactgtcgacaagcgcaaattatacgcgaattgtgagtggacaagagatgattcgaattttggcgaaaaacaattggaaccaaacggacagtcacaaggaactgtttttgtttaagccaaatctgttaaaagtcgtttgtctgggagctgaaaaggttccacgtactgtacgtgccaaagacagggcgccaaaaaatttggaaattgtttactacgaagtgaaaattctttcagcggagcaaaaggattttgatggaacccaaaatgactcaattggcattggctttgcgcccaaatcgatgccattaggcaccaaggttggcacgcaccccggcacttttgcctacttcaacgatggcaatgtacgtggccacagaattgtgggcagcaccaagcaaaacttggccaaattcgatgccggtgacgtcatcggatgtggactgaatttgaccagcaaagaaatcattctgacgaagaatggcgaacgattggggaaaaaggagcagccgtaccaccgcttcatttcctctcattacggcagcgaattgtttgatagcaatttcttcttcgcatcaaaagaaaccgacgatttatatccggcaatttccttgaacaaccccggggacgaagtggaggccaattttggaccgaacttcaaatacacacttaattaaatgacatatccctttttccgatttattatttgtatttgaaaaataatgtgttaaacagtaaaaaaaa

SEQ ID NO: 95115 - DNA, 1564 bp, Heterodera glycines
  SCN-specific regions: Sequence locations=1-67,89-812,835-1564
caagtttgaggctctaaactttccactattcaatttctcaaaatgctcgctgccaccggaagatggccctcgtcctcctccaattcgggcttgaggattgccatggcaatttgtgccattttggcatgttgttccttaccgaactcaacagaagcggcactggccgaggttggccaacagcccaagggcaacaacccgttgctgtacagtgtcgacgacccaattgttcacttggacgccgacacgtttgaggacactgtgctgcggcccaaccgggaccgggcgtacatcgtcgagttctacaaggactggtgcggttactgtcgccgctttgcgccctatttcaaagtgctttccgaatccatcaaatcgtggccatttgtccaagtggcggccattaactgcgccgacgcatacaatgtgaaaatttgcaaggccaacgacattcctacggtgccgaaattgaagtacttcccgcgcaatgcccggtcatttgaggaaggccaagtgattgaacattcgtacgaatcggcgatggaaatgcgcgagcaagtgcacaagaagatcatggaagagttcaatgccgaaacgggcaaaggcaatgccgatttctacctgcaaaaaatggaggcacaacgccaacacaacaatgagaacagtcaaccggagccgtggagggacatgccgaacagcacacagttcctggcccaactcttcgagaaggacgccaaggatggactgccgttctccctggatttgctgctgtacaagccaagcgtggaggtccgccaagtgctggtgggcagtgccgacgaagtgccacgcaatgtgccaaagccagcgaaaggcaaagcaacggaagcggcggccttcaaattgccttatgtgagggcgatggaacgcggcaaaacggagccaattctggcggagagcctcaatgatcagacattggccaagttgcgtgaattggtgaagccaatgatggtggagttgaacaagacggaacaagccaaggcacaccataaggaaccggtgcaggtggtggactgtgcgcaatccccggaaaagtgcaagcaaatgttctttgtcagcgagacggacatgctgaaggccatccatacggcacttttggacgaagtgatttcatcgggcggggacgaaattaacggggaccgattcgccgccctccggaaatttgtggaactgctcattcagcgattcccgaagaaaacatttgaacgaaacccgcaattgagtgcacatcccaaggggacggcactttcatccatcggaaagcctctgctgcgaagtcaacgggcgtttaaagtgtttgagcaaatgaaacgctttttggacgcaaaagcgggcgacggcaaagtgtccatggacgagtggagggcggagtttgatcaggcgaaggcatttgaaaatgccaaattcgtttaatttgtgtttttgaatgattccaatagaaacaaaatggcgacccgtttccggtcacagccgaatgggagcactgcaagggaacgcgcaccattttccgcggcttcacatgcggcctgtg

SEQ ID NO: 95116 - DNA, 647 bp, Heterodera glycines
  SCN-specific regions: Sequence locations=1-321,343-344,366-647
gtccaattaaggatttatgccattccttttactccaatgaaaaaaaattgattgtcatccaccgatggcaaacagtggtgaacattcctcgcgccgtcagcagcaacaacaacgccatcctaacaccacggcggaaaacaactcggacattgagggcactgcgcatcgggtggcgtccgttactttgaacacggagtccgactcgcgcacatccgccgacctgccggcatatccttttcggagtaaacggcgcaaaaagttgccacgtcgagacaaacaacagggggccgatatggatgttgatgaacatcaaccgccatggaaaaaactgtcggtgaacaccgtggacaatttgactcttccaagttgtaaagtgcaaatggactgggagcatggacatggacaggcactgtccactgccaatgacagcactcaaaaccaatcgtccagcacaacgagacaagcatcggacatggaaaacagtgtatccgaccagttttcccattcacaatccgaatctgaggccagcacttccaacattgacgcggatgatgaacaaagtgactggcccggaaatgaactcgctcgtcatccccaactgtcctcctcctcttcggtcattgtgcccttccaactcgccccaccac

SEQ ID NO: 95117 - DNA, 773 bp, Heterodera glycines
  SCN-specific regions: Sequence locations=1-773
gttccctttcccaaatgccttttctgtcccttttctcttccgtctccgcttttgcccttctctctctcctttccttttcttcttctgtccatcacttccatcataaccatcactccgattcgtccaaaggacacaacggccatcatcagcagaaggaccatcaaacggcacaagaaattccttccaattcgttcccttgcgcctgcggcggtcattcgtccggcggggaaaatgcgcgatggatgaacggaatgccggcgaatggagttccgttgtttttgtttccggacaatgtcttgcgattggtcggcgtcgttctccgaagtgaaaatgcttttcatagggacaacaacgaattggcgcggcatcttttccatcttttggcccaccagttcccccgaaaatggtttatcgtcggaatcggcacaatgccatcgaatggtgcgaacgaaccgaaaatgtgggcccgcgaaggaatcgacgcactgaacgggactgtacagttgcaaagcccgcccggttacggtagctttccctttttggacggacggcgttttcaacgagaaaacggaagcaaaatttggtatttcgtatatgcggtggagccaatgacggacaaagcaaaggacggattgccaaagcaaagcttggcaaagtgtttgtcggaaggttgcccttctcgcgacaatttcgcctcactttgtgccaacaatcgccgtcagcttggaacggtcgtcgaatttgaccaaagttcggaaatgtccattttcgca

SEQ ID NO: 95118 - DNA, 228 bp, Heterodera glycines
  SCN-specific regions: Sequence locations=1-143,166-228
atattattgtcagagaaaattttttaattagagggcaataaagaataattttattaaaagtaacttaaaagttaattgaacaaaatttttggttaattatatttaagaaaatatcgacaaagttgcaacaaatttttccagggttttgaatggatttttaaatttcaaaaaacaaaacaaaaaatagtggaaaatttttgaatttttccattcttagaaggtgtattt

SEQ ID NO: 95119 - DNA, 420 bp, Heterodera glycines
  SCN-specific regions: Sequence locations=1-95,117-222,244-281,303-420
tggagggcaacccggcaccgacaattgtgtggaaaaagggcggccgaaaaatgccattgaccgacgaccgagtgcggtgccaaacggacggtgacacgggacatgtttctctgatcatttccaaatgtcggccacaagatggggacgagtacacattgatggtgaagaacgcgcatggcaagcacaaagttggcgccaagctgcttgtcacgccagcggccgaatcaaatttggacatccgggccaagcagaaaaaacgtggcacgggctttagcaattcggaacaggaaaaacagcgccaacggagtgatgccgagcccaaaagcaaggctgaacgacgcaaacgccaagtgtatgtggtggaggagccccgtgacacatttgttgtgccgttgaactcgcagcatgccaacgaaaagg

SEQ ID NO: 95120 - DNA, 467 bp, Heterodera glycines
  SCN-specific regions: Sequence locations=1-355,377-382,405-467
ataatcattactcgcggcccggcagttacacgcgcgtgtacggccaacaatcgctgtacacgccatccgtcatggcaccagaggccaaattggccaccgaacggcgcacttattcggggtacaattatgtggcaggcgaacacagcttcaatctgtccacgaagccctggtcccagtccaattaccgcttcctccgcgtctctcacatttcttcggtcccttggtatttccacggccaaaccagcaatgtcagacattacaacagttaccgcccgccctccttcactccgcgtctgtccacctattggaaaagttatttctgaccagcgaccgttcagaatggcatttcgttgtccttttgaattctttgccttttcacctttcatttttccctttgctttagtccctccattatcattctgtgcatagaaaatgagcgtaaagtgtcaataaatgtgcacaaaagc

SEQ ID NO: 95121 - DNA, 508 bp, Heterodera glycines
  SCN-specific regions: Sequence locations=1-508
gttcggataggttggccagatacgaacagtccatgctaattgagacgggacatgtgtacgcccaggcggcacgcgacaatgcgctggcggcacgcaacaattctgtgacggcgcaagagagtgcccgggccgtacgtgacatcaccgaccttatggtcaaacagctcgagtccaaggaccgtcaaatcgtcgacaaagactttcaactggcacaaaaagatgtgctgctggaagaaaaagaccggctgttacgcgagaaggacgagatgatcgcacgtcttcagggttatatcaacggacttggtgttccattgcccgcgccggcagaacagcagcagcagggcggcggtggccaatgataaattgtttgaacacttaaagagagagaggcctctgacagaatccgactgaccggaagaaaaaaattcgtggacttttcttttatgtggaatgttttgttttgttttttttgatgctttgcgcctaaaaaataaacattgcttctgac

SEQ ID NO: 95122 - DNA, 202 bp, Heterodera glycines
  SCN-specific regions: Sequence locations=1-202
ggccgtgctcatcgaaacaacccttggtgacttggtcatcgacctttttgtcgacgaacggccaaatgcgtgcaagaatttcctgaaactttgcaaaaacaaatattacaatctctgccaattcttcaccatcgagcccaaatacatcgccccaactggtgacccaacgaactccggaagaatgggcgaatcaatttatggc

SEQ ID NO: 95123 - DNA, 605 bp, Heterodera glycines
  SCN-specific regions: Sequence locations=1-319,341-363,386-605
ccaagtttgagcatttttatccacgatgatcagtagcagcaaattttgcacaaactttgatcagctttttaaccatttgcgtttattgtgttcaaatgacgccggtgcagcgcattacggcaccgaactgatgccaattatcaaagaaaatccctttttcggtgctttatgttcagtgatggcggaagagaagcaaaaaataagggcaatgacagccgaaatttcgtgtgcagcaatggcattggcattttcgttagactcgccaacggacgatgcgaaggacaaaaattgtgcggttgaccaaacattgagcgaatgcaaaaaatattatttggaggaaaacgaattggatggagaaacaaaggacaaaatgaagcagactttggaagaacatgaacaatttgggcaactgattgagcagaactccgtcgcctgtctccacacttcacgccgtctgttcgctgtccatgcccaacttcgtcccgtcacccttggcgatgtgcaacagtttggcattgtgctcaaactgagcacaaagaaatggcaaaacgaactgaaagatgcggtgtgcagccaattgttgctgatcaaatcacgcgcagggc

SEQ ID NO: 95124 - DNA, 757 bp, Heterodera glycines
  SCN-specific regions: Sequence locations=1-757
attaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgacaaaaattaattgaaaatattgatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgacaaaaattaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtaaaaaatgacgccaccttagccattaggcctagaaaaaagagctctttcgaatggtaccttcaaatcaaaaaacgactgtcaggaagctgagctacagaaaaaaattccaagccaaggccaagccactatagcagtatagtgacc

SEQ ID NO: 95125 - DNA, 1024 bp, Heterodera glycines
  SCN-specific regions: Sequence locations=1-970,992-1024
taaagataaaatacttgcgacaatattctttattctgttgtcttcatcgacaaaattgacacaaaaagggacataatggccactgcttgcaagttggaaatgagcttggacgagatcatcaaagcaaataagagcaagaccaaccaggcttcaattaatgggcgaaagactcaaatgactggaaagcgattgattcgcggcaatattgcgaagggaaagccattcatccgaaagcaaatcaatgggcagaatcagaccaagaagtttggacttaaacgcgttggaattaatgttcgccgtggtcgccctttgagaaagtctaaccgtgttgttgtcatgagaaaaaatttcgctgcgaagaacagagccgtaatttccgctacaaagaatttagtgaataaactcgtcaagaaagctcttaacaaatcgaatgtttcgccccgtggcaagcgttttatcgctaattctgcccgtcgtgtccgcacaattatgctcaacaaagtcagtccccgttctcgggtgatcactcgtcaacgccagcgaattgttgccgtacaaccgcaacagcagcccgtttttgttcaacgagttgtccgtgggcgtggtccaattcgttatgcgtccgatgctgcgttagttcctcagacgatgaaaatggttccgaagcgacgattccgcatcaatcctatgcaacaacagcaacctgtcctacttgtacagaatcaatcaccgaaacgccgattgccgtccttttcatcgatgagtgttcgtcaacacgtcaatgcattgcgtcgtgcgactactgtgcaacaactccagactcagtttgttaaccagcagctaccgattcgtcagcagtttcgagggcggcaggccatcactacccccgttgtgccaaatcgcagtcgaggcaaacaacaattcattcttgaccaacccgtgcaagcaggacctcaatttatgaaattttctccccgccgtcagcgccggcagactgcctctaccaatacgtcatcgttcaaca

SEQ ID NO: 95126 - DNA, 719 bp, Heterodera glycines
  SCN-specific regions: Sequence locations=1-441,463-680,703-719
gcccttggacgcctttagcattcccataaacaatggcattgtcaattttggcacttctttgcttggcgcttgcacactttggcaccggtcaggagaaaaaaactgagccattggaccacaaatggacatgtggcaccacgtggaaatatgaaaacactggacttacggtttcgtggagccttcccgagttcctcgccgaaacttcggtggatgtcgattgtccatcgcgaaagaaccgaatgaacaattgttgttttgatcatgacgattgttattcaaagcaattgggacaaacgaagtgcgacgacgttttttgtgattgcttagaaagagcaactaaaggatcatcacgctgcgaaacttatgagggaccaggcttttgtcatcttgtccgcacgtatggcgcgtcggcctaccgcgcgtcggcccccccgttttggagcagttgtggcactgtgttgaacagcgcgaaatatttgggatgtccttgcggcacgtacaaaacatgggaacgctgcggttttctgtatatgggctaccgttacctgtgctatgcgtgctgatgaattttttttttaattgaatttggcatattttcagttatggcggaatgattcaattttcatgatatgcttagataattttgtgggcttttttctatatattcatagtatatgcatatttcttatattctaaaataaacattttctggcaaaaaa

SEQ ID NO: 95127 - DNA, 473 bp, Heterodera glycines
  SCN-specific regions: Sequence locations=1-473
caacctttgagaattaaataattcattcatttttctatctatcttgacttagaagaagaaaatggcttcaactggctttagtgtctacgttggaaacattccatacaatactactgaggctgacatcggaagtatgtttagttcatgcggagtggtcactaatgttcgcatcgtgtacgaccgtgaaaccaaccgtccaaagggattcgcgttttgtgaatttcaagaccagcagggagctcagaatgcagtcacgaatatgaacggaattgagcttaatggacgcccattgcgtgttaattgggccaacaccaacaaatagaaggaaggtgatggatggtatacttttgttgacagaccatttcgatcataaaatcaaaataaacagtttgttctttgattaaattgtttgcttttctaagttggaataaacaatttacaaatttggaatatgctaggatcctacaaatata

SEQ ID NO: 95128 - DNA, 1021 bp, Heterodera glycines
  SCN-specific regions: Sequence locations=1-33,56-70,105-105,146 -146,191-191,231-267,296-862,884-1021
gtttgagattccaaccattttatcataaataatagaattaactttaaattcatccgacttttgaatatgcgcattttggtgggcgttaaacgggtaattgacttcgctgtcaaagtgcgcgtaaaaaaggacggcaccggcgttgtgaaggatggcgtaaaccattcgatgaacccattctgcgaaattgcgttagaagaggcggtgcgaatcaaagagcgtaaagagaaggagggcggtgggcccgttgaagtcgtcgccttttcatttggcacacaaaaagcacaggaaacactgaggacggcacttgcaaaaggcgctgacaaagcattgctcgtcgaggtcgacaacgccacagaggagaagttggagcctatccatgtggcacgggcattggccaaattggcgaaggaagacaaatacgacttgctgttgttgggaaaacaggcaatcgacgatgatgcaaaccaaacaggacaaatggtcgccggatatttgaattggccacaggcgactttcgccagcaaaattgaagaggatggcgcttatataaaagtaacgcgagaaatcgacggcggattagacactgtgaaattgaaattgccagccgttgtcaccgccgatcttcgactcaatgaagttcggtcttgtttcaacaaacattgattgtttttgttttttagcctcgttacgccaccctcccaaacattatgaaagccaagaaaaagccattggaaaaaaagacagcgcaagaatttggcattgacatgactaatcagacagaaactttggaagtctccgatcctccagttcgacaggcgggcggttttgtggacgatgtgcctggattagtttcgaagctcaaggagaagggagtgatttgaccgacaaatgagttatatggccagaagatatatactatatatatttttacactttgtctattgagaagtcgttttttctctctaatttgcccgctttatcctgccaaatagctgtttaaattctaaattttgcttaa

SEQ ID NO: 95129 - DNA, 515 bp, Heterodera glycines
  SCN-specific regions: Sequence locations=1-515
tgacaattttggcaattttttgtttggcatttgttcaccttggcatttctggcaaatacgataagtcggatgagcacgatggcaaatatggtgccggtccacctggtggctactcacatgagaacaacaacaacaacaattatggtggcgattcttcgggcgaaaaatatgagacaatggaacatatgtggtcatgtgccaccaaatggcaatgggaaaagcccggcgtgtcaatgaaatgggaaattaccgacacactcaccgaagcggcggtggacacggattgcccatcacggaaaaatcggatgaacaattgttgctacttgcagactgaatgctacaacaagcaaataggacaaaagagctgtgacaaccaattctgtgaatgtatggagcgagccactgctggcaaaaaacgatgctcaatttgggaggggccaggcttctgtcgtcattaccgcttatacggcgaatcgggataccgcgcagcggcccccccgttttggagcagttgt

SEQ ID NO: 95130 - DNA, 475 bp, Heterodera glycines
  SCN-specific regions: Sequence locations=1-216,241-475
gtccctttaagcagcgtgaggatgactttgaaaatagttagttctcttgagaatttgatcagattgactccggatgtccattcgattcttgtcctcgatggggacggagttccggttgtcagtgcaggcgaagagatacgaaatcggtcccagtattcaatttcttacaattcgcttgtcgagcaggccaaaaagttgggcatgggagaacagaaattttgggtgtttcgctacgaaatgaaccaggtggttatgctcaggagggatgcatttgccgtattcattatggcttctgcaaatgccaatatgggaattctctgcactatgtcagcgcaacttggaccaattttggaggaatgtaaagtcatcgtaaacgaagtcataaatggacagatggccgggcaaagtccgagataaatgaccaaatttttcttgtcgagaattttacatcataaagttttaactataataaaaa

SEQ ID NO: 95131 - DNA, 125 bp, Heterodera glycines
  SCN-specific regions: Sequence locations=1-125
attaattcattgtttttcgtttcggcactttctgcccatttgaccaatgatttctgcccttccttttcctcactaatttgtccttttcgcctttcctcacatggcaattcgattaaattttggtg

SEQ ID NO: 95132 - DNA, 612 bp, Heterodera glycines
  SCN-specific regions: Sequence locations=1-408,430-612
gtcggacattcaaaaagcgattcaggcactggaacgagaatacgccgaacagaaagagctgttcgaaaaatggaaggaagaaaatgcatccgaagctgatactgaaccatacaatgcatatgtagagcagttccgaggatgggagaaggatgtgatggacaatttgaaggaactgcgggcatccatcgcccgacagcccgtggcgccggagcccgagttgcccatggtcgacctggacactcagctgaacaacttgttggaccgtgtcgatactccgcaattcatcatggcttttatgagtatgagccaacaggacccaacgtttttggcaaaggcatttgaggttgtgatggaagagtgtcgtaccaccggcttctccaatccgattttgccccaaagtgccaccattccatctcttcggcctgtccaccgtctgcccactccgctccaccaacaaccgcccggcgtcccttccgcttcgtcgtcagcgcggcatcaatcggcgagaagtcctggctctttgtacctgccgcctccgctgcagcccaaagcgtatgtgcaaggctcatccctgctggggccatctcggccaacttccaccgtttcttacac

SEQ ID NO: 95133 - DNA, 475 bp, Heterodera glycines
  SCN-specific regions: Sequence locations=1-364,395-475
gttaaataaacgaagtttctttaaagttgcaataaaggtgaagtcgtcataatacggggttagtcctgaaatagacattcctatgagcagaaaagaaccatattacatcgaccatcgccaagtttcatcggataatttattttttttttcggtagaacggtagtgtagattttttttgaaaatttcaggaggtttcctctgtgacgtaaagcgaaatctccaaaattttcaagagaatccgcacaaacgcactccctcaaagaataaattgttcgagaatttggcaatgcctcctgcgacttggttccctcttgctcggttcagtctaaatatggcgcagtttcttggacccagggatgcagaaacttccaagggttcccccaaaataaatttaggttcccccattttaagttttcgcagtattttgcccgacacatcaagtaacgcggtcgacagttgggttcccttaaaacag

SEQ ID NO: 95134 - DNA, 862 bp, Heterodera glycines
  SCN-specific regions: Sequence locations=1-57,101-553,577-805,827-862
tgagaatgccatctcttcggatttgccccttcaatttccccaccaattcccttctaatttccgtccttttgcttcttttctgtctccaattctttcctctcaatgcccttcatcattcggtttttgttcgacgtgacttgagccgacccgcgccggatgatggcgtcgcgtccgcctccatcaacacggaggaggatttggggggactgaacaccgaatggctaactgacgatcagctgagcgaattggcctctgccgggagtaacgaagaacgaatgataaaaatgaggaccttttatgacaatttggaaggcgaagcgaagaaaggcgcaacgaagaaaatagtggaggaatgctacggatgggtggacgaagtggcgacggaggacgagcgaaacgcactgaagcaaatgcaccaccaaagccatgacgaatgcaaggccaaagtcagggaactgatgggacggctaagtgaggagagaagcgaacaagtggagaatcggatgggtttctgcgaacacgtctattacgggaagatggacggggaaggcgacggaggagcaggaacagctggagacgaacaccaccaccaccatcatcaccacaccaaaagacgggctcacaggcaacgcagagaccaccaccaccaccaccatggcgaacatggacttgaggattatttcaaaacgcatttggcatggttaacggatgagcaaaaagcggaaataagcaggatgaaggagtcagggaaaagccgacaggaaataaagcagaaagtgatcgaattgtacgacgcaaccactggagaagcgcgagaaaaggcaaccgaactgctgaagggcgggtgccgagagctgattaa

SEQ ID NO: 95135 - DNA, 674 bp, Heterodera glycines
  SCN-specific regions: Sequence locations=1-380,402-511,533-555,616-674
gtttgagtcaataaattcggttaccaagcatataattgttttcatttcctgaagtatcgtgtgaacgaacagccactgagagcataatgccgcctggtttcaaggagtacttttttctcgacaaattggcaaaagcgtttaatattgtgaaacaaactgggggcatccgagcagccattaaacagcgttatttgatggacacgaaccgtgctggcacattgataggcgaggatcagtttggcaaccgatacttcgaagacaacacttatttcgtgccccggaatcgctacgtcgtctacgccgagagggtttggctcgactacgacgcctcgcaaatcccgcccgaatggcaccgctggttgcaccacatttgcgacaaaccgccgaccgttgagccgccgccggagcgcaagacatggatgttggaacatgagccgaacaattcgattgtaatgagcaaaaaatacgtgccctattcgaccacacgcccaaaagtggagggatgggtgccggggaggaagagaagcgaagaggggacgacgcactgagtgagggcgaaggaatgggacgaatgatcgacggacggacaaaagacaaacggacgaacgaacgcaccaccaacccattcagttgtaatatttgtgagaggagaaggaataaacccaattaggact

SEQ ID NO: 95136 - DNA, 749 bp, Heterodera glycines
  SCN-specific regions: Sequence locations=1-24,46-142,172-749
acaataaagttgttttcgttcgttataaattcacaaataaatctccaaaatgctcctttcttccaactttgttggcgttggccgtgtcgcgtctcgtgccgttcaccgtttcttcctgtcgacttccgctgtgcgccttcagcaacaacacaaagaagaagaaaatatggacattgaaaatctcttctcggaacagcaaaatctgccgcaatcgcagagcgaagaccaaccgcaggtgttcgatgcaccgaagcgtcgcttcaacaaaggaatcaaccgtgttgaattgttgggcggtgtcggcagtcagccattggtaaaacagaccgcgcaaggctccgcttttgcctctttcaacttgtacacaaatgtggagcgtcgacttggcgatggcaccacaacgaccaacacggaagtgcacagtgttgtcgcattcggctccatggccaaatacgtggagaaaaacgtggaacggggcactcgtgtctatttgactggccgtcttcactacaccggcggtgcacttttccccgacgggacgcgctctccacgtatttgttcggtgaacttggaaagcatttacccgctctccaagcaaggcgcaattttgcgttaatgcgagtgaggcaattagaaaacgaattttggcgatgatggttgaattgaccagatgatgagacattttgatgatttgatttgtttttgtttattttttgagtcgttgttatgtcgtacaataatagaaaaat

SEQ ID NO: 95137 - DNA, 451 bp, Heterodera glycines
  SCN-specific regions: Sequence locations=1-146,168-343,398-423,445-451
gccgccgatttcctcccaataaaaagcaccaaattctcattaacaaaaagccttcaaaaaaaaaatgcattttttgttgaacttcaagctttttgcatccatctttcttgtactttgtgtggtttcgtttgtcgtctgccaggacaagccagctgaagcatgccttcatcccaaagacgagggaactggcggcttggcactcacacgatggtggtgggacggtagtgattgcgaggaatttacctacaaagggcagggcggcaacacaaacaatttcccatcaaaggagctttgtgatgacgtgtgcaagccatgaatgagccgtggaaagaagatggagcgtgaagagacaagcaaagaagaaaattgaagaaattaaattcaaaaaatgaaatgtagcactaatgcctaatgattttgtggaataaacaaaacattgcaaaaaacaaag

SEQ ID NO: 95138 - DNA, 798 bp, Heterodera glycines
  misc_feature (751)..(751): n is a, c, g, or t
  SCN-specific regions: Sequence locations=1-798
attctccggcacaatttggccgccattcgcgacattgtttacaccgtcgaattcgcattgggcgaattggtcgagtcgttgggacgcatctctctggacgtgagagaggttcgccaacagaaccaactccgtcagctcgcccgtcccgtcaaaacgacgttggccatgctgaaaagagttcgccactctttggactccacgggttggtccctgtccactttgtcccggtcggctggcacttacgcgggccaagacgcgttggaccaattcgttgccatgttgccccagctgcccaaagactgctacaagttggtccaatgggtgtattcgctgtccgtgtggcgtgacttgccccgcggcggtgccacttccgtgtttctgcccccgtcgtccggcaccgtccctttccatgccaaaatgcatcctccgccgccccctccggcgccgttcccccaacaacgaccctcctccccaagctcttctctgctcaactattattcatccgagtccatcgaagatgaacaaaataacaacaacgaagacagcttcagaaattgggcaactgtgccaatgaatggctcattgacggatcggcacggagggcaggcaaagggtggcagaatgtttgtcgaacaacaacaatggcatccacaaaatggtggagcattggcaaacgatgtgatggacggcggggagtcgaccagctcgaccagttcaattttgacggcagaagaacggacgggtggagggnggaggaggaagaagcagtggtgacgaaattcgacgccattcgccgga

SEQ ID NO: 95139 - DNA, 857 bp, Heterodera glycines
  SCN-specific regions: Sequence locations=1-857
aaaagacactgtgataattagcaggtaaaacattaattggctttttccttcctcaaatgataatccttttcttttctcctttcgtcttgcacaaattttgcgttttccgttggaattcgaaaggcactcattggagaagggagatcatcccgaaatccgagagggaattgcccacgcgcgacaatggttcgatcgtcgattacaacaaattcgaattgtggagacgggagtacgaggaaggggttgcccaactcgagcaggaacatgtcaagaagctgaaagagttggaggaatcgttcttcaaagagttggatgaacagaatcggtctctcgacagtgaagtcaatgcgttggacattgccattccgccgcttggcaatggcgaggaatccctggcgaattgtgccacgcaattgggacagtgccaacaccacccgaacccactcagtgccaatcacggcataacaaccgcaattagcggcaaaaaattcctcagaagtcgacagaacgacgtgattccctcgtcgagtgttggtgccgagtcggcgctgcatttgggtgccattggactgacagatgcagcaggcacagcgaagagacgtactcagacgaagaaaagcggctcccctttcggattccttggcttcggcagaaccgaaggcgctgtcggtggttttgctggtgccatcggtggagggccgaccatcggaggaacgtccacttcttcgctgatgctcccttatcttttgtcggaatcggccatttcggaggacgtccattcgttgggcagcgactcggccaaccattgccatttggcggaacgttcgtcagcagggtgcggcggactgagtcaagac

SEQ ID NO: 95140 - DNA, 300 bp, Heterodera glycines
  SCN-specific regions: Sequence locations=1-300
ccaacatttacgaagttacaatattttataagaataaggaaatggcgatagataaaaagggccacgtgactgttagttgtgcccgtgtgaaaatacagtttcccagttacgcttttttcggccgaagggtgagagaagttaacgctaaaatcaagagtttgcagaacgaatgtgacatgattgaggggaatgtccaaaagctgcgaagtaactttcgaccgaattccgcgaattgacacaaacgctgtattctgatgctgcttatttatatttattatgcataaactttaagcatcaaaa

SEQ ID NO: 95141 - DNA, 1049 bp, Heterodera glycines
  SCN-specific regions: Sequence locations=1-338,360-406,453-823,846 -1049
tatcagagacgagggtttgagcacttaaaaattattttaaatcacttgaaaagaagcatgggttctttctctaaattggcaatcgaccaactcgaacttaaggggaaacgcgttttaatgcgcgtcgattttaacgtgccaattaaggatggcaaagtgacgagcaatcagcgcattgtggccgctctgtcgacaattaaatatgccattgaccatgaagcaaagtcagttgtgttgatgagtcacttgggacgaccggacggccaagcacaggcaaaatattcgatgaagccggtgcacgaggaattggagcgactgcttggaaagacggttgtctttttgactgactgtgtcgggacagaaattgaaaatgcgaccgccgacccaaagccgggcaccatcattttgctggagaaccttcgttttcatgtggaggaggagggaaaaggcaaaaattcggctggcgaaacagtgaaagcgtccaaagaggcggtgaacgcctttcgtgcatctctctcaaaacatggcaacctttacgtgaacgacgcatttggcacggcgcatcgagcgcatagttcaatggtcggctgtgcgatggagaagagggcgtctggttttctgatgaagaaggagttggagtattttgccaaggcactcgagtcgcccacccgtccattcctggccattctcggcggtgccaaagtggcggacaaaattcagctgatcaacaatttgttggacaaggtggacgagatggtcatctgcggtggcatggcattcactttctacaaagtgctcaccggcaaatccattggcaaatcgttgtttgacgaggagggttccaaaattatcaacgatttgatggcaaaagcgaaggacaaaaatgtgaaaattcaccaaccggttgattttgtggttggcgatgagttcaaagagggcactccattcgccaatgttgacgcaaaggatggaattccgaacggaaaaatgggcttggacattggtcaggaaactctcaaacaatttgccgaagtgattggacgtgcaaa

SEQ ID NO: 95142 - DNA, 469 bp, Heterodera glycines
  SCN-specific regions: Sequence locations=1-68,90-144,166-469
gaaagacaaaacccatcatttaattatttccactggcacaaatgtgccgcaattcgtcgcccccatttgttcttttcgttgttttgctggcactcgtcccctttttgtccaccggtggaatgccacgtcatcgacggcaccaacaaaaggaagcaatggaaaatgccggcggcgaaatggctgacgacagcggcgacacttcggcaaattgcagctacacggacccgtactgctacaactcggaggcgttcatcgacgcggtgccaataaaagaagaaaaagggacgaaatgaaagggagagagaaggcaaatgactcaattttgacgataaaaggcattcgaagtgttcttctgtatcatcaaaattaattgatatgccaattgattagctaatttgtgtcttcttaatgacttaagccatggcatttccatttttgtcgcgtttctttccaattcccccccccccgc

SEQ ID NO: 95143 - DNA, 481 bp, Heterodera glycines
  SCN-specific regions: Sequence locations=1-481
ggaacttcgatttaacgatttcctataagcgaagttatacacagaatgagttccgcttcttcacctgtgccttcacttatccttaactcgggcttcccaatgtctcaaattgggtttggcacttggatgtgcaaaccaacagaggtcaacgaaattgttaaaagtgccattcgtaatggatatcggcatttggattgtgcattcatttatcaaaatcaatcggagattggcgcagctctcaaagacatgctccaacacggagagattaagcgcgaggatttgttcatcaccagcaaagtttggaacacttttcacagctttgacgccgcattggcaaatgtccaaaaaagcttagaacagctcgggcttgattatttggacctttgtctgatccattggcccatgggttacaaagaggggacagaactcttcccaaaggacgcggagggacagaaagtgtttttgtcggacgtggactttt

SEQ ID NO: 95144 - DNA, 484 bp, Heterodera glycines
  SCN-specific regions: Sequence locations=1-95,117-484
tatttaagttatattttcactacataattttgatttgctggtaaatgtctctgtacgacgacattggaattgaatcatcaacatcagtgcaggtcaaagaagagaatttggagaaaaaagctgatgactttccgacaccaaactctgctcaaaaaccccaaaatgtcaccgtctcagcagtgtcagcggtcaacaaaatgaatttgtcctttctcaaatcgcaactcgaagccaagaaagccattctacagaatgcggccgctgccgcttcgcaaaataaatcagcccccggcgttgccttcgcgcagccgttacccgccactcttccgaatatgcctcagctgctgaacaagaagggcggcacgttcaagctgaagccacacaaagcaattccattgcccatcgattcgaccggcgctttcactttggtgccgaaatcactgaaagaagacaaagtatttttgtttggtgaactgatggtgga

SEQ ID NO: 95145 - DNA, 705 bp, Heterodera glycines
  SCN-specific regions: Sequence locations=1-705
gtccaattaagcacaggggaatttactttgggttacacagcttcaagggaatttactttgggttacaaagcttcaacaacatgcaaagtgtccaatcgtcggccaccgcggcagtgaccgccgcttccaccgttccgttgagcattcagaatgaaattttgtggatcaagcaggacgctctccaagttcgcaacgccgtcattctcttggagcaggagaaggacagtcttcgcaaagcaattcgcaaactcaagttggagaatggccgcctgaagacaaaggtgaaaaccttgaacgaaaaggtggcaaagattagcaacgaggaaatggacgatgaagagggaaaattggcgcctgaatctgaattggactatgacgaactaaaccgaggggatttctacctaatcggaggtgtccatgacccgatcagtcttcgttttgaagctgcgatccgtgaccaaaatgccgtcgaacataaaagtgccgaacgctactactggtacaaaatggcggaattctttggtgacgaggaagccatgaagagcattctgcacgcgcagaatgtccaacaggccgaagaggccatgaaaaacatcaaaggcttcgacgttgccgaatgggacaaagtcaaacttaaacattgggaggacggacagcgactgaagcttgagcaagtccgttggatcgaaaatttgctggtgctga

SEQ ID NO: 95146 - DNA, 822 bp, Heterodera glycines
  SCN-specific regions: Sequence locations=1-24,48-186,213-341,364 -441,465-495,517-822
gtttgagttctattattaaacttcctagaacaaacaaattgctttccaatttataaaatgagcagcagcaaaatcacgcgtgaccagctgaacgagagtgtggctgaagtcttgaaacaatcccaagagaagaagcgcaatttccgagaaacgattgaactgcaaattgctctgaaaaactacgacccacagaaggacaagcgtttcagtggaactgttagactgaagcacatccctcgtccgaaaacgaaggtttgcattcttggcgaccaaaaacattgtgacgaggccaatgccaacggaattccatgcatgacagcggacgacctgaagaagttgaacaaggacaagaagctgatcaaaaagctcagcaaaagctacgacgctttccttgcctccgaatcactcatcaaacaaatccctcgtattcttggtcccggactgaacaaggctggcaagttcccaagtgtggtgtcacacaacgacatgctgaacgcaaaggtggatgaagtgaaggcgaccgtcaaattccaaatgaaaaaggtgctctgtctggcggttgcaattggtcatgttgagatgtcgcaggacgaactggtctcgaacatttcgctgggcgtcaacttcctcgtctcgttgctgaagaagaattggcaaaatgtgcgctcgttgaacatcaaatcgacgatgggccccgcggtgcgtctgttctgatcggttacgatttttgcgtccgtatctttttgatgtgtgacctgaccatccaccgatcggccactgttgttgattttgttaaatgcgaaaaatgaatattatttgtta

SEQ ID NO: 95147 - DNA, 487 bp, Heterodera glycines
  SCN-specific regions: Sequence locations=1-487
gtttgagtcactttctttctaatgttggccaccgttcgctttcactccgtcactaacaatcgcattgattgttgtcaacaaactctgttttcgctggacgatagtgagaatttgccggggacggacttttccgttgggaaagcgaagtcaaaacttttgtcggatgggcggagagagcagcagaaaatggcgaagaaaacgaacggcggaaaaacggagggaattggcaaaacagcggcaggtggcagcagagggtccgactcccttctgacggacgaagtccaattggacggaggcgccgccgacggcgcgtcggacgacgaaagcggcgactttttgcccattgcattgggcacaaaatgtgccgccggtcacgcagaggaaaacggccgggcaaattgggcggccaattggcgactcagcggacgacggtgtctgaagagggcgtccgttgttttgggctgctgtttcccatgggccgttggct

SEQ ID NO: 95148 - DNA, 479 bp, Heterodera glycines
  SCN-specific regions: Sequence locations=1-297,320-479
ctttttcataatttgttcgcagcccaaaaacgaaagagaaatgctaagggcacttttgtcgccggaaatcttcgtggaaattgtgaattgttaccaggaactgatggtggtcgaaggctgtcttcagattccctgctgcgtggagtttccaccgctcagaaaatttgtggctgccaatgcgattcgttctcggcaacttcggcaggaacatttggaacggaagtggcatttggagttggcccgtgatgcatgtgtctcaaaattggcactgtccgaattgtcttgggacgcgagcctttccttcaaaactgtgagggtttgcatggaaaaactacgacggattggcccggaaaagtctgcccaatttgctcgtcttagcattcacctttcgaacagtccgaaattatttgtgatgttcaacggtcgcctctcagtgcctatcgattgggtcaaagaactttaaatgcaactgataatta

SEQ ID NO: 95149 - DNA, 187 bp, Heterodera glycines
  SCN-specific regions: Sequence locations=1-78,100-187
ctgaacccggcaataaaaaagagacgcggagaaacggggagaaaaatcggcgcctaagaaaatttgattgactttgtcttttttgacatggaattttgcacttttattatttttgctgttttttttttttgtctcttttgctgcagctgagtgtctaactgtcgcgtaaaaataaatttgcttaaac

SEQ ID NO: 95150 - DNA, 646 bp, Heterodera glycines
  SCN-specific regions: Sequence locations=1-347,369-453,475-561,583-646
ccaaaatggttaaattttggttgacattatttttcgtttttaccggcaacaatttgtattcaatttttgcgcacaaaccaaacttttctcagtgtggcatttccgactttgagcccgacttggacaatgtgccaaatgtgaaaatcggcacaaaccatatatataaaggacaaccagtggaaaatgccaattcaatgccatggatggtcactttgctttcattacaaggattatgcactggaacaatcatcagccacaaatacattttaacagcttatcattgcgtttccggcataatttctgtcccaagttcaatccaaatttcttatggaacagtcaatgttgctaatgaaaagcataaaacaaatgcacgcaatattataatccatccaaatgcttctctctcggaaatgcgtgtcaaaataaatggaagcgaatttggaacagattctgtttcaaatgatttagcaataatcgaagttgaaaatgcacttaaattttcaccaaatgttgggccaatttgtttgttcggcctcgatgcatccggaaacgacaaatttggcacattttcaccattaattaattcccaatttattattgctggttggggcttaactcagccaatgtgccaaaaatatccaactcc

SEQ ID NO: 95151 - DNA, 689 bp, Heterodera glycines
  SCN-specific regions: Sequence locations=1-689
atttaagcttttccttctcccccaattaattccgttcgctttctccgctttttctctccgatgacttccccctttcactccctcgtggagtctcagcgggaattctttcggacgggcaaaaccgccgaattggcacatcggaggcagcagctgaagaaactgcgcaagacaatcctcgacaacagcgaatttctctgcgaagccgtgcaaaaggacctgaaaagggacgcgaaactgaattatccgctcgaaatttcgtctgtgatcattgaaattgaatatgtactcgacaatttggagcgatggacggcgcctttaaatgtcgaaaagactttcaccacacttctcgactccccgcaaatcgttcgcgagccgaagggcgtcgttttgctcattggtccatggaattaccccctcaacactttgctaatgcctttggtcgacgttttagccgctgggaatactgccattttgaaaccgtccgaagtcgcgtcgaacaccgccgccgccgttgacgaaattatttcgaaggcatttgaccggaattatttggcagtggtgcagggcggcgttgaacagaccggcgaattggctgaaagaaaagttcgaccacattgtggttcaccgggtcagcgctggtcgcccgccacatttccagggcggccgcggaacatttgacgccctgcact

SEQ ID NO: 95152 - DNA, 257 bp, Heterodera glycines
  SCN-specific regions: Sequence locations=1-209,236-257
caaacagcagcagcgacgcacctgctgcatttggccgtgcattcgcgctttgctggagggccaacaccaacagcaaaaacagccaaacccgcaactgcaggtcctaccgatgggaatgcagcaaatccaaggaagtggaggaatgtgatccttcagcagatggaagaaattcatccctatttgctttacacattgtaaaacagatcagctatttattattttataataatttaaaccgaataaaacgaaaatccgcg

SEQ ID NO: 95153 - DNA, 493 bp, Heterodera glycines
  SCN-specific regions: Sequence locations=1-303,327-493
gtccatttaagtcaaggagtcatacatttaatgactcgatctcgaagtggcagtcgttgtggcgatgttgttcgttatgtgcttggacagaatacacatcagcagagttacaaccaacacatttacgatgacattgatgttttcctcgacttttcgcactgccgtccgagtgatcaggagcgtgccctcttctttgagttggaagcggtccttcagtttgcccagcgttccgccgattgtttggccatttacggcgctggtgctagtgccgaagttcgtgcagcactgcaaaattgtgatgatgctgacatacaaaatgcttcttttgccatcgtccgtcaattcgtccgtcgcattcgcaaatattttgaaacggcgcaacgaattgaaaaggtggtccctgagctgttgtgggagctctgttccggccctttgcctcccgttgagcagctcgactcggcccaggccctctgcaaacaactcgcccgactca

SEQ ID NO: 95154 - DNA, 599 bp, Heterodera glycines
  SCN-specific regions: Sequence locations=1-145,178-222,244-559,581-599
gtaaaatatgcaagagactcacattgtcctgggcattggcacggtgtgctctctgttggcgatcatcgccaccgtcgtcactttgccatcgctgtactcggagatgaacgaaatgagcaccaaagtgcacgctggagttgaggctttccgcgtcaacaccgactcggcctggactgatctgatggacgtgcaagtggccgtgtcaccgccgtcgaagccccgtgccaaccccttcagctccatcttccgtgccaagcgtcaactgcccggccattgccaatgcggtccgctgcaacagccaagctgccccccgggcccacctggtccggccggagcgccaggtcaacccggtcagcccggaggcgcaggacagcccggacagccgggagcacctggacaacctgctgctccatgcgcgccccagcacatcccatgcccgcgctgcccggctggcccgcctggccgtcccggaggacagggaccgcccggacaacaaggagcccccggccaacctggttcacctgctccaggcggaggacagggaccgcctggcgcgcccggaccccaaggaccttctggacagcccggacgttctggag

SEQ ID NO: 95155 - DNA, 660 bp, Heterodera glycines
  SCN-specific regions: Sequence locations=1-143,167-292,318-660
aagagactcacattgtcttgggcattggcacggtatgctctctgctggcgattatcgccaccgtagtcacactgccatcactgtactcggagatgaaccaactaagcaacaaagtgcgcgatggcgttgaagccttccgcgtgaacaccgactcggcctggactgatctgatggacgtgcaagtcgtcgtggcaccgccgtcaaaggcccgtgacaaccccttcagctccatcttccgtgccaagcgtcaattgcccggccattgccattgcggtcccccacaacggccaaactgccctcctggcccacctggtcctgccggaccgcctggccaacccgggcagccgggaagcgcaggactgcaaggacagccgggagcacctggccaacctgctcctccgtgcccgccccagaacatcccgtgcccactctgtccggctggcccacccggcagccccggaacacagggaccgcccggacagcaaggagcccctggccaacctggtgcgcccgctccgggcggaggacaaggaccgcctggcgcgtccggaccccaaggacaggcctgggcagccagggacgcagcggaacacccggccaacccggacagcctggaaataacgctgttatttataacaccattcctgggcccgaggggag

SEQ ID NO: 95156 - DNA, 762 bp, Heterodera glycines
  SCN-specific regions: Sequence locations=1-147,174-308,330-762
tgagcgtaaaatatgcaagaaactcacattgttctcggcattgcctcgctgtgctctctgctggcgattatcgccaccgtagtcactctgccatcgctttactcggagatgaaccaactgaacaacaaagtgcgcgacggcgttgaagccttccgcgtcaacaccgactcggcttggactgacctgatggacgtgcaagtagtcgtggcaccaccgtcaaaggcccgtgacaacccattcaactccatcttccgtgccaagcgtcaattgcccggccattgccattgcggtcccccacaacggccaaactgccctcctggcccacctggtccgtccggaccgcctggccaacccggacagccgggaggcgcaggactgcccggacagccgggagcacctggacaacctgctcctccgtgcccgcctcagaacatcccgtgcccacgctgcccggctggcccacccggcagccccggaggacaaggaccgcccggacagcaaggagcccccggccagcctggtgcgcccgctccaggcggaggacaaggaccgcctggcgcgtccggaccccaaggacagcctggacagccaggacgcagcggaacacccggccaacccggacagcctggaaataacgctgttattttcaacaccattcctggcccgagtggagctcctggtgcgcctggccaaccgggaagtcccggcagtcaaggccaacccggacaggccggaggcgagggaccgcctgggcccactggt

SEQ ID NO: 95157 - DNA, 485 bp, Heterodera glycines
  SCN-specific regions: Sequence locations=1-485
aattaaaaattttaaatactatttgtgttcgcttgtatgccaaattctgcttcaacaccgatggaagagtttgaggaaatggtcgctgttcttcagcttgatggcgtccttgactttgacgcggtgcgaagagcagtcagttctggtgcaatccgagtgcgcgaatgtgacgcggaaacgcccatggttcagattggatctcatttgtattctggacaatggtcacaaacgttaggcactgatatgcttttatgtccttcttcaatgtcggattaccatcaccatgaaggccatcagaggttggaattggtcgctgtgtcagacactcgtctctgtgcgcaaaaagttcttttagcaactgacgaaagtccgactaatggcaatggcactcggaatgaacaaagcacttcaaatagttcaaaggcataaagacaaagcatttgagcacttccagtttttttaaataaatattcacatatttggta

SEQ ID NO: 95158 - DNA, 615 bp, Heterodera glycines
  SCN-specific regions: Sequence locations=1-366,388-615
ccaagtttgagaattatgaattttgtcgtccgtctttcatcaaaatcgcgtttcctccgacttttcccttcctcctactcgccattttcctccccattttcatcgtccccttccaccgcttcatcgagcgtttcttccacccctctgctcattatcacacaaagggcagcggaccaactccgtcgcatcgcccccccgggtgagcatttgcgcatttgtgtcgactcgggcggctgttccggtttcgagtacaaattgacgctcgacaagcgattggacgaggcggaggacgaagtgattaaagcgtcggagggagccatcgttgttgtggacaagttatcgcttcaatttttgcggggctcaaagcttgattttgctgaggatttgatgcggtccgcgttcagaataacggacaatcccctggccactttgggctgctcatgtggtgcaagttttgcaccgaaaaatcaaatcgaataagcaaaggacggaaacggggcttcgtttttatggtcattgcttttttacttttattattattttatttgtttcaatgtttttgtgtgcatttcactgccggtgtatttgtagggaataaaattcggatttaaaaaa

SEQ ID NO: 95159 - DNA, 1139 bp, Heterodera glycines
  SCN-specific regions: Sequence locations=1-323,351-1081,1108-1139
attaaaaataataattccaaaaatggcttcacgtgatgagattggccaaacggtgtgcgatttggtgggaaatacgccgatggtttacctgaacaaaatcaccgatggatgtgctgcaaaaattgcggtcaaggtggagtggatgaacccggccgggtccgttaaggaccgcattggcattgccatggttgaagaagcggaacgccagggcaaaatcaagccgggcatcaccacaatcattgaaccaaccagcggaaacactggaattgcacttgcttttgtggcggttgcgcgtggttatcgtttcattgccacaatgccatcgacaatgagcggagaaagacgcacacttttgcgtgctttcaatgccgagttggtgctcaccgatccggcactgggcatcaaaggctgcgtggagcgtgccgaacaattagctgccgccattcccaactcattcattccgatgcagttcgccaacgaagcaaaccccgaaatccattaccgcacaactgggcccgaaatttggcgtcaaactcagggcaaggttgacgcatgcgtttttggcataggcaccggcggaacgatcactgggtcaggccgttttctgcgtgagaagaacccagcaataaaattttatgcggttgaaccggtggaaagtccggttctcagtggaggcaagccaaatcctcacaaaattcaaggaatcggtgctggcattgtgccgcccattttggacacaaaaatgtacgaggaagtcgttttggtgcactcggacgaggccattgctatggccaaacgattggcacgcgaggagggccttttgagcggcatttcaagtggtgccaatgtggtggctgcgcttcgcgttgcgcaaaagccggaaatggccggcaaactgatcgtcaccgtgttgcccagctcgggcgagcgctatcttacttccgccctttactcggacattcgcgcagaaatggaagccatgtcgcatggtgaaacgctggaggacaatttgaagcgtcttcttaaagtggaggatgccaacagcaaacagtgatgaatttagcggaaatttttttaccggaattaaaatttaaaaaattaaaatttggctgtttgttttttttttgcctaaagctctg

SEQ ID NO: 95160 - DNA, 481 bp, Heterodera glycines
  SCN-specific regions: Sequence locations=1-481
ctctcgtccccctcgttgttgtcctcctcctcctcctccgccgatgctgtcaaggagtaccgattggttctgttgggcacccaacacaaaaagccattgttcgaaaaaatgtgttcagcagcacaaaagtttgaacagcacattcaatacgcggacatttggtatttaacgtttcaattcaaagacagcgaagagccggttgtggtggaaataaccgacccaggcacagagaaaacgggcgaacgccaaatggccatccaacaaaaatcagacgcgatcattctctgctactccgctttcaatcccggctcatttctcgccttggagtccgtcacagaggactttcaaacattcaatggaaaaccgcccgccactctgctgctgtgcaacgaggaccaattggcggaggagggcttcgaggacggacacgaaacggacactgctgacgacggatacggcaccaactcgggcggagggtcgc

SEQ ID NO: 95161 - DNA, 420 bp, Heterodera glycines
  SCN-specific regions: Sequence locations=1-3,25-420
agctaactcatcaaatattcccaatcaggaggtctcttgcctcgatgtattattccttgtcacagattgagaatcatctttttcttaacagtcgcgacctcaatccaaacatggcagcgggtgcttcgacttcacgaaacctcttaaatgttgcgtcagttgaaattgcagcgcagaacgaatgtttcaccgtttgggagccgctgcaacttcgtcaggaatggactatcagcaactttgccaaggcattggatttggctactcccggcatttgtatgcgaagcaagaatttccgtgatgagtcaatgccggaaatttgctggcaactttgcctttacccgggtgggaagcgcgaggagaacagtgggaatgtgtcgctgttcctcaaaatgtcaacgacgcagtcgcagcgcgagttca

SEQ ID NO: 95162 - DNA, 1269 bp, Heterodera glycines
  SCN-specific regions: Sequence locations=1-130,152-345,369-1070,1093 -1269
cccagcccaaccccagaagtgaccttcaaagatcgttcagtgcatgagattcacttggagaatggctacacttatgttattgagcagaacttaaagcacttcgcctcggttatcaccgttttggccaagttcagtgagcaaattctgttgcaaccgaccgaagacggtttgatgctgtccgcctcttcctccgcgcggtcggcttacgcaaaagtgaaactgtgccgtcagttttttgaccggctgagggcacgcgaaaatttggggccggacggcgaagtgttctgtcggctggccacgaagagtttgatgcacattttcaaaagcgcggcccaatcgtccgtcggccccgtcccctcgtgctcacttgagttggacccccaatcggactttgcctacgtccatctccaatgtttgtccggcattcggcgctgttttgtgctgtcgttgcgtgagtatgccatggtctgtgacaatgtgttcaacgagcggcaacggctcaagaatcgggtgaccgcccacgccaaaatgctcgccactcttttgagtccgttggactgcagcgatctggaattggttgcgttggccgaccgattcaccgcctgccggtacatccctcgcgaggagtacggaaaagtcagacgaacggaggtgcaaattccggtggaccactgcgagcagtaccgcatcgaagtgcccacccgcgtggtggtcaacctgcgcgagttgcgccccatccttcagtttgccgacctttgtggcatgtccgtctcgctgcactttgaccgtgccggacgcccgctgattgttgcggtggaagagaatgtggactttgccgctgaatttgtgctcggcacccttgatgaacagttgccgctcaatgagcaacaacaacaaccgacgccgcagcagcaacaagaacagcaacccgtagtccaacaacgcgaagaacaaccgccacaacatcggcacaaccaaatgctgcggcaccattcgccggcccctgcggcagtcgcagaacgggtggaggaggaacacaacgaaacgccgccaaaccgtgaccaaatgttgatggtgcagcaggaggaggacgtccaactgtccatccgctcgacaccgattctcccgattgcagcgctgcggcaggaggaacacaacgaaacagcaccaaaccatggccaaatgtctatcggtcccacgcccattctcgcggtcgccgcaacggtgcagcagcagcaggaggcgcacaatgaaatttcacaaaatgat

SEQ ID NO: 95163 - DNA, 490 bp, Heterodera glycines
  SCN-specific regions: Sequence locations=1-3,52-160,188-193,215-490
atttgaatttccttttcctttttcttgaaatgctcttctccctttcccatttctcccccatcgttcagtcgcttttcgcctctcttttcacttgggcagtgaccgccctcggcgccgccgttgtttttgtttttccgtcctcgaacagagttttcctcgatgctagcctcggcttctcttctggtgtcatgttggccgcttctttttggtctttgctttcgccggccatcgaaatttccgaaagacaaatggccaaattggcctttgtcccagtcgccgttggatttgcgttgggtgccttttttgtatatttatccgaccgattaacacaaaatttcaatggcagcgctctctccgatcagataaatcaattagagaattggcattcggccaatcagcaaaatggaattcatagtgaaaatgctccattcgattttgaaacagaccgacagaggagcgaaaatcccgaaaacgctggcgaattggccgc

SEQ ID NO: 95164 - DNA, 418 bp, Heterodera glycines
  SCN-specific regions: Sequence locations=1-7,29-171,290-418
atcccaaaaattaaacttttttctccataatgctcgccaaccatcgccaacttttcctccattttctgttcgcaattgccatttttgtctttgtcattgcgccactgatggccgattcggagcacgaaatccacgctgatcagcaaagtgccataaatcccagagaaaaacgctggggcggcggatggggcggcggttggggacgcccgtggggttggggcggcggatggggccgtccttggggctggggcggcggatggagacgcccatggggcggctggggctggggacgatgagccgccgattccgtgccgtgttatgccatcatcagtcgtgccgtgtcagaaaaatgatttacgatttgaataatttttataattgatatgtgttgttcgagagataaacttttggctgataa

SEQ ID NO: 95165 - DNA, 561 bp, Heterodera glycines
  SCN-specific regions: Sequence locations=1-315,337-561
ctccctcacccgcatcatcatcaccagcacaaatcgcacggcctctgggagctgaccagcttgaacttctcgtccacgcccgccgttgacaacgatgacaagcagcaccttgggggcaacaataatccggcattctattctcgctttacgcacgagaagcgcaatgccaaagcagcaaaagcggtttcggcgccaatgccggctaagcaaaacaacgatgccgagcagggcaaggtcaatgatgatggcattttcgctgtacaacaacaacattccgccgacgacaccaccgacgacggttgggaggaggatggcatttttgctcagtgccaaaaattgccgccgtaccaacagcaaaagtcgtcgttgctgctgacgccggccgccacgtcgtcttcctcggcaatggtggacagtgtgatcagttgccactcctcgttggcatcgacgtccgctttttctacgcagcaaaggtgctcaaacagtgccgaaatgctgacgagtggtgccggcggagtgatgttcgactcggccattgtcagcgacggcggcgcgccgtcc

SEQ ID NO: 95166 - DNA, 475 bp, Heterodera glycines
  SCN-specific regions: Sequence locations=1-475
ccaagtttgagttttccaatggagcgttctttgtgcagtcggaacggtgcgggaaatgacagtgtggtgaatgtgagggatgacgaagtgcaggacgacgacgacgagttcttccacggcacggcatttgaaagtgacgaaggataggacggcatagggaaaaggcaaacgaaatactgtataatttgattaagcggttcgcggagaggacaaggagaaccgagggacgacggacacggcgaaatatggggttgactatgacgagatggacaaagggtctcaacagcggccacctccccacccttcggaccttccccagtcgacttcacttcgctacccgtcaaatctgtccaaaatcagcgaatcgcccgatgaattctctttttcgtttaaacgaggagaaaatgccatccaacagttcaatcgcgaccatgaggagttgcgtcgtcagaatcacctgcgcttgccctccgtt

SEQ ID NO: 95167 - DNA, 645 bp, Heterodera glycines
  SCN-specific regions: Sequence locations=1-532,554-610,640-645
aggtttttaatcctttaaatggggcgtcgtctgcccaatgttttggttaccggaacgccggggaccggaaaatcgacgttggccaaaaaagttgcacaaaatgttggcatggagcatatcgacaccgcattgattataaaggaacgcgaattttatgcggaatacgacgcccaattggacacccacgtgctcaacgaggacgcactccttgaccatttggaagaacgctttggctctgacgcgggcggcctaattttggactatcactgtgccgaaatgttcccaaagcgatggttcgacctcgtcattgtcctccgttgtgccaccgactcgctgttcgatcggctgaccgaacggggctattcggagaggaaaagacgcgagaatttggaggccgaaattttcggcatcatcgcagaggaggcaaatgccagttatgacgagtcggtcgtgcacgagttggagaacagcacagccgaacaactggaggccaacgttcggacggtcaccaatttggtgggggcgcacaaacagagaaagtgaacgaaaaagagcaaaggcaaagcagcggatttgtgtcataaatttcaaagcattttttgttgcttctaattttattgcaatttttaaatttaacatccgaca

SEQ ID NO: 95168 - DNA, 1294 bp, Heterodera glycines
  SCN-specific regions: Sequence locations=1-163,185-213,236-1256,1278 -1294
tgagaatttggggacgtgctgttattctcatttcccctatgattgcctctgaaaacaatcacttagaagcccaaaatggcaacagtcccgagggagaagaagagtcgaattgcggaggcagtgcttcgccttcgtctcttcgcgactgtcattctcgagcatcgaccaacgaacacaccaacatttctcatcactctcttcacgatgacaatgcaccaccttctccctccttggccaatatctcaacaaacattgaactccatccacacaacaatgcgcttggaggttcctcctctcataaattcatcaaaaggccattgaatgcttatatgatatggacaagacaggaaaggaagcgaattttaacggacgatcccaaaatgaagatgaacgaagtgagcaaagctattcagatgggcgaaaaatggaagaaaatgtcggacaaggaaaagaaaccttacttcgaaatggcaaaaaaattctctgaagaacacaaattggtgcttcaagaacaccctgaactgcaatatgcgccctccaaaaagaaggtggtgaagaaactggccgatggaaagcaattgtccgtggtcgattcttcgtccgtcaagtcgtgcaccataacacccgacgcgtcgagaagcacaacgccgcggggttcttcaaatctgatcacaccacaaccggtgtcacagagtcaaatgttttctccgtttcaatctccaactgtgcaacttgctcaggtccttcagggagtgcgttcggtgaccaaccaggctgccatctcttctaattcgcccatccaaaatccgttgcttggctcggcttcgacctttccgcaagcgttcctccaatcccattcgttacctcagcgtgtcgctaattcctccgtttctttgctcggaggaatgtctcagtcgggtaccacgccagttagtgctgctactcggaccacgcctggtcaaatgttggacctctactacacctcactttgccagcctgccttccccagcataaccgagaaccctgttaatcctcttggaatgtatccttcacactatttgttggagcagtacaaccagcatctttctcagcagcaacaacagcagggaaataacggaggcacatccaatgcatctgcaaatgggggtggacggttttagcaagtggatcaccgatcgatcactcatgcctaatcaacttgatcatcctcaacacatgtcattttgtgctatgctcctcccttcgcatccattcgaatctcctcttttcaatgttcctcttcaccccacccaat

SEQ ID NO: 95169 - DNA, 480 bp, Heterodera glycines
  SCN-specific regions: Sequence locations=1-195,217-480
cactgtcgatggagatgaaaaacgtgcagtgcgaggagcatttaatgtgattgaccgttttatctctgtcgaggaatgttctacggataagttcgacgatgagtgtgccaaaaaagagggcgcactgacggatggacaaaaagacgtttcggactcactcgcctcggagtgtcaacaaattcgtcagaataagcgccaatttgcttcaaatgccgtccgacaatacatgaccggtgcgcgctgctctctattttttgcgtctccgatgattcgtccgtacaatgtgtataaaattgctgagcaaatggtcgaccaaagtcagaaggaaagtctcacccgtttcctggcacgggttatccccgtggaagagacgtgccatgctaatttggacgaaattaagacattgctgtcagaaatggtcgtcaaacatttgaagggagagaagaaggacactccgccaacttacgcagtcgaattcaa

SEQ ID NO: 95170 - DNA, 479 bp, Heterodera glycines
  SCN-specific regions: Sequence locations=1-479
gtttttagaccagtctcagagtcagtaactgaatattaaaaatgaaagtggaaaagattaagacaaggagaggcaagaaatttcttgaggacagagcaccgaaattggtcgaaaatgacaaagtgacactttttgtgaagggaaagaaatgttcagtgatgctcaacaaaatacttggcgaactttaccaactgaagaagccattggccaatcgactgcaacggttaaattggcccttttttaatgattttctcacaaatttgacgcttctttatttgtcttcgggtccagcacaaagaaacggccgaattcattgctttttggcagaatgtacgaccatcaaatgttggatatggtcgaattgcaagtggagaattttgtctctagcgacgaatttaaacaagtcaaaagcgtaactttggggtcgaagccatgcatcattttgcaaggtcacctttttgagtctaacggaatacttc

SEQ ID NO: 95171 - DNA, 461 bp, Heterodera glycines
  SCN-specific regions: Sequence locations=1-372,394-440
gtttgaggaaaaagtaataaaaagatgcttgttcgccaaaacaaaattatcgctgccgctgcccggggcgttttgttggtttccaaccgttcgacaacgcgtacgcctaccatgtgcgcaccgccaatgcgttgtccgagtgttcctaaacggttcggcatgttcttcttttgctgtgtgtccattttgggttatccgacttatgtgatgctgaaccttgacaatgtgcgtccgttcaagcagacgcacttcaacgacgagctcaatgagaagctggaggagcgccgtcgcttacgtgctgaaggcaaattgaacgttcttcaaaagaagctgtgagcacaaagatgtagaaaaggaatgacaattatagcggaagatgattaattttgctgacaaaacattgtcaaatttagtgctatgaaacatacgtgatcgtataaatttgtttttccatgtaaaaa

SEQ ID NO: 95172 - DNA, 431 bp, Heterodera glycines
  SCN-specific regions: Sequence locations=1-313,336-431
gtttgaggcacattaaatgaaatttatggcctcgatggtgacgtcatttcctgtgtcattttttctgtttttttctacggctctaatccacggcacaatgggaggccttttctggtcgaaaaagccggcggattcagcggacgattcgctgtggagccgataccatgatcaaaatgcaatggaagagttgttggagaaggtgcacagcaaatgccccaatgtcactcgtctgtacagcgtcggccgatcagtccaaggccgcgatttggcggtcattgaattttccctccatcccggacggcatcaaatttgtaattcaatgtcgccatttgttagcagaggcctttcagaattacaaatgaccaatcaccgacaaattacctcgtgaaaaatcatagataaaagcatagataataaaaatctgagatcgg

SEQ ID NO: 95173 - DNA, 481 bp, Heterodera glycines
  SCN-specific regions: Sequence locations=1-481
aaacgatgagtgagatgaatatcaattcttcgtctctaagttcttctatgctcgtccgcgacctcactctcaaaccggacgtatcaaaaccacgctgggatcagtcgacttatcaaggccgggcgcgacactttttcgctgtgttgaatcctcttaatttgtttacctccaatcaaggattggaagaaagtcgcaacattgtcttagattatcgaaaaggcattttttccccagaattaacagttgagcgtttatggaaggccaaacatctgtatgaatcagcttatcatccgatgtctgaccaaaaaatgttgccttttggtcgaatgtgcgcccaagtgccatgcaatatggttttgatcggtggcatgctcagtttttataagtctccgttggccgtcgttttttggcaatggaccaaccaatcattcaacgccgtcgtcaattacaccaatcggtctggtgactctgtgagcactga

SEQ ID NO: 95174 - DNA, 420 bp, Heterodera glycines
  SCN-specific regions: Sequence locations=1-84,109-420
ccccgagcgggacaccaagatggacaccaccaatgccgaggtgatggacaccaagaaggaagccaacgcggcagctgcagcgccggtggcggcgtcggacaacacggcaccagccccaatgacatggatgatggacggcattgtgccacgcgatgtcaatgtgatggtggaccgtaccacgaaggagttgcgcaaaaccacggagacggacggcttctacgacatgagccagcgggcacaggaacgtgtgatgttggagacagccggcaaacagggcgaaattgtcaagacaaagctgaaggaagcaattgaggaggcccgaaaaatgatcgaacgtgctcttggcacagtgatttcctactcggaagcgccaatggagtccaaaatgcaattggaacaggtgttcatgacgctgacgga

SEQ ID NO: 95175 - DNA, 620 bp, Heterodera glycines
  SCN-specific regions: Sequence locations=1-70,144-281,317-620
ttgagcactgtgtttaaataatttgaaaaaaaagttcgcatcaactaaaaaaccaaaaaataaaaaagtatttgtaacaatggcaatggctgatgttaagcccaaccatactttgtacatcaacaaatgaaaaagtgaagaaagaagagctaaagaaggcactgtacgcaattttctcacagtttggacaaatcatcgacattttggccttcaaacacttaaaaatgcgtggacagtcccatgtcattttcaaggagataaattcggccgccactgccctccgttccatgcagggcttccccttctacgacaagccgatgcgcatccaattctccagggaggactctgatgtgatctccaaagcgaaaggcacttttgtcgaacgtcccaagaagaacatcgccgtgccgaaaaagaagaaaaaacttgccgagggtccgaccaaaaagagcaaaacgtccggcaaagagggacaacagcgttcgaccgcaccgcccaacaaaattttgttcatcaccaatttaccaccggaatgtacggaggaaatgttacgcgttgttttccaacctttgcccggccttcgcgacattctccaagtgtccaaccgtacagacattgcc

SEQ ID NO: 95176 - DNA, 719 bp, Heterodera glycines
  SCN-specific regions: Sequence locations=1-491,513-528,587-719
agttgtcgaagtgcattgtcctcgtggactacgccaggcagcgccaggaatggacgttcaacaaagtgagccaattgtcgacatcggtcgttgagttgcgcaacaaaatcgaaacggaggcaacgcgaacgcgaaagaacccgggggaagtgctgctgaagatcatccgcttctattcctccaagctgaacgttcttatgagcaaactgcgcgaccgcagttcggaggtgttgctttcttcttcgatgcagaaacaaattctgacattgactgcgtacgttcagcaattggatgacaattttgtgaaggcaaaggacatcgacgaggtcaaacaggaggtgctcgaagaagccaagcagaagctgttcgacatcgctcgttggtcggcttcgctgagccttcgcggtccaccgaagacttcgacggctgacgacgtggaaaatgaaaacctaagcagtaacatcgaaacggagccgaagcaggaggagaccaaaggggaagaggaggagacgctgcagcagtcgatgaaggaagatgaggaagaaaagggcgaagaggaggaggacgaggaagaagaagaggaggactaagcaaattaacacagtgacagcgaaaaagaacacttcgcctaatttgacatcctctaattcaaatgagttaacatataagacagttttgacgtcgtaataatttaattatgcaataaagggtacgacatt

SEQ ID NO: 95177 - DNA, 511 bp, Heterodera glycines
  SCN-specific regions: Sequence locations=1-291,313-330,352-464,486-511
ctcgaatagtggatcccccgggctgcaggtaccaggcacgaggcaagtttgagatttagacaaacaatttcctaaaaatgttgagccgattttctaaaatcactgttcgtggctatgcaaaggatcttaagtttggttcggaagggaggaaagctatgctctccggtgttgacatgttagcggatgctgtcgctgttacgatgggtcccaagggaagaaacgtggtcatcgaacaatcctggggcagtccgaagattaccaaggacggtgtcactgttgcaaaggccattgacttcaaggacaaattccaaaacatgggcgccaaacttgttcaggacgtggcaaacaagacaaatgaggaagctggtgacggaacgacttgtgccactgtgttggcacgtgccatcgcaaaggaaggcttcgagaacatctccaaaggtgctaatccggtggaggtgcgcaagggactgatgaacgcagtggaccaattggtcaaggaactgaaggcaat

SEQ ID NO: 95178 - DNA, 788 bp, Heterodera glycines
  SCN-specific regions: Sequence locations=1-440,462-788
gtttgagaaaatagttaaactatttgaatttatttctcttgcatatggcgacacccgcaacaatcaaaaaacttgaagaaaaaaagctgttggcacagcaacgtaagcaaatgcagcaaaaggacggcagcaacggaaacgcgggggcccaacttttgtcgctgagtgagcagtcggacgcgccttcctcccaccttttggtgcgcaccgaaccggtggagggagcaccgccacggcacatcgatttgcgaccattaagcggcaattattcgaatttccgtgagcgcagaggggaggatttctctaccgatgtgagtgctgaacgcccgtacggtttgtcgaattacaccaacttcgacgccaacagcggtcccacggcgtacgcatggccgccacagaattatcagccggcgtttgggcctccgccgccgctgcttacacagcaacaaaatatccttcagccactctctcgtccgtcaacattcaacacttatcgccgtccacgcaccgctgctaatttttcgggaaaactcaaaaaacagatatagttatcaaatggacagtttcggacggaattactcactgtcggatgacaccgctggagaggcaatgctcgacggattaaacatcaaccttttgtttaaagtaataaaaatggcgacgaaagcggtcgccaaattcgttgtgaccattttgaactgactggaatgagatgcgttttttgctgagctgtcctttcgaacgtttcatccgttgctttttgctgctcattttaagctgaatttggt

SEQ ID NO: 95179 - DNA, 160 bp, Heterodera glycines
  misc_feature (158)..(158): n is a, c, g, or t
  SCN-specific regions: Sequence locations=1-160
gtttcgtctgtcctttctccttatgttgtccattttcctcacttccgtgcattgtattaagccttggctcgggcgtatatatttatttggatgagtcgacgccattccgccaaacttccctttgatgcttttttgtgaaatcggtaaaggtcgcttcngt

SEQ ID NO: 95180 - DNA, 694 bp, Heterodera glycines
  SCN-specific regions: Sequence locations=1-81,103-258,280-370,392-694
tttgtcaatttttgacgagttccgtcgcatggatggtcgtcagattctgtatcaatttttaaatttcgccatgattgtcagttcggctctgatgatatggaaaggtcttatggttgtgacgggctctgagagtccaattgttgttgttctgtccggttccatggagcctgcgttttaccggggtgaccttttgatgctcaccaatgacttggacgacccaatcagagccggcgacataactgtgttcaaaattgaaggtcgtgacatcccaattgtgcacagagtaatcaaagtgcacgagaagaacgacgaagagaccaagtttctgaccaagggtgacaataacatggttgatgacagaggtctttatgcccccggccaatactggctgcaacgcaaagatgtggtcggtcgtgccaaaggatttgtcccatacgttggcatggtgactataatcatgaacgactatccgaaactcaagtacaccgttcttgcactacttggtctcttcgtgcttttgcatagagaatgaatggagaaattgattgcgaataagtgttgtttttttttaccgaggcttgatttgtttctcatctgtccattttcttttcggttcggttctatcatcttttttattgctttccttatttatgtataacttttcgctttaactaaatgattaaaacgttgttgc

SEQ ID NO: 95181 - DNA, 582 bp, Heterodera glycines
  SCN-specific regions: Sequence locations=1-514,536-582
gtttgagccaaaatgaacaaattgtttggattgctaatgctttttgctgctttaatggctcatttcattgattgtcgcccgatccgatcatcaaaacgacttgtcaaagttggagtccaattggacaacagcgaaaaaactgcttcagcatcaggcaacacatacaaattggagttcaccaacctttcctacaaattggtgtgccaagtcaaattccgtattgaactgcctcagacggcaactttggacgagtattggaacattaatcccatcggtcctgctgatgaccacctgttcacattgcctgttgaacaaatgtacccgggccgttccttcaccagtgctcgcgtcaaactgaacggtgttggagagccgaaagttacgataatggatactgtggatgttctgagcacaaaaccgtgcccaacagtgccaaacttttaatttggtaaataagcaaaacgcgagacttcaacccatttacatgataattgaagtgaattaatgataatgttcaaccatttctttaataattgttcttttttatttgggtaaaatttgcataaaatttggttttattaa

SEQ ID NO: 95182 - DNA, 798 bp, Heterodera glycines
  SCN-specific regions: Sequence locations=1-46,71-757,779-798
agatgttcggatgtcgcaaaatttattctattaaacaaatttagtagtttttcctccaacttcagtttcaaacaaattattcccattcgaaccattttcacaattcctttgcataatgcaaaatttgtttcccggcaaatttggtcaagccgcgcaagcggccaacacagcccaaatgcaaatgaaagcggagcatgaccctagcgcaggatttccgtggtgggttcgatttctcgccaagggccttggcatcgtcggtggttttgttgccatatttttcggagtccttgccctcttcaccatccatcccatgtgcatggtcgcagcgcttcttcaactcgccgctggttttttgaccattgcccttgaagcgcccttttgctgtgctttcgtcgatttcatcgaaagaattgctcaattttccgagtcgcgtgcgtattggcaaaaggcagcactttatggcgggatgggtatcgtccccattttgctgtgtgccgggactgagactattttgggtgccgggatgatatgcgcttcgggcgtcgcctacggttttatggcattgggaaagaaggctgaccgtactacgatgttaggcggtgctaataccgctggacaggacccggcatggagcccacaactgaaccagccatttccacgacctgccggtttctttcagccctaagtgattggagagaccgatgatggatcattttcttattccaattctctcattttgacacttacgtttgaaccctaaaaccctttcaaaagcccgctggaaaattgtgcattttt

SEQ ID NO: 95183 - DNA, 419 bp, Heterodera glycines
  SCN-specific regions: Sequence locations=1-419
gcctcacaatgggccttcctcgaacagccgatccaccaacttctgcagtgtcccgctgactacggggcctccgaagcacaatttggacaaagccgtgccattgtcgtgggcggtgccgacagtgcgtttttgctgcagaaaactcggtttgacgacgactggaatggacccagcaccatgtccactttgctgcttgctcaatacttgcaacagtctgagggaccgctgtggaatgccgttcgtggcacggggctcgcctacggcgtcagtctgtacgttatgccggatcgcaaagcattgtcgttggacctgtaccggtgctctgagctgaccaaagcatacgaacagacacgggacacaaccctcgctgtgctcaatttggaccgacttgacacgaatttgctggagtctgccaagcg

SEQ ID NO: 95184 - DNA, 475 bp, Heterodera glycines
  SCN-specific regions: Sequence locations=1-128,153-475
aaaagcgatggaaagtggccgtagcgacgaagtgctggcccggcttgaggctgttcggcgccgtgtgctcgccgcaccgatgaacgtccacttcggcggagatccgagtcaaattcggctcggcacatgttcatcttccgcttcgtcgccgccaatcacggacattgcctcacaatgggccttcctcgaacagccgatccaccaacttctgcagtgtcccgctgactacggggcctccgaagcacaatttggacaaagccgtgccattgtcgtgggcggtgccgacagtgcgtttttgctgcagaaaactcggtttgacgacgactggaatggacccagcaccatgtccactttgctgcttgctcaatacttgcaacagtctgagggaccgctgtggaatgccgttcgtggcccgggatatgcctacggcgtcagtctgtacgttatgccggatcgcaaagcattgtcgttggac

SEQ ID NO: 95185 - DNA, 404 bp, Heterodera glycines
  SCN-specific regions: Sequence locations=1-317,339-404
tctgtctgttcttcgccaaactcattgctcttttgtcaccgccctttcatttttgcctcaacggtcgtgcgacgtcaaagatttaggccatatcggtgaaactatttcgcacaatttgccttcaaagcgctgttttttgccggggatttgcgccgattttcgttgtgcccttgtctctgtgagcgttgaccgaacaattcaggttcaccaatttcccttccccactcaaagttctttctccgccttccttttccgtctgtcaattctgacttctgttctctacgttcttttgtggactctttttgcataaataaccattggcattgatttgttgtgatctttgaatgtctctaaattttaaattgtgaatctgtgatacatacgaaataataaagttttttgtt

SEQ ID NO: 95186 - DNA, 460 bp, Heterodera glycines
  SCN-specific regions: Sequence locations=1-460
gcaatttgcgcgttaattgaaagagcccagaattatgctggacactcgacgtcaatcgggcgcaattgaccaggctgaaatcctcataatttacggactgcgcattgaacatttgtattataagtattcttcgaatgaggtggaagatgaacagctgatggactcgttgtgcaaaattgtctatgcgataggcaacgcgccactcgcccgacagagggcaatgctttgtcaaatttaccaccacgcgctgcacgaccgatggcataaggcgaagaatttgctgctgatgtcgcatttgcaagcactggtggaccattcggatgccagcactcaagtcaatttccaagaaaagacaccgacccaaaaacaatcgaattaagattttgtacaatcgcacaatttgccaactcggactttgtgcttttcgtcatggatttgttcgtgaagcgcatcagaattt

SEQ ID NO: 95187 - DNA, 476 bp, Heterodera glycines
  SCN-specific regions: Sequence locations=1-71,93-180,202-476
gctaatgctcgttggtcttgaccatttgcttcccgtccgtccggttggcctttgtctcattgaatattcgtccactctttcgccctccttcctttttgtacatttcattagcaatttctccaaaagttcctcttccgccggcacttccgatcatcacatcactttcgtttccctccatacgactttgggtcttttgagaatggtcatgggcaaaatggcccaacgattgaatttggacacctttcatttcgtttccgtctcggatttcctcggcgattcgcttctgttcgactgtgatcgacttttctcatggatcacgaaggaagtccttcgctccgttctccccgaccgcccccaactcgtcgtcctggacgaccttttcctttctcacccgtccattcgtcctgccaaactgctccaatttctgctcgctctctttgtccgtcttcccgaccgttccttcttcataatggcca

SEQ ID NO: 95188 - DNA, 792 bp, Heterodera glycines
  SCN-specific regions: Sequence locations=1-251,274-792
ttgagatgcatttgttccatgccttccttcaccgttcactgctgatgaatttgccgccttcgtcctcttcttcccccgtcctgtttaatcggctgaccaatcgtcaaactttggctttttctgccattgtccgtcgtgtaactcgcggtttttctactcgtcaacgcaatctgtacaaagtgttgggcgtttctccttccgcctcacaaagcgacatcaaaaaagcgtattatacactgtccaaaaagtatcatccggatgtcacaggttccaacgaatcgtgcgcaaagaaatatttggaaatcaaagaggcttatgacgtattgcgtgatgaaaagcaacgagaagaacacgaccgatggttagcggccgaagaagttcagcggcaacgtccaattaacggacgacagccgtatgtacgcagacagaaagtgtacgacgatttgtggccaaacaatggaaccttttcggatgaggaaatacgaaggatttggcgcagtatgagtggcaacagcgaatttggacggtcgaattgggaatttgaaacggaggtgaagcgtaaacgacagatggcatatgaggaacagacgaggagaagaaatgagtgggcgaagaacgggttcggccaaaacaatggtcgaagtgattggactgaccaggaccaatacaaaatcattggcaaaattctcctctgttatgtgctcatcacttttttcatcgaaattttcagcgcttcccttggacttttccgagacccatttctgccgccatataacagagaagaagacatca

SEQ ID NO: 95189 - DNA, 524 bp, Heterodera glycines
  SCN-specific regions: Sequence locations=1-218,251-459,481-524
gttccttttaaaccaattaattacagttgcacttgcacgttgcactttcttgatttcttcacaacaagaacatttcgcggtaaccaacgcgacttggccagggagcgcaatctgaagaaacagcaacagcaaaaaaagcaagagcagggcacgtccactgagaaacggatggaaagggacgcagaagcaatgcgcctaaaacagcagaaagctgcagcgaaaaaagccgaagaggaaaaggcaaatgcacaagcgccgaaggtggtgaaagtggaccctttgaagggactgtgacaagcgaaaagaaccactcggccaggggatgcacaaactgacgcttttccgtgctttatttagtccatttttcgaattcttttcagcaaaaaccataattaacaaaacttctgcccataaacaaaagcatcgcatttaagctatgtagttgaacgccttcatattctttcaaatgcttcatgtttttatatgtgtgttacgcttcaataaaggctatccgtttaaaaacc

SEQ ID NO: 95190 - DNA, 528 bp, Heterodera glycines
  SCN-specific regions: Sequence locations=1-223,256-463,485-528
aaccaattaattacagttgcacttgcacgttgcactttcttgatttcttcacaacaagaacatttcgtataaaatgactcgcggtaaccaacgcgacttggccagggagcgcaatctgaagaaacagcaacagcaaaaaaagcaagagcagggcacgtgccactgagaaacggatggaaagggacgcagaagcaatgcgcctaaaacagcagaaagctgcagcgaaaaaagccgaagaggaaaaggcaaatgcacaagcgccgaaggtggtgaaagtggaccctttgaagggactgtgacaagcgaaaagaaccactcggccatgggatgcacaaactgacgcttttccgtgctttatttagtcaatttttcgaattcttttcagcaaaaaccataattaacaaaacttctgcccataacaaaagcatcgcatttaagctatgtagttgaacgccttcatattctttcaaatgcttcatgtttttatatgtgtgttacgcttcaataaaggctatccgtttaaaaaaa

SEQ ID NO: 95191 - DNA, 363 bp, Heterodera glycines
  SCN-specific regions: Sequence locations=1-363
cgcatttggcatatgcttttgttcccccatcgccacccgcgcttccgtgagaattggcgctccttcctcggcctccagcgcaacagtcgccgctctctttggcgtcacattttactgccctcctcccacgccacgccctattcactgaacgcggcctcggcctttgacgaggagcagcagcgactggtgacagttaaaactgacattggaaacggacacagcacaacacagcaacaggaagggacgccgctgattgccgactctccccaaagttcgaccgaaacgaataattccgccgatgacaacattttaatgatttgatgattattacccttgtcctttcctcatcgattccttcatttt

SEQ ID NO: 95192 - DNA, 561 bp, Heterodera glycines
  SCN-specific regions: Sequence locations=1-30,53-156,178-561
ttactccaattattaaatcctccgcgtcgctcaaattttggtcaaagttttttgatactcgattaaattggcattgtaggagaaattcgacagcgaaagttgtacccaaaaaagtgcttagagataattgctatcagagcacttcgttggactcgggtcttcgcattgccacgcttccggcgtatggacaatttacgacaattggcgttgcgatttatgctggttcacgaaatgaagtgcattaccctcccggcacagctcatttcctggagaaaatttcttttttgtcgtcacaacaattcccagacaaagcgcacactttggatttgttggagaaatttggcgctctgatcgactgtcagtccacgcgtgacactttcgtttacgccgcttcatgtcgcgttgagaatgccttcgacgtgttatcaatcattgcggacgcggttctgcggcccaacattttggacaatgagacagcctgagtgtgaacctttactcactgattggatacatcaggctgcttttcgctcgaatacgggcggtctttcccgccaatattac

SEQ ID NO: 95193 - DNA, 475 bp, Heterodera glycines
  SCN-specific regions: Sequence locations=1-147,170-316,340-475
caattgtctttttggtctgttgcaatgcaatgccaaatttcccgtgctgcccgggaagtcagcaagtggttgctgtgatgtccaattacattggcactttcactagtgaggacaaatctacagtatgctcaaccgcaaaaaatactgtggatggaataaaaagtgaactgtcctctcgcggcggatgcccaagcggaggagaagcacaaattgtgaacgaaatcgaccgacagctgactaacattgcgaaaatgaagatcaattatgaggacgggtgcccgtacaatttgggctttgctcgtgccatgttcgacttggccgctgctgctgctggccatgcgggcaacggcacagaatggcaaacaatgaaaggacaatttgagcaggaaagccaagcaatcaaagcaattggccaagaaatgaacattgaagttactgatgtgcattttggacatccaagcaaaggattttccgc

SEQ ID NO: 95194 - DNA, 392 bp, Heterodera glycines
  SCN-specific regions: Sequence locations=1-2,27-150,172-212,234-392
tcattaattaaattaaatatatttttgccatgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgactagtctacagtatgctcaaccgctaaaagtactgtggatggaataaaaaatgaactgtcctctcgcggcggatgccaaaacggaggagaagcgcagattgtggatggaatcgatcgacagctgaagaacattgcgaaaatggaaatcaattatgaggacgagtgcccgtacaatttgggctttgcccgtgccatgttcgacttggccgctgctgctgct

SEQ ID NO: 95195 - DNA, 704 bp, Heterodera glycines
  SCN-specific regions: Sequence locations=1-477,499-704
acaaagccaaaattcacaacaatgagcatcattcgacgacaattcttcgccaccaaactgttctctccccaattggctagcaacaaaatggctgtgctcccagtgcgccattgcgtaagcgtcgccacgccaacacaaaatgatgtgccatacaatccgtcgcccaccaccgcgcaaactttggacaccttaggcattggcacgacggtgcagccaccggagccaaaatggcaaaaggccggactccgaattgagctaaactgtgccgacgagcaaatcttccagagcattgtccaagagatcgtcgatcggttcggctgggacaactccgcctatgactacgccatgtggcgaaaagcgtttgggcccaacaatttcggcatgttcttcgccctggacgaagaccgattgccgatggcgtccacaagcatggcggtgtacccaaaaattgcacattggagcatgtattacgtgaaggaacgctaccggggacaccaattgggccgtgcgctcactcgacgagccatggaaatggctggggacagacacattttcggttacggagttgctgaaatgtgggccaaatacgcggaggagtacggcatgtgccatttcttggactggcagctgtggtcactgcttgtcaaaagtgccgacgtgcgacccgagcggctggacaacgattcgagtgtggtgctgaagga

SEQ ID NO: 95196 - DNA, 913 bp, Heterodera glycines
  SCN-specific regions: Sequence locations=1-165,201-232,255-691,713-913
ataaaataaatttggatgcatgagcgggtaaacacaaacattctttgtcaacagtaactcgtgaaaaatgggtaccactgcgtcctcccaacttgagaaagaactcagtgcggaccacgtattttcgaacgagcatttctatggtctcataaatttcggcaacacttgttatgcaaattcagtgatccaagctctgtatttttgcaaacagttcagagaaaaaattttggcgtacaaacaaacacacaaaaaatcagggatgcaacgcgataatttgctcacttgccttgccgatttgttctcaaacatttcgagtcagaagagaagggttggaacaattgctcccaaaagattcgtcacaaaattaaagcgagaaaatgaattgttcgacaactttatgcagcaagacgcacatgaattttttaattatttgttgaacgcaatttctgaagttttaatggaggagaaaaagaaggagcaattgggcggaagcctaaggaaagccaacagcgcaatggcaccaaacaaacggtcgttttccgcgaatgcaaaaggccaacccaacgatttgtccgcaaagcaattgaccagcacttctgacatcactggtcaacaggagttgacgtggattcaagaagttttccaaggaacgcttacgaacgaaacgaaatgtctgaactgtgagacaatcagcagcaaagacgaggactttttggatttgagtgtggacattgagcagaatgtttccattagccattgtctgcgcaatttttccaacatggaaacactgtcgggtgaccagaaatatttgtgcgaaacatgcggcagtaagcatgaagcccagaaaaggatgcgcattcgcaaattgccccaactgctcgcccctcatctgaaaaggttcaaatacgttgag

SEQ ID NO: 95197 - DNA, 284 bp, Heterodera glycines
  SCN-specific regions: Sequence locations=1-55,77-160,183-284
gagaaggagtcaagacagaacgaaacgggaatgttggtagttttcgagcagatgaaagtgatcacagcgatgatgaggcgacgtggaacggaaattcgactcagcagttgtgaattctgtgacggtgttgttattgagagatcaaagacaggatgataaatatgatatttatttttgttacagaaacgcgggctctagtgcactttatgagtccaatcaattgaaaatactcggtttttatacaataactttgtacatgttcgaacaaaccctatctttttggt

SEQ ID NO: 95198 - DNA, 161 bp, Heterodera glycines
  SCN-specific regions: Sequence locations=1-161
ctttattattctgctttgttaaggaaaaacgtcgcatgagccctatgatgccaaatttacttcgatgaagtacttcatttcaaggaaacttgtttttcctctagttcatcagtggacttccgcatatttaatcacgcttcattctactttttctgaaaatt

SEQ ID NO: 95199 - DNA, 488 bp, Heterodera glycines
  SCN-specific regions: Sequence locations=1-117,139-488
atttcgagcttttaccaaaaaaatggcatcggagaacgaaattccggataaattcttagggaaattcaaattggaaaagaatgagaagttcgacgagtatttggccagcaaaggagtttcgtggattttaagaaaaatgatttgttttacgacggtcacaaaaatttcgaaaaatcagaagcggaaaagagcaaatacaacgcgtacaaccaaagttcgaaacataacacaaattgggagggatggaaaatcggagaaactttcgaaggcattgggttggacggcaaacagcacaaaataaccttcgatttgagcgacaacggcgacacactgacggagaagcatttgcgcatggacaatccttcggacgtgggcgaagtgtaccgttactcggtggacacagacagcggacatttgattctgactctctccaacgaatcactcactgcccgccgtttcttcaaacgaatccaatagaatttgacttg

SEQ ID NO: 95200 - DNA, 66 bp, Heterodera glycines
  SCN-specific regions: Sequence locations=1-5,27-66
aaagggcagttgctgctgttgctcccgcaccaaatgctaacgcagcctcggctcaaacaacccaac

SEQ ID NO: 95201 - DNA, 493 bp, Heterodera glycines
  SCN-specific regions: Sequence locations=1-91,114-493
ctatggtccgtatttccgttgatgttgtcaatgatgcgtaccagtttataaatccgtgtaagcagcgcgaaatttcccttcggaatctgcaaattcctaccattgaaaatctcggagttaccagggatcaatttgatgtcattgatttgactgacaataatattcgaaaattggacaatttgccgagattgaaacgtttggaaactctgcttttgcacaacaatcgtgtcgactttatttcaaaggaaatcggagatcaattgacgaaattgtccacccttgtgttgactaacaataacctggcacaacttggtgatattgacgttttggcctcctgccctcgtttggaatatttgagtctccaagggaaccctttgacccatttgcccaaatatcgtcagtacgtcatttataaactgaagaatgttcgggtcctcgattataaacgcattcgccttgcggaacgccaagcagcgaagaaactctttaaagg

SEQ ID NO: 95202 - DNA, 186 bp, Heterodera glycines
  SCN-specific regions: Sequence locations=1-186
tgacaatcgcgccggacctgacccacacaattacgcgcttcccgccggcctgatcacgagaaggactgaactcacgaactgaaccgaaggatggttgaactgcctgaacgatgcgcgttgagaaatcggatcatctgattttttgtatgtaaaccccatttcacatgatgaactctctcaaactgt

SEQ ID NO: 95203 - DNA, 733 bp, Heterodera glycines
  SCN-specific regions: Sequence locations=1-242,301-491,514-733
attaatttccggcatctatttctaccaatcaccgagccccagacccgaattcgaacaaaaattcgaaaagtcaaattttatgaattttgagttttatatcaattaaagattaatttccggcatttatttctaccaatcaccgaaccccagacccgaattcgaacaaaaattcgaaaagtcaaattacacacacacttattgtgctttactaattgtatgtactttgtctaatattcctttggtaatttatttaattaaaaatatattttattgaaaatatttttctattaaatttaatttctcataatttagaaattgccagtcgtggagatttgattgcattactcaaaacctaacgatacgatgtgtttttcaagagaaaaaatggcaccaagaatgccgttaacggctgtcggtggaataccaaaaagcaatgcaattggtctctgtttgatttgcaaggaactttcttttggcaaacactacggttgtataagttgccttggttgtaaaactttctttcgtcgtgctgttatgcacaaccaggacactgtgtgcaaaaagccaggcttttgtgagttcgaagtgtcggctcgtcgactttgtcgttcgtgtcgatttcgtgtctcgacgatgggaatgagtcacagaagcactccaaccaaagcgtgatttgatcggccggcagagacgtcgacgctaccaagcagttgcatcttcggtcacccctccc

SEQ ID NO: 95204 - DNA, 505 bp, Heterodera glycines
  SCN-specific regions: Sequence locations=1-166,188-505
cgaacattaattggcaattaattaagtcgttttgtttttaaatgacattagaaggcgaaagaggtggattagatgcacttttgactgctcggttggatgaggatgagcaattcattgcgacaataaattacctgaacgacaatttgcgtttggatgccgaaacgacggagcaaaaactcagaatggtattggaggaccgggagctggagctgaaccaacagtacttggaacagcttgaaaagatgaatgaccgcgtgcagggatttgtacagcaaattcggtcgatgaattcgatttgctgcgaactcactgaacgcattcaaacgaacaaggaaaagacgcgcgagttgctgaagagaacagccgttctgcagacggaaaagcgcgaattgggtgccaagaatgcatttttggacgaatttttcgccaaatattccctaaacgaagaggaggagacggcattggcactacccaatcagcaggggtcgccttccgacgcattttt

SEQ ID NO: 95205 - DNA, 504 bp, Heterodera glycines
  SCN-specific regions: Sequence locations=1-504
gggctgcaggcttccgcgagcggctgacccaccacttttacgcgcagtatttggacgggttcaccttctacaaaatgaccaatttggacaatcgaattgccaacgcggaccaactgctgacgcaggacgtggaccgcttctgcgagggcattgtcgagctgtactccaacctgtccaaacccttcgtcgatgttttgctttacgtcagtcgcatcggcgcttccatcggttggcaggcgcccattcagctgttcgtctatttgctcttctccggcacggcactcacttatctgcggaggcccattggccgtatgacagtgatggaacaacaattggagggcgactaccgtttcgtcaactcgcgactgattgtcaacagtgaagagattgcattttatcagggcaatgagcgcgaacgcgtttctgtgctgaacgccttccaacggatgatttcccatctccgttcgctgattttgttccgcttttccatcgctttcatggaca

SEQ ID NO: 95206 - DNA, 870 bp, Heterodera glycines
  misc_feature (822)..(822): n is a, c, g, or t
  SCN-specific regions: Sequence locations=1-72,94-320,343-870
attttgttcgccatttttgcagtcaaaacatcaccaaaccgacaacaaaatgtgacgagcaagaaaattcttccgccccctcctgttcttcttcgtctgctgcccttgtccatgtgcaaaaccgtggccaatggccggtggaagtgttggccaaatttttggccgattgttttgtgctcggcgactttgtctcggaatatttaataaacgcagttgctggacgaagtttggccgcacatgaatcgaatgcggtgggaggacgaacattgggacggacaaatccaacgctaccgggagagggaacaaatgctggaaaattggcttcccgaaaaccaagcactgatccgacgcatttggcacacttcgtttcccgccccatttgagccgtcgccgtacgtacacattctcgacctgcaccaggacggattcatcagcccacatttggacaagtcgaggtattgcggccgggtgatctccggtctgtcccttctgtccgcttctgtgatgcgaatgcggcacaaaagtgccgagttggggcagctgtgcgtggccgatttgttgctcagccggctcagtctttactggctcagcgggtcggcacgctacgacttcactcatgcgctgttgggggccgaagagagtcgctttggcacccaaacggtgccaagggagcgacgcattgcgctcatttgccgggaagtggtggtgccaacggcgaaaagtgaccaaatcgactgacaaaacgaatcaatgaatgggcgagagcccaaattttgcttatttattaatttttttttgtgtgtgttatttaattttattcgntttttgtgatcttttttttgcatagaatgaaaaattatgatgaatgtt

SEQ ID NO: 95207 - DNA, 943 bp, Heterodera glycines
  SCN-specific regions: Sequence locations=1-674,696-856,878-913,935-943
aagtttgagcgtgaatttgtctactcaaaatgtcgccaaacacactttgtagcattgtttgcctgcttttggtctgcaacttcatctgggctgatgatgaacacagaagcttcgcagaggaattagtgagacgcctgcgacgttcccatggttactcagttggttatggaggcaattgtgcatgttcttcctccgcctacccggcgaccgcttcacacacttcatacacggcacctaaacaaaccagttactcatcttactcttgctccggttccggctgtggtcatcaagcctaccagccaccccaaaaaaccagctaccattggtgcactgggactgcctgcaacaaagcgcaggctgttgctcatccagttccggtgagcagcaacagttacaagtcttcctgcacaacttgtggctcaagtagtcaccagcaacattactcaaccgtcacagaaacgaaaacagtgtaccctgtgaagacgtactcatggtgcacgggtactgcttgcggtgctcaggctcaacccgttcaacccgttgccccggcagcaagtggtggtggcaccagtattagcaccggcagttcgtgcagcagcggaacatgcggacaacaaaaacaacaggttcaacctgttgcccctgtccaaccggctgccccggctagcaccagctcgtgcagtggtggcagttcatgcggtgccgcggcacaagaggttcagcccgctgctgaaagcagcagcggtagctcaagcagtggtggctacgacacacaggagactcaaccgagcggcagcgatagcagcagcggtgcgtgcagtggagcttcttgcggagaagcggctcagcctggcgccagcagcagctcctcatgcagtggtgcatcatgcggacaagcggctcagcctgccgccagcagcagctcctcatgcagcggcggcgc

SEQ ID NO: 95208 - DNA, 324 bp, Heterodera glycines
  SCN-specific regions: Sequence locations=1-324
ggaaaattttggaaatagcggacaaagagaaaatttcaggccttttgcgcattgtcgagtcttttatcattgattccgaatgcatccacccaattaggaagcttgaatatgcagcagaatatcggatgagccgactcgctgacacagtgcttcgattatttcctactcaaattgaccggctcgattcattattcttatatttagcagaaaatggagagacattggccgatgttcacttggatgtacttaaaatgcttgacattcatgattcatacattgttatgtaaaacaaattcttgctcttgacaagattttatctcttat

SEQ ID NO: 95209 - DNA, 862 bp, Heterodera glycines
  SCN-specific regions: Sequence locations=1-150,173-862
gctcaccttctctttcttaaaaaaacatcaagaaatcgacaaaaaaattcgttctctgtgtacaaaacgcatacgtctctttatttcaattaatttgcttataagcaaagtttcctaaaatctgataactgaattgtcgttgctccgcatttgacaaaaaagaaaatgactctccagtggaccgtggttgcgttcatcctttacgcagaaatagccacaattattgtgcttcttttgccatgggttcggccgacaatgtggaaaaaagtgtttaacagtcgcgttgtgcacaaactcaaacagttttccaatgtttacgcctacgctttcatttttgtgctcattcttttgttcgttgatgccacccgtgaggtgcgtaagtacagccacgtggacacgactagagagatggtgggacgagtggccgaggcggacgccgtcgttcacatgcgtctcttcagagctcagcgaaacctttatttgagtggtttttctctgcttatggcactgattatcagtcgcatcgtcactttgctcgcccgttgtgcccacctcgaattggctgctgaggcggcgatgaaacaggcggaaggggcgggcaaagcggcgcaaactctgctcggaaaagagggcgatgtgaatagtctgtccggcgaagaagcgaaaaaattgcgaaaccgaattggaaagaattgggagcgaagtttgaagaaaagcgggagacgggacagagacgcaatgaaagcgcaggcggagaatttgcaggaggaatacgaacgcgtgtcgcaacagttacggaccgcagaggcttcgcacaatggtaacaaaaagagtgattgaagacgaacgatcgcacaaagaa

SEQ ID NO: 95210 - DNA, 440 bp, Heterodera glycines
  SCN-specific regions: Sequence locations=1-106,128-246,268-440
agaaagcgaagagttaattgccaattaaattcaaatggcataattggcattgacggcgcgtgaacagtaaaatgaattggtatcagacggaagaaatggtggcacggcccatcgctggtggccacctccttgaaaatattgacccaaccaaagtccgcttgttcgttaaaatctttgcaacgcaattgcgtcggcagcccatcttttctcggaatgtgcaaccatttggacagaacttggccagccgttgcatttggcccatcaaaatcaccaaacgcatcgggcaacagaccaaatgaatcgattgaactcaactgattgacatcagtagaattgtcggtgaaatgagacgaagtccactcttgtagtagttttttcacggtgttcagtatttgcttcgttttcactgttgttgttgcacataaacccgcgtttacgcc

SEQ ID NO: 95211 - DNA, 518 bp, Heterodera glycines
  SCN-specific regions: Sequence locations=1-104,131-329,351-518
aaaagctggagctccccgcggtggcggccgctctccaactagtggatcccccgggctgcaggaattcggcacgagggtttgagagaaagcgaagagttaattgccaattaaattcaaatggtataattggcattgacggcgcgtgaacagtaaaatgaattggtatcagacggaagaaatggtggcacggcccatccctggtggccacctccttgaaaatattgacccaaccaaagtccgcttgttcgttaaaatctttgcaacgcaattgcttcggcagcccatcttttctcgggatgtgcaaccatttggacagaacttggccagccgttgcatttggcccatcaaaatcaccaaacgcatcgggcaacagaccaaatgaatcgattgaactcaactgattgagatcagtagaattgtcggtgaaatgagacgaagtccactcttatagtagttttgttcacggtgttcagaatttgcttcgttttcactgttgttgttgcacataaacccgcgtt

SEQ ID NO: 95212 - DNA, 504 bp, Heterodera glycines
  SCN-specific regions: Sequence locations=1-259,281-504
caaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcattttaattggtgtactaaatcataatctgcttgtgtctgtttcatctccttcttcatttgtccgtgtgctttttcgttttgtgcccttcgtgaacattcgccatccaaaaattaagaatttggcgctatctcacaccacctctccgactgatcagtgatcagctttgtcattccctgctgctcgtattgactcatctccgccgtttgcgattgatttttgatggattttccctttcttttctgtttgtaaaacataccctcccccactcttcagcataaattat

SEQ ID NO: 95213 - DNA, 554 bp, Heterodera glycines
  SCN-specific regions: Sequence locations=1-88,110-480,502-554
cttcgaactagtggatcccccgggctgcattaccccggcacgagggagatttgttacaaacgcttggaacttgcagtgagaacaacaattgcaacaatttttggccttgagccaacacaccatcagttattctgttcaacacttagtacgaccaaagaagacccctttcaattgcatgtgaacatggccgagaaaaggaagcttctgaacgaaattgataaatgttataaaaagatcgacgaaggctttgaaattttcgatgacatcatggagaaaatgaacgaagcaaacagcgacaatcaacgagagaaattccaggacgacctgaaaaaggagataaagaagctccaaaggttaagggatcagatcaaaggatggcaaaactcttcggagatcaaggacaaggactctctgtcaaagtttcgaaaactgattgaacaaaggatggaaatattcaaggacgtggagagagaaaataagacgaagccgcacagcaaacagggactgtcagcggaggacaagttggacccgagggagaaggaaaagtgcgagac

SEQ ID NO: 95214 - DNA, 1073 bp, Heterodera glycines
  SCN-specific regions: Sequence locations=1-22,44-1073
gaacatttacagtcaattggacccatcacaacggaagggactcgacattgatggtcactcatacggagttcatttttactcgctgcccggaatgtcgtctttgacctcattcgactggcacccgaccatcagtgatcggttggcacttttacctgtccaagaaaagccaatggcttttgcacattcgattgcctccacgaaacgaattgccataattaaacttcgtgatgacgtcaattccgtcatcggtccttccggtgacttttgcatttcggcggggccgcagctgaactttgaaaacggcgagaaattgttggccaaacccaactgcacttctgacatagacactgaaacactgttcaaacgacgggtgctcgccggctacggctacggaaattcactgaacgcattggcaacactgctcgaatattcgaagaaggccattgagagggaccaattcgcttcggatgatttacgcttttgctgggattggctttggatgcaattccaatcggcagatgctaacgaaattaagaagaattacggaaccatgttcgctggcgttaaacacattttgaaaggcacaaagtccaattcgaccatcaaacaggacgaaattacttacagaaaccgaatttttgtcaacgaaaaacgactcaaaattttgcgtatgtgcaattggcccaactgcgccgtgagggacgagtgcaaggcgcggtttgacgaaatcgcggctcaaaacggagtcttcggtatcactcgcgcggcggcgttggcacttttttcagtgcatggaatgctcagcaaagagtatttgactcatttgagcgagttcactcattcgcgcgaatttgccgaaacatggtgccgttccccctcctttgtgaccaattatcaacgaatggccgatacggtgctgaacattttgcagaagtacgacggagttcgggtaccgaactatgaaagtgtgtgcgagggactgacaggggacgattatttgctggcaattgttaagttcctcgccagacgtgacaaaatttacaatcggatttacaacgaaatcttcgaaagta

SEQ ID NO: 95215 - DNA, 604 bp, Heterodera glycines
  SCN-specific regions: Sequence locations=1-188,216-604
agggcgtgtttcactgctgctttttctgttccgtcgcaaaaggggcgatattcccgcggagaattaatcgagaaaatccgcacaacgccacgcgaccaatggacagaagcaaaacgaacaaagggagaagagaaaggcaatcgctggcagacatttcccaagaagtgatcagccaaatcctccgtctgtttcccttctcttcttcttccctccgcgttcacttctctccattctcttcgtccctgcttttccgtgctaagtctacttcatctgtccaacagctcaaaaagcaacaaaatatcccctcacaatcactttgtcgcgctgtgatcaatgacaatgcgaatgtacaaataatggaccgaattcgccgtgtcgcctcgaatttgtcgctaactgcgaagggacaaagagaacggcgacaaaatttggcattactttggggaagaggagaagcgaagaaagcgaaaaatggagaacaaaaggaaaggacgaaggaggagggggcattgagcaaattgtgtaagatgtccgtcgacacaatggcaatcactgcgcttccgctcgactgttggcttaaggaacggctcaaaaattgggtcca

SEQ ID NO: 95216 - DNA, 635 bp, Heterodera glycines
  SCN-specific regions: Sequence locations=1-67,89-606,628-635
gtttgagactgtttggctcgaaattcataccattttttcatacgattctcatgagcagtggtatcattgaatttgctgtggccaggggattgcacgtcaaatgcagagaaacggcagtgccatatttgcgcagttccattcgccgttttcccgttgatgaacaacgcgtgccatggaatgtgcctcttgtggactattctccgtgcgattacaccgctgattcggtgcacggaaagccatgggtttttccatcggagccgtcaagatgtaaattcaattcgatggacgacggggtgaacagagtttcgtttcacggcagttacaatttggacaccgatgggaggcctctaaaccctttcggacggacggggctcagaggcaggggactgtttggccgctggggtccaaaccacgcggcggatgccattgtgtcacgacggctggcgaatggccaattgcaatttgtggctattgaacggcgtgacactggcgaactcgcactgcccggtggaatgttgaacaaaggcgaaccgccgactgaagccgccgtccgggagtttagtgaagaagcaatgggagggcatcgacgggaggacaaattgggacatttttggaaaaaggggaaaactgtgtac

SEQ ID NO: 95217 - DNA, 470 bp, Heterodera glycines
  misc_feature (464)..(464): n is a, c, g, or t
  SCN-specific regions: Sequence locations=1-470
aagttttctaaaaatggaatttgttctaattgttcgtttgcctaacgacctgaagtacataaccgtccggccatcgagtaccattgcgtttgttaggggaatgacagcatcactgatgggtactgcaacggaaaatgtgcgtctccttcttgatgggatgcctatgcatgatgggcgaactgttgagcactacggattgacttcagacagccgagtcttcgccgagctgatcaacaagggaacggacggagcaggcagctcagcagggaagaccggaaagccaccggccggacgatgatgtgcgcccgtcaaattcgaaattgtcgcatgaggcgttatggggggcaaacgaatggacgagcacagaaaaccaaccgacaaattcttttttcatttgttatttttaatttgttgatccgtttcgtgttaaagaaaaattagttgacaatgcgtaaagtgaaccngaaaaa

SEQ ID NO: 95218 - DNA, 529 bp, Heterodera glycines
  SCN-specific regions: Sequence locations=1-42,82-461,483-529
ggaacccctcgccaattgagtgcgttttttggcattgccatggcttttcccctcctccccttcttttttctgtttccgcttgccctcgtccctctccaaaggacagctgcggttcatccaccgctgttcaaccgaattgtccccaccagcgaacggacagtgaatctgactttgacgcgggattttggcgaggcaaaagcggggaacgatgaaagcgcaaataattcaaatttgaccgcatcaccggtggaggcgaaaattcatcgactgaaagagctgagaaacgaaatgcgtgcattgacggcgatgatcaaagaagaacgacgacgaagcaaatccaaagacattcggcaccggcaccgatcaatcgcggagaaaatgcgcaccgaaatcagcagacaatttcgaaaatggcgcaaaaaagtgctaagcaaaattcacttggttatgcaacgattggaccaattggagggcgaaatgcacaggacaaaggataatttgcaaaaagtgatgcacgacaacggccggg

SEQ ID NO: 95219 - DNA, 475 bp, Heterodera glycines
  SCN-specific regions: Sequence locations=1-475
aaaagaccaaaaatgttttatcgacgaatattcgctttattcttgtgcattttcgtcattctcttcacattacaatttctccccgtcatcgatggcatgcaatttgatgtggtccaatgtggccattcaaaacggtgcgaattcggcggttgtgcgccaggcaaagcgcaaaacgcggcatcatgtgcctatttgttctcaatggagccggaggggccggacagtgttcgaatggaaatgtacactttacgcaacgtgccggacgtcaaatatgtggcagttgcattctccgatgacacacaaatgggtgacgatgcggtaacatactgtgttttgactggcaacggacgggtggaggcgcgcctttcggtgaacccggccaacacaaagaacaatgtgccggcgcctgcgggggcggagaatggctttctcgagctgttggaaggaaaagcggatgacaacggcatttactgta

SEQ ID NO: 95220 - DNA, 506 bp, Heterodera glycines
  SCN-specific regions: Sequence locations=1-342,368-506
agttcccggatgagcctggtttttttgttcggataggttggccagatacgaacagtccatgctaattgagacgggacatatgtacgcccaggcagcgcgcaacaactctgaggcggcgcgcaacaattctgtgacggcgcaagagagtgtccgtgctatggtgaacaaggaccgtttggtggcagacaaggaattactattggcacaacaaaagatagaactggacgaaaaggaccgcttaatcgcgacgctgagggacaccatccagaacaaggaccagaggatcgtttacttggaaggttatatcaacggacttggtgttccattgcccgcgccggcagaacagcagcagcaggacggcggcggccaatgagagagagaggcctctgacagaatccgactgaccagaagaaaaaaattcgcggacttttctttgatgtggaatgttttgttttgtttttttgatgctttgcgcctaaaaaataaacatggcttctgacaaaaaa

SEQ ID NO: 95221 - DNA, 467 bp, Heterodera glycines
  SCN-specific regions: Sequence locations=1-226,248-467
tgagatttttcggacgaatgcgcacttcgaattcgcagcggcgaggaaaagccgcagagggaaacgcacgcgacggccattccgttgccatcggcggccaatttattccttttggtgaagaaaatcatcaccgaatcaaccaaattgttcgctgacccaaatgcggtgctcagcaaattggtggagctgttccgtcagtgccttcgtcagttcgcccacgggtgcctttccgcctttttgccccaggcccttcccggcgtttcgccgggggcgggcggaataatcggcgcctccacctccattctgcagaatttgatgcgcgacgacagcgtcgtccgactcgacgccgaccaaaccttttttacgtgttgtgtcctcgccaccgccgattggagtgcggagacgaccatgcaattgcaggacaaactgaggcaaaagatagcggacggcgacttcggtcaggagac

SEQ ID NO: 95222 - DNA, 961 bp, Heterodera glycines
  SCN-specific regions: Sequence locations=1-18,40-165,189-353,397 -582,626-961
ctcaaaacgaaggatcactaaagagaattcttttttaatcattctcgaaaatgccaccgacttgggccttagtgccgcttttgcttctgttctttgtccatttcattgatgtcggattcgctcgtcgctacaaagcgtcaacaaaatacaatccgccggcggaagaaacgacgacagaaacgacagaattgacaaccccaacggaatgccctgcgccggtgtgcccatgcgaatgtcccaccgaagaaacgtctgaaacgcctccttcgacgggcgggggagggggcactgacgacgacatcgtgacctcgccggaaggagaggagacgaccacgcccgtctccgggtgtgttccgggcccgccggggcctcccggcccaccgggcccagcggggcaaaaggggccccagggaaaatgcggcgacaatgcgagcaaacgcaaaagggaagcagcagcagtgccgaaagagtttatgacgaatttggaaccgaatgtgccagtcaaacgtgcaaaagaaggagaagccgttgcaaagacgcattttgcacgtggccatgtcaaggggggctgtccaccgggtcccccgggggagcctggcactcccagggcctccgggccctcccggagacccggcgccatgcccgaagcacatgaaaagcgaagcgcaaagcgtcgatggcaaacaactggctaacagaaacaaacgtggggagacggtgctgaatgctgcaaaggaggggaccgaagtgaaacgccaaattgtgcgccatggcattggaccgcccggccccgccggaccgccgggagaagcgggcgaagacggagagccgggcccttgcgaatgttacaaagaccaaaaaagtcaatgaacgaacgcaatttatgcgaatagcacacgaaataaaactagcaaatttaatgttttttaaatttattttggtgaaaaaattttttattgct

SEQ ID NO: 95223 - DNA, 691 bp, Heterodera glycines
  SCN-specific regions: Sequence locations=40-164,188-217,302-691
cctcgtccgaattcggcacgagggtaaatctttgttttgttaaaaatgctttctctcgcaattcgacgtttcatcgtccaacattcaaatggcacatttatgagcactaattttgtcgcgacatcgtcaaactttttgctgatggaccaagaaaatgacaaagagacgaagaaggactttaggaaaattgtgaaactgctcgaacgaagtccgactcagaaaagaaagaaagagcaggaaaaagcggaagaaaatgcgaaaagagacaaaagagaagagaacggaagggaggaggaaaggaccaattggaaggagcacatcagcaaaagtctgcacaaaagttacgacgaatacgcgacgaggaaaagcatggaaagttggaagaggagggcccgaagggacacattttgctatatgagagaccggaacttgcccgacttggtcacttacacccatcggtacatcgaaggcctaaccgaactgaacgggaaaaacaatcagaggtccttcgaggacaacgagttggttgttgttgtgttgaaatttgtgatgaacgaattgctcaaagggaataatgtccaatcggcgcggaacgaacgcatagaaaaaaccgaaatgattctaatcgtcatcaattcggaatattaattgtttctttccttgtttttagtgattaaaaggatcaattatc

SEQ ID NO: 95224 - DNA, 459 bp, Heterodera glycines
  SCN-specific regions: Sequence locations=1-422,449-459
gtccaattaaggttcggttaaattacgtgctgggaagaggtggaaagagcgttggacgaattgattgagcaacgccgccagcggggcgtactgcccgaggtaaccgaatgggtaccgcccgctggcggaggaaggaggagagggaggaggtggaggggaagtcgacaacttcgtggaagtgctctgttggtttgtcgtgggagattggacggggcagtctcaccggatacatcatccgcagttctttcgttgacccgttttacaaaaaatgcaaagccaggagaggaaggagaccactttagtggcctggtcaacggaaagctgaccaaacatggccaccggcggataaacaaattgatcgaacgcaagaaacaatggacgcaaaattcatgatcagcgctttttcaaaccaaaattcattgtaaaaattttttaaaaataataaaaacatttggaaaa

SEQ ID NO: 95225 - DNA, 1118 bp, Heterodera glycines
  SCN-specific regions: Sequence locations=1-170,192-526,550-1118
caatgccattgcctattcgcttttttgttcttaaaatatgccagcagaatggacggaatggcaaattcgtttcgctgctcactgccgcccttcacagggaattgtcgccgccgcatttccgacgcttttttgcctcgaccacttccgcttcttccgatgatggttttgttgttgaaaaggtggagaatggaaacgcaaaaaattacgaatccattgacggcgcatggaaatgcacaaactgtgctcatctgaattggccccagcagcgcatttgcaaacattgcactattggcatacccaccgaagcgcaaatggcgattctgaaacaattgctttgggtgtgtccaaattgcactgctcgcaacaccggcgaccattgcggaaactgtgccttggcccggtgctcagtgtacaaaggcttttgggtgtgctcacggtgcacgtggcgaaacattcccgtcaatttctcatgtcgaaaatgcaaaaaaggcaaacagacggaggagcaacgccaactcatccagcaacagcgatgggtgtgcggagagtgcaaacaccacaatttcaaggaggaatgcttcagttgcggtgcccctgagtccaaacggttgcccgatggcgtcggtggcgagtcattgcccgacgggtcgtggtattgtgtcggttgcggctttctcaacttccccaactattcgaagtgtcgccactgtcgcagagaagaaccgacggatgagcaacttggcgtcattcacagttcgcgttggcaatgcgctgagtgtcattttgacaattacgagtccaatttgacgtgccaccattgcgacgcgccacggcccacggaagggcaactccctgcaacttctgattgtcagtattgggtgtgctcaagctgtttgtggcgtaactttcccacccatttgtcgtgccaaaaatgtatcaaagggagggcaccggaagagaatcgccaacaaattcaacaattgcgatgggtttgcggaatatgccgacaccacaatttcaaagaggactgcttcaaatgcggcgccccaaagtccaaaggcttttcctgcggaatcggtggcgagtcgttggacgacgggtcgtggtattgtgtcagt

SEQ ID NO: 95226 - DNA, 721 bp, Heterodera glycines
  SCN-specific regions: Sequence locations=1-172,194-721
tttccgtataaactctataagattatgatgaaaagttctgctgatgctgagcagttcggccgtctttcgttttcgatcaacagtttattcagcacccaagaagtggcatcgtcttcgagtgcgtcggacccgacaacacaattaatcatttcatcactgaattctgtcagaaaaacaaatgaaggcacagtggaaaatgcgacgaaaaagactgacaacaaagaattgagcaccgacgaggatgagcagcaaaatgtggcgagcacttcgacgccggaggacggagaattttcaaaaatcagtcgtattcgaaagcgccgctacagtcaggcacgaatacagccgacgagagtgaaaaaagtaatgcaaagtgacgaagacatcggcagaatggtggccagtgtgccggtggctatcggcagtgccatggaagtttttgcggagaaattgttgctcgcagcggccgaaagtgtccagcacagttcaaccaaaacgctctctccaatgcacatcaaaatggccgtttctcgcgttccgcaattttcttttttggagcctatgttgagggatgttccgatgaacccgaaaatggccccctcttttggacagcaatcgtcttcaacgtccaacggcgaatgaggcgatgctttccgtttaaatacctctcacattggacattcatttaacaaggctttactgcgattggttcagttaatctgta

SEQ ID NO: 95227 - DNA, 1242 bp, Heterodera glycines
  SCN-specific regions: Sequence locations=1-1242
agacaatgggatttcttggcaaattgtcaattggtttgtcggtgatttttcttgggatcgctgtttggttcagcaccagcaaatttttgccaaaggaatatcacctaccaccacctccggcattgactggcctcctaacggtgaacaaaccgaaggtgttagaaaaattgttggagggacaagttcttgggcctgaatcggctgtcatcgaaaatgatgtgatttacacctgcacattggatggaatgtgtttgaaaattgtggacggcaaaattgagaaaagtgtcccagtgacggcacatgcgacaaattgtgatggaaaacgcaaaacaattccaatttgtggacgtccgcttggcattcgtcgattcaattcacaacaattcattgttgctgacgccgtgcttggcttactgctcatcaattttgaagaagagacaaaagaagtgctgttgccaagtataactgttgtggacaagaaacgcttgggcttcccagacgatttggacattgtggacaatgacacaattttgttcaccgatttgtccgcaaaatatggctacagtgattgtgatttggcattttttgagcacgtccgggacggacgtctgcttgaatacaaagtgtccactggtcaattgcgagttctgatggacggtttagcagttgcgaatggtgtccaattgcaccctgacaaaaattctgttttggtatgcgaaacggccatggctcgtatacaccgctattattttgctggccccaaaaaagggatgcagcaaatttttgtggacaatttgcccggtttccctgacaacatccgaatttcgcgcagcgcagattcattttatgtggcgttacctttccatcgaagtgaacagaagccacacatttttgacagacttggcccatggcctttggcaaggaaattcattggcgaacttttgaaaattctgcctgacaacgtcctgcagcgttttgttgtcggatcgacgcatggcattgtgttacaattggatttgaacggcatgattttgcgctcttggcacgaccccgagggatcagtgatttcacacatttcggaggttgatgatgatggaggtgattttctgtatttgtccagttttgtgaacaattacattggaagaatgtcgaaggaatgaagaatccaaaatttggaatgaaaagccgataaaactgcccaattttcaaaatattttttttgataaattcttgacttttaaa

SEQ ID NO: 95228 - DNA, 548 bp, Heterodera glycines
  SCN-specific regions: Sequence locations=1-234,258-340,366-431,461-548
gagctaaaatattacttttgacttttcaaaatgtcatctcgacgtggcggtggtaataatgttgagggaaaggtttacgttggcggtctgccagaggacgcaacttccgaagagctcgacgacgtcttccacaagttcggcagaattcgtaaaatttgggtagctcgtcgtcctccaggttttgcctttgtcgaatttgaggacacgcgcgacgcggaagacgcagtgcgatcattggacggaacacgcatttgcggtgttaaagctcgcgttgagttatcaacgggccgttctcgccgcgatcgcgatgaccggggcggtggtggtggcggataccgaagcggcggcggtggtggcggcggcggttaccgtggcggtggagggaaccgcgactattcaagatctcgttcgcgttctcgttcgccgtaccagcgtcgcggaggaggaggaggccgttctcgctcgcgttcccgttgaaaaatgggagggatctacaatttccgaagaagttgtgacgaactgatgcgatttcaaccattggcgatttt

SEQ ID NO: 95229 - DNA, 496 bp, Heterodera glycines
  SCN-specific regions: Sequence locations=1-496
gccaagtttgagcccacaaatctgctgactaattccctactcattcactccgttccgaaatgccgaccactgtcgtgcgcacaacaaccactcggacgactggtggtggtgtacaccaccactccatcagaatggtgccgatttggtcgattaagctgatcactgcagttttggcccttctgatgctgatcctcatcttcttcctgcacacggccatttggcaatattacgtggtcactttcatcgtcctcgtgctcacttgcggctttctgctcggctgggcccttccgccggtgctcaatcgtttcctcaccttttaccgatcggaccaaatttcgtattcgatcatcgccggactgaccattctctcgttgattctctgcgccgcttatttgattcacaacgattactacaaacacggggacaactacaaaatcatggtcggcgtcaccatttgtatgaccgtggagaccttgatgtgttgtgtgttgctttc

SEQ ID NO: 95230 - DNA, 516 bp, Heterodera glycines
  SCN-specific regions: Sequence locations=1-403,425-516
gtttgagtcattctctaagataagatcattagcttaacaaaatgcccggcttcgtaccgccagtccaatcaaagtgcccaaaatgtgggaaatcggtttatgcagcggaaaaaatggttgctggcggatatgactggcacaaattctgcttcaagtgcgaaatgtgtaacaaattgctggacagcactaacgcgtgtccccacgaggctcaattgtattgcaaacagtgccatgggagaaagtacgggccaaagggcgttggcttcggaattggggcgggctgtctgacgacggacagcggggagaagttcggcaacaaacgcgtcgagaaccgaccccttatggccgaggcgttcaccgctccgatcaatccgcaacaacaatgaaaaatggacggacatgcgaaggaagggaaggaagagcacggacactcccatcgattgaattaccaaataaatttaaaatacaagcgaattgttgtattaagacaataaaagtgtaaagcgggaaaaaaaa

SEQ ID NO: 95231 - DNA, 574 bp, Heterodera glycines
  SCN-specific regions: Sequence locations=1-469,491-574
aaacaaaataagaaatcagaagtcgtggcagccaacgagaagaaacaaattaagaaatcggaagttgactttcccgtggtattgaagcgtggggtgcagggacgtgtgaaatggtactcgcccgaggatgcctatgggttcatccatcgttacgacgtcgacgaagacattttcgtccacggctcctccatcgtccgcttcaacattcgcaacaaaaaccagcatcccgtccttagcattcagcaagaggtggaattcgatgtgatcaaagtccgcaagggtctcgaggcgcgttgtgtctctggcccgggtggccgacttgtcggacgcttcttcaatattcctcgtcgaagtgtctcgggtgctaagaatcagaaacatgccgtcaacggtggtttgcgttcgattcgccgacgcagcgacggcgaagccatcagagaaggagaagggacgcgtggactccaacaaaaaggcagcggttgagaagaacactgaagacacaacggcagacttggccaatatgcgccttagtgaggacaaaaatgacagtggcaccgtggcggacacggaggag

SEQ ID NO: 95232 - DNA, 519 bp, Heterodera glycines
  SCN-specific regions: Sequence locations=1-466,496-519
gtttgaggcgcttttgcaaaaatggtcaaaatcatgaagccgggacgtgtggtgattgtgctcagtggacgctatgcggggcgtaaggctgtcgtcgttaagagctatgacgagggctcatcagagaggccgtatggacatgcattgattgcgggaatcgacaagtatcctctgaaagtgaccaagaaaatggggaagaagcaagtggagaagcgaattcgcatcaaaccattcctcaaggtcaccagcctccagcatttgttgccaactcgttgcatattcgaggccgatttggacaagagtttggtgaacaaagagtggatcaaagagccgcgaaagaagaagaatgccatcattagcgtcaaaaaagaatttgagactagctacaaagccggaaagagcaaatggttattcacaaaacttcgtttctgagcggttacagaggggaaacaaagcgatttccttatttgcattgttgttgtttttgtgttatgagtaaagatttaaagacaaaaaaaa

SEQ ID NO: 95233 - DNA, 693 bp, Heterodera glycines
  SCN-specific regions: Sequence locations=1-410,432-638,689-693
ccatttaaggtgcattaattatgtcacaatcaccgcaaatggcgactttcagcggtctgacagcaaatatttaccacgaaaaacagaagaggcaactttgcttgctccacacactgaacaaccttttccaacgtgaagaatttgtacgggatgaattggacgaaatttgtgaaagactcgacgacagcaaatggttcaacacccaccgttcatggcttggacttggcaattatgatgcaaacattttactctgcgcgttaaaaacacgtggactggtcggacgatggttcgacaaacgaatgccagcttcttggatccggaaggaagtgatagtcgcatacatcttcaacatcccatccaccgggttcatgccattgccatttcttaacggacgccattggttcaccatcaaacaatttgggcccacttattacaatttggactccaaattggccgccccaacactgatcagcacagccaatggcattgtccactacatcaactcacttttggcccaaggcaacgaactgttgctggttgtccgccccgaaaatgaggccaattgtttgctggccaatggcgaagcagaacatggaggaggagaatgattaaatgataaatgaatgcctcaacaaatgtgtcttaaatatttaaatttctttccacatttcaagtcatatatatttatatttc

SEQ ID NO: 95234 - DNA, 676 bp, Heterodera glycines
  SCN-specific regions: Sequence locations=1-676
ctagtcttttaattacgggttctccaaaatggtaaaaacattgtggattgtcagacacgccgaaagagaagacaacataaactcgaattggcaaaaaaatgcgaaccctcaaaaattgaaatcggataacagtccattatcgtcgagaggcataaaacaggccacagaattggcagaaaggttttcgaatgtccaaatcgatcatatttttgcgtctccttttgagcggactgtgcaaacagcgacttttcttatctcacagaggaaaattccgatcaaagttgagcccggacttgcagaggctctttacctttgcgaaagtccgcctggctttgaggaatcggctgaactccgtaggcggtttcctctcgtcgactccgaatatcgctcaatttacgaaaaaccaatgcccagggaaggctttggagatgagtcatgcattcaacgaatacgccaaactcttgaagagattctgaggagatacaacgaagcaacctccatcgtttttgtctcgcatggctcgcccattggtgctcttcacgaagtgttggtcggtgattggaattatgtcggccaagcgacagtcagcaaattcgtcgagacgggggatggcaccggaaaatttagacaggaatttactagcgattcctcgcatttgtcggacaaagaaaatttg

SEQ ID NO: 95235 - DNA, 659 bp, Heterodera glycines
  SCN-specific regions: Sequence locations=1-626,650-659
ccaagtttgagatcagctactgctgcgcttcctttcatcaaaagcatttgccgtaactccgttcgcacaatgcgcgtggttccaattccggccaacaccgacaattacatgtatttgatcatcgacgatgacgacaaataccaaaaaggacatcgaccggcggcactcgttgacccggtgaatgtggaaaagtgttttgaagttgtcaaaacggagggcacactgttggaggcggccctggtgacccaccaccattgggaccacgcgggtggcacctaccaattggcaattaagtcacggagcgggttcagcgacctcttgatgaagcagccgctgtgcattatcagcggtgacgcggagcgagtggaacgcactgagaaagtgatagcggacggggagagcgtgcagctgggcaccaatttgagcgttacggcgatgtacacgccgtgccacaccagcacacacgtctgctattatgtggttgaccagcgcacaaatgaacgtgccgtgttcaccggtgacacgctgttcatcggcggttgtggtcgctttttttgagggcaccgccgagcaaatgcatcacgcgctcaacgaacggccttgccgctttgcccgacgaaacgttggtttactgcggtcacgagtacacggtggcgaat

SEQ ID NO: 95236 - DNA, 444 bp, Heterodera glycines
  SCN-specific regions: Sequence locations=1-103,125-197,221-299,324-444
caagtttgagacaaaaatatttctgatttgctgttacaatggtgaatgttccgaaggcacgtcgaaccttttgtccaggaaagaaatgccgtaaacacacgaaccacaaggtcacccaatacaaaaagggcaaggagtccacgtttgcgcaaggaagacgtcgttatgaccgaaaacagaaaggttatggtggacagacgaagccaattttccgcaaaaaagctaagacgacgaagaaaattgtcctccgcatggaatgtgttgagtgcaaacatcgtgttcaaaaagcgatcaagcgttgcaagcacttcgagttgggaggtcagaagaagtcaagaggtcaggtgatccaattctgagtttgtgatctcacctcttttgttgtttggtcgctgttgataaaccgataaatttttttgttgaaaaacaaaaaagaaacaaaaa

SEQ ID NO: 95237 - DNA, 853 bp, Heterodera glycines
  SCN-specific regions: Sequence locations=1-54,76-288,310-420,444 -555,579-853
gagcattttttctatttttataaaatgcttccgccgggcgaatggcgcatgaccgacctgttgctggacccggccatccgcacatgggtgttcgtgcccattgtgttaatcacttttttggttggcattgtccggcactacgtgttcctgttgctggtcaccaagaagagtgctgacctgcagtcagtgcgggacagccattggctgctgaaggcgcgtctgttgcgtgagaatgggcgctttttgcccgccgattcgtttgcccagcggcgctggctgctgtgtgacgagcagcatggccagctggtcaagcggcaggacaaacagaacacgcagccgaacccgatgctggacccgtccacgatgacggagatggtcaagggcaacatgctgaacatggtgcccatgctggtcatcggcggttggatcaactggaccttttccggcttcgtcaccacgcgggtgcccttcccgttgacacttcgcttcaaaccgatgcttcagcggggcgtcgatttgcagtctttggacgcttcatgggtttcctccgcttcatggtacttcctgaacgtgttcggcctccgctcggtgtacgcgctggtgttgggcggcgagaatgcggccgagatgatggacgagcaggcaatgctcggcatggcacagccacagatggtcgcgccgggccaagacccgaagggggcgttcaaatccgaatgggaggcgctgcagctgtacacgcacacgttcaacccgagatagaaaaacggaaagaaaaccgtcgataaaaatacacaatttttttttgtcatttcgctaaacatattcattcgtaaagtaaactttagcgattttt

SEQ ID NO: 95238 - DNA, 541 bp, Heterodera glycines
  SCN-specific regions: Sequence locations=1-29,52-541
ttttgtatcaaatcgtttaaaatcaaaacaaatgcctcaaaacgagcatattgaactacacagaaaacgccatgggcgaaaattggatcacgaagagcgcacgcgaaagaaactggccagagctgttcatgaccgttcaaaagtggccaagaaattgcggaaagggaaggcgaagttgtaccacaagaagagatatgcggagaaggtccaaatgcgaaaattgatcaaacaacacgaggagaagaagcaaaaggggacgacggacactcaaacggagggagcagtccccgcctatttgttggaccggcaaaaggaaacggcggggaaggcactttcgactgccatcaaacagaaacggaaggaaaaagcggcaaagtaccaagtgcctttgccaaaagtgagggcggtcagcgacgcggaggccttcaaagttgtcaatacgggaaaaactagacgaaaagggtggaaaaggatggtcaccaaagtcactttcgtcggcgaaacattcacacggaaaccggcaaaattcgaacgattcatt

SEQ ID NO: 95239 - DNA, 504 bp, Heterodera glycines
  SCN-specific regions: Sequence locations=1-229,251-451,475-504
cccgattgtccatcttctttctgtgcattatcacattccgactaccatccaaagcatttcgtggcccgtcgcactcagtggacgcgatttgatctcaattgctaagacaggctcaggcaaaacccttggatttattctacctgccatcgttcacactatggcccagcctccacgtcgaccaaatgatgggcctggagtgcttgtgctgcttcctactcgcgaattggctgtgcaggtggagcaagtggcacgagaatactgcaagctgatgaaattggatgtgacttgttgttacggtggagcaccgaaagcaggacaggcaaacgatttgcgaagaggcgtcgatatttgcgttgccactccggggcgcattctcgactttatggaggccaataccaccaatatgcgtcgctgcacttttttggttttggacgaagctgaccgtatgctcgatatgggatttgaacctcaaattcgcaagattgttggccaaattcggccgga

SEQ ID NO: 95240 - DNA, 481 bp, Heterodera glycines
  SCN-specific regions: Sequence locations=1-137,159-162,184-204,226-481
atttacaaattaaacgacaatcaactaaactcctcaattagcaaatccttaattaacttcccaaatgactcatcgccaacaaaacgaaggagggggtggagcagtgacgccgaacgcaacaacgacgggccatttgcaggagcaaatggccaacgccatggaacgcgtgggggaggcggcgcacaacgtgggccaacgggtgaccgatttcttccagggggacccttttgggacgctaatcggacgcaaaatcgaattggccaccgatgctacgaaaatggccactgaaaattggggactgaacatggaaatatgcgacttcatcaacggcaccaacgacggaccacgagacgccgttagagcgatcaaaaagcgactgcaaacgcaaatgggaaaaaacaacgcaattgtcatgtacactttgactgtgttggaaacgtgcgtaaaaaattgcgaccaccgttttgctgtgctcgtcaca

SEQ ID NO: 95241 - DNA, 488 bp, Heterodera glycines
  SCN-specific regions: Sequence locations=1-237,259-488
gaagaacatcatgttatgtttggtgccaaaccaaaccaacattggttggttagagttgcacttttggacgccgtcacatttcttgcacccgccattcatgacgacgacttggaaagatttgtccaaattgacattgacgatgtgttcattggtgccattggcagtcgaatggttgcggatgacgtggactatttgtccattttgcagggcaaactgcgcgaacacattgccgactttcatttcacgcttggcttttctggcaatttttttcgtcatggtgacccggcagaaattcaaggagacgaaatccttgcaatgcgaacaaattccactgattcccgcacatgtggcgtcacaaccatccgccagaattttctgcggattatctgcttgcattgatgacacaaaatcgtgtgtttgctgagaatgttggcatttctgccaatctgagctatgccgtttcgccacaacattctggggtttatccg

SEQ ID NO: 95242 - DNA, 495 bp, Heterodera glycines
  SCN-specific regions: Sequence locations=1-389,411-466,488-495
cacacattccgacgcaattacttcattattttgggattagtacccaacgcttttcttttgcagcttttgaacaatgagcggtggcatttatggcggagatgacgtcggtgcattggtgttcgaccccggctcgcacagtttccgcgtcggttacggtggcgaggagttcccccgctttgacattccggcacgggtcggcgtctgtcctcggccttccgccggcactgacgcgtcccaaaccgctgacgccacaattgaagaggtggcctcaggacggggggccaacgccagcaacaaattcgaccattacattggcacaacaaagctgaatgtgccccgggccggcatggaggtgaagccgtacatgcgggagggcatggtggaggactgggaactttttgagaagatgctcgactacatctacgggccgtgtcttggagcagaaagccgtgagcatggcgtactgttcacagagccaccatggaacccaaagga

SEQ ID NO: 95243 - DNA, 593 bp, Heterodera glycines
  SCN-specific regions: Sequence locations=1-52,74-593
tccgcccaatttgcgatgccaaaacaggcaactatcagcctcagcagtgtcgggatgagaaacattgcttctgcgttaattacctaactggagtacggcaaaacaaaaaggaagtgccaaccaacgaaattttgcattgtgaaggcggccaagtcgatttttccatcgatgatagccatatcattaaatcggagaaaggtgagggagaaaaaggcgacgaggagctgatcccgatcggatcgccggtctgcaagaagccgagagatgcgggccacagatgccatggccgagctggcggaccaatcgcggccaaaaaccttaagtggtattttgacacggagacttttgaatgtttggcattttcgtacaacggctgtggcggcaacggaaatcatttcgactcgcccgcagattgttgggacaaatgcaaacttgtggacctcgccggttgtgcggggatgcgcctgccggcaacggataagcagggtcacacaatcatttgcgccggggctggctacccatcgcctaccgcggcatgtccgtccggctatcggtgcacaatgttggcgcacatgggagtttgctgtcattca

SEQ ID NO: 95244 - DNA, 294 bp, Heterodera glycines
  SCN-specific regions: Sequence locations=1-255,280-294
ttgctggccgaatttcagaacacccgtttcattgcggcagcgattttgggggcaacgaatgccgaaaaaacaaaggacggcgggcgggagaaggaaggagtggtcagttttgagaggtccaagcacagtgttccgcgcaacatgtggtacaaaaagttggccaaacgtacaaaagccaaacaccaacaataagaaataattgattattgcgattcaatgggagtgctgttgcgacttttaaattgtcattttgtactgttgtttttgttgtttgttcataaaatgccaagaaag

SEQ ID NO: 95245 - DNA, 571 bp, Heterodera glycines
  SCN-specific regions: Sequence locations=1-308,330-354,377-471,498 -525,547-571
aaatgaaccaacagaaaagtgcgaagcgggcgacgcgcggacaacgccaaatttatgaagaaaacaagcagactttgttatgctatgtgctggccagcatttgctcttccgttttggtgttctctctcaattactttctttttctgccgcaaaagggcgcgtggattggactcgcgttaagctctgccagtcaagcattttctgtgattcttatgtctatgatgatgaaaaccgtgcggaatgagcgtaatcagttggtcgatgctgggttggacctcaacgatccgaatgcgtttggagagtactgcaaagacatcgtcattctgagtgtgtctgcacagcttctgagtctgatttggaccggcttcttcttcgtcctgctgtccattccctttttcacactttacaaactttggacgaacattctcggcccttggttcttcagaccgactcttgacgacgatgagaaagaggacaagaagaagcagaaaaaacccaaatttgtacatgtgagacgatgaccaattgctgttgttgtttttgtttcataaactcccttataaacaccgag

SEQ ID NO: 95246 - DNA, 477 bp, Heterodera glycines
  SCN-specific regions: Sequence locations=1-477
attagttatatacattatatttaaacggctcttcaattatgacgtcaacctcgccacctttgaccaacggtgtcgccaatcatttatccgagaacggttcagcgacaagccctgaactgatcgtgttcggcagcattgtgcaagatttggttagctatgtggaccgcttcccgaagccgggcgaatccgttcgtggccacacattcaaaacattttgcggcggcaaaggtgcaaatcaggcagtgatggcctcacggatgggcactcgtgtgacaatggtcggcatggtcggcgacgatttgtttgcggccgaaaatgtgcgatcaattgcccaaaatggtgttgatgtgtcgctggtgaagcaattgtcgggccaaacaacgggcaccgccacaattaccgtatccggagacggtgagaattgtattgtggttacattgggcgccaacacttcattgggcgctgaatgcgcacttg

SEQ ID NO: 95247 - DNA, 627 bp, Heterodera glycines
  SCN-specific regions: Sequence locations=1-627
cttcaaaaatagctgaatacgaaaatgacaaaaccgcaacaggttcttgttcttgatccgaataacgaactcagcttcaagggaccgtttactgagtatgtgaatgccaatctcacactgtcaaatccctcgcgaaaggacgtttatttcaaggtgaaaacgactgcacctaagttttattgtgtccgtcctaactctggtgttatcaaggcgaatgataaaacccaaatcaacgttatgctgcagccggttgaatcgcctgagactctcgagagtgagcggagccggcacaaatttatgattcagactgcatttgcgcctgatgacgagcagcttcctgtggaccaattctggaaaactgttgacccaacattagtcatggattcaaagctccgagtggtgttccagcgaccttttggatttggcgatgaaaacaatcgggacgaaaccaatgcgactggtccgtttttcaatttcaacaaaacgggcgaaccgaaaaacgaacagccaacgcaaactccaaaatcgaccgaagcaaattctggcgatattcaacttgctttgcaaagggaagttgaacttcggatgatgtatcaggacgagaacaaaaacctcgaaaaggagaat

SEQ ID NO: 95248 - DNA, 596 bp, Heterodera glycines
  SCN-specific regions: Sequence locations=1-391,424-534,556-596
ccctcaaataaatgggccttttccgtgtgctcatctacggcattattctcggcgtttacgccagtgcgttgttttacgatgtccgctttatgccgcggctgggcgtcgtctggtgggtggagaagctggtgatgttgtccatgctgaatttgtctctccaatcgttttacgctttgctttgttttgtctgtgcgctgttcgattggaacgaagaatttgtgcacggcgaacagcacaaaaaggtgaaggcgacccacgtgcccagctattggcggcgcagtcggctccaccgcatttgcgactttgtgtacgccaccgccgcatttcccgtcggaatggcaagttctctgatgttttgggctctttatgtggccgaccctgagttggtgatgcccgcctgggtggccaagctggtgcctgattggcttaatcacgtgtctcacacggcccccgtcgcttttgtattggtggacactttgctgacttgtcaccatgcgcccgatcggaagattggctccactgttgtcgtcgcacttttccttttctacgttggaataattatatccgtccgtctgatcagcggtcattggctgtac

SEQ ID NO: 95249 - DNA, 489 bp, Heterodera glycines
  SCN-specific regions: Sequence locations=1-44,67-364,387-489
ccctttcgtttcgtcctctctatcagaattggtgctgctttgcctcattctttttgttccttttctgatgcttttccatcgtctggtgatcgaattctcattcgaagagagaatttcaaccgaaatagaccaaggcttttgaaaaggaatgaaaagagtcttttggctgagaatcggcagggaattcccacggcgacggactgtgcaacactcgtgctgttctgtcagttgggctcaccatccgccgaagaaagttgggttctcttcacacaaagggcgaaaaggatgaagcatcatgccaacgaaatttcgtttcccggaggacggatcgagcagggagaaagtgtagagactgcggcgatcagagaggcggaagaggagatcggactggaccggaacgacgtggaactgtggggcactcttcgtccgctgttcttcggagaggcgggcgtcgtcactcccgtggtggcaaccattgggcaaaacgtg

SEQ ID NO: 95250 - DNA, 463 bp, Heterodera glycines
  SCN-specific regions: Sequence locations=1-361,383-397,421-463
agttgctccgtccgccatgcgacaacaacacggcccgggccaaaaacgtgtgtcacgcgttccaatcataattatccctgccggtgcaagttcactcatcacaatttacaatgcgcaggaaattttgcaggatttgcgttacgtaagcacagaagaaaaaaagcaatttagcagtaaacgagagaatgagctgttactgcaaatcccaaagaatggcgtcactgttccgtaccgagtcgtagacaatccaacacgattgaaggacgaggaatgggaccgagtggtcgcagtgtttgtgcagggtccggcctggcaatttaaaaattggaaatggaatggcaatccggttgagatatttgccaacattgctgcgtttcacttgcaattcgacgaacttccaaccgatccaaatgtgaaaaagtggagtgtgcatgtgttgaaattgtcctgtacgaaaaggcat

SEQ ID NO: 95251 - DNA, 555 bp, Heterodera glycines
  SCN-specific regions: Sequence locations=1-170,197-472,530-555
gtcgctcatttgtcgccaaatcatgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgacgatattaagccggacgaggatccggcaaaaaaagggcaacggaacggacacgggcgacgacggcaaaaaaacggacgaagcgggcggagcatttggcgcggggtccatttttgttgccattcttttcggcatggctttgatgttcggactgatcaaaatgtatgtccattgggagaagcggcgcgagtcgggacccaccgaactatcagatgtattgaaaaaacatggaaagcattgggccaaaacaaacaaagatttccttatttcatttgttgttgttttttgcatcatttttatcacttctcattaaaatttctcttacc

SEQ ID NO: 95252 - DNA, 672 bp, Heterodera glycines
  SCN-specific regions: Sequence locations=1-14,37-174,196-672
ctcacaatggcgtcaaaaattaaaccattaatttgtccgtcgatattaaatactgatctgtcagatttggctaatgagtgtcgaaaacttatggccgctggtgcggattatttgcatttggatattatggacggccatttcgtgccgaatttgacgttcggacatccgctcattgaatgtctgaggaataaattgggaaatgacgcgaagttggacgtgcacatgatggtgtccaacccgtccaaatggctcgaccctctgcacaaagcaggcatcgatcaattcactttccattgggaggcactcggagaggacgaagcggtggacacactcatcgaccgagtcaaatccaagggaatacgatgtggactgtccatcaaaccaatgacgccgctggacaaactgatgaagttttgcgaaaagatcgacacagcactcataatgacggtcgaaccgggattcggcggacaaaagtttatgcaggaccaaatggaaaaggtgcgccaactgcgaaaagcgtacccaaacttggacatccaagtggacggcggggtcggactggacaacatcgaacactgtgcgaacgcaggggccaatatgatcgtttctgggactggaatcgttcggtcggctgacccgcgtcagacaatgccaaagatgaaggaaactgtc

SEQ ID NO: 95253 - DNA, 577 bp, Heterodera glycines
  SCN-specific regions: Sequence locations=1-577
cttaaaaatgcacaagcagaaagtaatatgaaactaccaatctcaagcaacaaattcaacaagtacgaactctacaaatttcgacatgcgactatggccatcgttgaaaatatcggattttctacttctaacagctccgcagtcagttccttgtcttttctgcttagaacttattttgagcaattgtgtcgcgactcgcttaactcggccattaattctggtcgtgcagaagttggcttggaagatgtttcttatgttttcggagccaatggaattaatataactgaacttcatgattatatccagcaagttcaaccatatgcggctgatgagcatcctttgtttcccgtcactgaaccattaaatgtgccgccgccttcctctgaaattgcggacacatccgagcaaaaaaatggcgagagagaatcagcagggaatgacggggctgaagttgacgaggaagggaatagggagcaaaacaacaaacactccttgaactcattcaactcgaggtcggtcatttctatgatttttaagatgatcaatatatttcaaaaggtccaatgttcgaaatgca

SEQ ID NO: 95254 - DNA, 240 bp, Heterodera glycines
  SCN-specific regions: Sequence locations=1-240
gtccaattaaggcatccgtaatttgcaattccgtatttttaatcgtttttttcatttaaatgcgcaatttacgccttttcttaaccctttagaggagcaagcgctgatgtaccaatatgccgacacgttggctgtccgtgcctttcttatgatggccgatctgtccttcgttttggagcagaggccaaacgcggaatttatgtccccgacgggagaagtgccctttctgcgtcttcagaa

SEQ ID NO: 95255 - DNA, 752 bp, Heterodera glycines
  misc_feature (744)..(744): n is a, c, g, or t
  SCN-specific regions: Sequence locations=1-314,338-752
gcaatatttagccagaaatgttcaagaaattcgattcggcagaggatgtggtcggttcccagcagctcaaaggatctgtgcagaagtcaatccgggccaagctggttgagcagtatccgagcattgagccgtacatggacgccattctgccgaagaaggagaacttcaagttggtcaagtgcaaggaccacctggagctgatcgcggacgccaacggcactgtccacttcgttaaaagccgtgatttggcaaattatttcccaactctgagactgctgcacaaatacccgttcatgcttccacaccaacaggtagacaaaggtgccatcaaatttgtgttaaacggttcgcatataatgtgccctgggctgaccagcgcgggtggccgacttttggacgattgcaacgaaggggcattggttgccattatggcggaaggaaagcagcacgcaatgggaattggacaaatgaagctttcgtcggcgaatgtgcggtcacaaaatgttggcattgccattgacaatgtccacttcatgaacgacgggctgtggcgattaaccactgttcaatgagcacagaacaatttttttttaaattattgtttaattgactctataattaatcgctttttcaattttaaattgttgatgtatgaggaatcatattttttcgtgctttatttgcaaaatgaaatacacaaaattttcattcgaatgtttacattaataaatgtgaggtgattanaaaaaaaa

SEQ ID NO: 95256 - DNA, 500 bp, Heterodera glycines
  SCN-specific regions: Sequence locations=1-181,203-500
gaataatgtcttctcgaagaaatgaatatctcgatgcgaaggttttaggtttttctacaataatttttcgaaaaacagttaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagatgctgaagatgctgtgcgtgcactcgacggaacgaggatttgtggcgtcaaggcccgcgtagagctttctcatgggagcggaagagggggcggacgcggttttcgaggcggagggggacgttatgacgaccgttatggtcgtgatcgttatgaccgtgatcgcgaccgtcgttatcgttcaaggtcgcgttctcgcactcctcgccgttcccgaagccgctctcctccgcttcgtgagcgcagccgatctccgagctacagccgtcgttctcgctct

SEQ ID NO: 95257 - DNA, 795 bp, Heterodera glycines
  SCN-specific regions: Sequence locations=1-795
ttgagctgctataagagccatcccctttgattgaaagccgcctttacccatcgaatgctacacccttcaacccattgcgcgcgcaaaatctcacgcaagcagtacagcaacgcgccggacggagcggaagagtgtggcggcaacgcggacgcgcttttgcgcaaagcgagccgaaagctgtcacaactaagcgagctgggcgacttccagcagcgctgcaataccgccaccagtcgccgtcgctgttcatcgacggaatccttgctggcggcgctgaatggtcacggctctgtggtgtccgcaggcgccgactcgtccaccgccagccatcgttcatctacggacgacctgaccgtgctcgactgctccaaccttagccttggtcagttgcccattgaattgctcactgaacactctgaggaaattgagcatttgattctggacgagaacgagcttgacgagcaggccttggaggacatccctcgcctggacaaactggagacgctgagtttgaatgggaacaagatcaagaacatcggtgtgttcctgcagtatctgaagcgcaagtgcccgaacctgaagttcttgagtctgatcggaaatccgggctggccccacccaattctgaacaacaacttgcaactctaccgcacttatgctctttccgccgtccgtcttttcccctccttgcaatttcttgacaccgcccgtgtctcatcgccagcatccatcgccattttgggcgaacagtgccaacagcgccaccaccagcagccaaatgccggcaacaaaaag

SEQ ID NO: 95258 - DNA, 761 bp, Heterodera glycines
  SCN-specific regions: Sequence locations=1-167,189-242,265-761
ctgtgatgagtgttggcgtactttttcgtcttacaattaggccaagcccggcggggcttcgactgacttgttttttggccaccaattaccatcacaatcttcatcagttcaacaacaactgcttggtgaggaggcatttctcttgtacatcgcggcttctgttggccaccaccaccgacaacaaaggcgatgccgcatcggcaaaacagcaacagttcgccaaaatagaattgaagccgaaaacggggagcgacggtgctgtggcggagccggaacggacatatttggaggaaatgctcattgaacgggatgcggagccgaagacggcgggccaaaaagtaaaacgtgcggtggagacaaccttctacatttcgtttggcctcatctcctgcgccgttctgggcgtgatgacctacctcgtgttcaaggagttcttcgccttcaacacgccccagggcgtttaccgcgatgcggtgaaaagggtgaaggcggacgagcgctgtcgggaaatgttcggcaagcgaatcatgacatttggcgaagagtcgggccggggacggcgacggcacattctccacaataaatatgtcaaggacgggcaggagcggttgagcgtgatgttccatgttaagggtgacgcgggcattgggaaaacgtacgcggagatttacaagggcgaggacggcaaatgggactatcgctttgtactggtagagagtgacgggtttccgaagaaagccattttcttaattgacaacagg

SEQ ID NO: 95259 - DNA, 476 bp, Heterodera glycines
  SCN-specific regions: Sequence locations=1-476
ctccacgccaattttgaagtcggtgaggagcagcggcggaggatcgccatgttcaaccaatttgagcgttgctgagggctcaaaaaacggtggaggcagcagcgggagcgcaaacgcacaacaggggacaaatggaagcggaaacaaccttttcattgctttgttcgactacaatgcacgaacggatgacgacctgaactttaagaagggggaagcgttggaaattctgaacgatttccaaggcgattggtggtacgcgaagagtttgatcagtggcaagtgcggctttatcccgtccaattacgtcgcccgcgagtcttccatcgatgcacaaccatggtatttcggcaaattgcgcagaatcgatgcggaaaagttgctgatgttgggcgtcaatgagcacggggcgttcctcgtccgcgactcggagtcgcgtcacaacgaattttcactgtccgtcagggacggtgaagtgg

SEQ ID NO: 95260 - DNA, 673 bp, Heterodera glycines
  SCN-specific regions: Sequence locations=1-673
ccaagtttgagcaatgtttttgggagctcgttcagctcttttcattgatcgtaaagatgccggccaaaaattggctaaggctttagcccatattttgcctcaacgtgataacattgtggttttggcacttccgcgtggcggagttccagtggcttgtgaagtcgctgatgcctttcaggctcctctcgatcttctgatggtaagaaagataggtgctcctggtcatgaagaatatggaattggtgctgttgtggaaggaaatccgcccgagctcgttatgaatgaggaggctgtcagaattacacgaccatctgaagcatatgtgcaacagcaaatgcagaagcaactcaaagaaatggagagacagcgaaaaacatatttgggcgacaaaccgccggtgtcgctggaagggcgaattgccattgtcgtggacgacggaattgcaacgggtggcactgctcgagttgcgctcaaagctttgcgtcagaaaaatgttagtcgtgcaattttggcctctccgatggcgccttccgacactttggccgaattacgcgctgaaggaaatgaagtgctctgtttggagacaccgccgaatttcagtgcagttggactccattaccaacgcttcgatcaaaccagcgacgaagaggtcatccgctgcatggaaaaagca

SEQ ID NO: 95261 - DNA, 525 bp, Heterodera glycines
  SCN-specific regions: Sequence locations=1-525
atcaatttgtataactcacttcaacagaacaaaaatgggaaaagttagcaaaacaaaatccgcaaagaaatccgccggaggcagcggaaataaaacggtgatttgggcggtggaagacattgtggacggaccgaaatacgaaacaattgggacgaagagacagaaactctacaaagtgcgatggggagagacgtacgaattggccagcaacattcccccgggactcatcgatttgtacgaaaagcgggaaaagaagcaaatcaaaatcctcggcccattggtcaccagcgaatcttcgaccagcgaagggtcgctaagtccgaaggagagaattccgctccatcagacgaaattcgccattgaaatcggtggcaaagtgaagtgcctcagttacagcgaagtgcgcaacacttacaaagaggaattgttgcagtatttcgaggaaagggccaaaatcgacgaagagtaaagcggaaggaaaagccacgcaaaagcattcacaaataaattagcatcgctcaactc

SEQ ID NO: 95262 - DNA, 592 bp, Heterodera glycines
  SCN-specific regions: Sequence locations=1-199,222-362,385-553,575-592
gtccaattaagccgttttactgacattggcaacaagaatggaccgcttggagttcagggatttcccttcctctggtggcggtgcttcgtccgaatttttcaattccgactccgtcaataataaacctcctcctgacccggcctttccttctggcaatcttttggatgtttcttcgtccagcgaatcgcaaagggatgactcctcaaaagtgcattttctttctctgagtttttaccgtcgcttctttgatatagacgaagaacaggtttttgcccgtttgttgaacagtgcgatgcctcgccggacgggcaatttcatctccgattttgtgcagccgaaccccgatttgaggggaccattttgggttagtgtttcgctcgtattttctattgcgattgttggcaatctgtcgcgttttttgcataccttcggctccgacgaattgtttatcagcgacttcagctttgtcactggtgccacttccctcgtgttcgggtacgtgctgacaatgccttctttggtctatgcctttctgtggtaccatcgtccgctcaatctccaatattcctttcttcaatttgctgtgtgcctt

SEQ ID NO: 95263 - DNA, 575 bp, Heterodera glycines
  SCN-specific regions: Sequence locations=1-575
ggccattggccgagtacagaaaggcactcgaagagttctcggcagagcgccagcagcagcgtgaatcaatcaccgattcgtcttccgacccgcctttggtggatgagtttttggagttcgtcgctttgtccggtcaatcgcatttgccatggactttgattcagcccgtcatcgtttggaagcttcaagctgtgatggacgccgtccacgtgaaggaagcggaggcgcaacgcgacgatttggccaaagaagcgctgataaacgacgccgagattaaggacacaaaagcatttattatggaaaaggcacgctcattcgacggcattcccttcacaatccaacgcctctgcgaattgctcacatcgcccggcaaacattaccacggcaccggcacttatttgcgtgcgttggagaagaacatcaacgtggttacaacggtgacggaaaacggaatgcgaataacgggcgctgatgaggaggaagaagcggaaaaggacgcgccaattcgagtggagagcaatttcattgtcagcgtcgatgaaatggacgaaccattggcattgaaattggagaga

SEQ ID NO: 95264 - DNA, 531 bp, Heterodera glycines
  SCN-specific regions: Sequence locations=1-5,28-397,420-507
gcaacaggaacaatgctttgtttaatgtgggaaacttttccatttttgtcttggacaacgccaattgctatgtttgacacgtgccttgttgcgatcgagtcgcattttgattttggatgaagcaacggcttcggtcgacatggaaactgatgcgcttgtccaggaaacaattcgtcgtgagttcagcgattacaccgttctgacaattgctcataggcttgagacaattcttgacagtgaccgtgtcatggtccttcaacaaggaaaagtggaggaattcgattctcccaaagatttgtcggatgatttgaactcggcattctctgccatgttagccggcgccaaacttaccaaatcccatgaaaacgcataatgactgacagaacttatcgtactgaaattttcaaaatttcccaaaagttcacatttgcataatttatcttctctcatctgattacttgcaacaatctctatttgttttctttgaattgttaattttttttaatagctttaaaaaataaaagttgaagc

SEQ ID NO: 95265 - DNA, 725 bp, Heterodera glycines
  SCN-specific regions: Sequence locations=1-45,82-181,203-265,287 -316,340-392,414-725
caaaaattttcaatttattattgctgagcaagtgggtatttaagcggggtttccttttgcaattaattaattgtaattaattgatcgtctccccaatggcttcttcactcaccattgaaaaacgctgcaaacttttcaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaatta

SEQ ID NO: 95266 - DNA, 528 bp, Heterodera glycines
  SCN-specific regions: Sequence locations=1-528
cattttctttctgtgctatgacatccgctgaaacggttaaagaagagccggggcgcgagtttatgtcggcagttaaaggacgacgtgagcaggacagaaaggaatgggcagcctattggaatattcgatggaaggaggtggaggtgcgatggatggaagtgcttatatcgacatggaatcttggtcaaatgtattgtcagcatgtggcgtggacaaccatgaaatgcgtgaaagataccaccaagttcgacttcgctcgcgtagccaaaatggaaagtacacgtacacacttacgacccgaacctttgaagacgctgatggcaagaaacttccccaaccggttgaaacacggaagcagttggacaggcgcgagtatcagagctacttgaaacttcgtgacagaagccgtcaatcaattcacaagaaacgtgtgtgttttgttctttttactatttcataagttctaatttttaattgtaaccgtttaatcgattttgtatcatattgaaaataaaacattttgtccac

SEQ ID NO: 95267 - DNA, 188 bp, Heterodera glycines; identical to SEQ ID NO: 80569
  SCN-specific regions: Sequence locations=1-188

SEQ ID NO: 95268 - DNA, 862 bp, Heterodera glycines
  SCN-specific regions: Sequence locations=1-587,609-799,821-862
atcacaacatttggtgcaacaatttgaccaaacgatgttaagcgaaaccgtgaaaatcggatttatcggagccgggaaaatggcacaggcattggcgagaggacttatcaattcggggcgttatccagcagagaatttgatggcgagttgtccaaagacagatgagtcactattggagcaatgcaaaaaattggggattggaacgacgagtgacaacacgagaatcgctcgagagaatgacgtcatcattttggcggtcaaaccgatgaatattagcaaagtgacgtccgaaattgcacccaatttccgaagggagcatttgctaatttcaattgccttagggattacacttcgctacatcgaacaacttttgccttcaaagtcccgcgttgttcgcgtgatgccgaatacccccgccgttgtcggggccggtgcctcggcttattccatgggctcggcgtgccaagatggcgactcaaaagtggtccaagatttgttctccaccgttggatattctgttgaggtgcccgaaattcacttggacccaatcaccggattaagcggcagcggaccatcttatggcttttcaatgatcgaagggttggcggacggaggcgtaaaaatgggccttccgcgagaattgtccttaaagttggccgccatgtctctctacggcgctgcgaaaatgtttctcgagacgggggagcacccgggcgtcctcaaagaggcggtgcagagcccgggtgggtcgaccagtgtcgagatccccgaattggagaagggcggcatgcgcgggttgctgatcaacgcggtggaggcggcctctgagcgctcccggcgaacgggcgaagcggcgctgccc

SEQ ID NO: 95269 - DNA, 657 bp, Heterodera glycines
  SCN-specific regions: Sequence locations=1-134,156-657
gataaactttgttttatgaaaataagccggtagactttttttgtaggccgggaatacctcaaaaaattgatttccgaacctgagtccttggaaaaccaaacaagaaccctgtttccgatcccgtaccactaacaacaatagatatgaattcagcagaaatggccagcccctccattgacattggtctgcttgtcctgcgcggaaatgaggaattaatacggcaaaaattgaaacgccttttggcaataacaatgccaaaagtacgtcaaaagttgtacgtgcatttggagcaaatggacgtcatccgggcacttcttcccgccatttacattaatgcggcatccattgcgccgaaaattgatctccgagtccttctgaaccgaacgaccagcgtcccagttgaccgggttttctatgacgaggtcaaagacccaagccatccgatttttccgatgcttcgcgaagagaatgggccaactttcaagatggattcttttgccacctcccatcacaaacttccggaaaagccgtatgaccatgtcgtgttgggcgggacgttcgaccgattgcacaacgggcacaaattgctgctctccgaggcggcaatgatggcacggacaagaatcacttgcggagtgacggacggaaaaatgaatg

SEQ ID NO: 95270 - DNA, 488 bp, Heterodera glycines
  SCN-specific regions: Sequence locations=1-248,270-329,359-455,479-488
ggcacaccttttagtcgcctttatcaattatcacaatggctcccaagggtaagaagatcgccgccgctcccttcaagacggccgccaaggctggcgccgtcaaggaccctcgtttcgagaaggccacccgcaacttcggcattggaaacgctgtccagcccaagcgcgacctcacccgctacaccaagtggcccgagtacgtgcgcctccagcgccagcgcgccatcctcaagcgccgcctgaaggttccccccgcgatcaaccagttctcgcgcgttgtcgacaagaacgttgcctcgcagctcttcaagctcctcaacaagatccgccccgagaccaagcaggagaagaagcagcgtctcaaggccattgccgaggccaaggccgccggcaagactgtcgaggctggcaagaagcccgttgttgtcaagtacggcatcaaccacgtgactgccctcattgaggccaagaaggccaagctcgttgtc

SEQ ID NO: 95271 - DNA, 1016 bp, Heterodera glycines
  SCN-specific regions: Sequence locations=1-500,522-913,970-1016
aattttaaatctattcttaaaatggtgaatttttttgttatttttgtgccgtttttgttgttgattgtgtcaaatcagttgaaagccgaagaaacggaagaaaatcgacataaaacggaggaaacatggaattatgaggagcccgaagaatggggaggaaagtgccaaaagggcgacagacaatcgccaattgacattcacaaacaatggttcattgattataaaattccggcaatttcatttgcaaattacgaaaaaaatggaactgtgacaatgaaaaacaacggtcatacggtggtcgtaagcggatttgacacttgggaaaagcagccgaacatcgccgacggaggctttgggagcaaatacatgttgagccaattccattttcattggtctcaaaacgagaacggaagtgaacatacggtggacggagaacattatgacgcggagcttcacttggtccatgtcaaagaagggctttctttgtcagaagctctcgctctttctgatggtgtcgctgtgttgggcattttcttcaaaagggcgtacgttggaagcgcacttttggcacttcaaaacggactaagccaagtgacgaataaagatgactccgtcacaattgaacattatgagcccaacgatcttttgcccaccgcttcggaggtgtttttccgctacaacggctctctgaccacgcccgactgtaacgaagcggtcatttggacagtctttgccgtgccgaagtccatcagcagagagcagatacaattgttacgagcaattaacgggcacgacggaaaaccgatcagttcaaatattcggccggtgcaaaagttcagcagaaaagtgcagaaattcggctacaacaaagtgtcgattttgccataaacatccactggcccttctaatggacttttaattaattaataattaattactaaatagattttatttaacaaaataatatttgtcattgcaatgtttttgttcaataaaagttacgataattaaaaaaa

SEQ ID NO: 95272 - DNA, 475 bp, Heterodera glycines
  SCN-specific regions: Sequence locations=1-77,100-475
attttctgatggattttgggccgcgcgacgacgagggaaagccgtgcaaggcgtgcttcagcttcgaggacatgctgcggatgatgggcaaaaagaagacagccgatcggcggaacggcgaagcgcaaaacaaaacggcgggggacgaaccgtcgacttcgagcagtccttcggcggataggaggaggacggactgtccgttggacaaagacgaattgggaaggtcgacttggaatttgatgcattcgatgtccgtttattacccaaaagagcccaccgaacagcaaaagacggcgatgggacaaaccatcgacggaatttcaaagacttatccgtgcgaccattgcgccgccgactttcgcgccgatctccgtgcccatccgccccttttgaattctcgcgacgcattcgcccgttggatgtgcgaggcgcacaaccgcgtcaatgtcaagctgggcaaagagcgcttcgactg

SEQ ID NO: 95273 - DNA, 216 bp, Heterodera glycines
  SCN-specific regions: Sequence locations=1-216
gtcaggtaaaaatggtgcaagtgataataggcaacaaataattttaaatagctgattttaggctttgtttcgaccggacaattatcttaaccggcttaacatggccgagaaaaatcgctcagaaatggtggacatcatggctgcaattgctttttgcaaccatatgtcaacggatgcctttctattggctgctcggttgtgcgatgtgtttatgac

SEQ ID NO: 95274 - DNA, 631 bp, Heterodera glycines
  SCN-specific regions: Sequence locations=1-389,411-459,481-631
agcagttgcccctcaggccatcagcagcagatgaacgcatgccaaaaactcaagcgtccgactccgccaatcacgacttactcatccgtcgggccggagagggactgtccgctgcgcaaagaccgcgctgaaccgaactggaccgagacggatgaggcgatttgcgacgatagcgacctcattggcattatgcagcgccagtatgtcaatttgccgcacagcacacaaaaggcggcacgtcgcacgaacgcagttcgccagcgaatggttgcggacgcgacggagtcgtccgactgctcctccgacgtcacaacacccaacggtgccattatggaggaattggcatcgctggcgacggagggcgacggcgcggcgatggcacgcgaaaatggcagtgagaaaagcacaagcagcagcagaacaggcgttgactctctgtccgccttgctcaatcggcgcgtctctcctcctcaccaccactctctgtcgccctccgccgctctttccgggggtgccgcgtccattcagttgcgccgtgccacatgcggtgaactggacaagtcaaagcgcggcgaacttggccacagcattttctatgtggatgagcccgactcgccgtccgcggatggac

SEQ ID NO: 95275 - DNA, 777 bp, Heterodera glycines
  SCN-specific regions: Sequence locations=1-61,84-196,218-687,709-777
ccaatacactcgtgaagagttgcaactctttttggagacaatgcgtcgcttcaagtccagcggcctttacaggcgtttcggaatgatccatcgccggtcgggcgtccattcggggcccgccttcttagtatggcaccgcgaatttttgaaacggctggaactcgtctttcgcgctttgcatccggagaattcggagcccattttgggcctgccctattgggactcgactttggaccacgacttaccatcgcccgaggattcggttatgttcagcgaatatttactcggagaaccggacgaagcgggctttgtgaccaacggattatttgccaattggacgacgatggatggtcggcactccttccaacgaatgttcggtgaccaggacgacggcgaattcattaacgacgcacgcattgattgggtgatgacgcaagacatcgtggaaagcgtgatggcattcactctgccgacacagaattgcatcaattacgaagtggacgaccgctttttggagtattcgcatgattatgtgcactatttcatcagtggcgacatgcaggagaggttcagctccagcaacgaccccatcttcttcatgcaccacggctttatcgactcaatttgggagcattggaggcaaaacaaacagagtcggctccaacgcgagacggactttccgcgcaatgacgccgcgtgtgcgccgcggtggcacttctcagaagagttcatgccgatgctgcagccgttgtggaacatcgacgtgctctccaacaa

SEQ ID NO: 95276 - DNA, 987 bp, Heterodera glycines
  SCN-specific regions: Sequence locations=1-3,25-305,327-745,841 -925,957-987
aattgtcattcgttttcatttctctacattcggtggtattcctcgattcgtctttcacacgcattttaagcatcatcaaatccaattcaaccgcagcttacctcaaacaatgtcctcctcttctggtcacccgcaaacatcaagcgcatccgcaatacgagcattgcaaatggagttgcgctcattgcaatcacaaccattggagggtttcactgtcacctgtgatgatgacaacatgttcaagtggacagtcggcatttttggaccacccggcacattgtaccagggtggctacttcaaagcacatttgaaattcccaacaaattacccatactcacctccaacaatgcgtttcattcatccggtgtggcatccaaatgtctacgagaatggcgacatttgcataagcatattgcacccaccggttgatgacccgcacagtggcgagatgccttccgagcgatggaatccaacacaaagtgtgcgcacagtgttgctgtctgtgatttcgctgctcaacgagccaaacacgtcatctccggccaacgtggacgcatcggtgatgtaccggaaatacaaagaccacggggaaccagagtatgcgactattatcaggaaacaggtggaaaagtccaaagaggaggccaaaaaggacggcatcaaagtgccggaaaccatcgacgaatacgtggtgaaagcgaagccgagagtgcagggcaacgagtccaacgatgtgattgagctggacgaggattactacgactacgaggacgacgacaccgatgaagacgctgaatacggcggcgaagaagagcaggacagtggccaaggagatgacgaaagttgagcggaactactaacaaatgtgtctaaacgttttctgtgtaaaaaaggacaatcaaccaacgatttgctctgctgtttgacataaacaattaattcaacatgcaaaaatgttttccatgtttttttttgaggataaaacat

SEQ ID NO: 95277 - DNA, 456 bp, Heterodera glycines
  SCN-specific regions: Sequence locations=1-11,38-456
gtccaattaagattcattttgcttttttgtttcttcctacatatattccatgtaatgtgtttctctactaaaaaaaaaatgacaagttttctcgcaaaaacgaagacaatgtttgccaattctttcgattgtttttctgcgtccgaaattggcgcgtttgaggcggagcattgctgtgcatgcggcacaacgcatctttgggccgacaaattttggaaggttgcatgttccgtggactctgaaaagttggcatttcgcggacaggcgacgacagccatcggcgccgcctattggcatccgatgttctttacggaaactcgtcgttcacgcagtgcggtccaagcacatttaaaatgtgcctcttgcgggaaggaagtaaacaaagtttacgaagggacggacgacgccggcggggggtcgcgcagcgcttttggtcattacaccgacacggaaaag

SEQ ID NO: 95278 - DNA, 805 bp, Heterodera glycines
  SCN-specific regions: Sequence locations=1-49,71-721,743-805
agtccttaagatacctgaacaagttacctgaaactttgtaaacataaattaatatttttgtaaaagaagaggattgaaacctatttattgcgtcatggcgaagtggggagaaggggaccctcgttggattgtcgaagagaggccggatgccacaaatgtgaacaattggcattgggttgagaagaatgccactccttggtctcgggaaaggcttcgcgtgcttttgttgggtcaaaccttggaaaaagggccggtgcgaattgaattttccgacttcaaaaaattggagggcgaagcgacggcgaacaatcggaaggcgaaactgattttcttcttcgagtggtccatcgacgtcaatttcattgcaactgtttctggttccgaaactgagtacaaaggaagtgtggaaattctgaatttgagcgatgagaacgaggcgcacgaaattgagatttccgtgcacattgaaacggcgggcccacatgaaaacgaaattcggcacattctctccaccgatgggctctcattcgtccgttccaaagtgggcacttacgtgcgcgagttgaaggaggagttcagcaaagggatcattttgccggtggacagcaaaggcgccattcgtccgcaggcggtggcaacgcaagggaaaacggtggtggacaagaggcgctttcagaatgataagacggaggagaaagtgaccacggcggaaactcaaaacgctctcaaaactggtggtttcgaactgaccgagacattcaaagtgccgcccgaacgcctttttgagattttgactgcgtctgag

SEQ ID NO: 95279 - DNA, 525 bp, Heterodera glycines
  SCN-specific regions: Sequence locations=1-303,325-525
actagtggatccccgggctgcaggaattcggcacgagggaccctacacccatcaaaattaaatcagaaaaaatctgaaaaagtcctagtttcttctgttcgaatggatcgtctctcgtggtatcagacgggcgagtcgatggaggaaattctctgccaagcgggcagtgttggcatttacgacggggacctcaaacagacgtcgttcgaacagggcaccgcttcactgacttatcagcgaatcatttgggccgattcgactgatccggattgtcgccttgttcttcaccattcgatggtccacaaaatagaaaaacagcacaaaacaatgtttggacgtggcggcaaaatcattgtgacggtaaaacccgtgacgcctggccacgcgcaagggccaatcgcggcgagcggcacaaattcactgcgattcgtcttcagaaatgggggcgaggaggaattttacaaacgttttcttgatgcgctcaacaagcaaatgtggcagcgcacttcgtccacttcaagctcc

SEQ ID NO: 95280 - DNA, 542 bp, Heterodera glycines
  SCN-specific regions: Sequence locations=1-402,424-542
accatgattacgccaagctcgaaattatccctcactaaagggaacaaaagctggagctccaccgcggtggcggccgctctagaactagtggatcccccgggctgcaggaattcggcacgaggggaattttcatcttagatttctctcccatcaaaattaaatcagaaaaaatctgaaaaagtcgtagtttcttctgttcgaatggatcgtctctcgtggtatcagacgggcgagtcgatggaggaaattctctgccaagcgggcagtgttggcatttacgacggggacctcaaacagtcgtcgttcgaacagggcaccgcttcactgacttatcagcgaatcatttgggccgattcgactgatccggattgtcgccttgttcttcaccattcgatggtccacaaaatagaaaaacagcacaaaacaatgtttggacgtggcggcaaaatcattgtgacggtaaaacccgtgacgcctggccacgcgcaagggccaatcgcggcgagcggcacaaattcactgcgattcgtcttcagaaatgg

SEQ ID NO: 95281 - DNA, 399 bp, Heterodera glycines
  SCN-specific regions: Sequence locations=1-399
gtttgagtttgctaaattcggcgctacagtatgtgccatcgatctcaggccgcgacggactacggtatctcttcctgttgctgttcctactgtagcacatgcaattgttgctcaataacggctgtgccattgccgacaactgctcaaccagtggttgcagctgtgaccgtaactgtttcatctcatcatcgtgttttaccgtatcatcggccgtcaatgatcagaatgttgctgctggctttgctgatggtgtattgttgttattgccatacggtacaatgcagcccgagcactgtatggaatacggtatcgggtgcggaagacaacattgacactgtagtggcggcggctaacaatggtggcggagccacatttctggtgccacagcagcaactgctg

SEQ ID NO: 95282 - DNA, 819 bp, Heterodera glycines
  SCN-specific regions: Sequence locations=1-819
ccaagtttgagccgcaactgtcgctgtttggggacccgcaactgttcgctgccaccgtctccaacccaaccgtcggtagcacaaacgcggcagcccccgcggcggagtcggccgcggcgctgcaaatgcacggacgacagcagcaactgcggatgagaaaggaaatctatcggtacacttgcgaagagccgttgtacgccgctgcgtggtccaacaaattgtacccggacaaacgcttccgattggtggtcggtactctgctgctggacgaagagggcatcagcagcaacaagatgtacatcattgaactggacgaaaatgtcggcgaacttgtcaaacgattcggaattttgcacgggtacccatgcactgccacgcaattcattccaaatacggacgtttcccaaccagaattatttgctaccacttcgaattgtctgcggattttccgataccatccgtcctccgcctccatctcccaagaatgcgaactgagtgcgacaaaatcgagcgcctattcgtcaccgctcacaaatttggattggaatgaagtggacccttcccttgtggcaacgtgcagcatcgacacgacctgcacagtttggaacattgagacgaatcagccgattgggcaggcgccgtccatcaaagggctgcaaaagactcagctgattgctcatgagaaacccgtgcatgacattgcattcacccgactggacaacggacgggaccaattcgccaccgccggcgccgatggaagcatccgacttttcgatttgcgggcacttcaacactcaaccattttgtacgaagatgccg

SEQ ID NO: 95283 - DNA, 1188 bp, Heterodera glycines
  misc_feature (1164)..(1164): n is a, c, g, or t
  SCN-specific regions: Sequence locations=1-27,71-71,104-104,127 -177,201-1100,1124-1188
tcgacaaagggcacagaaaggcggagttggcaaacgcgcaaagaattgctgagctggagcaacagttggtcacacaaaaaggaatggaaaagcaaaaaattgcacaagcggtcgaagaacagcggaaattggacgaaagtctttccaaaatggcgttggaaattgagcggagacggaacagagaaatgaccactggcgcaacacaaactgatcacctcgtcggctcaacgcgcaatgagtcggatgaagccgaattggacgcgcaactgaagcgggcggcgcttgcacacgccgaacatttggagcgagtgatcaggacacagaagcaaatccacgacatggagactcagcagattgtgcaggagacaattgccattgagcgggacaaatttggcaaacaaattgaaaatggactcgtaaagttggcggccattgaagaaatgctgaaaagtcgcgcaacaaaagatttggagaaccgaagggccaaaatctattggacaatttgccattcgctgacggacgcattggccaatggcggcacggcacagagccaaaaaacgacttactataaaacccaactgctggaacagattgctgttctcaaaaaactcgtccaaaatgacgcttttgctcagtccgtttgcgcccatttcccatcggacgatgccattggacggggtgtgccgacggagcagggattggtcaaacgcttcgacggggtgtacaaattggcccgctgcacggcacagattggcgacgagggcggcactctgtggcgctacatcacctcctggctccagtcgctgttcaccttcgagctgccctacgcgtactccgccgacgaccggctcgacctgaacagatacgacccgtacgagctgttggcccgctgccggcactttgtgcagcagagggacctgctgaacgcagtgcgggtggacaatctgatcagaggcaagtcggcccgcattttcagcgattggctcaaggacgccaaattccatctcgaagtgcgactgctggttgagctgctcttggcacattcccaggcttcgggaattaggacgacatattgaaaataggcggaaacgaaacaagaccagtttaatttgtccaaaaaatattgattggaatgataaagtttagacgacccttttacagctntcgacactaaaatgaacgcaaaaa

SEQ ID NO: 95284 - DNA, 461 bp, Heterodera glycines
  SCN-specific regions: Sequence locations=1-461
tttcgcctttatcaatggcctttcaacaacatttggtcaacaaattctctccacttctgatttccgtgttttcgcctctccgcaactgtgccaacttcgctgcaacaacgcaaaaagcggcgcattctccgctgcccttttcgctgaaaacgatggacgaattcgacgaggacgcggcgatggcacagcgaccgatgcccaaatggaaaaaggccggacttcgaattgagcgtaactgtgccgaaaaccaaatttttctgagcattgtccaagagattgtcgacaaatttggctgggacaattccgcccacgactatgacatgtggaagaaggcatttgggcccaacttcagcatgttcttcgtcctcgaccaaaacagagtgccgatgggttgcattagcatgtcattgtacccgcaggtggcacattggagcatgttctacgtgaaggacccctatcat

SEQ ID NO: 95285 - DNA, 754 bp, Heterodera glycines
  SCN-specific regions: Sequence locations=1-154,177-754
caccctttgaggattaaaaaatataattcggaatgggattttcgacaaagccaataattattgacggaaaagatcatttgcttggacgtttggccgctgtcacttcgaaacagcttttgcttggccagaaaattgttattgtgcgatgcgaatccatcaacatttctggcaacttccaccgttccaagctcaaattcctcgcatttttgcgcaaacgctgcaatgtgaagccatctcgcggacccttccactaccgtgcaccatctcggattttctggcgcacggttcgtggaatgcttccgcataaaaccgcacgaggtatggaagcactgaaaaagttgaaatgttttgacggatgccccgcagccgtatgacacaaagaagaaattcgtacttcccaattctcttcgccacatcgcattgaaaccgcgacgcaaatattgcacagtcggccgtctcgctcacgaagttggttggcagtatcaaggcgttgtagagaaattggagacgaagcgaaaggtcagaggcgctgctttccatgagaagaaaaaggcagtgctgaagctgaagaggaaggcggtcgaaaatgcaaagccaaagacggcactgttcgacaaaattctcgagcaatacggacacgcgtaaagaagacgacgaagaccagtcagaaatgtgggaccgtttacggtgaataatcaccttttttgttgttaccatttgttgaatgaaagtatttcaaaaagaaaaatttttc

SEQ ID NO: 95286 - DNA, 648 bp, Heterodera glycines
  SCN-specific regions: Sequence locations=1-546,568-648
gagattctttttttatatcattgaatcccacgtttgttcttattaatttgccagccttttcgaatatttaatggcaacgcaaaatggcgccgcaatggcaacggatcttctccaacgaaaggcttttaagattggcatcatcggcggcactgggctcgaggacccgcacataatggagcgcagcggcgaagtgcgcgtcgaaacgccgtacggacgcccttccgacgcactcattgagggaaatgtggcgggtgttccgtgtgtgctgttgtcacgccatggtcgtcgtcatcagcagtctcccaccaacataaattatcgggcaaacatttgggcgctgaaaaaggccggcgtcaatgtcatcgtcgccgcgtgcgcttgcggctctctgcgggaggaattggagcccggcaaattggtgctgatcgactcgttcatcgaccggacgacgaagcgcgagcagaccttttacgatggactgccgggtcatccgccgggcatttgccatatgccaatgcatcccgcgctcaacgaacgcctgcgacgggcgctgctcgccacggcgacgcgtttgggcgctgcacacagcgaccgcggcgtgttggtgtgcgtggagggaccacgcttctccacgcgggcggagagcga

SEQ ID NO: 95287 - DNA, 475 bp, Heterodera glycines
  SCN-specific regions: Sequence locations=1-141,163-231,253-475
tgaatccgtctgtcaacaaaattcacttctccaaagatgaattggacaagattttgagggatgctgacgagcagagggattttcccgcgttgctccgttcgcttggccaattggcttttcgtcccaccgatggcttttccctcccttcgtccgctctctcccaaatggcttcccattttgcttcgcttagccctttctccgcttttcactgggccaatggactcttcgctttgctcccatcagcagaaaaccatgccaattccgaagtgctcattgtttcgcttcttcgctcgttggttgacaatgtgccccttctgaatgccaacaaattgcgtgcctttgtcaaaactgaaatttcgcggcaatgcgtctcattttggcaaattgggaaagcgcatttggcatccgcactcactttatgtgtgctacgaatcttgctgatggaattgtcctatttggaggcaattcaaaacgg

SEQ ID NO: 95288 - DNA, 838 bp, Heterodera glycines
  SCN-specific regions: Sequence locations=1-838
ctttagtatttttcttttgaaatcgtataatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccggaaccaccgccacgccgactttgtgttcgaaatctaagcagaaatatcacaaaagcgcacatggaggaaatcttcgctctgtttggggctctaaagtcctgtgagttgccaatggaccgtgtgcatgtgcatttgcccccggggatacggctatgtggagtatgaaaaggcggaggatgcgcgagaaggctctgaaacatatggacggaggtcaaattgacggactggaaattcagtgcgaaatgacttttcctttcaaagggaccggcggaggtcgtggtcattcgcccgtcgggattaattctatgggcattgggatcaagcgcgagcggagccgttcccctgcgcgtcgttttgccgctcgtttgtcgcctccgcgtcgcggccgtcgctcgcgctcgccgactccgatg

SEQ ID NO: 95289 - DNA, 563 bp, Heterodera glycines
  SCN-specific regions: Sequence locations=1-132,155-563
gtccaattaagatgttggaaaaacctattttgtaccgaaattatctttcttcaatctcttccgctctgctaatgagcttccaacgagcacaactacaaaaggttgctgtgcattgtgaagggacaattagaagttgtagcaacagcagcagcagttcatctgatgacactcatccaacgtcgaagaaaatgccgccatggcaaaaaaactgcgaattttgtagacagcgcacagactttcgactattggacacgatgtgaagacagtgtgatcgaaaaggaatttcaacgtggaaaaatgatactgatggtcaacaaacagccggccgtccattccgattcgttcatttacaatccgaccaccagtaaataccaaatgcaaagtgcgccacgccttcgattgttcgattgccatgaaattcgtcaagttctcagcccctacggacttgaaattggtacattgaattcggcattgttggattattatcatgacgataacgatgtcatcgacatagatttgcgcgcacttttcggcacaaacataatgttgaacgaaccgcccaa

SEQ ID NO: 95290 - DNA, 543 bp, Heterodera glycines
  SCN-specific regions: Sequence locations=1-404,426-468,495-543
agattctttattcatttttcatatatcacctacaacaatgcaacatgcgagatgcccctatgttaaagaaaatgcaccattgccgacaaacatcaaagaggcattgccaaaggatgtgtcggtgaaaattcaacaaatccatgacgatgggtcgttgagcgcggagcaaaaaatggagcgaattgactcgatcatttgcactctgccggagaatgtcattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaggaggagaggaaagaagtggaaaaagcagcatggattaatgaaagcaaggctaaacaatatttattaaatattttattttttggtaaaatatttccaatttttcatttccaataaatatttttgctttgtc

SEQ ID NO: 95291 - DNA, 655 bp, Heterodera glycines
  SCN-specific regions: Sequence locations=1-217,239-503,525-655
gtccaatcaagataaaaaaacggactaaaaaaacattttcttaattcgccctcgaatgtctctttcttcgatccaccatatgtcacgtctgaaactttggatgaccccagtgcgcgacaatcactttgggttggatgacctcaaaattttcaacagcgatggttactctgaaaatgccccattttctcgtgagagcagccgaaactcttccgcggatggcagcatcgcatgcaacgcggatgctgctgatgcggtcattaacatgaaaattggcgtctggaaaccattgcctcagaaaacttgtggcttctgctacatacaatacaagcgtcactgtcagcgactcggagttgcatttccgcgtgtcaccgataagggcttctgggtcggacacaccaccaaagacgagcacggggatgtcatctgtccggagttgcgcaagctgaagtgtccgttgtgttacgcttctggaaagaaggcgcacacattgaaattctgtccattgaacagcatcaaagggaggcgtgacgaagcataaagtttcgtagaacaactaccaaaataacttgtttgtcggattgtttttgtattgaattttgttatcaccttgcttattgttagtttgtccaccattgctattctgttggtttgtcat

SEQ ID NO: 95292 - DNA, 636 bp, Heterodera glycines
  SCN-specific regions: Sequence locations=1-210,257-381,404-636
gtttgagagaaaatgccaaacattcgacagcagaagaagcatgaaatggtggacagtgatgacgaaaggaacgaatacggcagcactaaggctgaaccatcgccattgactgatcaatcggcgacgtcgatgatgactcataatagcagcaatgcggcggagggaggacacatcattagcagcaacggcggggcccaaatttgtggtggcaatggcacagtgccaatgccattgatttcctgctggtccccgtgctctgcgagttcagcgggggacccgctgctgtggtacgagacggacaaatgccagtactgcaaccaaaagtgcagaaagccccgtcgcctgttggactgtctgcactatgtgtgcgaagagtgtgtgcctgaacaatgcctgctgctggacaatttggagcccgacgaaatccgatgcccaaattgcagccaagttgaaatgtcttcaatttcgggtcaatccactgaaagttcgcgtgtggaaatctgtatcaaacacaaggagaactttacccgtgtctgtctgtcatgtgcgcgtctcctttgtgtgaattgcgagcagcagctgtccttgcccaccgcgcaagtcaacaatatcactaacgttgttgctgttccgcaa

SEQ ID NO: 95293 - DNA, 255 bp, Heterodera glycines
  SCN-specific regions: Sequence locations=1-255
cacgaggagcagattgaggtggacgagaaaatattccgctggcagatgaacgaagacgcaatggcggacgaaaagctcgcggatggaattcgccgctttgccgtcgatgctattaaactcgaagagttgattcgatcgaacctttgaattaaaaagtatttgttgcctcttttttacgagtgatagaccattcccagctcattcaaactgttaattatctgaatttatttgccaatttaatacaacaatttatta

SEQ ID NO: 95294 - DNA, 513 bp, Heterodera glycines
  SCN-specific regions: Sequence locations=1-2,25-416,438-513
ttaattgaataaaaattatttcatcaatgtcctttttactttttgtgactattgcttttgccaatttggcaccaaatgcttttggccagcaatggccaaaagcaacaagtgatgaaacggttccggcaacaattgttgtgacgggaggctccagagactttggctacaaacggttgaccgcctcttctgcgttgggcaccggtgatcagttcggagggccaaaaagcactgatccgtgccgaaaagggcgcagtgatcaaaaatttgatcatcggccaaaacggggcggacggcattcactgctatgacgggtgcacgctgcaaaatgtgtggtgggagaaggtgggcgaagacgcggccactttccggagcagcagcggatgcaaggagtacaattttctggtgacgggcggcggtgtgaaaaatgccaaggacaaagtgttccaaatgaacggcggtggcacgttgacgatcaaagattttgtggcggaaaacattggcaaattggcgcgc

SEQ ID NO: 95295 - DNA, 552 bp, Heterodera glycines
  SCN-specific regions: Sequence locations=31-421,443-552
aattaataaattgaataaaaattaattaatcaatgcattcctttcttgtactgaccattctttttgccaatttggcatcaaatgcttttgggcaacaatggccaaaagcgactagtgaagaaactgttaaggcaacaattaaagtgtcgggaggcgtcaaagactttggcttcaagcggttgactgcctcttctgcattgggcagcggtgatcagtcggagggccaaaaagcactgatccgtgccgaaaagggcgcagtgatcaaaaatttgatcattggccaaaacggggcggacggcattcactgctatgacgggtgcacgctgcaaaatgtgtggtgggagaaggttggcgaagacgcggccactttccggagcagcagcgggtgcaaggagtacagtttcacggtcacgggcggcggtgtgaaaaatgccaaggacaaagtgttccaaatgaacggcggtggcacgttgacgatcaaagattttgtggccgaaagcattggcaaattggcgcgctcatgcggcaactgcaaaacgcaatgccaaaaac

SEQ ID NO: 95296 - DNA, 794 bp, Heterodera glycines
  SCN-specific regions: Sequence locations=1-6,29-421,445-794
ttaattaattgaataaaaattatttcatcaatgtcctttttactttttgtgactattgcttttgccaatttggcaccaaatgcttttggccagcaatggccaaaagcaacaagtgatgaaacggtttcggcaaccatcaaagtgtcgggcggcaccaaagactttggctacaaaagattgaccgcctcttcggcgttgggcaccggtgatcagtcggagggccaaaaagcgctgatccgtgccgaaaagggcgcagtgatcaaaaatttgatcatcgggcaaaacggtgcggacggcattcactgctatgacgggtgcacgctgcaaaatgtgtggtgggagaaggtgggcgaagacgcggccactttccggagcagcagcggatgcaaggagtacaattttcttgtgaccggcggcggtgtgaaaaatgctgcggacaaagtgttccaaatgaacggcggtggcactttgacagtcaaagattttgtggccgaaaacattggcaaattggtgcgttcatgtggcaactgcaaatcgcaatgccaaaagcgcaaattcgtggtggagaatgtcaaagtgactgggctgaaaacgctattgtgtggcctcaacgagatttatggcgacgtggcgaccatcaaaaatgtgcaagtcagcggaccatcgaagaaagtgtgtgccgaatttgagggcaacgacaagcaaaaggagccgccgatgctgcgcagtttcgacgtcgggtcgagcggagacggcaaaaattgcataatttcgagcaccacaagcggctgatc

SEQ ID NO: 95297 - DNA, 269 bp, Heterodera glycines
  SCN-specific regions: Sequence locations=1-269
cgcaaattgcgcaacgatgtcgccacggaatgtgccaatgtcgccattcatcgccagcagcagcagaagaacggaagtgccatcatcatgcaaacttaagcagaggacggacgagtgggatgaagaatgatggtgctggtgccaacaaacattcaatgcgatgaaatgatataaagcataatatgtatttctcagctgtattccattgtattgtatattccattatatcgcctatatgcgtatgcatggtctcaaataaactcacctag

SEQ ID NO: 95298 - DNA, 486 bp, Heterodera glycines
  SCN-specific regions: Sequence locations=1-369,391-486
tttgagggaatggccaaatcaactgaggaggaaagaattgcaaatgtccattttgaccttgaagtggtcaattcggattttattcgaccgatgcgaatgaactttcgccggagggggcgcgacttatactgggacatggcgcttgggcacgacagtgtcgccgcactcattttccacaccgaaaggaagcagttgctgttcgtcaagcagttcagaccacctgttttcgttaacgtcgtccggtcactgcccgaaaacaaaaacaaatctctcgccgaagtccgctgggagaattatccgattgaaaatggatgcaccgtcgaattgtgcgccggacttatggacgaaccgggcaaaacgccgttagagcatatgaaaaaggaaatactggaagaatgcggttatcgagtggacgagtcgaacatccgcccgattcggcgttatgtgacgggcatttcgctgtcgggcgcaattcaacatttgttt

SEQ ID NO: 95299 - DNA, 476 bp, Heterodera glycines
  SCN-specific regions: Sequence locations=1-285,308-476
attaaatacacttttataatttcactcaccatttttcattttaaatggcgagtggcgaacgccaaaagttggtcaacaattcgacagctgaacgtccaattccgtcccaacatttttccgtccattcgaatggttacggcgccatcgccgccgatgcgacgcggccatcggtcagcggttcgtccaattcgtcgtccgatggctttcattgtcacgcggacggcgaccgacggccaacggacgcgcaaaacggcgcaagtgatcagaggagggcacggacagtgctgtggatgtccgtgggggtgtgctttgtgtttatgatttgcgaagtgatcggcggagtgttggccaattctttggcgattataacggacgccgcacatttgctgaccgacttggcgagcatgctcatttcgctgttttcgctttacattgcctctcggcccgcttcccagcgcatgagtttcgggtggcat

SEQ ID NO: 95300 - DNA, 464 bp, Heterodera glycines
  misc_feature (366)..(366): n is a, c, g, or t
  SCN-specific regions: Sequence locations=1-241,263-284,306-464
aaaaacaaaaatttcttttgccattatggccaatccttcaaaaaatattgccatgctgcgcgaagcgcgctcctccccgtacattggcggcggcggaagcgtcggcactttgccacctgacgcgctgcctgcttcaggcccgatgcacacgcgcctgcaacgcaatcgtcgaccggattcggccaccgcgcccaacactgcacgactgcagaacgctgcaagcgctgaacattttgagcagttgaaggaactcatccagttcagcgctggctcgtcctcttcaacctctctgattgctgctggacgccattttggcactgaacaatccattgaaaattatgggcgactcaaagcggaaagtgtggnacaatttgtcggaggtcagcggcatttgtccgaccagcagcaccgttccgtccatttcggaaagtcgcgcatcaatcacttcaatgacagccaccgcg

SEQ ID NO: 95301 - DNA, 420 bp, Heterodera glycines
  SCN-specific regions: Sequence locations=1-420
gtctttcaggcatgaccgcgtaagcagttggaacaccgagactgccttgcaagataatggttcgtggtcgtggatcattgcgtgatgctgctaaggaggaaatgaatcgtggaaagccgaattgggagcacttggaagacgatcttcatattctaatccaatgtgaggacaatgaaaaacgtgcgcgctccaaactcgacaaagccgtggataaagtgaagaaactgctcgtcccatcgcgtgacggaatcgatgagttgaagcgcaaacaactgatggaactgagcatcatcaacgggacttaccgtgctaacattgggccaaagaactcgccaaccgttcctcgtcttactcctctgtccatgctatcaccggtccactcacctctttcgccgcctcaccgtgtgcattccaccgttt

SEQ ID NO: 95302 - DNA, 481 bp, Heterodera glycines
  misc_feature (472)..(472): n is a, c, g, or t
  SCN-specific regions: Sequence locations=1-25,47-180,204-481
attaagcaaaaatgcagcaaattcccattctttccctctccaatttcctccccattttctcacttatttcggtgccctttttattgtcctttccttccacggccttcggttgctcttgtgcacccaccaaattcaatgagtcgatgtgtgtggccaaatgggtgtcccatgtgaaggtgttgcaaaacacaacaacaacaaactcccaccgcattttcactgtccgacatttggaagtgttcaaaagtcccaacggcaccgctcacaatgaccaactgattgggaaggaaagtgccgtttggactcccatttttacggcggcgtgcggagtgagagaattggacactgaaaaggaatatcttttggctggcactgtggacaatttgggaacaatgcaaattaatctttgtctgtttattccaatcgaagacggacagccaaatgccgagaatggcattgtcgaatgggcganagtgccgga

SEQ ID NO: 95303 - DNA, 917 bp, Heterodera glycines
  SCN-specific regions: Sequence locations=1-472,494-605,627-865,902-917
ctgaaggccatccatacggcacttttggacgaagtgatttcatcgggcggggacgaaattaacggggaccgattcgccgccctccggaaatttgtggaactgctcattcagcgattcccgaagaaaacatttgaacgaaacccgcaattgagtgcacatcccaaggggacggcactttcatccatcggaaagcctctgctgcgaagtcaacgggcgtttaaagtgtttgagcaaatgaaacgctttttggacgcaaaagcgggcgacggcaaagtgtccatggacgagtggagggcggagtttgatcaggcgaagaaacaaaatggcgacccgtttccggtcacagccgaatgggagcactgcaagggaacgcgcaccattttccgcggcttcacatgcggcctgtggaccgcttttcatgcaatgactgtgcaagcgtaccttggccaggagcagcaaccgctgaagccgttgaaagcaatccaaggctgggtggccaatttcttcagctgttccggctgtcgtcgccatttcatggcgatgaccacggagaaattcccaatggaggccaaaaatgtgaacaaaccggaagacgtggtgctgtacctgtggaaggcgcacaacattgtcaacaaacgactgcatggggacgaggcaacggaggacccgcagttcatcaaggaacagttcccgccgcagtatttgtgcccgggatgccataaaactccatcgtccgccagcgatggcaatgacccgacggagttggacccggagaagacactacggttcctgctacagtactccaccaacatcaaaccgcgaccgtagccacaccgtatgccccttctgttactgctgattcgtagatgataataaggatgatgatgattatggatgaaaatgaagcttacttgcca

SEQ ID NO: 95304 - DNA, 435 bp, Heterodera glycines
  SCN-specific regions: Sequence locations=1-435
gtccaattaagttgacaattttcgaacttttgttgacgcattatgcacgagcgagttcaacaggatttccgttccagcaagttttcaacacgagccaatcaaaatgggcagcacggaaatcggagtcgcgaagttcgtttcgacaacacaaatggacgggcgtacacacgtcgcaacggcagttattcgtcggaaccgtcgtcgggtcgacgaagctccttttcccgtcatcaagatggtgctcgtacatacgtaccctccactgcagtacagcgaccgatcagcccgaatgggtgtgacagtggcggcatgtttctaatggtcgaccccttcaacattccaaacacattgggcgcccaaattcaagtatttgatctccaagagaacatccgacatattattggttactgcattccattgcgttgctgtgtgggt

SEQ ID NO: 95305 - DNA, 470 bp, Heterodera glycines
  SCN-specific regions: Sequence locations=1-470
gatatgaattcatttatttttcgtcgattaccttcattacgatttcctacggcttctatgaattttcggaaaatgttttcaactgctgcttcgtcttctcagcagttcaatgtcgaaaaaccggtcatcaacaaaagcgatatcatggagcccgaggattatgatctcactgatcggaggaaatgggttatcgaaaatatttcgaattcaattggtgatttgactaagatgatttttgcggttatttacatccaagggaaacagcacaaagtgacccaggatgacataattcacgtcgaacataacattccgctcgatgttggagaggaaattgccctggaaaaggtcctaatgatcggaaatgatgaatttacattaatcgggcgtccgttactcgacccaaaatttgtgcatgttcgggccacggttattgagaagacgaccacctctcctgaagtgcaatacgattt

SEQ ID NO: 95306 - DNA, 641 bp, Heterodera glycines
  SCN-specific regions: Sequence locations=1-641
gtttgagataattttcactgcttttgcatacattcattctcgcgcattacaaaatgtcgattatatcaagtaaaccgatgaatatctcgtttagtaattcctgtagtccggattgcccgggcctcacgtggtgctcctgacatccctaacagtgagaacatagacagagatgcggttgctggtttagtaaaaagtgttgctgagggttggtgttgtcatctggcggagaagaacacgttggcactgtttattccatccaaacttttctcatctactttatcgcgcgagaattttgtcgatctgttggagtactgtgaggagcacttgaaggtccgtcgcattttggcttgcttcaacaagtcggacatcaatccatgccagggcattccacgcgccctccgttgcattggcttcaccctcctcccgcccgaacgttaccccgctggcattgacaagaacaccatttttgcgatggtttacaaaatctaagcgcagtcgacgtccttctcccccccccctttctctatctttgtaaaagatcgacacaattttaaacgagttgtattttctatccatgtattcctacagaaaatagcgtttttcatccattcacagtgatgtcaaataaaagtgtgaccaac

SEQ ID NO: 95307 - DNA, 340 bp, Heterodera glycines
  SCN-specific regions: Sequence locations=1-30,52-340
aatcattcgctgagaatgaaattgacaatattcgccattctgtttgtggcattgtttattgccatcgctgaagcagatggcaatgtccgggcaaaacgccatgaagaacgattgaagcgccaagacaaccgagctgatgaggagaaccgccaggtagacagtgctgatcgggagaagcgccaagacaaccgagctgatcgggagaagcgccaagacaaccgagcaataatgtattaagccattacggatgacattagattttccgacaagaaacgtctactatgaaaatgtttcaataatacaccgaaccttattatgtaaaataatcaaataaaatttt

SEQ ID NO: 95308 - DNA, 510 bp, Heterodera glycines
  SCN-specific regions: Sequence locations=1-19,41-510
caattaagatttattttagcttaatttttcttcctaaaatggacatcgatgaattgaaaaaaatgagtcctgagcagcaaaacaagcttctcgaggatgttcgtcgtcaatcagacacccaatcggttctgtctttgttggcctccttctctgaaaaatgttcccaacggtgtatcacaagtccgggcaacactttgagcggaggtgaaaaacagtgtttgcaacgatgcgtggacagatggcttgacagcttcagcattgtttcaactgcttttgctgccaaggcccaacagatggcaggcatgggcagttttggctcgccagacggagggccgtctttttcatgagggtggacagctcattgatcgttgggaatttgattttgttgtttttcgcttgtttgatcttttagtggtttctttttgaaaacagcatcgactcgttgagcaatattttcaattttaatattagctcaaaatgccagacacagataaaaatttgtcaacaaaa

SEQ ID NO: 95309 - DNA, 1794 bp, Heterodera glycines
  SCN-specific regions: Sequence locations=1-431,549-1204,1226-1794
gtccggagtcactgaatgcgttcattgagtcatcgtccgcccaattgatttcgcgcaaagagaatttcaaattggcgcagcaaagctttctcgagtgttcccaatactacggagagggcgcctctgccgtgccggacgttttttcacccggattgcgtcattttgcaagcaattcaaaaatgcccttaatgaactcgaagcgcggaaagcatctgaaaaagttggcatttttgccataattcgtcggaagattgggaaaagtgcaatggatattatgactgccgtccataggttcgatttctcagtgctcacttccgaccaagttgatgttctgcttccaatttttcttgccaaattgatggacattgagcgtttggagcggaaattgactctgatgaagcctttggttttctgttcccgaattgtttggcctttctctgcttttccctctccaagtctctcttcgtgcgcctcctcttcccctccccccgtctctcccttctcttccacccttctctctcctccactcgttgtccctcttcgttttcgcgaattctgtgcccaacccattcgagcagttcattttcaacacaaaaacttctgacagagagagaacagaggcaaaaggccaaagtgactttcgcgcgtttctttggttgcaattcgcgcggcaatgagtgcaattgagggggaaacgtgtggagtgttgggacggcttcagttcgaagtgcatgcaatcgttggcttcgcccgactttgtgccggcgatgtgttcgaagtttcggtaaggcacggccaccagcgatggcgcagcagaggcaaaacgttggcggacaaaagccagcggtgggagcagcgcatgtcgacgatggacgtgctgtggaacgagccggtggtggtgaaggtgctcgaagtgaaattcctcaagtcgcgctgtttgaacgaacgccaatttgacccagcaaaattcgcattggcacagccccaattggtcacgatgaatctgaatagtgccgggagcatcaaactccgtttggtggtcacttggcttccacttttggcaacaaaaacaattggcgaaaattcgctgaataattgccaaaaaggaaatttgacggagagagaaaagcaaaggacggaccatcggacgaacggatcgaaacaaaacgccagactaacgcaaaatgaacagaaaaaaagagatgaggaagaaagggggagggaaatgcaacagcaaaacacggagacgaaggaggaggaccaatgccagaacgaatcggcggacggcgcagcggtcaaagtttgcctgagggacaaaaaaaggcaaagggagcagcgaattcagctggggaacagtgtcagcacggggtcgaattttggaattggcaaagagaaatggcgctgttcttccacaactttgctggacgacgtgtacaaagacttggccaagtccattccgactatcgatgaccttaccgttctacacccgtcccatttcgcgtctcttccctcgtcgtccccacgccatcggtcgttcgactcggaaagtgaccgcgccaaaacggaagcgaaaaatccgcgtcgcattttctcatttataaaacgcggacaatccgaagcgagtgccgatcagcagaagaaggattggagaaagtcggcgagtttaggagaaatcgcattggcaaaagacgaatgctttacgactacaaatgcggaaaaagcatcgccagtctctacggaaaagaatggaaacggtgcaaaaaggggcaaaccgagcagtgtgaagaaaggacg

SEQ ID NO: 95310 - DNA, 659 bp, Heterodera glycines
  SCN-specific regions: Sequence locations=1-12,34-182,205-255,288-659
acgagggtttgagaaagtgctttactaataaattattcataatgaaaaggccttcttcggttgtcgcttttggtagtcatttatttgtcggctttatcctgttgtcgcttttcattggcactttgggcactgagaaaaaagagacgaaacctgccgctgctcattctcccgccgatgccaaacatccgccgccagtcgccgcccacgcggccgctggcgccggccacgcctccgatccgaaacacgcttctccttctcccgctggggctgctgctgctgcttcccacgctcatccgcccaatggcggcgccgcccacgcggccgaaccaaaacatgctgcggctcccgctatcaaaataactgatgaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaagaggacaaaatgatggcacgacgagaaggaatggatgaatgaatg

SEQ ID NO: 95311 - DNA, 484 bp, Heterodera glycines
  SCN-specific regions: Sequence locations=1-169,192-484
ttgaggtttagcaaaaatggtatcagcaattgcacaatatttcctagcctttcttctgtcagcatccgttatcgcatttttctcgtttcttcttctgactgctttgtccattttcaaaccatggaccaaaaggaacaaatcccatttcgtcgccccccgttttcactttcgtccggaagaagaagaagaggcgaatgcgcagttcccttgcctgctgacgcgggaagagacgagttggaaggggctgcagcactcggaacccgaactttacctgtcggtaattgtgccagcgaagaacgaggaaaaaagactccctcggatgctcgacgagtgtttgaaatatttggaaaagagggcggccaaggactcggaatttacatatgaagttattgttgtggatgatgggagcaccgacggcacagctgatgtggccttctcctacgcacgttctcaccccctttttattctccgacttccaaaaaac

SEQ ID NO: 95312 - DNA, 651 bp, Heterodera glycines
  SCN-specific regions: Sequence locations=1-133,155-261,283-651
gtccaattaagtggatcttcaaatttatcggctaaattcgacataattgacagacgtattgcaagtttagagcagagttggcgtaatgccatgcccatctcatcaaattctgcaactgccggcacctcggccatgtcttttgattatgcagagaaccgatttttgctgtgtggcaatgctcgggggaatgtgtcggtcgtcgatttcgagtcattttccaactctctgtcaaatgccgaagtttacccgaggcattacgtcgtaattaacaccaataggaaaagtcatcacgaatttatggtcaatggatgtcaatggtatcccgtcgattcaagcatttttgcaacgtcaggaagagacaaattgctaaagatctgggatgctgatcagctcaagtcggtggaaaaatttgcattcgagcagcccatttccagctttcattggttcgttccgtgcgattgcaactcttcgcttattcccattgccacttcctcgtcaaatgtcgttttgttggacccgcgattgggtaacactgcacaacaaattcgctgtttgcagcaacgcatttggtcagtccgctgggaccgtttccgtgactatgttttggtgactgggagcgacagtggcgaaatcgctttgtgggacattaga

SEQ ID NO: 95313 - DNA, 342 bp, Heterodera glycines
  SCN-specific regions: Sequence locations=1-179,201-342
gtgccaagtgccgatttcttcggcggcattggccaccgcctttcaggcgacgagaacgttgcgatggtgttcatgctgttgatgatcaccattttggcaacgaatacggccattctgatcatgcaaattgtcatgttttggacagttatctcacggccaagggcagcagcaggtgaacagcagacggagaagaaaaagacggacaactacaagaaaatgatgagcaacaccaatggaaaagtccatttggtgtcatcgcctcgcaattcggccgaattgctattgtttgaccgcaaagggaatgccgtcgtctgaacgctgtgcctttcggcaatttgctag

SEQ ID NO: 95314 - DNA, 416 bp, Heterodera glycines
  SCN-specific regions: Sequence locations=1-316,338-375,408-416
ttacaaattaatttgttcaatatacacacataaacgatggagcttggtgatatggttttggcaattttggagttgatctgttgcttcttcgtgccgcccattgccattctgctgaagtcgggcgagtgcaaccaacaagtgctgatttcggtcgttctttgcattttgttgtggatccctgccgtcatccatgccatttggtactgtttcattcgctgaatgccatggcgaacaatggcattgaaatgattcgattggaccgtttcttattcataaaaaactattccgattttgggatttgttacatatccaattctcatcattttcaccttttctcatcaacatttcaaaaataaaatcgatcatggttgtaaaatttcaaatacaaaattaaaagaaaagtaaatttcaacccg

SEQ ID NO: 95315 - DNA, 240 bp, Heterodera glycines
  SCN-specific regions: Sequence locations=1-240
ccctgcgcctcctagcgactcaattgttaatgccaatggccctcagttaaacaatcaacaaacggacactggtctcgtaaacattgttccgcttgcatggcaaccgccgaaattcacaaatggcggaatccaaggacaatcagagtcgaatcctatgctttttggtggaggattttcatttacgactactgttcctccagcagctaacggtcctttccaatttggtgctgcacctccagt

SEQ ID NO: 95316 - DNA, 658 bp, Heterodera glycines
  SCN-specific regions: Sequence locations=1-568,591-658
gtccaataaagcgacctgttaacagcgatgggtcttccaattatccaaatttatatgatcgtcgccagacagttgtcaaagcccatcactggatattttatgggattggggaaagaacacccggcatttcggaacagagtgttaataccaatagggaaaactatcacaaattggttccacaaaattgcgaatgaaaaatttggacctcggctcaccaacttcagtggtaaatgtatcggaagagacagcgcttgaacaggcttcagaagtgatccatcaagtggccattttcggctacactgtcgtggtgttttacgcttattcctatttcacgcacaaagaggagaaggaattggcaagcgccgaggaattgagagagctgagcaaaaagacgagccaggagataatgcgactgaatgtgctggttacggaattgcaggacgaaatgcgaatgccgcggagggaccgaaattggactttcccatggtctggggaaagcaaaagtgcgttgcgtgaaagcgccgtcgttaacccaatgttgccaagtgtggtgatgaccgacagtcagccgaaagaacagaaaaaagacatgaccaaatcaatctcaaggacggaagcattgaataggctaacaaatgccaccgaaacttcatcgtaa

SEQ ID NO: 95317 - DNA, 744 bp, Heterodera glycines
  SCN-specific regions: Sequence locations=1-12,34-482,504-744
acgagggtccaattaagtaaacttttctattttcctcgccttttcacaatgtctcggcatttttccttattttccacgaccggcagaatttgtgaactacggctgcagccaaagtgttctcgtcgtttgttttgcagcatttcgccttcaacaagttcgggtgctcatttggacagcggcagaaaatgtcaaaataaacctttatgcgcactgagtgcattctcacgggagcaactcggcacttccatcctccacccggaggcgaatcggtcgacgcaaaggattgtcctaatctcgaaaatttgttccctcggaagttcagctttcggtctcgtcatggttccgctggtcacttccgccctttgggagcccatcgccgaacggccggccatcgctgtgttcgccggcgtggccaacgtttttctgttgctcttcgctttcacgccaattctgctccatttcctgaccaaacgttttgtccaaaatgtgttcttcaacgaaagggagcagatgttcaccaccgtccactacaatttcttcctacaaaaacgcgctcttcgctttaccgccgatcaattggtcgatgcgtctgagctaccaaaggacaggcgcttttggctgccgttggccacttgcttggcccactcctacccaatgcttctcccattggacgccaattgctacagcgaccaaacggcgttcaaattgctcacaaaaaacataaaattgccgacgaaagaggag

SEQ ID NO: 95318 - DNA, 496 bp, Heterodera glycines
  SCN-specific regions: Sequence locations=1-4,27-423,453-496
atttacatattttcccttttattttccatcataagaaaatgaacagtaagatgcacagatctttctttcattggacatcactactcatgcaaggcggtattttgtgtgcgccaataattgtcaatttacagagaaataaattgaaccatgacttcaaacttcgcaaaatgatgtccgctgaccttcccaatatgcctgatgaaaatctgctcgatttggttgaagctgaaatgttagccaaatctaatgatcggctttatccatttgaaaagcaccatttcggcatcaaagttaaggacgacattgaatcgaacacttacggctttttctattgtcaaaacggagtcactttccgattcagttcgagattggccttaaatgatgtcgagaccatccgacgccattatccaaattttctcggactttttaaagaaaatctcaaaagcaaatgggcgaaagacttggaaagtgtcaaggaaaatttacggtcggcaaa

SEQ ID NO: 95319 - DNA, 431 bp, Heterodera glycines
  SCN-specific regions: Sequence locations=1-8,30-71,96-431
gattcttttatttaaataaatggataacgaaaaatatgccatgcttgtgcgttccgttcacaaaatcgtttctcttgcggacgaactcattgagcagaacaacgagttgaccgaatacgtccagggtttggagttgcagggccagcaattgcctgacctcgaaattccggccagggatatggtttctgctcttttgcaaaactatagtggccagagacacgcgacgggtgttcaggcaaagatggaacttcttagagaggcgatcaacaatatttcgaaacttgccgatttgttcgtggctcgtaactgttacttgatcaagcgaattcatgcacatttggagacggaacgcttccgtaccaatgatagagggattaactgaacgaatactgatcaatcaaatgctttgtttttgaagacaaatctacaat

SEQ ID NO: 95320 - DNA, 1507 bp, Heterodera glycines
  SCN-specific regions: Sequence locations=1-1507
gtccttaagtacccatttcgtacctacatttgacgaaaatggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatcccagccccgtgccttttctgtgctcgatgccttgtccgcttctggtctgcgcgccattcgcttcgcgttggaagtgccaaatgtgacgcgcgtggtggccaatgacttctccgagaaggcattcgaagcaatccgtcggaatgtgcagctgaacggcgtccaggacaaagtcgaggcggtcttttccgacgcaatcgatttgatgatggcacatcgcaaattcggcaaaaggttccacgccgtcgacttggacccctacgggtcggcgtccgcctttttggacgcggcggtgcaagcggtgatggacggaggcttactgatggtcacttgcacggacacggccattctctgcggcaacactcccgaggcgtgcttcaacaagtacggctcggtcccgctgcggcacaaatcgtgccatgaattggcccttcgcattttgctccgtgccatcgacgcccatgcgaaccgtcacaagcgttacattgtgccgctcctttcggtcagcgtcgacttttacgtccgatgtttcgtccgaattcggtcgggcgctgcgatggccaaagacagcgtgacaaaactcgccaatgtgaactgctgcgccacctgccaaagtttggactttcagcctctgctcaaaaagagtgtcagtgggcccagcgtgcgcttctccaccgcccatttccagtccgaattggttcgtctctttttgggacagtccgacgcgtcgatggacggacgaatggtggccaaatgcgcgcattgtggggggacggccattcacacgggcggccccatttgggtggcgccgacgtgggacaccgaattcgtcgggaaactgctcgcaatattgaaaggcccgaatgcggggcagctgagacttggcactcgtgaacgcctggagggccttctgacggttctgtcggaggaactgcccgacgtgcccctcttctacgaacacgaccagctgatggtcgtcatgaagtgcccctcgcccaaaatgaacgtcttccggtccgccctgctcaacgcgggcttccgctgctccatctcccactgcaatccgcgggcagtcaaaacggacgcgccgacctcttttctgtgggacgtgtgccgtgaatgggcaaaacgaaacggaatc

SEQ ID NO: 95321 - DNA, 584 bp, Heterodera glycines
  SCN-specific regions: Sequence locations=1-494,516-584
gtttagatcagtttttaaaatttcatccatttgacatctatttttgaaaatcagcagtttcttctttctgtttaataatgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaaatgttggaacagagcaggacatgtcaagcggctgtcagcggaatcgccagtggcattttggggctgaccggcactttgggctttctgttctatttcctttgtgttttcttacaggcttttgtctggcaatacaagacgggctttcgatggagtgcgtttttcacgagtcgttcgcttttcctcacccattcggtcgttagtggccttttcacttatgtccttttttgggtgtttgtctacggacttgtccatgtttattagctgttttgtaccaacagtatttaattttctttattc

SEQ ID NO: 95322 - DNA, 426 bp, Heterodera glycines
  SCN-specific regions: Sequence locations=1-426
gtccaattaagcatataaaatttgccaatttgtttcccattttggaagaaatgtcccaagatttgttcggccacagcaaaagtgaggaatggaaggattcggacgagacgggcaacgactcggacaaactcagccaaatgtatgtcggcattcgcccggtggacaaatgcctgcgaattgcctatgccaaagcgatggacatgaagcatcagaaagtgattgtgatggtggagaatgacaacgattttcgcacctacgacacgaaggaagtgcccgtgggtgaaatcatcaaatattgaacattgttggctggtcgaaactgaaaaggtgtcgaaattgatggctttccggcggcggatgatttgaaaatttaaataatgctttttttccctctctttcactttgtcatttttgatcgtttgcctt

SEQ ID NO: 95323 - DNA, 289 bp, Heterodera glycines
  SCN-specific regions: Sequence locations=1-24,50-169,191-289
tatacacaatgtctttaattaccataattaattaatcaattaattaatttttcataatttgttccttccattgttcgcttctcttctcaggttgattgatcaccgccaccacacatacacactttccgatcacattttgctatatgaattccttcgcttatttaccatcaaacaaaatatgcaattttttggaccaccaatttaaagcacatttattttcatgatttaaataaattttccaccaataaacaattttgctttgcttttttctaaagaattataaatcttt

SEQ ID NO: 95324 - DNA, 661 bp, Heterodera glycines
  SCN-specific regions: Sequence locations=1-404,426-638,660-661
gcgtcgtcttccccttgtgccgagaattgcaccattttcccccatccaacgttttgaaaaacaattcccgaagatttattatgctccggaatggcgacttgacgaatcggggaagagaatgacgaggggtgtggaggagaaatactcgccgatgaataattacggagttacgccggacaagtgggagtacatgaacaaggtcgtgtggccccctaattacgtggtgccggagacgggcaaaccgaagccgagggaagtgttccattgcattgagaatatccacacggcaccgaaaaaaatgcacactgttcaccaatttgcgttgaatatggtggtggacgaggccattcagcagcttcgaaaccaccagaaaaagcctacttttttactggccgatttaatcgaagaggcaaaagagcgtgcaaggaaggagtttttcattgaaaatcctggaaaaatgtttgttgccgagacatttcacatccaatcgaaaattgtgaaaggggcgagacgacacgcgcacgagaaatggcacccgatgagataccgttacatcaatttgttcgttaggctgcaagaaggcgatccgcccaagtcccaaaaacgcgaacccgacgccgacggatgggataaaatggacaattattatgcttttttgcaa

SEQ ID NO: 95325 - DNA, 1039 bp, Heterodera glycines
  SCN-specific regions: Sequence locations=1-4,26-278,324-370,531 -544,570-843,869-872,899-1039
aattagttgaaaaccaaaaattaattggccgtgacgaaaacaatatcatcaaccacagaaaaatgaactgctccagcgctgcaatgttgatgctgttgatgaccattttcactgtgctgtccaatgtcaacgaggtagcagccgaggagcacgagctggtcagccgcattaagcgcaacggctacggatacagcagcggttatggtggtggctgttcagcctgccaaagcagctgcaccacctgtggttacacatcctaccataccgtgcctgcggctcccgctcccccgccaccaccgccgcctccgcctccgcctgcgcccgtctacagccagtcttcctactcctcctgctccacctgcgggggcagctcctactcctcttacccgtcttcctcttactcctcttatcccgcttcttcctcttcctattcgtcctaccccgcttcttcctcttcctactcctcttaccccgcttcttcctcctcctactcgtcctacccgtcctactcctcctcttcctcctgctccacgtgcggcttgagcggctacagcaacagctggaacaacggtggcagctcgtccaacacgtggagcagcggcggctcgtccatgtcggcgggcaacggcggtggctacggctacggcggtggcagctgctcggtgtgcggaaagcgcaagtgagcgatgcgcagcgcgcgcagcgctgtttcggcacggacgcaacagcggcgagggcgcgcggacacggagaatgaactgacggaagaccattgaaattctcccaaaaatcttggacccatccccaaccacaatacccatccaatccgtcccacattttgttaggctcagaaagcacacattttaaatggcataattattttaaaaattttaatttaccaattggcacccaaaacagcaccagcacactttgtttatttaattgtttaaattaatttttgtttcaataatgttattttttgtttgtgtgatcacaattctccaccaccccaataaatgataaagattcgaagttgatt

SEQ ID NO: 95326 - DNA, 1092 bp, Heterodera glycines
  SCN-specific regions: Sequence locations=1-46,73-113,156-170,193-1092
caagtttgaggattttaggaaaaggtacacttactttctacaaaatgacctcacaacccattcgcgtattggtcactggtgcggctggacaaattggctattctctggttctgcaaatcgccaaaggggatgtttttggcaaagatcagcccattgtcctcgtccttctcgacatccctccgcttactgaagtgctcaccggcgtccattacgaattggttgactgtgcgcttcccaacctcttcggcgtcgaggcagtgaccacggaagaggcggccttcaaagacattgactacgcttttctggtcggagcgatgccccgcaaagaagggatggagcgaaaggaccttcttgcggccaatgtccgaattttcaaatcgcagggcgaagctttggccaaattttccaagccaacagtcaaagtgctcgtggtgggaaatccggccaacacaaacgcattaatttgcgccaaatacgcggccagcaaaattccggctaagaattttagtgccatgactcgtcttgaccacaaccgtgccatggcacaagtggcacaaaagtgcgcagatggaaccaccgttgggatggtgaaaaatgtgatcatttggggcaatcactcgagcactcagttcccggatattcgacatgccaaaattgccaaaggtggttccgaaactttggcctatgatgcggtcaaagacaccgcgtggattcaggaccaattcatcaagaccgtacaaaagcgtggcgctgtgatcatcgaaaagcgcaaattgtccagcgcaatgtccgcatcaaaagccgcgtgtgaccacatgcgcgattggttttttgtcactccgtccgacggtcgttgggtgtccatggctgtgtttttttacggctctcacggcatccccgagggattggtgttttccttcccccgcaccatcgatgcacaaaaaaagtggagagttggggaggggctctacctcgacgactttgccaaacagaagattgacatcactaagaaggaattgttggccgagcgcgacgaagcactcgcggcatgcaagtaatggaaaaggagagacaaacgtagaggaaatgaca

SEQ ID NO: 95327 - DNA, 421 bp, Heterodera glycines
  SCN-specific regions: Sequence locations=1-22,52-77,117-125,147-421
gcggattgttctacctgcattccaagggcatcatctacagggacttgaagctggacaacgtgatgttggagagggacggacacatcaaaatcaccgactttggcatgtgtaaggagggcattcagggcgacaccaccaccaaaacattctgtggcactccggattacatcgcaccggagataattctctatcaaccgtacggaaaatctgtcgattggtgggcttacggcgtccttctgttcgaaatgctcgctggacaaccgccgtttgacggggaggacgaggacgaattgttcacagcgatcaccgaacacaatgtctcttaccccaaatcgatgtcaaaggaatcggtgctgatttgtaaaggatttctgagcaaagcgccctccaaaaggttggggtgcagcgcggacggagaacg

SEQ ID NO: 95328 - DNA, 411 bp, Heterodera glycines
  misc_feature (210)..(210): n is a, c, g, or t
  SCN-specific regions: Sequence locations=1-253,275-411
attccatggaaattgattcgcacccatccgcagcagttcagcccgaaccggcaccaattgagcaccaacagcaaaataacacgagaattttgccaaaatcgaaaaaatggtggaaaaaagcactgaacattaggccgatggccaacagcagcacaaagcccaggtcaagttgggagcgcaaaatgcagaaaaaggggcaaccgccaccantgccggggcggtggaaggcgaaaatccggcaaacggttgccaaaacaaaaggaacaccggggccagggggttaaagggaccgccagccagcccgaaaaaaccaattaacgggaaggttaaaatttttccaagtgatccccaaaccgggcaaagttgtaaaggggtgaaaacccccactcttttggcgaacaattgtcaaat

SEQ ID NO: 95329 - DNA, 780 bp, Heterodera glycines
  SCN-specific regions: Sequence locations=1-264,286-408,430-780
attttgttttatttattgcttctcaatttgttaaattttattcaacgcggttatcttatgtccgaaaaggacgtcccacttgccttttcgggaccggtcaaattcgtcagcaacgcgctcgccggaggcaccgcggcggttgtcacaaaaacggtgattgcacccattgagcgggtcaaattgctgttgcaggctcaggacgcgtcggcacatatcactgcggacaaacgctacaaaggcatcgtcgacgtcctcgtccgtgtgcccaaagagcagggcttcctggcattttggcgtggcaattttccgagcattgttcgctattttccttcacaggcgttgaattttgcgttcaacgatttgtacaaaggcattttgagcaaaaattcctcctcaaaaaatggtcaatttttggggagttttgccagcggtgccgccgccggtgccacctcttcgctgttcacttattggctggactttgcgcggactcggctcgctttggacattggcaggtcccgtgaatcgcgcgagttcactggtctcgccgatcttttcgccaaaatttggcgttccgacggacttttcggcctctaccgcgggttcagcgtgtccatttgggcgtccatcatttaccgcgcctgttatttcgggtttttcgacaaggccaaggcgtacgcgtcgtcggacggcaaacggccgttgtcttttctcgagagatggctaattgcgcagggagtcacaatggcctccggaatgttggcctatccgttggacaccgtc

SEQ ID NO: 95330 - DNA, 408 bp, Heterodera glycines
  SCN-specific regions: Sequence locations=1-408
ccactattgagattttcttgctaaatttgtgccgaataaacgcaccttgggaatattttaccggattaaataaaaaaaaagatggccgagacaattaaggatgccacccatcgcatgggccgaatgcttccggcagaggctggcccgcgttatgggctttacgcggcactggcggcaattgccggattggcctattgttaccgcgaccgtcttggatttaaaaagtgaatggacggacggcggaacggattggtcacccaccattttgatgagagagggggcaattttgaattcggattgttccaaggtccacaaattttatggccaatggtcggatcttttttcatttgatgctttttggtttcttttcactgtaaaataaatactatttcaataaaaaaaaaaaaa

SEQ ID NO: 95331 - DNA, 447 bp, Heterodera glycines
  SCN-specific regions: Sequence locations=1-60,83-126,151-447
agagcattaaaaatggcttcaaaaaaagccgatgaaaatgatgagcctgaaggttccgagggttctccaaccaacaaaaaccggtgggacgcggatgcggccaatttggaaaaggtgaccgatttccatgaagaaaaagatgagatgaacgaaatatcgaaggaatcgttgggcaatttgaaagcgcagcccggcgaaaagcgattcagcgtaaggaaggaggacgtgcaggcgattgttgacgacttggaagtgtccagaataatcgccgagaagaagctgatacagcacgaaggaaatctgaaagcggcactgctcgaccttatgggcttcgcggagaacaaccagtgaatggcgtcatacctaaatatatttctgtcaccaatttattgtttaaatcctttatcagcgattatcgtaaataaatacgatggcgcgaatgactaa

SEQ ID NO: 95332 - DNA, 396 bp, Heterodera glycines
  SCN-specific regions: Sequence locations=1-48,70-396
ccgcattcaaatttaaattttcatttccatccttaaaaaaaaattcaaaatgaaaagccttactcaaattaccccaattattctcccaatatttttgttactcttggttttatcaccaccaaacgcaatcggccaagatttgtgccaatgggacagcggcaaatgctttgaccgagggtgtccatatggttgtccatatgacacggaaccagaatgtggttgtacttcaccaaagcatgacgccggcaagaagcaaaccaattagcctagaagccgagaactaaacaaattaacagaaaaaaggcttgaaggagggacgcaggatgaatatttgtctaaaaatgaaatacatggattaattaatgtattatttaatgatttaatccgaaaatgata

SEQ ID NO: 95333 - DNA, 483 bp, Heterodera glycines
  SCN-specific regions: Sequence locations=1-483
atttacggcgtgtgcctaacggcactgcctggtccccttgtacccctaaaaattgacttttttaatccccccccccccccgaagccaaggtctgggctacgctcttggttggtttcaattggtttcgtttctctcattctccgatgcttaggtcggaagttcgtccgttccgaatgctgaagtcacaaatgtcgcaagtacttccgtcgatgttgaccaaaacaaagacaaaaaccgagtggcccagcagcctttcttcggtcggcggcgacgtgtcgtcagcgcttttgagaagatcgttttccgctcggctaattccggcctcaccattctcatgcccagggaccaccccgatttggcggcggcctttcgaattgcttccgagacgtactcccacgggtacaacactgccaacgcgtcaaaggcgttggaccgattcgtcaagcgcaaattgctttgcgtcgagcaaatgcaatgtttggc

SEQ ID NO: 95334 - DNA, 1170 bp, Heterodera glycines
  SCN-specific regions: Sequence locations=1-55,79-382,407-816,838-1170
ccgaggcgagggcggttttctgattaataacgaaggggaacgcttcatggaacgctacgccccggtggcgaaggacctcgcctctcgggacgtcgtctcccggtcgatgaccatcgaaataatggagggacggggagtcggacctctcaaggatcacattttccttcaacttcaccatttgcctcctgaacagctcgcacaacgtttgcctggcatttctgaaacagctagaatcttctctggcgttgacgtcaccaaagaaccgatccccgtgttgccgactgtccattacaatatggggggaacaccgaccaattacgaaggacaagtgatcagattctccaacgacaaaggcgaccaagtcgttcccggtctttgggctgccggccaatgtgcggcacattccgtccacggagccaaccgactgggcgccaattcactgcttgacttggtcattttcggtcgcgcatgtgccattagcattttgtccgccaatacacccggcgattcgctgcctcctttggaaacggatgccggagagtcttccattgccaatttggacgacttgagaaatgccagtggtgacgtgtcaaccgcggaccttcagctctaattaccctgcgtacaatgcaaaaacatgctccgtgctgttcaaaacgcccaccattgcttcaagaaggaattgaaaaaggtcgaagtctcttcggactacaaaaacgcccttcgcgtgtcggaccgccgattgattaagaattcctacctagttgaaacgttggaactgcataatctgctcattaatgccctccaaacaatcgtcgctgctgagaacagaagagagtcgcgcggtgctcacgcccgggaagactttccggttcgggtcgatgagttcgattacacgaagccaacagaaggacaatcgaagaagaaattggaggagcattggcggaagcacagcataatttaccaaaatgtggagaacggagcggtgactttggagtacaggccggtcatcgacacgacgttggacaagtcggagaccgattgggttccgccgaaaattcgctcctattagaagcaataatgacaaattgcaatccaattttgttttaccgtatttagctggttgtttcaattcgattggctttatgattaggtcttcaccgcaatttt

SEQ ID NO: 95335 - DNA, 497 bp, Heterodera glycines
  SCN-specific regions: Sequence locations=1-9,31-497
atttttaagccaaatatttaaaatggaaaatatcgaaattacgcacgaatggagcggccaacaatgggattggcccctgcagcataatgacggggtggtgaaggttcacaacactccggaaaaatgggaagttgggttggacgtggcattcttcacgccaaacgaaattgaggtgaaagtggtcgcggaccatctgaacatccattgcaaacacgaggctcggagcgatgtgcacggctcagtgagtcgagagattaaccgctcgtataaattgccgaacgatgtgaacacaggcacaatcaaatcgcatttgactcagaacggcgttcttcgcgtctctgcgcagaaaaaatgagaggaaatggcgaaccatggaagaagagaagagacaaagtgttctgtttcacaaccaataataatcctgtttatttactttgctttttacttttgtaatttatcgccgtttcgcgaataattaaaaattgcgtccatcaaaa

SEQ ID NO: 95336 - DNA, 509 bp, Heterodera glycines
  SCN-specific regions: Sequence locations=1-509
gtttgaggtaattgcatttacaattgtaatataaatgtcttatgcttttgttcgacaaccgcacaaaaattcggtgtgccttatgggatggccaacgacaaattcggtgattatcagacaaaggcacggcgctgaaactgaacaggcgcgcatttattggccaggaagtgggctcagaacgaagagcgaaattgaggaggagtttaaatgtgcccgcgacggcaaatacccagaagagaatttggaagattggtcaatcacaggcaaacggagtttgactcagaaggcgcttttccattacacggaccgtcgggcgggcaaaggctattccgactttgccaccaccctttactacggtcgcccttacatttggccgcccgttcgcgaaattaaccgatggcactttttcatttgtgtgacctttgccctggttattctcgtcgactgcaaatggtttgtttcgtccttcgaattgtttcgtccgcccaaatcggaagccgcgactttgg

SEQ ID NO: 95337 - DNA, 634 bp, Heterodera glycines
  SCN-specific regions: Sequence locations=1-634
attgttacaaaaatgctttcttcttccgcctgctgtactctgttggccgcgctcatttcggcggcgtttttcgccgcggctaacccaccaacggtgaagcagtgcttgtgctccgaaattcagccctgcacccaaaagtacatgaacacgtggaaggcgtgcatggagcagtgtaagggccatctgtccggcgtgggtggcaacgtggacaaattgggccactgcatggacagcaactcggcactcctccaattgtacaatcaaatgcacccaatcgcatagccaaacggcatgtgccaaatcggcggcatcagctaaacaggtgccaaagcgataccctgaaacgttggaaattgctacaatcagtgagatcaatcggatggtcaacagcatgggcatcgaaggcgcaatgaaaggtttgatggatgccggcaaaaaaatgtacggctgcacgagcaaatgcatgaacagcaaggcgggcaactgcgagaagtcgttcaagtgcggcttggactacccgccggacaacgtggcggtacaggaagtgaagaagtgcgccctcaacagcggactgaacaccgccaacgcgcaagcgctgtgcaaatgcgcgtccgccgcgggcgttaaaaatttg

SEQ ID NO: 95338 - DNA, 917 bp, Heterodera glycines
  SCN-specific regions: Sequence locations=1-697,720-866,888-917
gttacaaaaatgctttcttcttccgcctgctgtactctgttggccgccctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccagtcgaccatcagatgcacccaatcgcatggggacgagtcatgtgccaaatcgccggccgcggttaagcaggtgccaaagcgatacccggaaacgttggaaattgcaacaatcagtgagatcaaccggatgatcaacggcatgggcctcgaaggcgcaatgaaaggtttgatggatgccggcaagaaagcgttcggctgtacgcgcaaatgcatgaacaccaaggcgggcaactgcgagaagacactcaagtgcggcttggacttcccgccggacaacgtggcggtgcaggaagtgaagaggtgcgccctcaacagcggactgaacaccgccaacgcgcaagcgctgtgcaaatgcgcgtccgccgcgggcgttaagaatttgacgccagccatctgcgcaaaggtcaaagtcacctaaacaagttcatgtcgtccgggcgctgctgatgactgactgatcagtgtagtaacagagagatgagcaattttagtgatcgattgaccgaaatcccccaaaatgttttgacaccggtgattgatcgatagttatcatttatcattttggtggtcccttccaccccatttgtttcccatgacatcacctttttcaatttaacacaaagcatttttctcttttcactggcaaaattgctttttcttatctgtagt

SEQ ID NO: 95339 - DNA, 575 bp, Heterodera glycines
  SCN-specific regions: Sequence locations=1-123,145-178,200-404,426-575
cctgattacgccaagcttcgaaattttccctcactaaagggaacaaaagctggagctccccgcggtggcggccgctctagaactagtggatcccccgggctgcaggaattcggcacgaggaaagcttttaaatttttcttcactgctttcttagtcagtttgttatcagttgctctccatttttattttgacaacaaaacaatttttcccgctaaatttggcgaacgatggcttcttctcattgcgcacccggatgatgaaacgatgttttttggaccaactctgttgttcctttcatctatcggtgttcaattgcatttgttgtgcattacgtcggggaattctgagggacttggaacgattaggcgaaatgaattgtattcgtctgcttctgtttatggcatccaacccaaatacatctcttttgtggatccagaagagcgaagattcccggatggttttcgcgattggaatatcaccagcctttctgcgctgatttactcttacattcgacggctgaaacccgatggactgatcacttttgacgaatggggcatcagtggacatccaaacca

SEQ ID NO: 95340 - DNA, 635 bp, Heterodera glycines
  SCN-specific regions: Sequence locations=1-60,82-459,484-635
gtttgagtaaaattcttgcatttttttcgtctctacctaatcatgaatcgtggacggaacaatcaaaattatttaattcatggaattagcaaatactggcaagtcgtcggcgctctgggtctgtgcgttgttatggtatgcatcacttatcaattgtttctgcacgtggacgaaaagcacaaatcgttcaaactgatgatcagtggacatttcaacgatatcaagcaaatcaacaacgatttcacggcgtggtcaaaaaatttcacatcgcatctcaatgagcgtttcgaacagcaacaggctcgatcaagggctcgtttcaaacaacagttggcgaattttgtcaaaatccgtttggattttgataaacaatttcaaaaaacaatgtaccgttttgccgaagttgagttggaaaccgtgctgaataaaagcaaagcctccggcggtggctgacattgacgtttgtttgttggttgttttttgccgctcaatgtgatctcctccgacttttggacttcaaaatttttgccccgttttgtgggaaattggattatttacattggtttttctttgttgctttgccagtgactgtttttttgtttgatgcgcaaacgaccacattattttgcacaaaa

SEQ ID NO: 95341 - DNA, 479 bp, Heterodera glycines
  SCN-specific regions: Sequence locations=1-188,210-400,434-479
ccagtcgggagtattattttgtgattgttggtcgtcaggaccaacctctgttcgagatggacttcccgccaaagaagcgcgagcagcagcaggagacgcaccatttgctgcagttcatcgcgcacgccgcgctggacattgtggacgagcagacacttcgcgagacgcaaatgtattttaagattgtagacaagttcaacgaatggtttgtgtcggcatttgttactgccagtagaattcgctttttgatgttgcacacgcaaaaaaatgaagacggaatcaaacaattcttccaggaaatttatgagatgtacatcaaattctcgatgaaccctttctatcgacaagacactccgatcagatcgccaagttttgagcaaaaagcggcgatgtatggacggaagtttttaggggtttaaaaaagaccttggaaatttaagtttttgttgccatcagatttgtgtattttttgcattaca

SEQ ID NO: 95342 - DNA, 624 bp, Heterodera glycines
  SCN-specific regions: Sequence locations=1-624
ctttgctcactccttccgtggcttcttcttcggggtgttcttccttcacaattaacagcttcacccaaaatttggcctctgttctctctgacaccaaacggtcaaaggccgaagtcgcggctttctttactcgccattggggcgagcaattcgtgccacagaaaaccctttgctcagcaccgaccattcccaaaatttccttggagcatttccggcattatttggacaacacagcgaagaaacaccgtcaatatttgcgagtgcgaaaaacacttcagcggagcaatggccatctcatcggtgagcaaatcgcaccggatgaaatcccttcgattttcttctcctccgccttttcataccgtgactcggctacttttgaagcagttttccttgagccccgtcaaggggaggccgacaaaatcatttccggggccgagcaaagacggggggccgtgggtattggttcactttatcgtcccgcgagttgtggctcgttgagttcgatgcaaagtgtgcaaatgagcattgctcctgctgccgaggcttgtcacgggcgaatgttccgcggatgccatcggctccaaatgcgcctcgagcactttgatgatacggtcggaatgctgc

SEQ ID NO: 95343 - DNA, 475 bp, Heterodera glycines
  SCN-specific regions: Sequence locations=1-7,29-475
gtttgagaaatggcttcttctgctgctggatttgccattgtcaccggtgccaacaccggcctcggcttgcattttgttaaatccctatatgcttccggcacttattccgccattgtgttggcctgtcgaagtgaacagcgcgcgaagagcgcaattgaacaaatttgctgtggccaatcatcgccggcggaaaatggcaacggcacccaaacaaaattagaatttgcgaagttggatttgacctgcaatgattcggtccgcactttcgtctcccaactcgacgagcgtccctatcaaaagggcagtttgcgattgctcgtcaacaatgccggcattatgggccatccctttcaattggtcgacggcgttgaggtgcatttcgcctccaaccatttgggtcattttctgctcacaaatttgctgatcaaacacaattggttggcttccgacgcgcgcattttgctggtcacttccg

SEQ ID NO: 95344 - DNA, 347 bp, Heterodera glycines
  SCN-specific regions: Sequence locations=1-347
ttgtgccgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggagtgtgagctgcagcaatttcgcgtggtgcaaccgacgaacaaattgcctgacaccgaaccgaagttcaaatcatcttaaaccgattgatttcatgaaaaattttgttttttaattaggaaaataaaataaaactaaaa

SEQ ID NO: 95345 - DNA, 658 bp, Heterodera glycines
  SCN-specific regions: Sequence locations=1-267,291-440,462-658
ttgagtttttttattttattcttttcttgccaaaaatggtcgacgttccggctgattttgctgttctgctaaactccgcgccgccaattagccgaattgagtcaaacaaaatgcattggctgcgaaaacggcaacagacaaatgcgacggcattgcaacgcggcatcgatcagattggccaactcgcgacggagagtcgaggtttgaagcgtccggtgaccagttttgcgcgttttgcggattctcccgacgaacaggcgctgtatttgctgtgggaaccactcacttcggaccaaccgacggcaaacggagggccgtcctcacggatttatggatatttaaaagtcgtccgggaccgacgattgtatttggtggacggagaagggcgacagttcgtcacgacgcccctttgtgttttggactttttcattcaccaatccgtccaacatcagggcaaaggcgcccaattgttcagagcaatgctaaaggctgagggcgatttgggggcccatcgctgtgcctttgataagccatccgacgtatttctccactttttggctcggcattttggcctcgaaaggcccctttggcagccaaattcttttgttgttttcccctcattttttgagggcattaagccagaaaaagtgtcttctgc

SEQ ID NO: 95346 - DNA, 731 bp, Heterodera glycines
  SCN-specific regions: Sequence locations=1-269,291-731
caagtttgagttaaaaattatggaaaaaagtgccaacaatttttcgaaaatattgtggacacaaaatgagcatcgtttccaacaaatttgtgctctcccatttattcgtgaacaaaaagatgggacacttgctgaggaacgctatcgccactacataatacaagacacactgttccctggagggattaagcagtgccatcgctgtggccgcttcaaaggccactgatcacccaaaagggcacgagcgtgccatgcttttgctgtcccatggcattgccattttggacaccgagttggacttgcacgatggcattctgcgcaagttgggcctggtcagtcgtagtgaagtgcacatgaactacgaccaatcgccagtgtgtcatcattatgtgtcctttctggcagcaacggcatcacagcaatctttgccggtgattgtcgcgtcaatgttgccctgctattggctctaccgcgaagtggccaaatggatgttggcagaacgccaaaaagccggcggcacaaacaccgtaactcagtaccacgaatggattgacatgtactgtagtgaagagtatgccgaggcggtggacgaaatgttggcacttgcggatgaattatcgcaagaagcggatcagcggacgctcgcgaaaatggccaccgtttttgagcgcagcttccaactggaatggatgttctggaagtccgcctatcaaatgtgccaatggggaatt

SEQ ID NO: 95347 - DNA, 1337 bp, Heterodera glycines
  SCN-specific regions: Sequence locations=1-334,358-642,664-996,1018 -1337
gtttcccttaaggctggaggggatttgtccgttgggtgccaatggccggggtcgaaagatgagtacgaacttcaggacgcaattggagttggtgccactgcgactgtgtttaaggcattctgcaagtcgaagaacgaaatgtgcgccataaaaagcataaatttggaaaagtgtcagacttcggtggacgaattgtcgcatgaaatacaggcgatgtcgctgtgttcgcatccaaatgtcgtcaattactacacttcctttgtcgtcggggaggaactttgggtggtgatgcgtttgttgaactgtggttcaatgttggacatattgaagagaaaaataaaggcaattggcaaagaccaggcggcctacggagtgctcgacgaagtgataattgcgacagttcttaaggaagtcctccggggcctcgagtacttccataattctggccaaatacacagggacatcaaagcgggcaacattttgttggccaacgatgggaccgtgcaaatcgctgacttcggagtgtccggttggctggcggccagtgggggagacctttcccgacagaaagttcggcacactttcgtcggcactccctgttggatggcccccgaagtgatggagcaggtgtccggttaccgatttcaaagcggacatttggagctttggcattctgtgcattgagctcgccacaggcaccgccccttaccatcgctaccccccaatgaaagtgctgatgctgacccttcagaatgacccgccttcgcttgagacgaacgccgaccgaaaggagcagtacaaagcatacgggaagagcttcagaactgtgataaaggactgtctgcagaaagacccgtccaagcggcccactgcttcggaacttctcaaatactcctttttcaaaaaggccaaggacaaaagttggctggtccattcgctgattgagaatctcggctcggctccatcaatcccaaccattcccaaaaaggttgcaagtggcaagctgaagaaggacaaggatggaaattgggagttcgaatatgacacttcggacgaggaaaattcgtcggaccccgaaaatgcgaccattcagcaaagcgcaagtggggaaagaccaactgtctccagggcatcgagcgaaggcaaaggggaggaacaaatgccgccgcttcaaacactgaacttggttttgcgggttcggaaccagcaaagggaactgaacgacatcaaattcgactactctccgaatgcggacagtgtggacggaattgctcacgaactcgtcaccgccgaactcatagatggccatgatctcgtcgtagtcgcggccaaccttc

SEQ ID NO: 95348 - DNA, 481 bp, Heterodera glycines
  SCN-specific regions: Sequence locations=1-1,23-86,108-164,186-481
cttgggcaagcaaatgttgaattgttttctggacaatgactcaccatttaaattttgatcaatttctccaagttcatgagccccaattgttggcttctggtttgcctgaactgttctggaaatccttatacaaaaagatatccaatcagattttcgatgcaggaaaatattttgaggttatcatcgaagaaagcgaaccgaatgaaacaatttcatcgcaagtcaaagctatgagcgaattgaaaatggacgacccggaaaatgtttttctcattgaccatgcgtggactttccgtccgaatacagcacgttttgcacttcaacaagttgacggactgaggaagagattattggacatgttcaatatcaaagcttggtatgccaacaaagaatgtttaaaggacccttttgctgatgatagcgcagaccaacagcaaaagtgtgctgatgccgtagccactcattccgctgattgtgagga

SEQ ID NO: 95349 - DNA, 503 bp, Heterodera glycines
  SCN-specific regions: Sequence locations=1-11,33-132,154-480,502-503
gtccatttaagattaattcatattcattttgtttcttggaacaccttatttttcaatcaatcgccttaaatgatctcctgtcgtcgttcggtcagcaaatgtttgctgccacaaattacgaatcggttgacttccaattttggccatcttcagccgtgctgctcatcccaaaaggtgccaatgtgtgcgtccgcttccaatcgttcttccgtgcgtctttcagccattttcccacgaatgctttcgtcttccgttggtgacaaatcacatgagcggccccaaatgtaccaacttgaacacattcagaaacggttggaatatacggtcccgctgatgttcaacgcacgtctcgactacactttctacaccaaagatgtctttgtggacaatcaaattctcgggagtcaactcagaagcttggaagggtttatgcatcacatttctctgatcactgtcgccgctcaattttgttgcacgcatatcgaaacgcaaattttgaacat

SEQ ID NO: 95350 - DNA, 614 bp, Heterodera glycines
  misc_feature (608)..(608): n is a, c, g, or t
  SCN-specific regions: Sequence locations=1-2,24-614
gtccaattaaggaaacccaattatgacgagctcccaacccattatttatgagaaaattgtgcaacaaaatggtagcaaaaacagcgctgaatggtgtctggcctcggaacggcgactgctccaaaaactgatccatcataagccggtggggatcaatcggcacttcaacctcaacttgttggtcatttacatgaacaacattttcgactttgaggaggacattaactttgatgactatctgagcgaaaaggatgttgaacagttgaagaggcggcgtatggagggcaagcaggacgagcgaaggccaatggcattttcaccgtcctacgcaattcgaccgaccacgaaacaggttgaagaaaagttgaacgaatacttcgacatggagctgatcggggagaacgagtccccctctgaagaattggaaaagaaagctgtttttgaactgccccaagagtaccaattcaaggaggaaatggtcccacgataaatccatcacatttttggcatttaatacaatttttttacgtaataaccaaatcctttggtttctatcgaaattttctgtaaatgtgtaaaaaaatggcataaaaatacatagggaaaanaaaaaa

SEQ ID NO: 95351 - DNA, 399 bp, Heterodera glycines
  SCN-specific regions: Sequence locations=1-399
ctgaaatttaatctatcatttgccatttgctgtaaaaaattgaatttttacaaaaaaagcgatggcagaagtgaaaaaggagcccatttttacggaagtgaagaaggagccaatttttgcagcggagacgccagcagccgagccgagaagggacagcgccgtgtcaacaatgccacccgactttgacgacgtcaccgcagtgattgagggcgttttgcgcgagacgcgggaccgtttccaggcgatggccgaccaaatcattcaccgcattgacgagatgacccagcgggtggacagcctggagaagaacatcaccgaaatgatggcctccgactcggcgctcgtggcgagcaccagcggaacagtggacgaggacaaccaatgatggacgacggagac

SEQ ID NO: 95352 - DNA, 578 bp, Heterodera glycines
  SCN-specific regions: Sequence locations=1-578
gtttgagagccaattcaactccaaaagccgaaaatgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcgacaaactgcggccagcaaggagccccagtatttgttcgccggtcaaacggcatggaccacggacggaaaagaccgctttggccatgccgagttggacttcgccactggcacaatgaccatccccaacttctccgagaacgacttgggctcctacaccttcccgcttgagcagcccaacttcagcgcagtgaatgggcccaacggatgcgagctgcagggtgtcggcgggacgatgttggatctgatcaaaaaagaatgagcgaagaacagcgactgatcggagggaagagaagaatggtgctaacgccggaatgacactcttttcaattgcattttaagcatttagcattaattaacactttggcatttgataatccagggataaagaacggacaaatc

SEQ ID NO: 95353 - DNA, 499 bp, Heterodera glycines
  SCN-specific regions: Sequence locations=1-499
ttaagtccaattctttctctttgtctcgtccaatcatctttgccaatgtttgtccgttgtttcattttgcctttcatttctttgacattttttgtgtccttttgcacggcaatgagaagaaatccatcggattatgatcagtcacgggtgccgtccaatctgaggataatttcatggcttctcggcgtttggcgttcagagcatgacggcaaagcgatgtttcccaccatcccaaaattcacttacggcgaagaaatttcaattgcactttcggacacgcgaatgaacggactgccggcatttaattactctgcatttgcctggtcagcacatgaccaagacgagttgcacagtgaaaacggttacattaccgtatcaggcggaaaagtgatgctcactaccgtaatgaacaacggatttgtcaccgtcgaagagggccccgccggtggctcacgaatccgcttcaaactcgtggacattggccgtatcagtttcagcc

SEQ ID NO: 95354 - DNA, 546 bp, Heterodera glycines
  SCN-specific regions: Sequence locations=1-44,69-317,339-546
gttcgtagaagagttccgttattcaagtgaagcaaattattagttcaagtcgaaatggctgagtctgagatggaaataccggatacgatgggcgaacgtatggaaaagcacaagaattcaggccagccgatgatgttgcaccccgaccacccggacaattgggaccctcgttatcacgaaaaggcggcgcatcttctctggtcagctccatatgatgcacgttatccacaagtacggaagcagcgtcagtgtttcgaatattatgtggatttctttcgctgcaaggagctgatgggcgaagactacaaaccgtgcaaattcttccagaatgtctacaaagacatttgcccatcattttggaccgagaaatgggatgagctccgtgaggagggacgttttcctgcgaagttcgaccgttaaattttcggcgattatttaggacacttttgatgtgatggtgacattcattgttagttgtattcattaatacaaattcgtgtgtcaataaattggcgatgtaaattaaagaatggaattttaaaaaaa

SEQ ID NO: 95355 - DNA, 470 bp, Heterodera glycines
  SCN-specific regions: Sequence locations=1-432,458-470
cttgtgttgaaggcaagtaacaaaaatatcaacaccaaacagcagcagagtaaggattcgacgtttcagaaatggaccaaacacccgttgaagatcggtctgttgagctatgttccgatgacgacgaaacaaagcgaaaagtcgaaaccgattctgaggattactttatggtggaaaaacaattgagagaacgtcgtgttggaatacaaaatttctcttcgatggttttgtttgaccggaaagcgaagcagcgacaaaaaatggcagaaaagcggaggaaagagcgaaacaatgcgaaattgatactctatggtcgtccccgcaaaacgaaacaatgctcttcagttttttcaaaggaagactttgcgcaaattggaaagaaagatggcagttcagcaaacgaacgcattaaacgaattcgataaaatacttctttttgtttcgtttttattttaataaattacttttcc

SEQ ID NO: 95356 - DNA, 459 bp, Heterodera glycines
  SCN-specific regions: Sequence locations=1-162,186-459
gtccaataaggcttttaatttatcctttattcaaacataaatcatggccgattcttctaaggtccctggcggtggcaaagtcgtcccacgctctgctgctggcggtggcttaagacaacggcgagctggtggggcggcaaacactggtcgtactcgaactgctggcggaggagggggcggaggaatgaacagcggcggactgtggcgcttttatactgaggactcgaccgggttgaaaattggacctgttcccgtgttggtcatgtcgttggtgttcatcgcttctgtgttcgtcctccacatttggggaaaatacagtcggactcattgaattctcactttgccgattcattcggtctatcggcaaaaatgcgattttattcatagtttttacaaatcacttccatttaatggaatatttgttttgtatgtaattctgataaagtctttgttataaaa

SEQ ID NO: 95357 - DNA, 306 bp, Heterodera glycines
  SCN-specific regions: Sequence locations=1-177,200-270,299-306
gaacagcgcgagtacatctgcgacaaatatgccgattatgtgctgccacttgaggaggccgactggtacgggttggagctgaacacggcgtgccgaaaactgcaggacctcgaggacaacacgagggcacagccgatgaaatacgcatttgagaaggaattgatggcacaattgcaaagggaggcggcggcggacggcaccgaaaagcaaagacagcccaccaaacttgttggatgaggacaattaagaattacgccctgcaattgtgtgtatttttttaaattgaaattaaatttttgtttggtt

SEQ ID NO: 95358 - DNA, 255 bp, Heterodera glycines
  SCN-specific regions: Sequence locations=1-255
atttggaactgtccgaatgcattcccttcgatttgtttcatcaacaactcattttcatgctccgttcctctctttcaaaacagcaacgaaacattttcaacgcattgaaaagttcagcggcggtgagaaatttcctcgtcgatttttatttgaataatgtcgactgattggattgtccttttcgacctcacaatcagccttaacattgcacttcacgttaatatttttcttattaattaatacacgtttacgttg

SEQ ID NO: 95359 - DNA, 431 bp, Heterodera glycines
  SCN-specific regions: Sequence locations=1-291,313-404,430-431
tacaaggaagagatgcttatatttcaagatatggtcatcgacgtgccttacaccgagttgaaccactcggccttttgggtggaattcatcgttcgtcaccaggaagttccccacgcccgctcgggtgcggacgacctgaatattttccagtacttcctcgttgatgtgatccttttcctagtcggcctctcactgctcgtcctttaccttttcattcttttgctcaaattattcttccgtctgatcatctttttgatcaaatggcctttttccgccggttggggcgctaacaaagagaaaaaagggacaaaacacgcaatggctaagaagagagactgatcgacataagcaaattcacttaaaaccgagctgctgactgatttaactggccgtttttgctgagccaatttttaaataaatttttagtttcc

SEQ ID NO: 95360 - DNA, 420 bp, Heterodera glycines
  SCN-specific regions: Sequence locations=1-131,154-420
taagattttattttccatttgtgatgcgttatctgttgagaattaggaattataattttctcacaaagatcggcaaaagcagtgttgtccaatcgcaagaatcccctccatcgcttcttacggattcaaagccctttaaaaaagtgctcaattctgccgtccaatattacgaggaatgtattggcctggtagaagtccacaaagcccgcgacgaagtcaaccgatgcgaaaacaatttgtttttggcacaacaggcgagaagagaaaaacagggcgaaataaagtcattgcaaaaccgattgaaagacattcacagcgaattggacagaactcagcgaggcgaagacaggtatctccatctgctcacagaagaacacgcggcaatcaaaagtgagagggaattgctttcgtcctttgaac

SEQ ID NO: 95361 - DNA, 507 bp, Heterodera glycines
  SCN-specific regions: Sequence locations=1-47,69-108,131-386,408-507
acaaatttcgtggtgccatggcgtttcaacggatttaatgcaaatcgacgaacaacaacagcagcaaatggctgctgccaatgagtgctgcttcatatatccgttcccggcttctgggctgtcctcccgccaactgatgcgtgtcctctccgcttggctgatgccgtctttctccgccgacgaggagggcccgtcgatgaacgtgccctcctgcttttccgatattgactcctcgtttgaatgcgcttcattttctgtacccatggtcttctcccacgacgaatggtttgtccaatgtgtgcccgccctgtgcgaacagcttgacaaacttttgctcctgtcccaacaccagcgggaagaggaaggaaactcatgcctccaacaacgacggaatacggacgacgacggggagtgtcatgtgcgacgggtgctgcgccatttgctcgcgttgaccacccgaattccgatgcggacacggcccaggactgaaatgggacttttcattgc

SEQ ID NO: 95362 - DNA, 1044 bp, Heterodera glycines
  SCN-specific regions: Sequence locations=1-947,969-1044
caattaagctggtgcttcttttaatgtctgaaaacatgggtgctatttttgagaacattgctttgcatgactttgtcgtgaaagaagtgataaacagtttcccggacaaaaagagcatttttcttttacttgcgaaatccgatgagaaggctttgctcatctgcaacaaacaagcttttgaagaggaagtggcaaatgtttccgattggttggtcaaatcgaaattgcgttacattgattcaaatgatcgttttggaaactttgaaatggcattgccttctgaatccaatcaaatcaaagtcacgttcatttatccggctaccgaatgggacattgagaaatattcgcgtcagacgccgttcttcatttatgagacgccggaagactacaaaaatatcactttgaattatctttcggagattgactacgttaaacaactcaaatgggtttacaattttttggagaagaaaagtgagtcggagcgaattgtttttgaggatgaagacaaacagaatggttttgttcttgcgcccgatttgaaatggaacgggactaatgtggatgatctttatttgttggcaattgcacatcgccatggcttgcgttcagtgagggacttgactccagacgatttgcctcttcttgagaacattcgtgaccaatcagccaaattaatcaagacgaaatacggattggatcagaatcaactgaagatgtacttccactaccagccgactttctaccatctccacgtgcacattgtgactctgaagtacgatgccccgggttggggaggcacttcgattctgctgcaaagcgtcattgacaacatcaaaaattatcccaacttctacaaaaatgctactttgcccttcatcggaaaggaaaagcattcccttaccaagaaattctttgaggctgggcgtgtttgaattttgaataccgattttgtattttgttgttacttttgataatttgacgatgaaaatctcactgaatgactgtttttattgttgttttactacggattaaacttgaaaatta

SEQ ID NO: 95363 - DNA, 326 bp, Heterodera glycines
  SCN-specific regions: Sequence locations=1-91,114-295,323-326
ttcattcttgattatgtctatgctcgatgggagcggggatagttgttttggggcgggagctcttgtcggatttggtattcggtattttggcgcaggacccacagcagccacagcggacgaaactgatgaatttccggagaacgaagttatcgatgaggggccgaacaacaacgggcagccgccgaatcctcaccatccgctgccttttaacgaggagagtgattaagaaaaacattgtgacatttaattagcgtattataaaatttgatttatgttgttttttgaataaattattgagtttaaaaaattgaagaaaataacacaat

SEQ ID NO: 95364 - DNA, 476 bp, Heterodera glycines
  SCN-specific regions: Sequence locations=1-224,246-476
ggttcgaccaccgccaacacccgcacgacaatttcttctgctgatgtttctaaggctggcaaagtgacagacaaaggcggcgattcagacgacgaagcggccgaagaatttgttccgacgggcacttttaagccgattgttccgttgccctcaaaagtcgatgtgaaaagcggcgaagaaaatgaggaggttcttttcagtgctcgttgtaaattgtttcgctacgacccaatggacaaaaagaacaaagaacggggaattggggagcttaaactgttgcacaacaaagagacgggccgttatcgctgcgtcattcgcagtgatgaccaactttgcaaattgttcgctaattttcccgtcttggccacaatgataagccgtatcactggtcagaagccgaacgttcgaactttgcagtgccgagacttcagcgaaagctccgagggaattgacgaagtgtttttgcttaaatttcg

SEQ ID NO: 95365 - DNA, 1688 bp, Heterodera glycines
  SCN-specific regions: Sequence locations=1-523,546-1325,1347-1688
aattgaatcaacaaaatgtctaccgaccgatatgatattgtgttgtacggtgcttcaggctttactggccaacatgttcttgaatcattcgtaaagaatggtcatttggaccaatttaatttcgccgtcgcgggaagaagtgagaaaaaactcaaacaaacactcgaagacatcgaattcatcactgggaaagttttgaccaaaattccaattatcatcgccgattcgtccgatgctcagcagctcgcagaaatggccaaacaagccaaagttattgtcaatgttgttggaccataccggttgtatggtgaagcggtggtaaaagctgcggttgaaaatggtgcaagtcacgtcgacatttccggcgaaccagcctggattgaagcgatgcaaatgaaatattcggagaaggcaaaagagcagggcgttttcattgtcagtgcctgcgggtgggactctgtaccgtgcgacttgggaatgaattatttgaagcagtacttcaaaggcactctttcgcatgccgaaacatttgctcatattcaaatcggggaagcgggctattccttcaacgccggcacttaccaaacattgattttgggcctttggcaggccaaaaatgatgatcttggaaagatacgacggtcgattatgcccgagaaaatggagaagactaagtggagacctccaaaaagaggaatgttttggtggaacgattcattggacgcttattgccttcctttcatgggtgcggacaaaagcattgtgcaacgatcgcaatatttcgataacattgccgacaaaacataccctgcttcgctcgagacttacattctcgtcaagagttggttttgggctgttgcgcttatgatgtggctgactatcttttatttcgcggtcaaattcgattttacgcgcggtattctgcagaaatacccggggatttgctcggggtatttgttcaaagagactgggccgactcgagttcaagcgcagcaggcttctttcacttattggttcttcgggtggggctgggaacagtcgtcgcctcaacctgacgaagccccgactaaacgaatggttgtccgttgcgatggccccgatgccggctacattggcaccgccggttgcattttgtcatgtgccctgactattctcaaagagcgctcggcaatgccttctgaaggaggagtgttcaccactgcagcggctttcaaaaacactaacatttatgaaacattgtcttccttcggagtcacttttcgcgtcgattcgtccgtgaaagtttagaaactgtgcgatgcacacaaacaccaatatttttaatattttctgctgttattttttatatttgttatcccatcaattggaataagtcttacaattagtctgctcatttgacacttttaattaacgatcattcaattgataatgttagtttctcattgacttaaaaaataaatttgtataaaaaatcacaaagaaaaaattaatcggacgaaatttttgaatccgtcaattgtttcctttagcccgccaactgcttttgtgaagttcaaattactgtcccctgtggggccaggccgaccaaacacattcgaattgtttgaattctttttgtcggaaactgcagacaagcagcacttgtaagcatcgttgcattcgtaattgtcgggacagcgaaagttcac

SEQ ID NO: 95366 - DNA, 578 bp, Heterodera glycines
  SCN-specific regions: Sequence locations=1-308,332-578
atctcaccaaaatcagtcgtctgtgccacttcaacgggctgttgcgtctgtttacaatgctaattcaatttcaacttcgtccagttcaactaaacatgcagtggatttgataaacgaatatctgacaatgctttccgtctgtctctcccatgatgaattgaacaaattcgccattttaatgcgccgttggcgcgcacgtgaaatgccaattttggagttcgcccaaaagctgctcgagctgtatgggccggagaggcggcaccttcttgcacgaatgcgcactttgcttcgcggcgacccttctgacttggaagcactgactgattttcttcgtgccaacggagtggtggagaacgcagcggcaatggccgcgtcgccacttttgaccgcggaaataagtttgggagaggggacggacagtgccaaaagcacggccagttccttgccttcggcaccgcttcatttttcgtcttcgcatggttttccatccgccgattttcaccgacctaattcatcataacctttcctgaataatttacagctgtcaattaatagttaacaataaattttaacattcc

SEQ ID NO: 95367 - DNA, 485 bp, Heterodera glycines
  SCN-specific regions: Sequence locations=1-485
tgatcaaaaatgcgttccatttgtttctgccatttttcggcattttccttttctcgtcaattcttcggtggatgccatcgctctttttcatcaccgatgacgcccttatttttgagcttttctcttctgctaatttattcccagtttgcttctcctacaaatgcatttattctgcaggaattgccattgtaccgtaacgttcgcaatcagcgacatgccactcccccgattggtccgtcaaaaccctccattgactatggaattcgtcgttcgactgtctctatgcctttggtgatcagaattgaggacggaatgccaaccatttttgtgcgtccctcgcgggcatttaatttccacagattgaatcgcttgcaagaattctggcaccgaaatgaagcactgagaagattgacccaaacggggaacagaccatgaaatgatcagcagagaaagaaaaagaaaagaaatcggatgatcagacaaat

SEQ ID NO: 95368 - DNA, 673 bp, Heterodera glycines
  SCN-specific regions: Sequence locations=31-673
cctcgtgccgaattcggcacgaggagtttgaggacatgaacatgtaaatgtttgatttattcaaccaacaatattccacttctcttcctccaaatgtcctcactttgtcagtccgactttcccatgcgtcccattgattccctcaaattctcacttatgaactgcgcttttttctaccgtccgcctttgtcattgcgtgaaaccaccgaactccttgaacatgacggagacttccttgttcaggattccaatggaaccaaattgttgctttctgtgcgtgtttatggcgttgtgtccgaatttcgcataacaattgttcagaatcactctcgccaagtaatcttcgaatttgctggccaatgtttctcctctttggaacatttggtgctcacattttccaacggccgtggcggcaagcactttctgaagactgttgatggcgatgagtttctgctcgtccgtcccatttttagagcattgcacgccggtcgttttgggtacggcgagcgcatggaagtgagtgacagcgtacggaagggcaaatggctgccgagttttgtgcgaaccttgcgacccgaattcgctgctcgcccacagacggagactgacttggaacgactgatcgaattggaccatcgaaatttggtgcgcgtgtgtgactttttcaagcagt

SEQ ID NO: 95369 - DNA, 487 bp, Heterodera glycines
  SCN-specific regions: Sequence locations=1-341,363-487
ccaagtttgagctgtcatcgttttcccttttccatcctttcaattcaattcgatgtcaatcgatgaaattgagcggacaattcctttgccttcgtcccatctcttctctcattcgcaattcgtccgggctgagattcactcttttgaagaagcttttgtccacaacaaacgcttcaaagagttcgaaggattactcaaaacgaatcacaaaacttacgaaagtgtcgaagcgaaattcgacctgcaaaaaatcgaaaaaatgagcactttgacgaatcgactgaacaaattggcggatcatttggggaaaattggccatttgcattttgaaaagggtgagcttaatgcaatggatttggaggagaagccaatgttcgaaattgttcggcttgcggaacaaaaacagcacgaaattgaagaaggacgaaggaatggcaaatcgaaagcggagaaagtgaccgaagcgatggcaaatgaatgattttca

SEQ ID NO: 95370 - DNA, 480 bp, Heterodera glycines
  SCN-specific regions: Sequence locations=1-480
ttctttttcgctgacgcgacttttccccactttggtcttccaccgtcatggtaacattcaactgctgcaaattgcggcttaccatgagaaagtcattgaccattacgaaaacccaagaaatgtgggctctttggacaaaaatgatccgtctgttggtacagggattgtcggggcaccggcttgcggagatgtaatgaaacttcaaatcatggttgacggaaacggacaaataattgacgcaaaattcaagacgtttgggtgtgggtcagcaattgcgagttcttcgttggccactgaatggataaaggggcagaatttggaatatgcgcgcaaaataaagaaccaacaaatcgcaaaggagctttcactgcctccagttaagctgcactgctcgatgttggctcaagacgcaatccaagcagcgctaagcgattatcagaagaagcaagaagctcgcaatgagaaaacttgaacgttgtg

SEQ ID NO: 95371 - DNA, 231 bp, Heterodera glycines
  SCN-specific regions: Sequence locations=1-231
cacgtgtcgctgatctgagcagcaagcagcagcagcagcagcgagtggacgaatttagtgctgggcaaaacagtggaatggcacaaaacgatggaaataatgccaacgaattaatggacaatttaaagctagcagccaatgtatttaaaaaagtgccgattatatttatccgtatttattttttgactgttatgccattgtatatatatgtatgatcataaagtttaaagc

SEQ ID NO: 95372 - DNA, 517 bp, Heterodera glycines
  SCN-specific regions: Sequence locations=1-411,433-517
ctcattgctggtaaaagtgccaatgcctcgtcttctctcttccttcgcctttttcgttttgtcaattatttgttcgattgtcttcttcgaacccatccatggccaggacgtgtgtcgacatcagggcaaagagtaccgaaatggggacgaatggattgtttccaactctttcattatgaattgcatcgtccattacaaccgatgggaaacaaagatcatcgcctgtctgtcaatgttaggcgagagaatccccgtaaacggacagatcagtgatcagcacggagtgtggaaatgcgagcagaagccgaacggaagcacacgattggtgcagcagaagcagtgaagggaggaaaagtgatcagtgatgggagagacgaagcaaagcattgattggcagaggaaaagccatcacagcaaatcaaagactgttccacacactttttaataccctgttaattactcactaattaatgtccattttgaccctggaaaaattagtaaatgcattggttgcttc

SEQ ID NO: 95373 - DNA, 480 bp, Heterodera glycines
  SCN-specific regions: Sequence locations=1-190,212-306,328-480
aatttattctcttacaacatttaaatccgcagaaaatgctctcattgatagtcatcgtttgcttctttgggattgtgccgaatttgtcaaaaccgatcaaactcagaaaccattctccaatgaatgttttgtttatggcctggcccgaggcgcgttatccactggaattgccttttcaccgcgtggattgctttagtgagatggagaggcgacacatcgtgccacaagtcatcacttaccggctggaaaatatcaaaaaactccgtaacgggatatgtttggtacgaatccctacccggagccgagtgactgtcacacagatgaacacaaacaatgttaaaagttatgtgaaattcatcgctggttccacgcagctaagcatgccactgcatactgatcatattcattccggccaacacgaaaaatttgggccatggcatatgccgtgccgttacgcctacattgtgttccgctcccgaa

SEQ ID NO: 95374 - DNA, 737 bp, Heterodera glycines
  SCN-specific regions: Sequence locations=1-381,407-737
gtttgagccaatttattcacaaaatacatttttttgttgccgaaatgagcacggaacgctattccttctctctcaccaccttcagtccctcggggaagttgatgcaaattgagtatgcgttgaatgccgtcaagggcagtgcgccatctgttggcacccgagcaaaagattgcgttgtgttcgccaccgaaaacaaacactccgtcctcacacagcccgtcagcaaaatctccaagttgtccgaccatattgcatgcgtgtacagtgggatgggcccggatgcacaacttctcgtgaagaaagcgcggaaaattgcgatggattaccaagtgctgtacggctatgaaattcccgtgcctcaactcgtttcccgggtggctgcggtcatgcaggaatacacacagtcgggtggtgttcgtccgtttggcgtttcattgctcattggcggatgggacagtgaaaagggggcgcttctttttcaagccgatccggcgggttcctattttgggtggaaaagcacggcgatcggcaaaaacgaccaattggccaagaaattgttggagaagcggtacaatgaagacattgagaaggtggacgcgatacacatggctctgcttgcaatgcgcgagacttacgacgttgccatgactgaggacaatgttgagttggccgtgtgcacaaaggactgctttgaacggatgaaccaagaagcgctccgtgagcagatccaacccctc

SEQ ID NO: 95375 - DNA, 786 bp, Heterodera glycines
  SCN-specific regions: Sequence locations=1-16,38-786
cgtagtctttctcaaactttcccctcccctcccctccgactctcgccgatttcttcatttgatggacgtgttcaatcggttgctccctcggccgggcaatggcaatgttcagttcaaaaaactcagacatacgtcaaattccgccagcattttcgcatctgacgaagcgacgggtgacaaacagcacaacgacgaaacaacgaacaacggaatgatgccggcgacgaattcgccacgggttgaactcggattgatgctgagcaacatcagtgctgaaatgcgacacgggcaaaacagcgcaactgaaggaaacggaaaagcgaatgcggacggggaagcagaataaaagctttgtgcgaagaaaaggccaatggcaaacggaccgtcgtcagaagtgaccgctttaagcaaagggaaaagcaacggaacggccaaaggcggcggaaaacgctttctctctgcgcttttgccgggaaagagaaagggacgacttggcctttcagtttcggagcctcgactaaattttgacatcgaaccgtccaaaaatgactttgaacccacggaaatcgaagggggagaaaatgcgaaaggaggacaaattgcggaccatcaacagaattttggggagaggaaccgattatgcgatggcatttcggacggaagtcgcaaaagtcggccgaattttgcaggggcacttcaaaaggtccgtgaaaaattgaacgttcgtccgtcgtccaattcccaccgctcctccgccttttctcctccgatgaatcgttccaatac

SEQ ID NO: 95376 - DNA, 784 bp, Heterodera glycines
  SCN-specific regions: Sequence locations=1-784
aactgttgcatatttttttcccaaaaatcttatttcaaactgttaattaatcatataataattaggcaatttgtaattgaatgcaaagtgttctcaaacgatttctgtcaactgaagcgccaacaacaaaagaacgtttaccatccaaatacgcgtggttttttaacattgtcttcagcgaaatcattatatttggcggcacttatttgtctctattggagttgcgcaaaaacaaacaggcacgacttaaactccacaaatattggccgagtgcattgaaacgtttctattgggctgaagaccaattgtccggcggtcagctcaccggcgaaaagcttaaagtcgctgatttgaagcgttggaatatcgaaggcaaagtcaaagtccagcagaaggaagacgccatttacacgtgcgagtgaacgacgcaaaaacaaatggttcgccagtcctccttttattacatgatggcgggcaacatgatcgttattgcgattttcgcggacagggccttgacgcgacggtactttggcaagaagatggagccgatggcactgccctcgtggaatgcttttgtgaaaacggagttgaaagaaggcagggaactgacgatgccaattagcgacgacgaaaaattaattaattaacggacgattggttttgttcctgcacattttacaacttattatttcttttttgctggtttgttctgcacatttattcaagctgttctattgaatttaggctttcaacaaaaatttatggaaaaataaaatgaaatatt

SEQ ID NO: 95377 - DNA, 533 bp, Heterodera glycines
  SCN-specific regions: Sequence locations=1-47,71-154,176-218,241 -260,282-533
gtattcgtaatctttctaatagaaattatttcacaaaataaataaatatgggagcatttttggataaaccaaagacagaaaaaacgaatgatgcaggtgttggacgagactacaaatatgttgttgcctcaatgcaaggctggcgcattgacatggaagatgctcaccatgttcaaattaccataagaaaggaatctccgttcgaagaatggtcattttttgctgttttcgatggacacgctggcaacaaagtcgcctttcactccgcacagaatctgctccaaacactgctaaacacagcagaatttcaagcagtgaaggaagaacttaagaccaatggccctaaaatcacggaaaaggccaagtcgcttatccaagacggaattcgcatgggcttcttggagttggactcctcacttggcgagttgcagggaggcggagagagggagagaaacggcacaacggcaatatgtgccattctgaccccggattacatcttctttgctaatttgggcgattcgcgtggattgtta

SEQ ID NO: 95378 - DNA, 638 bp, Heterodera glycines
  SCN-specific regions: Sequence locations=1-405,427-551,575-638
atttgtatgaattaatcccaatgatttgctcccgtcttttttcgtctcccatttcttcgtcggtttgccgacgatcccttcggcgaattggctactgtgccgacccgaccatcggcctctcctcggaacaaatcgaaatccaacggatggccaaggattttgccaagaaagagctgtatccggagatggacaaatgggacaagctggggcaacttccgatggacgcgcttcgtaaagccggcgagttgggcttcggtgccatttactgcgacgacgcgtacggcggcgcgggactgagtcggtccgacgctgcgttggtcttcgagcagttggctgccgggtgttgcagcaccgccgcttacatggcggtgcacaacatggtgccgtggatgatcgaccgttttgccaacgaggagctgaagcaacggtacatccccgaattagccagcttcaccaagttggcctcctattgtttgactgagccgggcagcggctccgactcggccgcactgcgcaccaacgcacggagggaaggcgaccattacattgtaaatggctccaaggcgttcatcagcggcagcggcgtgtccagcgtttatttggtgatgatgcgtcacaaagacgcgccgccgggtccc

SEQ ID NO: 95379 - DNA, 682 bp, Heterodera glycines
  SCN-specific regions: Sequence locations=1-6,28-427,449-682
ataaggttcttttttaacagaaataaataaattttcgtcttattcaatggctcagtcacagaatggtggtgtcaaaaaccgtcggatttcacttggttcgcctaaggacctgaaggaagtgcacttttttgaggaagatgaagtccccgatgtgccgttaaatggtgcaagagtcaaagtttgctatgccggagtttgtctaactgacaaagaaatcagtaacacgaaacaagcacgtataactcacggcgttaaggacaccagtctttttccaggctacgaagtttccggagtgatcgatgagtttgggcccaatgcaactccggttgagtacaatttgaaagtcggcgacaaagtcattgtatggcccactgaagagatgtgccaaaatggctatgctgactttgtggcagtgccaaatttgtcgcttcttgtcaagattcccgacactttgtcaatgcatgtcgcgtcgattcttccggccggcgcaacttgggcactctctgcgattgtccatgcccgtcctgtcgttgaggccatcgccagcacaaaaggatgttgcaacattttaattgttggcgctggtggacttggactttggattctgacattggccaaacattttcttaccgcgggtcaggagaaccgaatcaaactgattgatgctcactctaaggagaat

SEQ ID NO: 95380 - DNA, 825 bp, Heterodera glycines
  SCN-specific regions: Sequence locations=1-698,720-825
gagctgctgatatatttattctgaagaatgcctgtcgtaaaaccacaaacggacagcgaatttacaaaatttcttttaaacgttgggactgctccgtgtattgttgatttttttgctacttggtgccaaccatgcagtgcgatcgctccggtttttgacgaattatccaacaattatcttaatttgaaatttgttaaagtggatgtcgacaaatgcaaagaaacaaagaacacatacggcgtcagtgcaatgccaacattcattgttctccttaatggtcagcgcgtggaccttttgcgtggtgccgacaaaactgcacttcagaatttggcccacaaatggtccaaaaattgtccaactcaaatggtctcaccgattcctggccaatgcgaattgtcaccgcttttcaacaaaatccaatgcgaatgtttgaacgaggacgattccaacaatttgaacaatttgctgaacggagttggtcccctgatcagtgattgtgacgagcaactgctgatcagcgtgtcgttcatccaaccggtcaaagtgcactccgtccttttcaacggccccaaagagaaggcgccgaaaactgtgaaaatttttgcgaacatcaccaacactcttgggttcgaccaggcacagtccaccgagccaattcagtgcatcgacttgtccgaagaaaaactcgtcgcgctcaaatacgtcaagttccagaatgtgttcaatctgcagtttttcgtggaggacaatgttggagggggcgacaaaaccgttgtcgatgagtttcgaatttacggcacgccaattgcgaagactacgaacatg

SEQ ID NO: 95381 - DNA, 244 bp, Heterodera glycines
  SCN-specific regions: Sequence locations=1-92,114-244
gttaatgtaacgacgaattcaaatcaaatttctgtttacgctgcttcgaaatttcgcgttgacataaatgtctcaactcgtgacgagtcgcatttgaataacaaatacgaaattctcatggaaataaatacaacagatggaggaaagcagacaattttgcttgattcaaaagcattggtatttttacatgatcaattggatgcgctgactcggacttttcccaaatgttatgtttgtgttgatg

SEQ ID NO: 95382 - DNA, 454 bp, Heterodera glycines
  SCN-specific regions: Sequence locations=1-334,356-413,435-454
aaattttctatttcaaaaagaaaagacaataattccaatgaaagatgaaaacgctcattttactccacagcaaatttcaaagctgttaaatctacacatcaaaagtcacaaatgcctagatgttaagtgccaaactgaacgacaacagttgcttagcaccatagagaagctggcaagaaatttttacgacatttacaaaatgtttgaaaaacagaaacgtgagatgagcagaattagcaatttatacaaggatttctgtatacaatttggtctgccggtgaaaattgacttggtgaaacaacaggaaatcagtcagatcgacaaagtcgctaatatgatttaccaacattttataaaaataagagaggtcaacaagaaaagtaaagtgcatccaaatttcgatgagaacttgcaatcctctggattgacttccatcaatggacaatgcaaaaag

SEQ ID NO: 95383 - DNA, 1048 bp, Heterodera glycines
  misc_feature (206)..(206): n is a, c, g, or t
  SCN-specific regions: Sequence locations=1-1048
caactcgccgtccatctgcttgttcagtacagcacaatgttggacatcaccgccagggcttttcagcgtcctttcgccattgcttttctgatgccttctcaacccactgcaaaaaatgtcgaagcgttccaacaagcggcggctgaactgcttatgccaatcatcgcctgcaacaaacgttacgtccattcgattttgcgtcaagncgatgctaatgctttcggaacgggaccagcagaatgtgcagtcatactattccacttcagggaacgcacagcaaattgtgatcgtgtcgaacaaactcaagtccgtggttcaaaagacaaatgcgtggtttgagcgtgtttcagaccaattgtgtgaaagtgacgggtcggcggacgaatgcttttgcgaatgcgctggccccgaagagtttcgccagttcgttgttttgcttgcgcaaaaacactcgtcctgtgcgcttctgaatctcatggaattggcgccttgcaaagacgtcaaattaaaacactcaatccaagaggcgtaccttcgtttgacagacacagaagtagccaaaggtctgctgttctgtggacagacggctgtggtgcggagcacttttggggcaaattctgaacttccaaggcatgaaactgaggaccccaacagaacagaggaagaatgtattcctcttgtcgtggccagagaaagcactctcaaaacactttcatatcgtctattacggtgtgtctatcctttgctgactggtgaacgaatagtaattttggcgtcaaaacagcgcgtttcaaccggggttgaccttctcaacaagttgaactcaatgcgaatttgtcgaaggccattatggcgtaaaatggaatttcgattctgacatcgacactgaatcaaataccatgtccgacaacaacacacactgtcaattgtttggtatttctcgtgaggcgaacgcgacttcgcagtggattaatggcgagaagtgcgaacattgtactgtcgttgacttgggcaaccaaaaaatgcgggcccatgaatactcgggccg

SEQ ID NO: 95384 - DNA, 721 bp, Heterodera glycines
  SCN-specific regions: Sequence locations=1-9,31-154,176-721
cttcatttcaatatttttattttttattttggaatttcctctatcaaattgcccaataatctgtggcttttcctatggcttctcagcccataaaggcggttttgttcgatttgggcggagttgtggtggaatacagtgaccgaaatgcgtatttaaaccgactcaaaatcatccaatcaaatgccaaatttgtcgacctatttgaacagttcgagtgtggccttctgaccatttacgaaattgagcccgaatttcttaaaacagtaatgggaaataaaagcggagatgacctaattaaggcggctaatccgactaatttgatgaaaacgaaaaatcctttcgttgaaaatgccattcgctcacttcgttcctcgggcaaatatttggttggccttttgaccaacaatggattttgggtgcgcgacagatcggagtcgaagttgatcattgacacttccgacttcgattttgtcatcgaatcgtgcaaaatcggcgcgagaaagccaaatgcggatttctacgagatggctctgcttaaaatgggactgtccgcggcagagtgcgttttcatcgacgacctcgaagaaaattgcaaaggtgccgaagcggtcggaatacgaagcatttggctaaaggacgacgactacaaaacggccatcgaacaattggaagaaattatcggcgagaaattactttaaattgccattcttttgtggcaaca

SEQ ID NO: 95385 - DNA, 654 bp, Heterodera glycines
  SCN-specific regions: Sequence locations=1-11,33-40,62-519,541-632
gtttgagatgcttttgtctcctccactgctcttcgtgctcagtctgtgttcattgtgcgcctttggccataaaacgccgaatgcgtcggatggcccggcaatgccggaactgccgaaagcgctgcaaaagctgagcgacgcggagaggaactgtttgttcaccatttacacaatgtccaaactgttcgagaacaaaaaggtgcagaaaacgctggccaaacagttaaagtcatgcgacagcaaagacacttctgagccggacatttggaagagtcgggagaagagcaacggatggtgtgaggtgaacttggaaaggatcgacagcgaatatggccccgtaattatgcacgcccatggctcaatcgcctctatcaacggcgcccgtctatttgtgaagtcgacctcggggggcatttggatagcgatttatcagccggaatgcctaaaagagaaggatgagtcgaaaaaatcggaggaaggtgttgtgagcaacactttggaccgagtccgacgttgggttttgttaaaatgagaagaaaaggaagtgaaagccgacggaccaacaattataaattaacagacaactgctaatgatcaatgattgattttaagtgtaaatttgtttcaattggttttttaaataaaaattatttt

SEQ ID NO: 95386 - DNA, 480 bp, Heterodera glycines
  SCN-specific regions: Sequence locations=1-480
ctttctcagaaatgacatcaaaaattgaatctactatcgccagcagttttcgaaaatttcttttttggtttcgttatgatggttcaaaattcccagccatggcaaagggttctgactctcgcaacgggccaagtgtcatgcaggtggtcgaatcgtgtcttcaaaaattatttgctacagagaattcggaccaaatcaaaacgttcgctataagcagaacggatgcgaaagtgcacgccattcgatcgccgattctcatcggattgcccgtcgcttgcgattggttcagtcagtcagaattggccaggacagaattccttctatgttttaatgaccaaattcgcaataatggatttacgaatgcgatcgaattgcttcacgttgaccccgtcgcaatgggatttcacccgtgttttcatgtttcctataggcgttatatctatcgtcttcgcgtcatttcgacagagcaaagccttaatt

SEQ ID NO: 95387 - DNA, 169 bp, Heterodera glycines
  misc_feature (15)..(15): n is a, c, g, or t
  misc_feature (19)..(21): n is a, c, g, or t
  SCN-specific regions: Sequence locations=1-169
gggaagctccaccgncggnnntggcggccgcttctacgaactagtggatcccccgggctgcaggaatccggcacgaggcaaggccctaatctgcatttcgtgtccaacatagacggcactcacttggcccaggtgctcaaaaaggtggagcctaaaactgtgctcttca

SEQ ID NO: 95388 - DNA, 493 bp, Heterodera glycines
  SCN-specific regions: Sequence locations=1-221,244-472
tcttaaatatggccgaatttgcccaccgtgccggtgctccgttggagtgcctttgcatggctttgaaggtccaaaagcgtcaggaaggaacggacgccgaaggcaatcggcgatggaaaattggcataagtatcggcggtggcattgaccaaaaccatcgacagtccgtctacagtgattccggaatttatgtgacaagcgtggaagcaaattcacccgcggaagaagctggactgaaagtgcatgacaaaattctgcaagtgaacggcgtcgattacacgatgatcactcacgaaagagcagtcaaatatttgaagaaggagtccgtgttggatttgctggtgaccagggccacacccaaacacagcacggaaatgcaaatgtgaacagattgtccgactgctgatctagcacaacatttcatccaaataaacacacattccaatctttgatccatgtattggtccaatcgaaaaaataaaactttttcttg

SEQ ID NO: 95389 - DNA, 284 bp, Heterodera glycines
  misc_feature (284)..(284): n is a, c, g, or t
  SCN-specific regions: Sequence locations=1-231,276-284
cccacttgtccggcacagtttggcaccgaaagggaattacgtgcccatctcaaggcaaatttggtcatctgcggtttttgcggcaagcactactgctccgagacgcactttcagtcccatcggtgccctctgttttaaaagtgccatttgatgtaaaacacaatgaattggagatgatccttctgttttattttacgggattgtttcacttttcatttcttatttccaaacaatttttcttaatttgtaaattctttattatttatattaattttcacctttan

SEQ ID NO: 95390 - DNA, 475 bp, Heterodera glycines
  SCN-specific regions: Sequence locations=1-275,297-338,363-475
acggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaaggaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacggcgttctcctcgtcggctacggtaccgacgaaacgcacggtgactattggctggtgaagaacagttggggcccgcattggggagagaacggttacattcgaattgcgcgcaacaaacaaaaccattgtggcattgcgacgatggcatcataccccgtggtctgagaaagtgtgggaat

SEQ ID NO: 95391 - DNA, 640 bp, Heterodera glycines
  SCN-specific regions: Sequence locations=1-81,116-640
ttcaatttttattattttattccaaaatgttttctcagctttttctttttctcatttttctcgccttttctgctgaaagcgccccgcggggagaaaagaaaaaagacacaccaaaagatcggtattcgctttgcagaaaaggcggagtgccaattgcaaaacttaacgatcagatcaacggcaaagatttcgacaaactcttcgcaccgctgttcccacatccacttctcatcagtaatttactgtcattggaaggcttaaaatgcccggataaaattgcgcctttcctgaaaaagtgcgatgccaaaaaagatggcgaaataaatctgcgcgagttcaaatgctttgttaaatcactgctcgcctcatatttggtggacgaggaccggaacaaatgcatcacggaggaggagctggagagtttttacaaagaatgtggattaaaagaaatggaagaggaaatgatgggagacggatcagtgcgaaaagagtgatcggagagaggacattgggaaaagagcgatcaattgataatgtgatcaatcgataatgcctagcaataatatggaatttatcggtataagatatatgattagaatggtcacgtagaaataaataaacgacggtgattagtaaaaaa

SEQ ID NO: 95392 - DNA, 865 bp, Heterodera glycines
  SCN-specific regions: Sequence locations=1-249,271-471,504-619,641-865
agcaaatcgcaaggcaacttttcatacataatttgcatatagaattagccatgatcttcaggttaggcaattttcgacattttcccgtcaatttttgcaagttgtgtattgctcgtttcaccgtggccttttctcgccgtattttccgtgaccatttttcgctgtttttgcgcagcaaacgaagtttgctctttggcgcttctttggtcggcgtttcgttcggttcaaatgtgactttggaagacgaatacaaaaggataaaaactgagtgcaaagaatgcgaccctttttcgcctcccccaactgacgaaggttggacactcttttggtgcaacaaaagtttggcggtgtaccggcggagatttgtggccaatgggggaaattgcgtgtttgaataccgatgcattggcacttacgaagacatttcacccaacgattttgtaactgtgcaggaggacatttcctgtcgactcaaatgggataaaaatgtgaacagccttggacgagttggattttgattacaacacggggacacaagtgattcggtgggagagcaaatatcccttccccctttggccacgcctttacattttcgctcgtcgccaattcgttgatcggccaaggaaacaaatttatatcttaagcagagcacttagcagcgacaatttcccggacccttcgcaaacgaccgtccgagtggaatgctatgaatccattttgatagtgcgcgcacacgacagtttagacaaaaaaggtttggactttgtgctctcttattacgacgacacgcggtcttccatcccacagaaaatctaccaatacggcattaatgttattggcccaagctttatcgaagatgtgcaca

SEQ ID NO: 95393 - DNA, 1024 bp, Heterodera glycines
  SCN-specific regions: Sequence locations=78-1024
gacaaatttgtcaagcgttgggagcgttctcccgtcggcacttccttggccattcctcacattcctatggcggtgccttccatttcgcccctcgggcgtccccatcctccgccccctccccgctctccaagtcggccatcgtccaaacattcctttgcaggcgaccacggttcattcttacaaacttctccgatcaaccgaattgtggacgaggagggccaagagtgggaggtggaggaagtgcagctggacgtgtccaagacgggactcggattctcaattagcgggggttgcgaccgcgagcctgacttgatgtataacgaccgatacattcgcgtgactgacatttcgaaagggggcgccgtggagacggaccgacgcattcgcatcggtgacgtgattctgttcgtcaacgattgggagacggccaacagagagcacgacttcgcggtgcaagcactgaagaacgcgggcacttttgttcgactgttagtcaaacgcctcaaatatccgccgctgcaaaaatcgctgagtcaaagccatttgagtgagcccatcgccagcggcaccttccaacggtcgttgagcgggggcgcggccgacagccgaacattgcctctgcagccccccgtccgttcccaatcattgcaccatttgccgatgaatgccgtcgcaacttcgccaaatgttgtcactgcgatgggcactttgccaaggcgggcgaatgtacagcagcaatttgcaacgccactaaatgacccgggcagacagccgagatgggttgtcatccgaaaaggcgaaatgggcttcggttttaacattgtgggcggcgaagatggcgagcccgtgtacatcactcgcgttgcacccggtggagcggcggaccagaccggcaacattcggatgggagacgtattgctgcgtgtcaacgatgttgacctgtcaatggctacccatggagaagcagcggtcgccctgaaggcgattccgcagggggcccaagtgaaactgctattgcaattca

SEQ ID NO: 95394 - DNA, 447 bp, Heterodera glycines
  SCN-specific regions: Sequence locations=1-170,193-447
cagaacatacgtttttgcaaggtgctggtcagccggactgctcacacacttcggatgagtattgtcagctcccttattacaccgctatccacgaactattccctccagagcgttctcggtgggtgccgctgcccacccaaccgcccatcgccagccctctgtcagtgcgactcgtccagcggcaacatctacctggaaaccaactgaacctaaccatcgccatccaaggtggcactgacaagttgtcattgcatatcactccgctaaatggcttccaattgcgacattggtcattgacgccttttgatcctgccacttttgggatacgcaaaacgtactttgtgtttatgacttatggatttgaatcgcccggagaacgtctcgtttggattctgcttgagaataatgaacgcagtgttagcgcgacggacgaagtgccgagtttgg

SEQ ID NO: 95395 - DNA, 632 bp, Heterodera glycines
  SCN-specific regions: Sequence locations=1-286,309-632
tacagaattgacagattgcttatgagatgagtgggaagggtgcgcttgtccatcccaaagccccggcactcattccttcgatagaaactgtcaattctgttttcctacagtaatctcgccgaaggtgcaagtgtctgaatattgtgacttttgcctgggtacgaatttgcaaaatgcggagggcgaggcggagccgctcatttcgtgccatgattgtggtcgttctggacatccgacctgtctcaaattcactaaaaatatgctcgtctccacaaaacgttacggttggcagtgcatcgaatgcaaaagttgtgcaatttgcggaacatccgaaaatgatgaccaacttttattctgtgacgactgcgaccgtggcttccatttgtactgcttgaagcccccgctgaaagaagcacccgagacggattggagttgccatctgtgcgtgaaggaattcggcgccgaagcgtccattgcgaaggcgacaaaaagcacggaagacggcacatcatcaccagccaaatgaccaaaacataatggaaacggggagaattgacaccgtaagacatttcgaattttcaattttgttgcccatccaacaaactaaccataatttgtttgtaatttcggat

SEQ ID NO: 95396 - DNA, 578 bp, Heterodera glycines
  SCN-specific regions: Sequence locations=1-126,150-197,221-578
actcctccaactgcgcggccttagacgaatttctctccatcatcggccaccgagttcagttgcgtcattttgccggttatcgtggcggactggacaccgttcatggacagtcgggcaccgaggttcggtggggcagagtggggcgggcatacggtaccgtttgcattggcgacgcgcaacaattgcagcgcaagcggcacattggcaacgacatcgtggccattgttttccaagagcagaacacacccttctgtccggacatgatcgcgagcaactttctccacgcctatttggtggttcatcccattgagccgggcactgaccgcacgcgttaccgcgtgtcgatgacagcgcgagacgacgtgccgttctttggcccgacgcttccgcgctcttccataatttggaagtgccaactgcgcgactttttgctcaccaaactgatcaatgcggaaaacgcggcttataaggcggaaaaatttgccaaattggcggaacgcactcgggcatcgctgctggatggactgtactcaaatttgaaagagcgggcccaattttacggcatggcatttttggat

SEQ ID NO: 95397 - DNA, 312 bp, Heterodera glycines
  SCN-specific regions: Sequence locations=1-31,53-65,91-290
ccttcattgctgatttggttgttggactcgccactggacaaatcaagactggcgcgccgtgccgttctgagcgtttggccaaatacaatcgtattatgcgcattgaggaggaattgggcactgacgctgtctacgccgggaaaagtttccgtaacccgcaaaactaagagcgtgtggaaacgaagaaaaataggactgttcgttgactattcgctggatgtttagtttcctgacattgattatttgttttcgaaaagtcacttgaatgctatgagtatattatttaattaaactgaataaaagttatttctc

SEQ ID NO: 95398 - DNA, 377 bp, Heterodera glycines
  SCN-specific regions: Sequence locations=1-294,347-377
gctgtgaatgatgtcgtcaaatgaagaagaagaatccggcggttcaaatgatgaccaattttcctctccgatcagtccggtcagccccattcaaccgatgagcaccgattggagtaacgcaattgatgcgcaggaaatgggcgccggaggtgttggaggagggatcagcagcggaagcctgcacgaactttcgcatgggtgtgaccgttggccgttctttgttcgcaaatgtccggcctcctctccgactgtcacaaattttcaattgctgatgagcccgaaaaatcattttccattttaaatttaaatgactatttttttttgttaatttatttatttttatatacaatgtctaataaaaaatcttcgcaaaaaag

SEQ ID NO: 95399 - DNA, 386 bp, Heterodera glycines
  SCN-specific regions: Sequence locations=1-386
tggctgagcgtggacgagctgaaacggatgattgttgcggaggcggaacagagagcatttgcgcccattccggagtgctttttcgagctgtccaacctgttgatgctcaacgtgcgggaggatgtcgagcagtatgagcagcacaatactgtgccgaaatggttgaaacacttctcgggaaaatgtcggacaaggacgcgttccatttgcgcaaggagatgaatgatgttttgacgaaatacgcggccgccgccatcgacgacaaatgagaagagagggattgattgattgtctgccagtgatttattacgcttgcgcatattcatttgatcacaaattgtcactgcttttccgtttctgaccatttgttgagttagttattaccc

SEQ ID NO: 95400 - DNA, 274 bp, Heterodera glycines
  SCN-specific regions: Sequence locations=1-274
agtactgcgccgaaatggttgaaacatttctcggaaaaatgtcggacaaggacgcgttccatttgcgcaaggagatgaatgatgttttgacgaaatacgaggccgccgccatcgacgacaaatgagaagagagggattgattgattgtctgccaatgatttattacgcttgcgcatattcatttgatcacaaattgtcactgcttttacgtttttgatcatctgttggattgtctattatcccaagttttcttggttccgtaaattgtgtttac

SEQ ID NO: 95401 - DNA, 539 bp, Heterodera glycines
  SCN-specific regions: Sequence locations=1-114,137-201,223-435,458-539
ccaagtttgaggtaaatatcggtttatttaatccaacccattaaataacccccacgtaagaattgaaagaaatggcgcccaaacaaaggatgagtgtggccaaccaacacttcagcaaaaatgtggtggcccgcggtcaggtggccaagtcattgaagcccaaggaaaatcagtacccggccgcgccatggctgatcggcattttcgtgttcgttgtttgtggctcagcagtgtttgagatcatccgatacgtgaagttgggcttctgatcacagtgtgattatatgtgtgtgtttggcattttgactgacggacggacgagtgtttcttttttttcttggtgttgtcattggcgcattgtttggcgggaaatttggactggatacacacacatttaaatgaacaaatgatgatgatgaccgataattggttgacttccctttaacttctactctttcgttctctctgtccattcatttccatccatttgtttcacaatttcctaacaaatcgccaacagaaatttaattatttcttta

SEQ ID NO: 95402 - DNA, 460 bp, Heterodera glycines
  SCN-specific regions: Sequence locations=1-460
aagtgctgttacgccaccaacgacgacgacaacggcggcagagagtggcggcgaaggagacggacgcactgagacgacaagcggacagcggaagcgacacagcgcaaaccaaacggactcggcgaacggcgccgctggggggcaagggtcgaataacgccgttgttttgtcctcttctgagtcggctgcaaaggaagcaaaggtcagaaagatgtcgacaacatcgcagaacaagggccacaaatcgaacaccatggcggaggacagcggcggtggcacgggcacgtcggctgcctcttcgggcaacggggcggagcagaacgacaacagccgagcgaccagacggccagcggaactgcagcatttgattgactacttcccggaccagcagagcacggacggaaatcggatgacgcgttcgaaggcgagagcgatgcaggacaaaagcagcaacagtgct

SEQ ID NO: 95403 - DNA, 477 bp, Heterodera glycines
  SCN-specific regions: Sequence locations=1-188,212-477
aaacaactcatcggacagaacaatttgcaaataaatttctgatgtcaaaacatcaaaaaagtgctgttacgccaccaacgacgacgacaacggcggcagagagtggcggcgaaagagacggacgcactgagacgacaagcggacagcggaaacgacacagcgcaaaccaaacggactcggcgaacggcgccgctgggggacaagggtcgaataatgccgttgttttgtcctcttctgagtcggctgcaaaggaagcaaaggtcagaaagatgtcgacaacatcgcagaacaagggccacaaatcgaacaccatggcggaggacagcggcggtggcacgggcacgtcggctgcctcttcgggcaatggggcggagcagaacgacaacagccgagcgaccagacggccagcggaactgcagcatttgattgactacttcccggaccagcagagcacggacggaaatcggatgacgcgtt

SEQ ID NO: 95404 - DNA, 500 bp, Heterodera glycines
  SCN-specific regions: Sequence locations=1-233,258-500
ttcgcaatgagtgccgctgcgacccaacgtcttcaagcgaagcggcaaactttggacgaggcttatgctcccccagccaattttttggagatcgaagtggtcaatcccatcactcacggggtcgggaagaaccgatacacggactacgaagttcgactgaggaccaacttgccggtgttcaaacacaaagagtcgagcgtccgtcgacgttactcggacttcgaatggctgaggaatgagttggagcgagacagcaaaataattgtgccgcctcttcccggaaaagccttcaagcgccaattgcctttccgttcggacgacggcattttcgaggagggcttcatcgaagaacgccgcaagggactggaacagtttctgaacaaagttgccggacatccgttggctcaaaatgaaaaatcgcttcatatctttttgcaaatgaacgagcttgacaaaaattacgtcccgggacgcattcgtacggcctgaccaactgacaa

SEQ ID NO: 95405 - DNA, 726 bp, Heterodera glycines
  SCN-specific regions: Sequence locations=1-726
gtccatttaagactagacgagcaaatgcttaaaatgcgttccgtcgtgccacatttcccaccgttgcctgctcttcgtgactttatctacatgtaccggatggacgcggacaaaacgctgagccaaaattacttgatggatatgaacttgactcggaagatggttaggagagccggagacttaacgaatgcgtttgttgtggaggtcggaccgggtccaggtggaattacccgagcaattcttgagcagccgtgcaaacgattggacgtggtcgaaattgacaaacaatttttgatgcctttgcagcatttgagcaatcattccatggagcggatgaatgtccatcgggcggacgtgctcaaatttgactttgaacaagtgtggacggatgcgggggcggccaaatgttcatgggttgaggagcatccgaattttcacatcattggtaatttgccctttcacatttcaacgccgttggtcataaagatgatgagacaaatgtctattcgccgtggaccgttcgtgtttggccgggttccgctcacctttaccttccagtccgaagttgccaggcgtgtagtcggcgaaccgtgcaccgactttcgctctcgcatcggagtgacgtgccaaaatttgaccgagccgcgcattctcttcaatgtacctggcaaatgttttactcctccgcctgaccatgacgtgtgcgttgtgcagtttctgcctcga

SEQ ID NO: 95406 - DNA, 273 bp, Heterodera glycines
  SCN-specific regions: Sequence locations=1-216,245-273
gacaatcaaaatccgggtgtccaatccgaactattcgacgtcgacagaacgccgtttcggcgcttggattggcggctccattgtctcttcactgggcaccttccaacaattgtggatctcaaagggcgaatacgaggagaccggaaagtccattgtggaacgcaaatgcccatgacggtcaaccgacactaaataatttgcttcctttcccggccgatttaattttttcatttttatttattttggttggttaaaataaatggctagcttatc

SEQ ID NO: 95407 - DNA, 861 bp, Heterodera glycines
  SCN-specific regions: Sequence locations=1-398,421-786,830-861
tgccaataatcggctaaatttgcgaaatgagacagaacaaaattttccgcttaatctctgccgtcccttcgcttctcctccccccaaatggactttgtggcgcttcgattgtcgcgactttccgaatcattgcacagtgaaaacatgtgcattttgtgccgaagtgaacaaattacggccgaccgccaaaaacattgtcaacgaaacgcacgcccgctgggattcgatgaagcgcgagaaaagcttcgacgacgcgccgactctgctcagaatggccaccgatacatttctgcccagcaaattgacgaaaagtgtttttttcaatcataaattgggcgtcgcaattttccgcgacgaaattccgccaaaattcgaaagtgtcgaaaatctctccggcggcattttccaattgtattttcacggcacttcgggtcgtcaaagtgcggtgaccgtgcaaaaactcgacgctctgttcatccaaactgtccgctcgctgttcggaatgccctctccaattgcgtgccatgtccacggattgttctaccgatgcgaaattaacccgggcaatcgccgtgatccgatatcctatggcaacttgttggacttgccattcatggccaaatttgaggtgccattatgtgcgaggaactttctgatcagacagaattggcaaaaatcctttaaactttgataatcagagtgatcatttaagatttggattgatgacgtcgtgaacagacgactgatagagcagtcgttcatttatcaccccaattttcaatgaccaatttttaaaattattttttaaaatttattattttttatttatcccaaatcgattcgataaatttttgatcacaa

SEQ ID NO: 95408 - DNA, 635 bp, Heterodera glycines
  SCN-specific regions: Sequence locations=1-103,125-635
tgctcatttgaattgaggagcgggggaacaaactccaatattacccctttttagcgcttatgtcttatggaggtcggaattgaacggatggaaagcgatgagaatttggaaaatttaccaaaagtggattggacgataacaccagaaccaattgtcatccgtggagttggacacctaaccctgtttggccttaactcgcattttccaacggaatttccgagcgctctgataggaaaattggcaccggaagagtttgacgacacattgcgacgtgtgaattacgttcttcagaggaatgttagcagaaacttgcgctggttgatctgcggattgcttttttgctgctgcagcttcggtatttcgttatggccggtggtctgtctgaacagaaggactatttccgctctcgagaaaacgctggaccatgaaaatcaacaattgtacgacaaactcggcttgcattggaagttggccaggctgcccgttgagccgtccaatcgcctgacagaatatgtccttctgcttgaaacgctgccacgaattcccctttccatgccggattagcacgcgaaacttttattacccactttgggaatgataaagaagtttagatttcactgcgatgtctctttctg

SEQ ID NO: 95409 - DNA, 546 bp, Heterodera glycines
  SCN-specific regions: Sequence locations=1-546
gtgccgttcatttcgggcattcttccgcttatccctttcatcagctcatccgccgcttcatttggcgtcacctccaaacaatcgccgctgctcaatttgggaggggcagtgaataacgccaaagaattgccggtgttggcaggtgctatggttatgctcagtttgtttcagttggccgctgcctttagtcttctcctttatggctgtcgaacattcgggcgcacaatgcgacacgtcgagaacattcagcgagggattaacgccctccaatcacaacaaaaccccgggggcgaaattggggagcaagaaaaagacgccggaggggaaatgaggcgaaagctgtgaagaaaccgatgaatttctccataaattaataagacttacaattagtctaaaaaatcgcaatttttcgcatcattttgttcattttcccattttttaacttattttcctttccttgccactcacgcaaattgacagcgaaggactgtaaaagtcatttgaatttagttggcataatgaaatgaagtgaatagcagtgaaaaa

SEQ ID NO: 95410 - DNA, 668 bp, Heterodera glycines
  SCN-specific regions: Sequence locations=1-668
aaattttgcctataattaattctctttttgacgaattgagtttgcaatgtctatggatgaactgaagaaacgcgccaaagccattggtacatttgaggaactaagaaaaatcatagatatccgtggtgtgaatcggtacaacccaaacaatgcgccggttttggaacgggcggtggatttgatgatcaaagagacgaaatacgacaaggacattctgatgacactgttgaagctgtaccagttgaacccatttctttacaacgaaaagtacgtgtgccttgtgctattgaaaacgatgaccaattttccacgcaacgattttgctttggcaaaatatttggtggacgctgccaaagtgaacgctccggagttgcgacgcgtctgtcagattggctctcttcttgagtcttgcaatttcgcgctcttttggcgtctcgtcgacggacggtacaaaccccgcgacagtctcgacgaaccattcaaaaaacctgacgaaattcgccaattggtcgagtccgtcacaagtttcaaagaggcgacacggaattatgcatgtcaagtgatcaatgtgacattccaacgcattcacaagcaacagttggtcaatctgttgggtggtattgatgatgcccaattgactgcctatacaaatttgccatcaaacaaat

SEQ ID NO: 95411 - DNA, 625 bp, Heterodera glycines
  SCN-specific regions: Sequence locations=1-177,214-339,364-382,411-625
ctttccgccatttcccttaattttcccgcggctcttccaaatgaaagccggcgccgaatgataaaagccgaagtgtcgctctgttatttgtactcatcgacaaatgccgccgacttcttggccaaatgcctttgtaagcaccgcaaacgaaagaaatgaacggcgaattgtgccaacccaaagcagcagcaccagcagcagaaacagaggcaggcacagaagggttgcatcgtcaccagcagcaccgatcatttcgtccggcgcttctccatcgtcttcggcccctctctttggccatcgtcgtcctcccccgtcgccttggccatcgtccccatcgtcgtccccccgatttccccccttttctcgggtctctgctcataatcgtctcctccccctcccgcttctccttctgctaattcttccgatggccttctcctcccttctcattcattctgcaaatgccctccaccatcggcacgaacacccgcaaaaatgttcaattgagggcgaaatttgcacaacaattaatgctcatgtgtgccgaaatgggacctgtgtgtccgcttgcactcttcgcggcatgaaagagtgccattgcgacgtggaggaggacaacttttgcttt

SEQ ID NO: 95412 - DNA, 172 bp, Heterodera glycines
  SCN-specific regions: Sequence locations=1-56,78-172
gtgttggacaaagtgtgccgcacctcagcggtgaagcaggtgttacgccgccaatttgccaatgccaatgttcaaattgtgaagcggggccgagggacagttgcgctgaagaaactttaaaacaaattcgagcagcatacaacttctaacatggacatggctttaatcccac

SEQ ID NO: 95413 - DNA, 480 bp, Heterodera glycines
  SCN-specific regions: Sequence locations=1-480
ccgcagcggacgactgcagaaaagcgcttgacatggacagaaagaatgtgaaggcgaattactacctggggaaggtgtacgtacaccagggacagtttgatgaggctatcaaagtgctgtcgcgggctcatgaaggcgttctcaatcttaagcaaacatatggcgacgaaataacccaattgttacggttagcgcgcagagaaaagttccgtcaagaagaagacaaacgcataactcaggagattgaacttcaaagttacttaaaccaattaattgacgacgacatcgccaaaaaagtgaaccaattggaggacaaaaaggaaaatgacgttgaagaaaaggcggaagaactgaagacacagggggacaccttcaaaaaacagctgaacaatctctttgctcaggttgacgatcgtagacggaagcgcgacctcccggactatttgtgtggcaaaatcagtttcgagctgctcaaagacc

SEQ ID NO: 95414 - DNA, 476 bp, Heterodera glycines
  SCN-specific regions: Sequence locations=1-12,34-60,82-476
gagatctcggcaatttattttttaaatctgtatgtcttcagtaccgcaattatctgcttccgaacacaaagaacgaggaaatcgttattaccaagcaggaaaatatgaggaggccctttctcactacacccgcgctattataaagaacccgaatgatccgacttactttacaaatagagcactttgcaatttaaatcttaaaaaatgggactccgcagcggacgactgcagaaaagcgcttgacatggacagaaagaatgtgaaggcgaattactacctggggaaggtgtacgtacaccagggacagtttgatgaggctatcaaagtgctgtcgcgggctcatgaaggcgttctcaatcttaagcaaacatatggcgacgaaataacccaattgttacggttccgtcaagaagaagacaaacgcataactcaggagattgaacttcaaagttacttaaaccaattaattgacgacg

SEQ ID NO: 95415 - DNA, 458 bp, Heterodera glycines
  SCN-specific regions: Sequence locations=1-230,252-458
atttccaatggatttgctgctgttcccattccctgggtcaatgatgtcgacaattttgaacttgcaaaattcgattattcgcctctccctaaatttgctgaaaatctgccaaatcgggtgttttgcaattgtaagggcaccggcggatgctcggctcagaaaggctgcgcatgtgtcgaaatgagtaccatcgaactctcagaaccaggtcgtgtgcacaatgcccatttgctcagtgagaatgcatttgagtcgcgcttcttcgagtgttcctcactctgttcgtgtgccggcacttgtgccaatcgattggcgccgcaaaacgacgcgcagcggaatcatttgcaaattttcaagacgctcaaggccgggtttggatgccgtgcactgaagccgattcggaaaggcagtttcatttgtttcctcggcggcgaaatctttcccttcgattatccgtc

SEQ ID NO: 95416 - DNA, 596 bp, Heterodera glycines
  SCN-specific regions: Sequence locations=1-596
actttccgttgccctttttgacccccccccctagggctttttctgcttcccttttctccctcaaatcacttcccccaatgatttgccccaacttcgttcttttgtcccttttatccgtctctctgttcagttccctttcattagctgataatcagaccataacagtgcatgggcaaacgatttgtcatcgtcgaagtgtgaagggactgcacgttgaactgagagagcacgacacatttgatcccgatgattcgttgggctcgacaacgacaggcttggatggctcgtttaaggtgcgcggattggaaaatgaaatcggctccatccgtccctatttgagaatcacccacaaatgcgacgtgaaggacgaattgaaatgccgtcgtgtaacggagatcgacatccccaaggagaaggtgaacaacgacgtgtacgagatgcattttgtgaatttaaatgtgcatggccatagggacacagagaattgcgatgagtgaccaaaagggaagaaggaaaagcgaaatttgaacagatcaattgtaaatcaaattcaaaatgaactgatcaagggaaatacacatcatttaaaaatgaga

SEQ ID NO: 95417 - DNA, 551 bp, Heterodera glycines
  misc_feature (535)..(535): n is a, c, g, or t
  SCN-specific regions: Sequence locations=1-551
aaagctggagctccccgcggtggcggccgctctacaactagtggatcccccgggctgcaggaatttggcacgaggaaaaaatgacacttcatttgttgcttgtccttcccgttttggcgatggctttcgcttttggcaactgccaaagtcaaactataattagcggttccggctgtgtgtaccataacggatgggtgactgaaagtggacgctcgcggccgttgaccaccaacgaacgcagtcaacttgacaattaccagcgccaatcgcaaagtgccgccgctgctttttccgccgcatttcgtccgccctttccttttggagggccaatcaacccgcagttgaatttgccgcagatgccatgtttctgttccgctgcctcatgcgcgggcggtgtgtcatgggttgacaattaatcagtgggccgatggacagagggaattaattattcactaatgaaacgaatttgtctgattcacagtcgggggattacaataaagcacataaatattgcggataaaatgctttctatttnaaacaaaaaaaaaaaa

SEQ ID NO: 95418 - DNA, 769 bp, Heterodera glycines
  SCN-specific regions: Sequence locations=1-31,58-127,151-268,290 -520,543-769
aggaaatgcactctaaataattcagtgaacctgtaaactttttaaaaatttctttatccttttttgcccaaaaatgactgccgcccgtcttctaaaaatggttccatccgaaagtgccttgttggtctgtgacatgcaggagaagttcagggagcacatcaaattctttccgcagattctgcaggtcacttgccgcctcattgaagctgctaaactgctcgacatgaagattttggccactgagcaaaacccgaatggacttggccacactgtgccagaaattgtcctcaaaaagcatgacattcccgtctttgagaagaccaagttttccatgtgcgtccccgacctccaacgcgaactcggcctctccccggccgttcggtcgctgcttctctgtggcattgaggcgcatgtttgcgtttaccagtccgccattgatttccaacagcaagggttcaacgtccacgtggtggtcgacgcaagttcaagccgttcaatggtggacaggatttatgcctacaaacagttggagaaagtgggcatcaatctgattaccagcgaatgtgccattctcggcttggttggcgacagtgcgcacccaaaattccgtgaagtccaaaaactgatcagagagagtgcgcccgacacgggactgatcagcaacacttcgcatgtctgatcagcagatgatagatctttccaaggactgtgatgagacacaaataaattttaatatgaaattcgtatttattttctttttattaataga

SEQ ID NO: 95419 - DNA, 673 bp, Heterodera glycines
  SCN-specific regions: Sequence locations=1-252,294-673
gtccagttaagttcaccaatgcttccgctgacaccagcaaaaagattcgtctccaaaaagcattgtgtcgattcaattcgatggctctctctccaaaggacgacttttgcgaagacaattccgcccggtccgcttctgttttcccatgtttatttgccggaacggacgccggacggacagccgcagcgcaaaccgtccgaacacccggactttatgaaatacgatttcatggcggatcccgaatttgaaaaaccaccgccgccggtcgaactttttcttcttgaggatataaaagaccttggcgaaaagtttgacattgtcaaagtgtccgccgaagtcgcgcgttgggatttgctgctgaagcgaagggcggtgtacgcgtcgccgttcaatttgaaatattacgcggagaagagaaagaagtatttggccgaaatggaaagtcgtgtgcgcattccgctcgatttgctcaaaatgtcggcacttctcatgagccaaattttgcctgtgaccgtttccgcggacgttgagtggacgctgagcagtgagatgctgatcaactccacccagagcttgggtttgtacataaccgagccgggcatcatccatttggacaatgtgtcgacactcaatgggccccgacccgaacattgagggccgtctggttccgttt

SEQ ID NO: 95420 - DNA, 445 bp, Heterodera glycines
  SCN-specific regions: Sequence locations=1-395,421-445
caggagttattgcgacgtcgcaattcaccggtggacccgagggatcgattcggctcaattgcggcgaaaaaggtgcacatgccgcagacggaacgcatttattacggctttcagccggacgtttggaacgaaggcgcccaaattgaacggctgctgcatgagcgacagaatgcgtttatggcggacgatgaacgcgtggaggacgaattcgctgagggacgcgttccacagattgtagagccagcgcaagggacatgtccgggactgaagaagcacgcgcgaatccaacgaaaacggagggagtggcgcacactgatgaaagcggagagaaagcgcaaggcggtggcgactgacccgggctgcgtttaagcgaggagatgcttcaccttcgccgatttcattttctcaaatttttaattttgtgtaaaataaatatcttgttttt

SEQ ID NO: 95421 - DNA, 1198 bp, Heterodera glycines
  SCN-specific regions: Sequence locations=1-1198
atcacagccaatttttcttcgaccccaattgtcccgaaacgtgttctccattttatttggatgcgctcttccgcaaaggccatttggtcattcgaatgttggagaaaaggttacccaaggagcagttcgttaaggttttgcaacgaattctttccctgggggttcagtacagtcagaatttgtatcggcctgtcgaatggacgcacatgctaattaacacggcgatgtttttgcgggttatgactgatgttactgggaaggaattgccttcctttgtcgaacaatggatcgattttggtggatttgttaattttcaggtttcccacattttcaaccgcaaaagaaatatcattgaattggagctgcgtcagacagttccgcttcgagaaggatgtcggaattacaccgggcctctcgcgatcgttgttcaggagcttggagggctttttgctcacactatccaaatagacgccgccgtttctcgccacgacatccaatgccattcgaaggggcgtaaactaaagaagaaacggataatgctcgggaccggagaagaggtcgacgtcgacctaaactcgatggacttcgattcgccagtgctttggattagagtcgatcccaatttattactttatcgtcaaatgtcaatcaaccaaccgttttatcaatgggaacttatgcttctccatgaaagggatgttctagctcaacaacaagccattgaaacactttgccgtttttccgaacacaaaacaaagatacttttggaagagacagtccgaaacgacaaattcttctaccgaattcgacgagaggctgcccactgtcttgtccaaatttacaacagtctccccgaaagccgtcttggcgagtctcccccactcatcgattactttcgccagaattttgggagtaaaacttcgcctgacattccattaccaaataattacgcggccacttcctccaaccttcagaacaatttgcttggacaagctttgcccgctgctattggcttaattcgaggccaagacggaagagagtgtccggaatacgtgttggaattcatcatcaacctgattaggctcaatgacaacagcactaaccgttattctgacgattactacagaggagcactgatccacgcacttggcaaaactttgacaatgtctgaacggactgttgaacaacccgattgttt

SEQ ID NO: 95422 - DNA, 508 bp, Heterodera glycines
  SCN-specific regions: Sequence locations=1-455,478-508
ctttattctaaaactatttacctatacgtatattcctttgttttaaaaatcaaaactttaatctattcgtcagatgactgctttcaaagagttcgtcaatgggttaataaagactaagccggttgtgatcttctcgaaggagcattgtcctttttgtgtaaaggcgaaggatgccattaattcgttcaaactgaagccgggcgcacttgaaattgtcgagttaaaccagcgcaatgactgtgaccaaatccaagactttctcaaggagctcaccggtgcccgctcggttcctcgcgtgttcatcggtggaactttctttgggggcggagatgacacagtcgtagggcttaaaaatgggatgcttgagaagcaattgaaggcggcagatgctttgcaatgaaattacaatagaatagagaaatttgaaaagtctaattgttttagtcaagtcaaatgttatctttttgctttcttttaaattattaaatggctcaattcttcaaaaaaa

SEQ ID NO: 95423 - DNA, 579 bp, Heterodera glycines
  SCN-specific regions: Sequence locations=1-84,110-158,188-426,449-579
gtttgaggaattaaaaaaaaacaacaaaaattgttgagccatggaaagtgcggacgaaaagctgccgccggtgacaagcggcggcactgccgccgccgccaccgctgcgttagcaatgcaaaaaattgtccaacaacacgcagcaaccatcgcgaaccaagtgcagcaacagcagcagcaacaaacagtttcttcttccgctgtcgtcgccccttccgtgggcatcgcttcattaccccaataccatgtgagcgcgccgcaccagaacatgccgggcagcaagtaccagcaactgttgctgttcatcgatgaattggggcgtgtcatccgccccacgtacaacgcgaatcgcaacgcgcaggaacgcctgaagcgtgacattgtgcaggcgcggctgttggtgcgcgagtgcatggccgagttggagcagcagcgcaagcagcagcagacgtgacaggacggagatagagagaaagacgacagacaaattaccgattgattttttaatgtattgattgaccagttttgtaccaaaaatcttctcttttttctggattgatgcacaacgatgggaattgt

SEQ ID NO: 95424 - DNA, 821 bp, Heterodera glycines
  SCN-specific regions: Sequence locations=1-821
gttcaataaagtcaaaaccttcaaaatgagttcaaggattaacgtcgtcagtgtgcagttgttggagaacccggccactccgagtgaccacatcaaactcgaaattgttttcgaaatattcgaaaacattaaggaagacgtcgaatgggaattggttttcgtgggcactgatggccgagaagaacacgaccaagtgctcgactcagttctcatcggaccgattcaggagggacgacacaaatttttgtttgaggcgccacctccacaaattcacaaccttcgacccgaagattttatggatgtcactcttttgctgctcaagtgcaaatatcgtgaacagcttttcatgaaaatcggttggttcgtcacgcacacttacactgacccggaactcgtcgaaaaccctccttctcagcccgtcatcgaaaagctcaagcgaacgattgtcggcgaggatgtgcgcgtgacgagttacccgatcaaatgggacgaggaggcggaacagccgatggatgacgatgaagagccaaacgccgggaatgaggtttcctacggagtggcggccattgaattaacatcgaacggcaacagtcaacaaatgaatatgtcacaacaggaacagacgccgatggcggctgttaactaagcggatgaaagttgcgagcgttaaaaggacagaacggactcgatgttttatgggtacaaaaaacggatttgatcttcaaatttgcatttatcactttaacccaatgttttgttcgacaagctcatcataaatgtatgcggcaaagccgcccaacttgataaaaaccaagctatcc

SEQ ID NO: 95425 - DNA, 481 bp, Heterodera glycines
  SCN-specific regions: Sequence locations=1-429,451-455,477-481
ccttaaaatttctactgaagattttaatggaagctgaggcggatttcgattccggattgctcagtacggaagtgagtcatcgacggcgatccgcttcagtgtctgaggattattcggtgcaaaaaacgaacgacgacgccacggaatgcaaattcgttgctgcgcagttgggttactactccgatagatttatcccggctttcatccacgcgtgcaattcggagaagccccaccacagagatccggagatcactcgtggctattgggcccggacaaacgcaatcacttcgatggtcgttcaatttgttcagcttgccggtccgtcaactcaaattttgaatttgggcgcgggatttgacacactttattggcgactcaaagatgctgggcttagtttttataagtttgtggaactcgacttcagcagcgtaacagccaaaaagatttgtcagatcaaacgcaacaaaaatgtgaatttaac

SEQ ID NO: 95426 - DNA, 538 bp, Heterodera glycines
  SCN-specific regions: Sequence locations=1-485,511-538
tatttcgtttaattaactcaccatcaaatcatcatgaaactggtcttgttcggcgttattcttctcggcaccctgctgtgccagtgccattctgactcggtggctgttgaacagtcaaaagtggatgccgtcgatgttggagacgcgtcgcacatgatgttgacgcgggcaaagcgtgccagcggcggcagatggaccacgcagcagatcatcgagtgcattttcgcaattttcatcccgcccgtggctgtgctgatccatggcggccacgaatgggtgctccatctgatcatcaacatcgttctctggattctcggctggattcccggcaccatccacgccttctggtactgtttcttccgctagatcgatgaaggatgtgatgatcaacaccgatcgagacccccatcattgttgaagaaccggcccaagaaatgagaatcctgccgccttatttttccgatcattttatgctttttatacatcaaccacaaaatacaacaacaaatcgccaacatattttccatatttggataac

SEQ ID NO: 95427 - DNA, 262 bp, Heterodera glycines
  SCN-specific regions: Sequence locations=1-262
tggcgccgagacttcggcacgcccaccaccgcctgcagaagaattgtgcgcggatgacgtcaaagtggcatttattgaggcgaatttcatgccggactgtgaacgcgcgtgccggtactatgaagactttgcggacgtcgcttttgaaactatgtttttcggaaagaccgacgaggaaagagtcaccaaattgtctttttaggctttttcatctgttttgactttttcgaatttactcgacaaacaatctcaacacaagcag

SEQ ID NO: 95428 - DNA, 471 bp, Heterodera glycines
  SCN-specific regions: Sequence locations=1-148,170-344,368-441,463-471
gcaaaaagcaacaacaacacccttgttacgtaatgctcatcaagctcgtcaaggcgacggtgggcgtcccgtcgccggtggcactgcgcgcggtgtcggcacgcggcgtgggcagcggcacgcattggattggcaacgattttgaggactttgacaagcactacaagaccggactgcgtgacgccgtgccgattgccgccttctggaagaagttctccgctttcgtcatgatgccactgttggtattcgcgggctattgcggatggaaggaccatcagaatgtgcaccattctccacgccctgagtacgtcgcatacgaatatttggccacgcgtcgaaagcctttcccctggggcgacggcaaccattctttattgcacaacccggccactaattgggtgcctggcgttggctacgaagccccgtggcccggcgatgcgcacaaaaaggagggggacagcggcggcgagg

SEQ ID NO: 95429 - DNA, 476 bp, Heterodera glycines
  SCN-specific regions: Sequence locations=1-155,177-444,466-476
gcacaatggctctctgcgtggcgatttatgataagcatgatgccctcctctatttacgcctcaaagatcgaatgtccgcttctcccttggaagtccaacgtttcctgcacagttcgtgtgacattgttgcggacaaaatgaactcccctggtaacaaggccacccaacaagaaaattttctcggtgcacttcttttgagtgatcgctttcggtcatttgcttatctgacaaacaccggtacgaagttccttttggtcatcgatgcggaggagggcactctcaaagatcacgaaattcggctctttttcaaaaacattcacacaaaatattgcagcgccatttcaaatccgttttattcgtttggaagtactttgcaatccagtaaaattgatgccgtcgttaacgaactgcttacatccttttgactgttcagaaaagcagtaattgatcacagaaaagagaactattgcaaataa

SEQ ID NO: 95430 - DNA, 601 bp, Heterodera glycines
  SCN-specific regions: Sequence locations=1-134,156-601
aaagctggactccccgcggtggcggccgctcttccatagtggatcccccgggctgcaggaattcggcacgaggcatgaaaaagcaacccagcgcattgcttccacaacgtcaacaattccgccaactcaacccgccactgacccacaccatgacctcgcttgccaacttacacaatgccaccgacgatgaccatttcggccgcctactcgaatccagtgtccagtccaatgtggtcgtgctcaacttccacgccgactgggccccgcaatgcaagcaaatgaacgaagtgtttggcgagctggcaaagttgcacccggccgtcgacttcatttcgattgaagccgaagagcttgtcgacacctctgaactctttgacattgctgccgtcccctcgtttgtcgtgctcaaggccggcaaacccgtcgaccgtgtcaacggcgccaacgccatcgaactgaccaacattgttgaaaagcacgccaaggcggccaaatcgcgctcggcgggcgccaacgccgacttttccgacacggcctcgacggccgctggcggcgccggcgccgatgcatccatggccgccgccccactggcgccggcggc

SEQ ID NO: 95431 - DNA, 500 bp, Heterodera glycines
  SCN-specific regions: Sequence locations=1-449,471-500
cactgttgtggatgttgcagaagaaactgttgcacaatcaatggaccaattagaagaaggcattgaagtggggacggtcgtcaacgaagaaatggcacagaatgtgccggaagagcccatggcatcagtgcaattggcgaagcggtcgaagccgttcaatcagaggattgtcgagaacatcggatggcgaaaggaatttgggcgggttccaccgaaggaaagggactctttgggactgatcgaatgcattgatggcgcaacggtcggatgcaaccaacggcttctcgcttctctgaagagttcaaacccttcattgtttttgagaactgataagtttcgctcgagaaatgcgtgtggcaataaaaaaagcgaagtgagtctacaaattgatgaatttgacgaattctacaaacgatggatttcaaattatgagcaagagggagcggggaagagccacggagaggagaacagtgaacacgatgggaaggaggaaagtgaaa

SEQ ID NO: 95432 - DNA, 438 bp, Heterodera glycines
  SCN-specific regions: Sequence locations=1-356,378-438
atcaaatgttttgtcagtggagaattaaagttaaaagcaacaacttcttgaattcgttttctttttactgccaaaagcagtgtctcttttcctctcaagaaaagtgcaacaacaaaaacaaatatttgcccgacgaggatggaatcgtccgttctgaatttcaatcagtgccgattcagtccgaaccttttaccgaaacacttctgaatcgaattcgacaattttccgctgaacaaccaaaacgagccatttttgtcgatgccgaaaacccttccaacattacaacgtttggccaatttctgtccaagactcactccgccgctcactttctcaattccattggcttctcctccggcgatgtcgcctgtgtcattcttccaaactgttggcatttttttgccatttttttggccgcttccatgcataaggcgtgcattt

SEQ ID NO: 95433 - DNA, 724 bp, Heterodera glycines
  SCN-specific regions: Sequence locations=1-182,213-724
tacatatttgttgactaaaagcatgtttctttaaatataaaaagtcccatcatgtcgaattccggcgaattaactttttccgacaaggatgatgtcaaaggtaaaactgaagacgacaaatcccgtggcactaaaaggaagaagcgaaaggactcgcctagcagcagttcgtcgacatcttccagctcatcttcctcctcttcgttttcatcttcttcagagtctgacgacacttcgctttccgaaagtgaaggccctcccgcaccgagcaaagtcaagaaaagtaaacttacgcacgtcatcaacccacgtaaaatttttattcacgaatatttgatgagcaaattgcacgtttccgatgtgaagagacttccagcggaaataagtcaaaagtatcaaatggtgcaaaaagagctcattgggaaattcgcatcgggagactatgccaagaaaccaataagtttccgaatcgacgaaattacgcttgcgggggcggcagcacagaaggctttcaatcgtggtccaacagtcgctgagtactttttgaagaaaaatggtattacacttaaacatccgcaattgccttgtttggtgcaaagcggcggtggaaaccataaaagcttttatcccatggaactgttgttctttgcccaataatttgaagatgtccatttctttttcattttttatttgtttatttttctataagtaaaaatttcgattg

SEQ ID NO: 95434 - DNA, 671 bp, Heterodera glycines
  SCN-specific regions: Sequence locations=1-138,160-163,185-473,496-671
aaatggtgaatattttggccgatttggtcgccttgggcgacgttgaaaagcgcgctttggactttttgccaagggcagcgcgcggctattacgaaagcggagccgacgatgagcagacgcttcgggaaaaccgcgaggcattcagaaattttctgatccgtccctttgccctgagagatgtgtcccaattggacccttccgtcaccgttcgcctttccccctcaacggccaacccgaagtgtcgtccgttcgctcgcacttttgcctgcccaattggcatcgcgccatcggcattccaccgaatggcgcacgacgagggcgaaatagcgacagtcaaggctgctggcgagacgggcactctgatgatttgcagcactttgtccaccgttccgttggagaaagtggcagaagcggcgcccgaggggagcactttgtggtttcagctgtacatttacaaagaccggacattgactgagaaaatcgtccgaagggccgaaaaggccggctttgccgctttggtgctcaccgtcgacgcgccactgttcggacggcgaagggcggacgagcgcaacgccttccaattgccgggccatttgaatattgccaacttcgcctctcacatggaacagtcgaccctttccggcgccgaagtcggctcctccggcctttcc

SEQ ID NO: 95435 - DNA, 240 bp, Heterodera glycines
  SCN-specific regions: Sequence locations=1-76,99-200,222-240
ggaaagaagcggagaaagacaagcagaaggcggaggaaggcaccgagctgagcaaaaaggccaaaaagataagggcgaaaaggaagggggaggcggggaaagacagccgaactgactgataatgcccgtgccatgccgttgttgttttggtgctaaacaatacgtgtcttttgatattgtttcgttgttgatttatctttattatttttgactttttggatcttataaaatttatatttt

SEQ ID NO: 95436 - DNA, 621 bp, Heterodera glycines
  SCN-specific regions: Sequence locations=1-398,423-621
aagtttgagtcaaaccaaaattaaatttattcatgttcttcgtgaaccttgctgcaatcttaattttcctgcaattttatttggatttgaccgaagcgggcatcgaatgccaaccaaacggagtctgtagagacgtttctggctcaactcctgcgagtaccgtatgctcaaaaaaatgctacagttgcacttacaaaaactgttgcaacaaagtgtacacgagccagtacgccaaatgctcaattaaggggtggcgtaaaaaaggatacattggcaatgtgccagtcgaaattggtgcaacgaagaaacgagacgtttactgttctaaaagcaatccatgcgcaaaagagggctacaaatgcgtggcctataaaaagggagatgacagaggcttctgctggagagaaaaagttgagaaagggcctccgtcaagctttgctttggcaattgcgatcgcaggcctcgtcattctgctgtgatggactgatcagaaacagagttgaagggatcaaggaattacgaacagcgattttttgggattaactaatcaattatataattagtcatgccgtttacatttaaagatggcagtttttatattaaaaaagcatctgcgtggta

SEQ ID NO: 95437 - DNA, 824 bp, Heterodera glycines
  SCN-specific regions: Sequence locations=1-418,440-824
cgcggatgttcgtgccgaaaagtctgtggccatccatccaaaaaggacttgccgaactcgcctctcaaaccaaaatgggcgatgtccgcgacccttccattttcatgtcggctgtcatcgatgcgaaggcgttcaaacgaatcaacgactacatcgcttacgcaaagggagccggagtcaaaaaggacggcactcggctggtatttggcggaaaatgcgacgactctcgtggatggttcatcgagccgacttgtgtggaggtggacaacatttcatcccttcttctcaagcaggaaatatttggaccttttatcgctgtttacgtgtacaatgatgtggatgctggtcagctcgttcgttccctgaaggaccaaactccgttcggactgactggcgcagttttcagccaggacaaggactttctttatgaagcaaaagacattctccgtgatgcagtcggcaatttgtatttgaatgacaaatgtaccggttccgttgttggtcagcagccttttggtggagcgcgtcaatccggcactaatgacaaggccggaggcccccattacgtcctccgatggacttctgcccaagtgatcaaaaagagttttgggccgcttaccgaatggcgctacccgcacatggattagatgggagacctttattgtcttttgaaaccaacgtggttttcatgtagcgagatttccctccattcaatccaataatttcctttgaatttctcccataattctctccctatcgccccatctttttttgatgttttgtttttccctattctattgaattgtcgcataataaatggaata

SEQ ID NO: 95438 - DNA, 521 bp, Heterodera glycines
  SCN-specific regions: Sequence locations=1-13,37-521
gtcctaatttgtgcattttaatttattttatttcaccgctatttctttcctaactctccgccaatgatttttcttcttttttgttttatggtgttgtttgccttttgcggccactcaaatggccaaatgactgctgccaaccaaacttggcttgcctcccaacaggcattggcaagaaacacgggcagatgcggctcgttttttgtccgttttggcgacttttgctacttgcgctgccgacaacgcttcggcgatgacggagccaacggcgactgtcccttgggtggaggaccgtgccttatggtgaacagaaacgtgaacatttgtttgcgagttgctttcagcctcagacagcagtgaaagaggcaaagaaagaacgaaaaacattggggaggaagtgatcggcagagcaaatgataagaaaaatggaaatgattgtgattttgtgaattgaattgatcaaaaatgaaaagccaagacttttgtgagtagtcccaacttgaaaatacacgtaaataatt

SEQ ID NO: 95439 - DNA, 476 bp, Heterodera glycines
  SCN-specific regions: Sequence locations=1-476
caagtttgagcgaaatggacaacacaaataataaattcattttgttgaagaatggggcaaaattattctatgcttctgaagaatgcgtacgtcaggaagcgaaaaactttgtgggtggaattgtcggtttgaatgggccttcggatttggaggagggcatttatgagggtggcctcaaaatttgggagtgtacggtcgacttgtgcaattttctactcagcaattatcagacaatgagcggaattgacattttggagttgggctgtggcgccgctttgccttcgattttggcgctgtcaatgggcgccgattcgatttgtgttcaggatttcaatacttttgtcgtcgaatgtttcaccaaaaggaatttcaaattgaatggccataaaattgacggtggaaaatgcgcttttataaacggacgatggggcggagaaattttggggaaaattgggcagaaaaagttcggtctgata

SEQ ID NO: 95440 - DNA, 509 bp, Heterodera glycines
  SCN-specific regions: Sequence locations=34-52,85-87,109-124,175 -205,263-279,328-376
ggatccccgggctgcaggattcggcacgagactggtgcccttcccgcgtttgcacttcttcatggtcggtttcgcgcccctcacgtcccgcggctcgcaacaataccgtgccctcacggtccccgagctcacgcagcaaatgtttgacgccaagaacatgatggccgcctcggacccgcgtcacggtcggtacctcacggtcgctgccatgttccgtggccgcatgtccatgaaggaggttgacgagcagatgctcaatgtccaaaacaagaactcgtcctactttgtcgagtggatccccaacaacgtcaagaccgccgtgtgcgatattccgcccaagggtcttaagatgtcggtcaccttcttgggcaactcgaccgccatccaggagctgttcaagcgcatctcggaccagttcacggccatgttccgtcgcaaggctttcttgcactggtacacgggcgagggtatggacgagatggagttcaccgaggccgagtccaacatga

SEQ ID NO: 95441 - DNA, 599 bp, Heterodera glycines
  SCN-specific regions: Sequence locations=1-599
tgagaatcaaaatgcatctgacccaaaaattgcaaaaatagccaaaccacttcagcctcgaaagtatccatttgtcgaacttgttcctttgatgggtaaaaatcatcttgacactgtctcagagagagttcgcggaatccatccatgtgttgaagaaagacataatttgtttgcatgtttgaaaaaatgggactacgacgacatgaaatgcacaaaattctccgattcattattcagttgtatggaatcaaacaaaaaaattgtcgctgcacacaatgagcaaagaattaagggagagcagcccttgcacatcgtcgatgaaggtagcagtgtgaaagcggaggcgtccaacatactccaagcagacattgaccggcttttccgcaaatggaaacagcccgaacttggcacgatccaaaccaaagttatgaagcgccgcggacacatgccgtactacgtggactacttccaccggaagaacatgaagggatggcgcgcctaagaaaaagactcaattgttttgtaaaaccttagttggatttcagctgaagcttttcaaatggcataaaattgataccccagaactgaccacatggact

SEQ ID NO: 95442 - DNA, 710 bp, Heterodera glycines
  SCN-specific regions: Sequence locations=1-80,102-330,353-710
gtttgaggcattttggctgatcaccgctttttccttacattattatgcgctgcttcttcccccgtgtcgtccgaagtgttttcccctcgcccctttccttcgtccgttcctctctctccactttttatcccatcgatgaccaattgttcggtttggacgaggaacaacgacagcttcgtcaattggtctttcgactcgctcaaaaggaattggccccttttgctgatgaaattgaccgtcaaaatgaattcacaaaacttcgcgatttttggcgattgcttggtcaacaaggccttttgggggtcacagtgccagcggagtatggcgggtcggatcgcacttatttggaccattgcattgtgatggaggaattgtctcgtgcaagcggatcaatcgctctcagttatggggcccattccaatctttgcgtcaatcaaatccgtcggcatggcacacccgtgcaaaaagccaaatacttgcccaagctgtgctccggcgaagccattggcgcattggcaatgagcgaaacgaatgcgggttctgatgttgtttcgatgaaattgagtgcacgaaaaactggcgacaggcgttccttcgtgttgaacggctccaaattttggataaccaatggacccgacgcggacattttggtggtttatgccaaaacaagccctgccaagcatcaacacggaattacggcatttatagtg

SEQ ID NO: 95443 - DNA, 832 bp, Heterodera glycines
  SCN-specific regions: Sequence locations=1-32,54-86,123-349,371-832
gtttgagggagagaatttccgttccatttaataatttaataaacccaaaatgtcttcatcaactgctgaactgaatccggaagatggtggtcatccgccacagaacaccgccgtggccatcgagcagtcgcaacaggccatccatccgccggcacaaagcggaagcggcaaaattgccgcgtgggcatcgccgaacgcggacgacacggagccgtacggaatttgcgcaaagattctgatcgttctgtcctacatcatcacaatcatcacttttccgatctccgtgttcatgtgtattaaaattgtccaacaatatgaacgagcggtgattttccgtcttggccaactgaagaagggtggagccaaggggcctggccttttcttcatcatcccttgcatcgacgagtatcgtaaaatcgacctgcgcgtggtgtccttccaagtgccgccccaggaaattttgtccaaagactcagtcactgtcgaagtggacgcggtggtctatttccgcgtgttcaatgccaccatttccattgtgaacattgagaattcgaccggctccaccaaattgttggcacagacaacgctgcgcaatgttttgggcaccaaaacgctgagcgaaatgctcagcgaacgcgaacacattagccaccaaatgcaggaagtgcttgacgaggccaccgagcattggggcgtcaaagtcgaacgtgtggaggtgaaggacgtgcgcttgccgcgcgaaatgcaacgcgcaatggccgcggaagcggaggcgacacgcgaagccaaagccaaggtgatcgctgcccagggtgagcagcaggcgtcgcgc

SEQ ID NO: 95444 - DNA, 399 bp, Heterodera glycines
  SCN-specific regions: Sequence locations=1-41,63-124,147-399
tgaaaatgaatgtggacaatgcaaacattgtctggataaaaatgattgttttctcaacatgatcactgcttgggctcagaatggcgaaatcgaatggccacgggtgttgggagagaacccaaatttgtggggaaaggaacaaaaagtgttggccgatgcgaaggcaaccgaagacaaacagttccaagacccgaaatttgaacaaaattttaaggcaatgaatgccattggtatggctcatcgcggtgcctaccattacttcagaggagagccgggaagtgccggtgccttggagcaagtgcggcattttctaaacacaagcataagggcgggattcaatgtgcacaaagactttgctgtggtcaatgttgaaatatataagaatgaaggtgcagacaa

SEQ ID NO: 95445 - DNA, 704 bp, Heterodera glycines
  SCN-specific regions: Sequence locations=1-127,149-704
tggatatttcttcgtcccaattaaaaatcttttcggtatttctgctctttatcgacttcgtatttcccaacaaccatgaaaattttgtcactttggcacaatttagagccggtggtgaaaaattcagttttgcggaacggcgttttttgctctacgatgtgaaccccggcgagggcttcaatttgcgaagggatgtctatttgagagtggccaacacagtacggcagctcagagagaaaggcttcgactttgttcttgtgctgccgccttggggaaactgttggcattggcgcacaaagccgcggcagacgaaaatccgttggtctgaactgttcgacttggacagtctgtcggactttgtgccggtcatagagttcgacgagttcctcgaagctcagggcacttccgtcagcactgttttgtatttgcagcattacgcggagggatgggccgaaggcggcgaatacactctcaaatacgacattcgcccgtgcattgaggcggacaaatattacgctaaaaggggcgacaaatggaacggccatttcttcgattacgctgaccatttccatgcgaaggatttgcaatgtctgtccatccagggacagtcgagcacactcgcagaagcaatcgcacaattattccccgagggtcgttctttgatggtcgaccgtgccgaaacgattctgcacgaccaattcggc

SEQ ID NO: 95446 - DNA, 630 bp, Heterodera glycines
  SCN-specific regions: Sequence locations=1-5,27-34,56-189,211-305,328- 487,510-525,554-608
cgcccttaaaataaaatattaaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaaataaattataattttataa

SEQ ID NO: 95447 - DNA, 151 bp, Heterodera glycines
  SCN-specific regions: Sequence locations=1-151
tgattaacgtagcctcgctagaatttaatctaaaaaacttttgtaaaaaagcatttaacaacgtcgcaagcattgtagttttaataggttctaccactatccctttttgaaccttgaaactacgttaatgtccataaaaaaaaaaatccac

SEQ ID NO: 95448 - DNA, 170 bp, Heterodera glycines
  SCN-specific regions: Sequence locations=1-128,150-170
gagaataatgtgatggatataacgcaattgagccaaattggaacggaattttggacgttttgaatttgcattacccaaaaagtggcgtttttaagtgatgccttttatacattaaaatatatttgttttacatatttatgaattaaacccttcgagaataaagcgcaaac

SEQ ID NO: 95449 - DNA, 503 bp, Heterodera glycines
  SCN-specific regions: Sequence locations=1-1,26-503
tattaattaattaactaattaattatccgtaatgcattttccgccgaccattcataacgcccaaattcgccacggtccgctgaagccgccgaatatgagccgaagcccaacacagccggacacaagccttggcaaggtgtacttggagtgtgtggccagcttttcggagccgacaaaggccaaatggctattcggagagagcgaactgagcaaaacggacggacggtttgagttcagccaggaacagcaggacacgaacagggacaagttcatctgcgagatcaaaaatttggacaaatcgctgaccggagtctacaagttggtgttgatcagtgcggaaggccgtgagaacatcgccacgttcaatctgcccctggtgggcatcgaaaaatgcaattggactaatgtggccgcttctctgacaatggacccaatggtcgtgcgagaagtgccactccaacctctggtcccgatcagataaagcgcaagaatggcggaactcg

SEQ ID NO: 95450 - DNA, 617 bp, Heterodera glycines
  SCN-specific regions: Sequence locations=1-237,261-476,498-617
agaatatgcaacaaaagtgcactttttcgttgattactcaagacaaaacggaagttgttgtcccttctgactttgtggatcagtccgatatgttgtcggattacgcaaaaatgcaacgtcagaacaacggagacgcggaggaattgcaagcgaaatttgaaatgaccaacgaaatgccattgatcagcaaattccacttggaaatgatcttcgaattcctcggcacttatcgagaggagaaacaaaaggaaaacgaaggggcggcggacgaaaagcaaacgacgaaaagcggcgaaagagtggccgaagcgacggcggaagaaagtgccgagttgtcgaccatgccgaagtgggcgttcgatttgttcgacaaactgccgaaaaatgaccttttcctggcaatgaatgccgccaattacttcggcatcgcccctttcgtttcgcttagtgccgcgttcgtttgcttccaaattttgcagaaaaaggggaagagggaagtcgcggaatatttgaacatggacgagaacgacaataacaacaacggcaaatgattgaacattcgcaatgtttcagtgctctctctctattcacgattttttcaataaaacaaaataatt

SEQ ID NO: 95451 - DNA, 735 bp, Heterodera glycines
  SCN-specific regions: Sequence locations=1-17,39-177,201-407,429-735
gttgccccaggtgttacaattaattttttaattaatttgacaatgacctatgaggaggattacatgtcaagtgctttcttggcaaaagtggaagatgttaagccaggtgtcggcaccggaagagaggggcgtcgaattttgcgaattaatgccaaccgagaagaggcgattgaaagacagcgggtggagaagccaaagtcaaaagccgaacttgaaagggacagactaatggagggactaaacaatccgatccgagcggagtcaaaaggctttcaattgttggccaaaatgggctacaaagagggcatgcgtatgggaaggagcgcagcggacgaacagcagatggacagtcggacgaaggagcccattctgatccaactcaggattgatcggtcgggcgtagggatggacgagcaccgaaaggagaagcagagggatttgtgtgaagcgcacatggagcgaatgaagcgacaggcggacaatgaggaagaattggccatcgatttccgaagacgcaaaagggcagcaatggaaatgaagcaactgatctcggagatccaaaaactgagaaagacgtgccaagagatggacatgcgaatgggcaaaacaattccagacgaattttggttttggccgatttattcgaacaataatgaattggtcgacatggtggaagtggtcgacaaatcaaaccaatcgatggatgaaaacaaacggacaaaacgagagccttca

SEQ ID NO: 95452 - DNA, 801 bp, Heterodera glycines
  SCN-specific regions: Sequence locations=1-734,765-801
tgaagattcaatggctatgatacctttcaatttgtttctgctcagcgcccttttcttcacagcgaatgcatatgacttaatattcaagaatatttccgtgccagacgaattgaaggacaaatttgaatgcacttttgaagtgaaaaaagggaatggggagaacgaatgcggattgggagagttggaaacggacggacgacgaaacggcgaattgaaatgggcggaggacaaactgtgcatcaaagtgaaatgtgaagagaaaggaaacgataccaaatttgcattccgtctccagcagtgtgagctggtggacttaaaaaagtccgacaaaccgatgaaaaggcccatccatctgatcgactcgaacggatgtttggcctcaaatgccaaaggacaatggccaaaactcaatcctccactgaactattctttcgaagagagaacggtggaaatgcgcggatggacttttggcaacgaaacggacattggccaattccccgacgaagcgacactttcttgtgcggtcgaaatctgtgcggatccgtgtgaacagagctgtttggacaaaatttctcttgacaagtgcagcctcaatgattttatcggtgacaaaaatgccacggatatttgccacgaaggaaatgccgccgctgttcagggcacaatcagtttttgtttgatgacgcttctgatgttcctctgttcttccactgttttgatgtttcagtgataccaaaaaataattttattttgtttttataattctaattcgttaaagaatcaaataaatttttatttgtc

SEQ ID NO: 95453 - DNA, 1100 bp, Heterodera glycines
  SCN-specific regions: Sequence locations=1-221,244-275,297-681,703 -892,921-1100
ctcgactctctattgaaacgcgcgccacggcaccgtcgaagcaaaaagcaccgacggagcagaggacatcaccacgccgaacaccagcatcaacggggggatgtgttcggaggggaagccgaccaaaatggacaatttgcttcatctggaccccacgcgaagtcatttctgacgcgactcgattctgcgcattcgccgggctctccaaattcgcggaattctttcatgcaaatgatggtgttggaccgaagcagacagccttcggccgatgtcattgagactgtgtgccttcagaacggtgtgtgcacttgtgccgaaacgacctgcactttgcgctgctcttcgtgtgcgcgactcactttccgagagatttgcctgaatatttattcacctcatggtcaaatgcaaaagtttgcacttacctttcggcttaatccaaactctgtgcctcaaactgtgaaaatctctcagtcctcagctgagtacaccgttttggagaatgtgagagtcgtcgaatggcaaagttcgtcgttggatcgaccagaattgttgactgttgggtcagaaagtgcaatttcgcctgtttgaatctgctgaaagagaccaacggaaagtcgccccgttttatgctaatcggaaatccgcaaggactttttgacgagggcgaactcagcgcagatttggaagaacgaggcgaaggcacagtttctgaaaacagtggcagagcagcggacagaatggtccggacgcattatgtgatgtatgacaacgaccgactgctgagaagcaccgattgtcacgagcttttcgggagggtggcagacgaatcatgcgaaaatgagaaggaaacggacggaaaaggaagaacggaccaccgatttgaagaattttcttaaaattataaatattttcaaaaatttccatgccttcggcgccactcactgagagatggacgaactttgacattggtagcatggactttcgaataatcacatatttttaacttttcctctttatctcaattcaatgatcttgtttttctaaattgtttttttccgttcactttcgcatttttaacacataaataaatgtcaaaattt

SEQ ID NO: 95454 - DNA, 564 bp, Heterodera glycines
  SCN-specific regions: Sequence locations=1-183,205-279,301-564
ggaaatttttgctcaccaaatgcaataaattcaaagccccacacacaatcaccaccagaatcatcataatcaccataatcccaacaaccaccggttcatccatccgacataccgtatcgtccgcgccgaatgacgtcaccgacgacattcaacggggcacgggtttttgccaaactgtccggcaacagcaaccaacaacagcaggccattgagcacaaaatggcggaacttcgagcagcatacgcaatacaaccagcacagacgccgacggtggcaaaaagtggtgccaattccacccaaaataaatcgtcggcaccaccacctcgtcgacctggacgaacctcattgccaactccgtcactaggcgacatgcttgaactaccacaattgagctctcgcagttgtgtaccgtcgagaagagcaagcacagtgactgcctgtttttcaccagccccatccctaatggatttggcatcgtctgccggacttttgtcgctgtcgccaagcgatttggtcttcgagtcgtccgtgctcggcattgcctattatgactttgtgttgtcg

SEQ ID NO: 95455 - DNA, 461 bp, Heterodera glycines
  misc_feature (461)..(461): n is a, c, g, or t
  SCN-specific regions: Sequence locations=1-416,439-461
attgaattcgttcgacctgtcaattcgatttattatgaaagtgtcgccccttttgaattgcgccgtttgactcccacgaaaaaatgcgatggcattgcattttttgtgcatctttccacctcaaattcaacccctaaatctggtcgatgagtttcattttcctttggctttttctgaatttgttcctccccaatggcgttgaagccatgccctattattacaattctcccaatttgcagcagcaaaagccctttttggccggcacgcgtttcaacatgggcatcgacccatggagcggcagccccgaaaggggaaacatcggattcggaaacaatttggctgcctttttttacgtttgccacacatgcagcagaggaagaagataaaaggagcgatcggtagaaaaacggcgttaatttttaaaaatttcatttgtttacaataaataaaagttgaaaaan

SEQ ID NO: 95456 - DNA, 498 bp, Heterodera glycines
  SCN-specific regions: Sequence locations=1-498
cgcttttgcacatttctctatagcacacattcaagaaataaattgataaattaaaaccctaatcgaccgtttttctatctgcaaaaaatgctgcaattcgaagaggcaatggcccaattcaacgcaatgtttccaaatttgaattcgtccgtcgttgagtcagtgctgcgcaattgtgacggcgatgtgagcagaaccatcgatgaattattgcgacgaagtggccaagaagaaggaaataattcggagacggatgaacggcgaaagagtgtgtccactccgccgagggaccaatgtgccaatgacgagaaaatcgctttgctggtccaaaaccgcgagtttctgaggtatctccgtcgcgacccaaacttccaacgtgaaatgctcggccgttccaattcatctgattatcgacatcggcaccattcttcaactcatcgaaggcgcaatttgcccgttctattaacgtcgtctcgcacttcccaatcgcctaattca

SEQ ID NO: 95457 - DNA, 505 bp, Heterodera glycines
  SCN-specific regions: Sequence locations=1-111,138-505
atgacactttgtttttaaaaaaaccttcaatggagtgggcggaatgacaccggtgccaatgctgagaaagcatccaacgttcacggcattgaggaaaattctgaaaaaacgaaaaaaaaatttaaaaaatttattttgctgttgttattggtgttttaccttgtacttgttgaagctgttccaaaattggatttcctggagcagttccaatgacgggttgttcgcaataatgcctgacaaaaatgagtgagggttatggacagaaaaaacacatattctaatgggatggaatttcattaaaatcaaccaaaaatttcaaaaaacagaaattcatcatttaaattacgaaaaaccgcttttttcttgtcaccaaatgcattttaattgtccaccgattaatacaacaacaacaatcaaagcaccactgttcacccacctccatcaatgtatttgttgtccacactggcaaaataggtaggtgctgaaaatttttcgcgaatttatt

SEQ ID NO: 95458 - DNA, 679 bp, Heterodera glycines
  SCN-specific regions: Sequence locations=1-679
caagtttgagcaaaatgcgattggcttcgttattttctgttctgctgtttttattgttcatccatcgaacaattccctcaccttcgccaaaatttgatgaagccataaaagacaatggcattttcgcattcgattcgtccgttgaggacagtgccgaggaagtccctccttcgcctgcttttgccgattctttgcggtcgcctcactcctccgaggccgaggaggacggtccatctgctgaagaggaagaacagtttgtggacaatgtggccggatggcggccacgtccatctttcctgccgccttttgctgttcaaaatcgatgcctaaaagccaaattcttcgattcgaaatcggacgaatgccgcccttgttccatttgtgggcccgacctttatgagcgggaaaagtgccgtacggacagtgacaccgtctgcgagtggtgcctgaccaatttgcgagtgattgtccgcaacagcgactttcgcgtcaaatgtgaacagctcattgccctccgtgaccaattccgcgcggcattggttcaacattccgttgttgagggaaaagcgaagccaacgatttattcggtttcgatgttcgaaaatgcctccaaactgtggaagatcgagttgtttgtggagatggctttttacatcactctgattgccctcgtgttggc

SEQ ID NO: 95459 - DNA, 598 bp, Heterodera glycines
  SCN-specific regions: Sequence locations=1-107,129-383,405-408,430 -511,533-540,562-598
attgctgccgtcctaaatctcctattatctccaatgttcggtcgcttcgtttcatcccttttctcctccacggtttcttccgtttttcgccccgaacgattcctgcaaaaattttccccaaatttctgctgtcattcgaactttctccgacaattttcgtttacagcccaaaatcattatgatgacattttaatgcgggacattcgcagaggttctcctccaaagcatgcgcgaaaaccacacgacagaaagccaatcaaaggaaccgcttttaggaaaggcattgttataaaagttgtcgtgaaacacccaaaaaagcctaattctggcaatcgacaatgcgtgttggtgcgtttatccaccggaaggcaatgcatcgcttacattcctggggagggacacaatttacaggagcacagccaaatttacgtgcgcggtggtcgcagaagggatttgatcggagtcagagcaaatgtcatgaggggaaagctcgactgtgcggcggtcaaaaagaaataaatccgaaaacgatcaatgcttttataattcggtaaaatattttgatagagtggtcaaaggacattaaacattggtaaaa

SEQ ID NO: 95460 - DNA, 475 bp, Heterodera glycines
  SCN-specific regions: Sequence locations=1-151,173-475
catataatttcgagccctactgatggcactatttagtcatttttaattttattatttgtgaatggcctgctactaatacaccatggatattcgatctgaccagcaccggtatcctttttgcattgtttggacgccaatccccctcatcagttggttatttccctttattggacacattggtattgcaactagcaaaggtataattcgtgattttgccggcagcaattatgtctctgaggacaatatggcatttggatggccgacgctttatcatcaactaaatcctgaaaaagttaatggaggttcagaggcatgggataattctgtggcagaagctagcgatgaatacaaacgtcgtttacacaatttgttccttgacaattgtcactcgcacgtttcacttgcattaaatacaatgcgatatgacgggaaaagcaattggaataattttcgggtcgcagcggacattaattta

SEQ ID NO: 95461 - DNA, 475 bp, Heterodera glycines
  SCN-specific regions: Sequence locations=1-19,44-475
gtccaattaagctgcccattgctcctctcctctctttcctccttcgccacttgcacagcgactcggcaattcccgtcgcgggcggaagcaattaggccaacccatcgccgctttcattagcatcgcaccgcttaagtcagtcagtcacaaaccgacaaaagaaacggcaaaattctctcgcacattattcagaaaagtcgaggctctgccaaacctccgaacagcgaaaaattcaatcggaaagtgagtctcgaggaaagggagtcgagaggggacgagcaaaaggtacggcacggcaaaacaccacggcacacgccggtcgatgagcgacgaactaaacattgacggcgcctttgcgatgaacatgggcatgcccgcgggcgcgacggaagtgcccgagggggtcgtgcagctgaatgtcggcgggacttgttttctgaccacaattgacacgctgaaaagggacagcggagca

SEQ ID NO: 95462 - DNA, 464 bp, Heterodera glycines
  SCN-specific regions: Sequence locations=1-19,41-139,249-369
ccaaatttcacactgaaaatgtcttcttcgtccaccatttttgttgttctgctggtaattgccatctgctgctgttcattaacaattgccatgccagcagcggtcaatgaaattgatagtgttccacttcggcaaaagcgtggctatggctatggtggctacggctatggtggctatggctacggcggtggaatgggcggcggcggatttggcggtggaatgggcggcggaatgggcatgggcggcggaatgggcatgggcagcggaatgggcatgggcatgggcagcggaatgggcatgggatttggacgctgatccgtgaaattaattgtaccaataatcggattgtcaataaaaagataatggaataaaaataataataaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 95463 - DNA, 138 bp, Heterodera glycines
  SCN-specific regions: Sequence locations=1-42,65-138
cactttcggctcgcttggcagagggcgtcagggcatttgatgagagcgacggaagagagaaagacgaaatttataaccattttttgaatttgttttgttgtgtcttctctatttttctttttgcttaaaacacacacg

SEQ ID NO: 95464 - DNA, 210 bp, Heterodera glycines
  SCN-specific regions: Sequence locations=1-99,122-210
gttgacattactaagccaaggagacgaagattctcaatctcttaaaagaaaacgtttgatctaagtgcttttgtgtgttgtgtataactcttttagactagtgtgcttattgttcccttcttgatgcgtgatttttttttttgggtgtgtgtgtttattgtttaatgagcttggttaataaaatgaaaatcgaaaccagattgatttact

SEQ ID NO: 95465 - DNA, 369 bp, Heterodera glycines
  misc_feature (369)..(369): n is a, c, g, or t
  SCN-specific regions: Sequence locations=1-14,36-205,227-329,351-369
tttttcgcctttagaccgcttcaaaggctttccaccgctgcgtggacatcgacccgtcccatttcgaggctttgaataacctcggcgcttcctattttcttatgggggagaggcagcgtgccgaaaaaatatttttagaagctcaaaagttaaatcgtcaaaattcgcacgttttggaaaatttacacataattgaagcagaagcaaaagcgaagaaagaagcggaaaaactggccaaaaatcaagaagtaatagcgaagaaaggaggcgatagctccaatttgggctaggacgacaatgaaaaagatgatcatcatttgttgagacgcattgattgtattgttgaaaaaataagtccaaggatgccan

SEQ ID NO: 95466 - DNA, 881 bp, Heterodera glycines
  SCN-specific regions: Sequence locations=1-471,494-735,758-881
gcaacatgggcttcgaggattgtaaggctcgcttctactcgctgaaaacggtgtcgctgccgatgcaaggtgacaatgccaagctgatccaagtttgcggcgagctgacgctggtcaaggcggctgtgcaaaaacagcagcctgttcttccacgacgctttgtccaaaccatcatttaggcccaccaaacgcccaccgttttgtacgtgaagagcgatgtgtttcagtggttggataccgcctttctggttaccgttagtgaaaaatacaacgcggccaacaacgccggtgctactgtgccaagtccgccgactactgtcgctgaacagcaacagcccctcgaaaatggtggtggccaggttgctcctcctccaatggttaatggtggaagtggcaaactccatcaaatcgttgttgagtcggaacctaaaaaggcgtccgttgtcgtggatcactcacctcaaaaggaaccggaaaaagccggatgcgccatctgatgctgctccaaccgttgttgactcattgccctctccgacgtctacaccgaataagaaggatgaagttatggcgatttccgccgttgctcctccctcctccattgtcgatgttccgaaaacggatgataccgccccgccgccgtctttgtctcagccggtggccgcaactgccgccgctgcaccaccaccaacatcggaacaacagccgaaccctgcggttgtcaccactgccgcggccaacaacaccaacaatagtttggctcaaaggccaaagtctgtcgtggccggctcgtacgcggccattgccgctgccgcacgagggaatgggccgaacaatgttgataacatcgtgaccgtgcacgttcctgctgcaacgaatggtcc

SEQ ID NO: 95467 - DNA, 359 bp, Heterodera glycines
  SCN-specific regions: Sequence locations=1-95,117-134,173-359
gagagatgtttgaccgcgtctttcttcgctttaatccctttaattgctcaggcgttcattgggaaagcttctccagtcgctgtgttgcaggtgcgattcaactgtccatggcatcggagtggttacacgccaaattttttcggttttaaagtgaaaagaaaactgaaaatgcgaactgttgaacggttgagtcagacggaaggaagtcggcacattttgatgagacgcgtcctctcagagaaacattttgtcgcatggaattggccatcaaagaaaccgcggaatgatcgactgaattaccctctctgatcgttgacattttgttgatagaataaacgctttggattgttaacaaaaaa

SEQ ID NO: 95468 - DNA, 541 bp, Heterodera glycines
  SCN-specific regions: Sequence locations=1-7,29-37,59-111,133-451,475- 541
ttgaggcattaatattacttttgttgcaatgctgccatccaatcttttcttcttgctgatgaccatgctcagcagttccctcctccatcagacattggcaaataaattttcagcagagaccgacgcagtaaatccgacgcgattaatccagagacggcatttgattcgaagccgcgcaactcacaaagaaaaaatgcactcgaacgtaaatgaaggctatttacagtgggaaaaggataaattccacgaagcactgggagaaaagattttgccgaagagttcccgatctctgatggaccccaagtttttgggatcggtggaaccgcggcttttgaaaacatcggcggatgggacgcggacaaaaagcgattcggaagaggaaaagtggcggaattggctgcgcaggcatttcccagctgcgagaacaatttctgatcagtgatcactgatcacttttcattttatcaaatgcaaatgatcgctcatctcacctttttgaattggatcggattttcaatcttcaataaactttatttattaa

SEQ ID NO: 95469 - DNA, 556 bp, Heterodera glycines
  SCN-specific regions: Sequence locations=1-104,126-556
aaagctggagctccccgcggtggcggccgctcttcactagtggatcccccgggctgcaggatattcggcacgagggaaagaatttgatcactcagaagaagtggttacaaaaataactttggagacaattcttttcaactttggtaatctgtcggtgcatacgacccgagcaaataatttggatacgaaacattctgctggacgggacactgaaaaaatgctgcaaagtgactgccatctgccgaaagtgccgttgcgttacttcccctacaaagtgccgcgcaggtttttgctcgccaaacaacgccaaaagctgcgcaacagtcaaagcgattccgccggttcgacattttcttatgagaattctctgctgaatgcgcgtctcgacgggtgtgaatttgacggacgatcgctaacatcggacaccaaagaattcgctgacgtacagcagagcaaacaaacagcggagaagcgtcctcgctgtccgtcctcctccgccacttcggccttttccgcgtatcgtaccgccccaccaccgcctcgtccgtgttggctt

SEQ ID NO: 95470 - DNA, 264 bp, Heterodera glycines
  SCN-specific regions: Sequence locations=1-125,147-264
gcgggatattgtgcactgaaaaaggtagcaagtagagtcctcccactagacttcacaaccaatctctgttttagcttgccgacaatgtgaaagggcgtgccaaactcggcgttttggtgccgtaattctttctttctttcttaatccctttcaattattgtcatcattctcattcccaggcttttgctgaggctttgctggttattccgaaaactttggcggtcaatgccggattcgacgcccaggaggtgagggaaaagcatg

SEQ ID NO: 95471 - DNA, 557 bp, Heterodera glycines
  SCN-specific regions: Sequence locations=1-557
tctcaaacgaggatttcgactatctctccgccctcagtggcctttacacggcatcggtcgaacgtcgaaaatgcaatttgcttgtgctcgtgcagggcaatttggacaatttggaagggaaaatggtcattttaactatccacgacgtgggcaaaaaccacctgagttttgtcgacttcgtcaacagtctttcgatggcacccctccgcggccgttcccttttcctccatatttgtgtgcctggccaagagcccgatgttccgattttcgccggaagcagtttcccgtcgatggatcagctcggccatgccatggtgcaagtgctgcgccatttcaaaatctctcattgttttgcaatgggcgaaggcgccggcgcggacatttgttgtcgattcgctttggattttccgtcgatggtccgggggttggtgttgatccattgcacttcgacaacccacggaattgtcgaaaacatcaaagagattttcgccgggttgcgtctcgaagacggcgaaatgactcattcggcgtggaattatttgctgactcaccgtttt

SEQ ID NO: 95472 - DNA, 915 bp, Heterodera glycines
  SCN-specific regions: Sequence locations=1-439,461-654,676-915
atttgttcgaacaaatgcttgaggtcagagcagtcggaacaaatatcggaaaagagcaggatgggccgtcatacgaaatgcttttccgtttaacaacgacaaatagaagcaaatctgctccttttctggccaaaataccgacaaaaactttgaaaagggaagtcgcaaacgaagcaaaaacgaataattcaacaaatgatgacgagaggaaggaggaggagcaattcgcatctctgaaaaaccgttgccatacaatcgcatcgacaagcgcaccttttgcttcgacaaaagtgcaacagaacggcgtggacagcaatcattctccgtctgcaaaacagtcttcgtcctcttctcccgttgcatccacaaaaacttttcgacggcggactgcctttgaaacttcggaagcaatgcgtgaaattttcggtgcatattctcctttctcatcacagaaaaaagagaattccggagaatttaatcggaaaaaaatggcattggaaaatggaaggacgatgaacggaactcagcaaaacaataaaacagcgattcgaccgtcggagtttgaggatgacacggagagcagagactttgaaaatttgtccatgtcagtgtcggaggcatcgtcagaagtgggaagtgtgtccatccaagacggagcaatgctaaaccaaaatgaacggccaatgcttgaaaatggaatcacgaaaaggaacgtcagactgaaaagtgatttaagaatttcgcccgcaagttccggaagttgggagagggcaattcgtcccgtagtgaacaaacatcacaatgccaatgctgcgtccgttggacggcgacctgcggcgaatacccaacgatcttcggtgtgttggtattgtggtgtgaaaggacatgccgcagcccattgtcaaaaaaagcgca

SEQ ID NO: 95473 - DNA, 878 bp, Heterodera glycines
  SCN-specific regions: Sequence locations=1-75,127-290,313-771,797-878
gtttgaggcgcagcactttccaagctccactaaatttgtttttttgtgaataacagtcagcaaaaacaaagcaaaaatggacgccatcaagaagaagatgcaggcgatgaagatcgagaaggacaatgccatcgaccgggcggacgccgcggaggaaaagtgccgtcaaacgcaggaacggttggagcgtgttgaggaggaattgcgggacacgcagaagaaaatgatggcgacggagaacgaattggacaaggcgcaggaggacctgacggctgccaacaatttgttggaggagaaggagaagaaagtgcaggaggctgaagccgaagtggcgtcactgaaccgtcgcatggttctgttggaagagggagttgggacaagcttgaggagcgcccttaaacttgccaccgaaaaaatggaagaagcgacggccaattgcgacgaatcggaacgtgtgcgtaaagtgatggaaaaccgttctctgcaagacgaggagcgtgccaatgccatcgaagaacagctgcaaggaggcccaatcgctggcggaagaagcggaccgaaaatacgacgaggtcgctcgtaaattggcaatggttgaagccgacttggaacgtgccgaggagcgcgcagaggccggggagaacaaaattgtggagttggaggaggaattgcgcgttgtgggcaacaacttgaagtcgttggagctcagcgaagaaaaggcgttgcaacgcgaggaagcgtacgaagagcaagtgcgtcagatggaagtgcgtctgaaggaggctgagactcgcgcggaattcgctgaacgttcgggacaaaagctgcaaaagggagtggacagactggaggacgaattggtccacgagaaggagcgg

SEQ ID NO: 95474 - DNA, 511 bp, Heterodera glycines
  SCN-specific regions: Sequence locations=1-20,42-213,248-286,308-511
tgtctgtctgtttagtgctctctccaaattggcttctatttccatattgattaacaaccctccatattgcctcgggcgtagtaagcctactccctcaaggaatagtgtttgatgtcgagaggaaaagaaaaagagtgatggcgccgatgggtgtgcttttccctcccgctgtggctttatgtgagtgactaaaagatcagttgaaccccaacaagcagcttcttcttcttcctctcctcgttctgctttgctgtctcttccctcatcaattgggccggcggttaaagcaatggtagccaataaatgaagcatttttgccatcgggggacattcaacgaaaagaagaagcggaggaatggacaaattgtcgtcccaaaatgtatttagagagcaaatgagcatcacattacaaacaattccatctaatatgtatccaaatttaaatcgactatttaagggatctctctatttttcccgaactccgaattcctaaatacctgcaaaaaactac

SEQ ID NO: 95475 - DNA, 577 bp, Heterodera glycines
  SCN-specific regions: Sequence locations=1-77,104-368,394-439,461-577
gcgacaaaaggagcgaagattggactttgggttgatttgacaaattccgacaatttttacaacgaggaagaggttttaaacaatggaagcaaatttctaaaaatgaaaatggtggggcacaaacaaacgccgacgcctgagcaaacgacggcattcattgaagcgattgaccgttttatcacgaataacccggacgatgtgattgtggtgcattgcactcatggtttcaatcggaccggctttctcatctcggcctatctgtacgaaaagtgcgacatgagtatcgaaatggcagtcagagaatttgcggagtgtcgtccgaatggcatttacaagcagtactacttggacgaccttcgcaagagatacggcgatgaggacgaagacgagatgacagtttgaatatccaatagatcggcaaaacactgtgatttccttttagttccccggaaggcctttgtgggagaacggaccgatcagtgacgacgaattcaccaacaacggagcatttgtcatggaggcgacttccaacaattctgacgttggcattgcttcgaatgggccttcgtcttcctcg

SEQ ID NO: 95476 - DNA, 428 bp, Heterodera glycines
  SCN-specific regions: Sequence locations=1-428
aagaaatatagcaatgggaaaatatgacccggaggaaggttatgattcgaatctcaccgacttgaaactgttcgaagcgggcgaaccttttgaaatgcaaattaaattgttgaaaaggccttcggaggacaacctgcccatgacagaaattctttcttcaatttctttgagtctgacaatgacagtgattgtgagcacgccgaaaggaaccagccaaaccaactacacattggacagtgaaagctaccgagacatgaattacataacagtgcgtggtgacttggaactgttcgcggaaccttcattgctgaacgatataacacatcccattcttcccgtgcttattttgcatcggtatcgcctttactggtaccggtagttcattttttcgctaccgtaaccctaaaaaccaatgacgagaacacggg

SEQ ID NO: 95477 - DNA, 881 bp, Heterodera glycines
  SCN-specific regions: Sequence locations=1-186,208-485,509-517,539-881
gttgtgcaaaatttttttgtaataaaaactatgaaaattttttatccggggttttagaggttgctgatcacgaatttgacatctaactcgaggtcatggactccaagaaccccagggaattctttttaattgggaaatcgacaataaggaattcccggaaacttttccgttctcgaaaatcgcatttgtcttcaattaattccttgcagaaagtgccactaccagaaaacaggacactgcacaattggagagcgccgacttagcatttgccaatttaatgcaggcggaagagcgcgttcacgagcgggagcaggaacaacggttgaggaacagccaaagtgttcaaatggaggtcgacaagttccaatcgtcgcaaagtttgaccgggaaaaggacgcacaaattcacactttgggtcgacaaatacgcgccgagcacctttctggatttgttgaccaaagattgctgttatggctccgtctttgggatgaatgtgtttttgagaaaagaggaggcaaaaaatgggaggggaaccaccgacgcatttcccagcggaacaatgccaatgcgacgtctctgtgggacaatttggaggagagagatcgaacactcttcgaaatggaacggccaaaaggcactgacagccgaatgccaaaacaaaaaattttggcactttttgggccctccggagttggcaaaacgtcgttggcccgcgtggcggcggagcaggccggctaccggcctgtgatcataccgatcagtgaacttcaaaacatggcggagctgaagtcgcgtcttgaaaatgccaccgattgtacgtccattgacgcgctcttccacaatttgtccgtctctgccgcttcggcaggcgaagcaccgcc

SEQ ID NO: 95478 - DNA, 622 bp, Heterodera glycines
  SCN-specific regions: Sequence locations=1-183,237-248,272-622
atcagttccatcatttccccattttcctttgatcaaattggccaagtcttccccaatcgcctttgaacgaccccattaatccgggatttttcactttaccaattcttcttttattttggtctcttctatttctgttcaacaccatccctcatttctggtcaacccatctctttcatttctggtcaaccccctttccccatttccctctcatctctcaaaatatttccttttaattaccgatcagttccattttccccatttattttggtcaacttgccccaatcatttcgatcagtgccattcccccatttattgatcaaatggcacaaatttagtttgggtcaatgccattcatcatttttctcaaattgcgcgcaattcttctgatcagcgtatcccttcctctttgatcagtgccattctctcccccattttcttttgatcaattgtccctcattgattaatttcatttattttgatcagttccaccccattttatttgaccaattagtcccaattaatttgatcaggcccctccctctaattttcaattgattaaattgtgcaaatttcttttaatcagcgccacctcctccgtttttgtggtcgaattgcgcttttc

SEQ ID NO: 95479 - DNA, 1180 bp, Heterodera glycines
  SCN-specific regions: Sequence locations=1-351,373-1180
ccaattcattcgttttcccttcttttttcttttcctccatttctgtcaatttgattttgatttctcttggaaattctctgaaaatgccttcctccgattttccgatgccgtacacttcacggctcagtgagccttgcttggcaccaggccaatctttggtcttccaagggtccgttgattcggatgctcgtcattttgaactgtctctgatcagtggggtgcctaactcaggccaagagcgcatcgcccttcagatttgcttccacttcgaagtcggcatcaccattttgaactcgatgttggaaaacggcgaatggggcgaggaggagtttcattcgaatcccttcttccatgggaaaccatttgatgtgcgaattcgagtccacgagaaaagattcgacttttttgtcaaccaagtgccgtgggctgtgttcgaacaccgcacggatttccgaaaaatcgaccacatccaagcgtcgggcgacgtttcgctgtccgccgtccattggggcggccgatacttcgaaatgccgtacgaaatgactttccacgaccacgcgctcgaaagtgggcagcgactgttcgtttatggcattccccgccggcgatttcgccgtttcactgatcagcgacagtttggaggagctgttcagaatgagtgcactgcttcgacaagcaaattgtggtccgaaatgcccaaacggacaaagaatggggcgccgaagaaagtgaaggaggccctttcccgttcagaaagggcgaggggttcgacttggtcattctgaacgagccattggcactccaaatttccatcaatggcactcccttctgttcatttttccaccgcaccatcgatgcccacaaagactacaaaaaggtacgcattagcggtgaggtggaattgaccgggcatggaaagtgagtctgtgctgggaaagtgttggaggagtgtccaattgctgcaaatatccggagggaagggcccagcggacgaacgcggccggggagaacgtgcagcagccgattggactgagccgttgaaaaagcgcgcggggaaaggctaatgaatggacggctaatgtcgttcggtccagcggaaacgccgtttgatcttccgctaatcattcgaaattacattaatttgatcagtgatcactcatttattcccatcaattttgtg

SEQ ID NO: 95480 - DNA, 800 bp, Heterodera glycines
  SCN-specific regions: Sequence locations=1-83,112-149,171-243,265-800
gcaaacggagcggcagcccaagcgcaagcagtagctgtagaacaaccagcggcgacagcaaccgcacaaccgtcacaagcagtaacagcaacaacaacaacaacaacagcagccgaagtgcaacaaacggagcaacccacggccgcaatacaacaccaacagcagcagcacaaatcggtgggccaaatgctgctgaaactgttgccctgcaactgttcgtccatcggaagtggcgggtcagtcgggtggggcgggggaagaagtacagtctattcgagagtctcgactcctccacttgagaaaggtctccccttgtttggtgttgttgtccaattaaaaggaattaaaattagggttggtcgccgtgccggccccatggatggagaagagtcgggaatcggaaaggaaattccccgaccaaaattttgtcgggaatggctggagaaatttaaaaacggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaattttggttaagtttcaaaaaagttatggccagaaggaactcaaaaacccagtaattcgaactttttttgctctgattttttttgtgcataaataaaaatttttgaaaatttgcaggctaatagcatttttcgaatgctttcgaataataacaagaatgtttaatttggttgagaaagaaaaaagttatggtcgaaaaattc

SEQ ID NO: 95481 - DNA, 562 bp, Heterodera glycines
  SCN-specific regions: Sequence locations=1-17,39-241,270-562
ggcatttattgtctcaattagttaatgaataatgaaaatgatgtggcggttgacgaccgaccacagaccgccacttttgttcattttgcttaaattgggcagcaaatcatttgtgaattgtggaaattttttttttttggagggggatgacataatgacaataattggacaattaaattaatgagaagtgtgtgctttgtttctacaacaaattgctgacaaatgagcgtgcaaaaagtgcaaaaataaatatttaaattgaaaataatgcaaattcagccaaatttatagtagggaaaaacagcatttcctgaatgatattatgtacaatgagtgcggagctgtgggggacatgttttgtaaatttcggaaatttttcatttttttatcataaaaaaatttggggttaagcgggagaccggcggggctgatcaaatcgggattctttagtcagcgtcttaaaacttgcagaatcggggtaaaattttgcgcaaacaaacaatggtacacactgaatctaacttttagggatttattaatttttaatccggctgaaaacgct

SEQ ID NO: 95482 - DNA, 878 bp, Heterodera glycines
  SCN-specific regions: Sequence locations=1-62,84-786,808-878
agtccaattggtccattctgaattccctcctccgtccgttgccctaagccatcaatttgaccattgggacgccctcaggggacggaagggaattgacaaattcgaacatttttctgccgcttcctccacaaaatccaatcgttttttggtttgcactgcttttggcgcttttttggcaacgaatttcgaaaattgcgccgttttggagagaatttgcgattcgcgcctcgggaaaaatccgaaggaagtgaaacgattcgaattgccatttcgaataggaaaaatcagtgccggaagggatcacctaatcattttggactctttgaacggagagatttggagtttcgggacggggacgaggggcgaattgggcacggggcgagtggaggcggacaattgggcggaggggccgagacggattccgagtttttccgaggcggacattcgctgcgtggacatcgaaagcggcgcatggcattctttggcactgaccgcggaaggcgatgtgtacggatggggatggaatggacacggccaaattgggcatctgtccacagaattttccatccaaccgacgccctttccttttgatttgggcgatggaagggccaccatgatacgttgcgctggcaataattcatttttgttgcttagcgatggaagtgaaatggaatttggagaaatttgcaccgaaaagccaatggacgaacaaatggcggaaaaaatgccagaaaatgggtccaaaaatggcaccgaaaaagacgaaaagaagggacaaagccaagaaaaggacggaaaggagaagagacaaagtccatcggcaaaaaggcaaaggcaccaacggacactgaaagtggcggtggtcggctgcagtcatg

SEQ ID NO: 95483 - DNA, 1196 bp, Heterodera glycines
  SCN-specific regions: Sequence locations=1-94,116-254,289-289,319 -352,381-425,449-1000,1022-1196
gtttgagcaagaacattatggtaaacaagtttttaccgctgatcattttcgtttttctgctgattgacaccgccatatgtcgccatcaccatcggcactcccatcaccaccatcaacaaaatgagcagccggagatgatcagcgttccgcttcgccgcatggacaccgtccgcgcccgtctggcgctcaccggatcgcttgaacagttccgcaagcatcgcacggagtcgttgcgccgtaccgtggagcgaatgaacaacaactacaacaacaatgaagagtacagcagcgcggaatcggaccaggaacagatggaaatggcacaaaacggggccagagttggcacggaaattgacgaactgttgcgcaactacatggacgcccaatattacggtgacatttccatcggttcaccggcgcaaaatttcaccgtcatcttcgacaccggttcatcaaacctatgggtgccgtccaaaaaatgtcccatttatgacatcgcttgcagccttcaccacaaatatgatggcgccaaatcaacctcctatcagcccgatgggcgaaaggtggcaatacagtacggcactggctcaatgaaaggatttgtttccaaagacattgtttgtatggcaaacatttgtgtacaaaaacaggaattcactgaagcgaccagtgggcctggcctcaccttcgtggctgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattggcggcactgatcagcgacgatttgtggccccaatcacttacacaccggtcacacacaaagcctactggcaattcaagatggattcgatcagtggaggtaatggcaaacttgcgtgccaaaatgggtgccaagccattgcggacaccggcacctccctgcttgctgggcccaaaaatgacattgaaaagattcagaaacacattggagcaattccgctcttccatggcgagtatatgatatcatgtgaacgtattcccacactgcccgatgtgacgatcaacatcggtgggcaggcgtacacgttgaaaggccaagactatgtgctgaaaatgaca

SEQ ID NO: 95484 - DNA, 804 bp, Heterodera glycines
  SCN-specific regions: Sequence locations=1-471,495-804
ccaagtttgagaatcaaaatgagacttagcttatcacgttttgcctccaccgtggcaatgttcgccggagggcccatcgagcggccgttggcctattacagccagtttcggcccgcttcgctgaccatgcatcaatacttggactttggccgcaagggcagtgcgtttacctcctaccacttcctgaagacggaactgctggtccgcatggcgaacattatgcaggagttcgacctgctgcccgccaaactgatgcagacgcccagcgcacgccatgtgggctcgtggtacaaacaaagcttctctgaactgctccatttcgagggcctcgagcccagcgacatggtgttggacaagttcaacaaccaattgcgcacaattttgcatcgtcacaacaccgtcgtggagacaatggctgaggcactgctcgaactgaaggaaagccacggcgtggacattgcatgcgaacgcaacattcagtacttcttggatcgtttctacttgaatcggatttccatacgaatgttgcaaaaccaacacttggcaattttcgccgccgcctgcgacaccaatggcactaacaatcagtcgcgcaagacagtcgtggtggacccggccggccatgttggacacattgacccgcagtgcaatgtgcgcgacattctgctggacgcctacgaaaacgcgaggtttctctccgagcaacacttttgcgtgtcgccaatgctcgacttgcgctgcttcaacacccgaattcccgaccagcaaattagcgtcccgctggttccgctccatttgtactac

SEQ ID NO: 95485 - DNA, 1964 bp, Heterodera glycines
  SCN-specific regions: Sequence locations=1-163,187-466,489-578,600 -682,705-982,1004-1468,1490-1618,1641-1727,1749-1749,1771-1886,1908 -1918,1940-1964
attgagcagcccatttcgcgtcacttgcgccgattggtcacttcgatcacccttttcttcaccatcattttgcttgtcgtctatgttccagttcgggtgatcaaatggctttgtccttcgacccttccctacgttttctcggggtctgctgacactccactggttgaatattcattcgaattggttcttttgcaggttataatgcccagcattttggagtattccaaagcattttctctgctcaaacgaactgttcgcatttggtgtcgtgtcgttggcggatggctttctttggacagttatttgcttcctgcggacaaagagaagcgaaacggcggtcagcagcacagggaacagcaaaggcagcgggcgagggaacggttgttgaggggcgaccaggaggaacagatcggactcattgaagcattggaagcgatcgaagacaattcgacggatgacgaggaaaggcaggagagtgaggaggagggggaattggtggagaatggaaatgagggggacaatgttgtggatgacagtgaagaggacaacaccgaatccaatgggcaacggaaaaccgaagatggacacgaggaggagggggaagtacgtgttgagaaagagatggcagagaacggactaaaagcgaaaagcgcggtggaaaactgtgaagacaccgcggaagaccaaaagagggaagtgaacaacggaagacccactggggagagaccggaggaactttttttttatggcatggagcaggacaaccagctgaatggacgaccagctgtggtgggccgacaggaacaacaaattcagcaacgtcttcagagggcacagcttcatcgggagcagcgcaatttgggcgctcaacatcaggcactcctccgcttccgagactcctccgtacccgaagaatatgtccagccgaacctcttcccccttcgcatttcgcttcttctttttttcgtcgccctccccaccattgcaatttctttgctcttttttcttataccgggtaaatggaatttaataatcccatgtaacactaacattccgtttttgtttagtcacaattggtcgctttttgctttccacgttggctttgacaaatcagcccatccacgacttgtacaccatcgccgttgggctttacgcctgttggatttgtgtccgtttgggccttctttctcgggaatgggctcgcagagggtggacttacgtgaaaaaggttggcacgggtcttttgccttttgaatgtccgtttggttccttttcagctgttcaatgccacggtgtttctgctggttcgtgtctttgccgccgcttttcctttgttggccgtcattccctttatgctcggcctttacttccaaatgctcgtcatttctcctcttcgcgtggccattttccaatcgccgcttttcttcccctggaaagaatgggccatgggtgttgtccacttcaaaattgtttgtgcttccgttttgatgggccccgactggtggctgaagacggcttttgaacaggtccaacaacgcacatgtgctgggttgtcactgtttgtttttattatttacgccgatggcatttggaacatccgtttgcgagacctttacacgaacctggtgttcccaattgtgaatacactcacttttctgatcgcgtttccttacgttctcagcaattttctcctcttttttgtcggtaagcgatttaaatttttttcttttcccaaattttaatatcaaaatattttatcactattttattctgtgttttcagatgcttcacgcgaggaacaaatcattgtgatacgatttgcttatccgtttctgctcggctccatttgtttctgtgctttaatcacatggcaatggcaaaagctcaaacttttggcccagaaaattcgtaacgacaaggtgctttgttttgctactctaataatgaatattgggtagggtttt

SEQ ID NO: 95486 - DNA, 540 bp, Heterodera glycines
  SCN-specific regions: Sequence locations=1-285,307-384,406-540
aaagctggagctccccgcggtggcggccgctctcacaactagtggatcccccgggctgcatgctctcgtgggaccccgcggcgttcagcggactccgtcagattgtcgtcccgcgggcggacgtttggctgcccaaacttttcatttacaattccatggataccaaagaaatgctggcggataattacttcgacgtccgcctcacgcaccagggcaaactgaagataaacattccgcattacgtcacttgcatttgccgattggatattgcgcttttccccttcgacacccaattctgtgccattgcccaggcttcgccactgctcggagtcgaagagatggacgtcaacgtgacaatgccgcccaaagattcttacttttcgggaaatgccgaatgggaactgttcaatgtcagcgtaagggacaccaaattttgggaggatggcgagcggagggtcgaagtgcattatgtgatgcacatgcggaggaggcccgtctattacttgacggtcatcgtcgcccccacttttctcatctctt

SEQ ID NO: 95487 - DNA, 475 bp, Heterodera glycines
  SCN-specific regions: Sequence locations=1-475
agccattcaaattacaagtgaccaaatgattgcgtcgaattcggctggcgcgccgtaccgcggcgatccgatggcatccgctgcactcggtttttcaaattttgtgaatggtgccctcatccgacaccctttcgttgtgctgcggcgccagtgccaagtgcatgaccacgcgacacgcaaacatttgacgcccattagtcttttgccggttgtggtcaacttggccgggaaagatggtactttttcgctttggaaaggtgccattggcagcggcgttctttgggtggtttcgcatgcgtcggaatttttgattgcccagctttttaacctaccaaaatcatttgtaccccaaggcagctccgaacgcttttggcgccatgtttttctcaaaaccgcctcttttctcgcctgcactcctttcattggctcctctttcatcgaaactgtccgcagtggtggaaggttatcggatgaa

SEQ ID NO: 95488 - DNA, 192 bp, Heterodera glycines
  SCN-specific regions: Sequence locations=1-26,53-192
ctaaaattgcagagagatcaattaacagacaggaaatccaatacaaaccatccattatgagtggaattgtgcgggattggatcttcctaggcacagtgtagcccgaacgttcgatgttcttagccagcagctcttcaaagccagcttccttccagttgctgacgcacaaaatcaacagtgtgctgttaccag

SEQ ID NO: 95489 - DNA, 421 bp, Heterodera glycines
  SCN-specific regions: Sequence locations=1-421
aatgagggattgaagccatgataatcccagcatttttagcttttggggcctacgcgttaaaaaacatgtttttaagtccctatttgcttttttgggctgccccaggtttgtccggttgttggcgctagagctcctcgagagtcaaaattccgagactcgagaccgaggtttctagagcatccctaattggcggattggcggcaatctttttggggacggtccaattttaatggaatccaaaaatcccatggaaatatgtcaaggcaaaatcaccaaagagcagctccgttttgggtacgaagcattgggccgcattgagcgccacgtgcaaaaagggactttcggcagagactttgtggaggcaatgaatgagtgaggaaaagcaaagaaaatgggggggggggaaaccccacgaaaatcc

SEQ ID NO: 95490 - DNA, 507 bp, Heterodera glycines
  SCN-specific regions: Sequence locations=1-238,260-426,449-507
gaatgttttctcacaaaagcgccgctatgtccggaaatgagcatggagcagcaggacggcctttggccactctcttccacggaccgatgccaaagccgagcgaattgcaatgccatcggagaaaacggcggactcgtaacattgagcggagaagagacagacgaatcgcagtgtacgacgccaaccgaaacactttcaccaattgtacgacgtaaaacgacggattcaaaagaaggcaccaaaatcagagaggaaaagagagcggtggaaggaacacatggaaatgtaaaagtgacggacggaattatgttggaaaaaaggggcacacaaagggcgacggagcggcaaaacaacgacgaaagggagacggacaacagagcaccgctggacagtccccgtagtcagaaccaacactgtacggatgtgctcatcccaacttcaaatcccattttcgctccgtgcgcccggcctttctttcacaacaaaatgccaatcttacgtccaaac

SEQ ID NO: 95491 - DNA, 374 bp, Heterodera glycines
  SCN-specific regions: Sequence locations=1-199,221-374
ttttcaaagcattattgacagtttgtacacagaagggacttctcgaggcgaatcgtgaatcgcccatcagtcagcctacgctcaattttttgatcgaaaataaaaaggacccaatgtcaatggtcaacatttactgctcggttttgggtgatcccaattttgagttttttggctttcatcttgttagtcaggccaagcaaatttctttttatcactgaattgagaggtcggcccgtttatggcttttgcgcagcgtcaaaaaaggaggccaaaaaggcctgtgcattacgacttctcgacattttgatgacataagaacgactcgaatgtgttaatgtgtccggacggaaagtgaggaaaatgccgccaaaacc

SEQ ID NO: 95492 - DNA, 462 bp, Heterodera glycines
  SCN-specific regions: Sequence locations=1-173,195-462
cctaattacaaccgcaaccaatattttaaaagcattatcgacagtttgtcacagaagggacttctcgaagcgaatcgtcaaccgcccatcagtcactcgacactcagttttttgatggaaaggaaaaaggacccaatgtcaatggtcaacatttactgctcggcttcgggtgagcccaattttgagttttttgtctttcaacttgcagtcaggccaagcaaatttgttttcatctttgaattgagaagtcggcccgtttatggcttttgcgcagcgtcaaaaaaggaggccaaaaaggcttgcgcattgcgacttctcgacattttgatgacagaagaacgactcgaatgtgtcaatttgtccggacggaaagtgaggaaaatgccgccaaagccaattccgacaaaagcagcgaatgtcgaacaaagtcaacagcaggaaaacatgcacttgtcattctct

SEQ ID NO: 95493 - DNA, 476 bp, Heterodera glycines
  SCN-specific regions: Sequence locations=1-4,49-476
caaagacgacggcgccaatgacaccgacgacgacggcactgacgacgagcgcgggcagtcctttcgcctttggctcgtccgcctcgaccaccgcttcccccggcgccaccacaaccaccgcctcggccactctcccgcttctctttggcactcagcagaaaacgacggcacccgccgctgtgccttcctccgtccccgccttctctttcggcaccgccaaattcccttcttttggctcctccgccgccggtggcactctcttcggttcgaccaccgccaacaccctcacgacaagctcacaaccacacgttaacggtggatctcgtaagcgatcggctgcacaatcagtcgatgacatttcgccgtatggaaagagaactgcgtccagttcattgacggagacaagttcaatcgccaacgcccctctgtttgggggagcactaacgatgacgacgaaaccaaacacagcaattgat

SEQ ID NO: 95494 - DNA, 2515 bp, Heterodera glycines
  SCN-specific regions: Sequence locations=1-781,812-878,923-1052,1083 -1095,1117-1166,1202-1205,1231-1266,1288-1298,1345-1358,1392 -1650,1683-1688,1772-1772,1802-1853,1976-1978,2006-2013,2090 -2161,2229-2364,2400-2515
gtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgctggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaaca

SEQ ID NO: 95495 - DNA, 166 bp, Heterodera glycines
  SCN-specific regions: Sequence locations=1-59,81-166
tttcaactactcgaccaaatttttgaaattttattggcttccggcattaccggactcagaaattttactaaaccaaatttaccaaaatgtaaaactgatcccctccctgccctccaaaaattattttttgaataatgagctaaaaaatttagtgacaccgaaaggc

SEQ ID NO: 95496 - DNA, 462 bp, Heterodera glycines
  SCN-specific regions: Sequence locations=1-1,24-230,252-462
aataatttttattagaggatgtggacatttttaggaaaatggaagaataataatacaaagaactaaaaattttgcattttatacctttcaatgtttatttaacccataaaataaatttggctcattcgaaatcattataaatagcatttatacttgcttaattttttcattttgttgtcttcatctcattaatattgcatttttcctctataaattgcactcttcctttcgttaatttttccaaaattgtagcttccaaattctcaaaatggtgcttcttacggaaaaaatcgccaaaattttaaactgccgtgtcagcgagctccgtgatcggcttaatcatccttccgattgtgaaacggtggtgaaagcgctgacaggacaccgtgttaaaacaacatacaaagacagaaatggatacaccaaaagctttgcttttgggggaattacagcacaaggagc

SEQ ID NO: 95497 - DNA, 847 bp, Heterodera glycines
  SCN-specific regions: Sequence locations=1-847
atcagaaacgaggaggaaatgccattgaaaagcattaatgccctccaaaacggttaatgtctttgagtggcgtcccgaaacaattaaatttgccaaatgtctgccagaattcagcacgaggctttttttgaacattttggcattgtgttggacaacgccgagggcgtttacttttccggacaggaaattgccggaaaggtggtcattgagtgccgggaaccgcgccgaatcagcgaacttttgctggaagtgaagggacgggcgcggacgcattggacaaagtcacgcaaaatgtgcagcgaaaacgaaacgtacttttgcgagcagttcaacacggaatacacgcgaaagttgccaaaaacggaggccgaaaacgacgcggggggagaaacaccacgggaaggggggaggacagtggcggaacggagaagggaaagcatcaaaatgatgggccgtcttctccacgtcggcacccacgagattcccttctcctacgcactgccgaagagtttgccgagttcgttcgagggcgagttcggcttcgtccgctacacgtgccgtgccatctgcgaaagtccgtgggacttcgacacggtgtgctttttgcccttcactgtcattggcatcgaagatttgaaccacgaggccgaggttccgtcagcgccgaatttcgactcgccaagggtggccttacgccgggcgaaaatgtgccgatgaacgcgaaagttcgaaaccaaagcggacgaacgctgcgcgggttggagctcagactgagcaaagacgtggtgtacaaatcgaaaacatttgcgggtgccgaacagcggcggaccaccaaaaatgtggtgga

SEQ ID NO: 95498 - DNA, 2209 bp, Heterodera glycines
  misc_feature (1514)..(1514): n is a, c, g, or t
  SCN-specific regions: Sequence locations=1-1861,1884-2209
gttcaaccaaacacttcaaagcttcattcgcgagttgtcttcctgtttatcgtattcttcgagtccgtaatcgcttccgggatagggcgtttatggacgtgtcatttgacgcgactaccctcaaaaccaatccaaaattacaccggaagagcctttagaacatctattgcccttcacacttccttcgtttgtcgtccttcgcttggcactgctgaaaagtcactgcaccgaaccgcggccccgaacccgagcctcacaacacttggacgtgaacgcggagcctccttgggaccctgatccgaacgcaattacctgacattcgttcccgtacattggtgaaattgtcctccattattgttagtgtcccatccattgtctcgtccctttgtttctgccgacttcgtctttgaagcggcgttcttattcaacacgccaaaattcgtctcttttccaaccccaaaggccttttcctactccgtctttcgtcctcttccttcgtcactgtgcgtcctcatcagttgaaggtcgaccaggagcgtctctcccactttcggttccggaagttggccgccttcgtccgtcgtctgaagcgaccgccctaatttgtttgtcctttcattcattggcattggcaactcggcattatttgaattccaccaactacaacgatcagcgctcttttcttcggcagaacatgacaaacttcggcttccccccttcgcccacttttcacaccgttcgattgcgcgagggtggcaccatcacagtgtttcgagacgtcgccaacgacgagtttcgccggcgtcgtccctcggaatttgctgcacaaattgcggaaagcaaaagtgcaaaggatgactgtcgtccttttttcgtcatgaacattgactgcgccgttgcactgcttgaactttgggcccagtttctcccacgcgtgcagcccttttatgcgctcaattgcaacgcggacccaatgctgcttcgcttgatggcctctcatcagtctgttgggttcagctgctcatccggcgcagaaatgctcaatgctctccattatgtgtcggctgaccgtgtgtttggcgcctttccctgttggactcggtcggcactgcgccaggcggaaacgtgtggcgtgtacacgctgtgtttcgacagtgagcgcgacttggaccgcatcttggccaaccactcaaacgccagattgcttttgcgtatctgcgtggacccctgcgcgactgatgcgaatgcgttgttcggagccccgcttgacgaggcagtcgaactgttgaagctgtgcgttcagttgggcctcaattgcattggaatttccctctcaactggcccttccactgatgataattgcaatttgtcatcatcgtctcttttccatttctcttccgtctatgcgtttgccattgaatgcagtgcgcgtctgtttcgcattgccattgacttgggcctacggatggacgtgctgaacattggcgatgcttttgcttgtccttggtcatcancatcgactgaaacggacgagtcactggcgcatttcgcggagttttgtaccgaatttaaccggtccttcgatgtccatttcccgtctgatggcattggccatgggcttcgcattatggcaacccctggccaattctttgcgcgttccccattttcatgggtcaccaatgtgattggaaagcgaagcactgacgcaagtgcagtgaccaacaacgattttgatgctggcaaaaccgcttttcattaccagactaatgagagttattacggcacatttggctgtcgaatgatggtcaacaccgaaccgcgttgtgcaccgctttttaatgacttcgacatggacacggaacagaaccaatgcttttattatggaacagtgtttggtcagtcgggctttgacgacggctcggacacggacattgtccaatcggtttgccactttcgccagttgaacattggcgattggcttatttggtccaacatgggagcgtattcatttggcaattgcgggtcactggatgacgaaatcaacgacgacgatgacagtgatggaaacgaatttgacacactcaaaacgccaccgattttttatttcgcttcgcaagggaattgggagtccgtctgtcacaagtttgatttcgcctttcttgatgagcatcaacagcagcgtcgtgctggtccgttgtttgcgtcttcc

SEQ ID NO: 95499 - DNA, 558 bp, Heterodera glycines
  SCN-specific regions: Sequence locations=1-274,296-354,391-558
atgtaaaaattaacagaaattcacgggttcattcgatagttgcgagaaattccccggagaaactccaaaataatgtgaaatttattttttgaactcgcatctccaaaattttgtcatcccatcagaactcattttagcgaaggtccttagaagaccttcgtaagacaattttactttttgttttttggttgcaattgggttagccatttctgaaaaatgtccaaatcagaatgcacatcaaattggttaactattaaaaaataataggatttggaataagtaaaattgtaaaaaatgagcgaatgttaattaaacctagcttatgccaagtggcgagggatccctcaggcttagtttttagaatcttaatttttaaaaaagcacatttttcgatttttgggttgggcccaaacgaccccggggcccaaaaacgggggcccaaattaccccggggcccaaaaacgggggcccaaacgcggggggccaaaaacgagggcccatacgctctggtcccaaacaaaacaccactttcggcgcgaattcaaaaaggcaaaaagg

SEQ ID NO: 95500 - DNA, 920 bp, Heterodera glycines
  SCN-specific regions: Sequence locations=1-920
gcagactctcgttttgccgttcttcttttttacggctaagataggcgctgcccaatgactgaaatcgattggcttaattgcgccaatttgaagaaggcgatccaattcggcattcacagcttccatggcgccatgtggaattgggcgagctcggcaaaatacacgctttgcatcagaccgcaaaatgagatgcgcctttgcctttgagcagtgtcccagtccttcttcaaagacttcagggaaatctttttggagtaccgctttaagcgttgacacattattgatcgatttgtttggcggcttcactgccgaaaaattttcaatcattgtcgcctgatcagccgatttgctggacggaaataaaatttggcggggaatgatctccaaagcttcgatccacggcaatcccaataaattgtgtccgacttctccgctcacataagcgatcagaatttgcggtggtttgtcggcaaattggacagtgcattggaatttgccaagtaaggcgaatggctggtcattgcaatttttggcatcgatgtcggatggagtcagttccggttctcccaactctcgccatgtttgcaatgaaataattgtggcctgagcgccggtgtcgccattcatggaagtttgccttccattaatcaaaatgcacaatttccaccatcgcccttgagtcgtgccgacatgcaggcaatttgcgtcgactttgacactgtgaaatgaccggtggctgttcggtggtgccattttcttctttgaccggcaaattgttgaaatgtgcccttttttgttgcacttaaagcaagtggcgtccttgaatgagcaatcggagcgccagtggtcaattttgccacatgatccacacggaagtgttggacgaccacgtgttggctttccacttgaattggcatttt

SEQ ID NO: 95501 - DNA, 310 bp, Heterodera glycines
  SCN-specific regions: Sequence locations=1-91,113-310
cgtgcaaaaggacctgaaaagggacgcgaaactgaattatccgctcgaaatttcgtctgtgatcattgaaattgaatatttactccacaatttggaacgatggacggcagcctttaaatgtcgaaaagactttcaccacacttctcgactccccgcaaatcgttcgcgagccgaagggcgtcgttttgctcattggtccatggaattaccccctcaacactttgctaatgcctttggtcgacgttttagccgctgggaatactgccattttgaaaccgtccgaagtcgcggtcgaacaccgccgccgccg

SEQ ID NO: 95502 - DNA, 849 bp, Heterodera glycines
  SCN-specific regions: Sequence locations=1-512,535-849
agtggaattgggagcagtggcggcagccaaacgaacgacgcaaaagcgaaagtcggcacgaaaagcgacaaaaagcaaagggaaggagggacggcagaggacggcacaatgccaaaacagacgcaaaacgacccaatggcgggcgccggcgccgatctgctcagagacggcagcgaccttttctcgccctccggcacgttcaacagcagtttaaacgaaagcacttcgcccattggtggctccaccagcagcaaaatgagcagcagcttcaaccagagctcctcctataatcgcactttcgaacgcaaagtgatcgaagagagtacgccgacaatgaccacgcggatgttcacctcatcaccactgaacacaatcaagaccactcttggctccggcttcccctccgacttgggcggactcggcacgggcaccggcaccaccttcgtccagccccacaactaccaattcggcaccgccacctcgggctcgttccactcgtctgacgacagtctgtcggtcagcatggactgtgccatgtttgcacccgaagaactgaaggtgtctgttgtgggcaaccaaattgttgtggagggaaagcacggcgaaaagcaggactcacttgggtcgattgagcgccaatttgtgcgcaaatttgccatgccgcgcaacgccaccgccgactcagtgaacagcaatttgaccagcgacggaatgctgacggtgaccgccagcgcaccgaaagcaaaggataattcgccgattcgcacaattccggtgaaaattgtcacaacctccgcgggcggacaaacgccacaggaatgggggaggccaatttcaacaaaatggcag

SEQ ID NO: 95503 - DNA, 908 bp, Heterodera glycines
  SCN-specific regions: Sequence locations=1-253,281-379,401-790,842 -848,897-908
caagtttgaggaaaatacttttaactgatttccaccattaaaatgcactttgttctcattgccttctgcattgtttggcaactggttgtcgccaataacgtggagcagccggccaaccgtgccaagcggttcacctccttcggctcattgtccaccattgggggccgcgttggatgtgttgtgtcgaagaataagctgttcgtcaacggacacttcaccaaggacctgagcgaggatgagcaggaggaattgaagcagtaccaggagcagctggatcagttcaagtccgaagtcaagacctacttggaggagcgccagaaacagttccgcaaccaggtggcgcgccagggcggcgccgaggccaaggagggcggaactcagctgaagaagccggagccgccaaagaagcccagcttctgctcggacaaagccaccacacagtacgtgttcgacggctgcagcgttcaaggcgacaacgtgtacattggggatacttttgtgcgcaagctgagcccggacgagcagaaggaattggcccagtttgaccagaaattcaccgcctaccagaaggcagtgacggccggcttccgcaagcaagttgaggagatgtttggccaacattttgggcgccctgttcggcgccttcgatatgagccaatcgggtgctgaggacaaacaacaggcggtgccctcctccggcgctgagctagcgccggctggcgcagagaacggcacggcgccggaggcgccaaaaacgccgagcttctgcactttgttggtttgagatggcgagagagagaaaaagaaagaaaagcgaaagggcagacagagaaaccaaaggacaaagaaatcaataaaatcgatcaaacaatcgatgaattaatcgataatcaaccctattttaccgt

SEQ ID NO: 95504 - DNA, 209 bp, Heterodera glycines
  SCN-specific regions: Sequence locations=1-90,112-174,198-209
attaaatcagagggggaaaaaaattcgtaggggtcggaacggtgcactataaatgttgctgctgaaatgcatttcgccgaaacataacgtcaccaggaaaaacaaattttaatcgaactttttgtaatttttttgtaaaaatttcaagaaattccaagaaaaacctaagattgcattaaaaataaaattcagaattcggctattaagtt

SEQ ID NO: 95505 - DNA, 550 bp, Heterodera glycines
  SCN-specific regions: Sequence locations=1-550
aagctggagctccccgcggtggcggccgctcttcaactagtggatcccccgggctgcaggtccccctgaagtttgaaaatgttagaacggcttccgtctcagttagtgtcacgaagcgcgagctttgtccaaactcggatgacggcaaacaccgtcaattttttcatgcgtcgaaccggcgacactttgtggaagacggtgacgaacgtgtccatgggagggatgaagcgggggagggcgcggacgcggcagcccatccgaccgttgccccaattttaccgagtcggcatgctcaagtcgagtccgatgcgcatccgttaccctgggttaaatgcgcccattgtcccgcaaagtgttgccgaattggcctcgagaccgttttttgttgaggaacagtcggagcaggaaagggaggaggtgctgcactttgtgaggacccaagtggccaagaagagcagtcagaagcgccatttgtgcaaggagcgcctcactccgctggagcggggcttcagcggcggcactttcatgggccaacgcatgggaccgcccc

SEQ ID NO: 95506 - DNA, 601 bp, Heterodera glycines
  SCN-specific regions: Sequence locations=1-601
ttttccgatggataagcaaacttttggtggagattcttctgccaattcggcagcggaagacaaaatgagcggttgctgttcagaacacattgtggaaattgagtggaaacatttcgactatctctccgccctcagtggcctttacacggcatcggtcgaacgtcgaaaatgcaatttgcttgtgctcgtgcagggcaatttggacaatttggaagggaaaatggtcattttaactatccacgacgtgggcaaaaaccacctgagttttgtcgacttcgtcaacagtctttcgatggcacccctccgcggccgttcccttttcctccatatttgtgtgcctggccaagagcccgaggcgccgattttcgccggaagcagtttcccgtcgatggatcagctcggccatgccatggtgcaagtgctgcgccatttcaaaatctctcattgttttgcaatgggcgaaggcgccggcgcggacatttgttgtcgattcgctgtaacaaagctttttagtcaaattggtggtccatcatctcgagtagtgcaaattttatgaaattgtttcgctacattcattgacttttgcatatcccgagaaagg

SEQ ID NO: 95507 - DNA, 542 bp, Heterodera glycines
  SCN-specific regions: Sequence locations=1-263,286-542
gagtttcataatattttcttcctccgtcctcccttttcgcctccttttaaatggctcgtcagcaattgaatattcgccgccgttccgttgtctcttacgttggcatcagtgagcatggccaatgcggctactgcaaattcacaaaacgcgcccatgacaaggccaagttcgcagcttcaaccagtgaatgcaatgcctccgtcgatgcgtcgacggtggcgagcagtacaaataatgatgggcaacaacaagcgaatccgcccaatgcacatgatgaaaatgccaacgatgatacaaatggagggggcgactcggccgtgttcggcctctgggcccaccggctcactgtccaccattaccaatggttggccaatcgcggctggcgacgttcgggtcgctttctgtacaagccgttgatgggccgcacgtgctgtccccagtacaccatcaggttggacgtgcacaaatttcgcctctctcgcacccaaaagcgcgtgctgcgcacaatgcgcgactttttgcgcacggaccaaaggccgaaa

SEQ ID NO: 95508 - DNA, 890 bp, Heterodera glycines
  SCN-specific regions: Sequence locations=1-52,74-890
ctacaactagtggatcccccgggctgcagtaatctcggcacgaggcagaagttgattttgaagatgaaggcgattacgagcaattaaatgccaatcagaatagaaaacagaaaaaggccggaggatggcaatctatgggtctcgaccattccgtcttcaagggcatccttcgcaagggttatcgacagccaacgcccattcagcgcaaagccatccctttgatgtgcgacgggcgtgacctcgtggcgatgtcgcgcaccggctcaggcaaaacggctgcgtttgttgtgccattgctgcaacgactgaaacaacgcgatgcacgcggcattcgtgcgcttctcttttcgcccacgcgcgaattggctctgcaaacattcaaaattgtcaaggagctcggccgtttcaccggtctttactgtgcctgtcttatcggtggcgacagtatggacgaacagttcaatgcccttcaccaacacccggacattctcatcgccacgcccggccgtctgctccatttggtggtggaaatgaatttgaaacttcaaactgttcagtttgtcgtgttcgatgaagctgatcgtctcttcgagttgggttttgcggaccaattaaaggaaattctgaagcgaatccccgattcccgccagacccttcttttctccgccactcttccgaagatgctcgtcgattttgcaaaggccggcctttccgatcccgaattggttcgtctcgatgtcgagtcaaaactcagtgacaaattgtccatggctttcgctttgtgtcgtcaagttgaaaagttgcccgtcttattaaatttgtgtcgggtgttatgcaaacagaagaagaaaaccattattttctgtgcgacgatgaaacacgtggaacac

SEQ ID NO: 95509 - DNA, 545 bp, Heterodera glycines
  SCN-specific regions: Sequence locations=1-54,78-78,114-185,210-545
cacattctcaatcaacacaaatgcttaactaataaaaaataaatcttctttttggtccattgccatagccaacgcttcatctcccaaattccatcggcggtgccattctccgtccgtctcccccccccccctccggtgctgcttttcctctgctcttccgctgatctcactccctccccaccgtttggtcctcaattatttctcattagtgccattttatgcttattccttcttctctccgcttcatcatccgctgtcattcttcagctgctgctgagtgttttttgccttcgttttcgtcccttttacaattgtataattctttcaattgagcaactttggcattatttcctcctccttgtttgttagcatttgaattagccgaggttcactcggttctcagccagcagaatggccaactccagtggccatgaccattcggcgggcggtggctcactcggctaaagcctcgttcgcgcatcgctttggtcattttcggcgctgtgatgatccacctcagcatcggcacttaccacaccttcggt

SEQ ID NO: 95510 - DNA, 476 bp, Heterodera glycines
  SCN-specific regions: Sequence locations=1-43,71-476
gcgcggcgcttggcacttttcactcggagagattttcgtcgttggaaagagagaagcaaagagaaaagaatttcggagaaagcgatggaccaaaagcgaaacgaatgaccgaattttcaacggaggaggaaaagccggagaagaagcgggacggagaagacaccagtgaaaagtacaagggaagcagtgaccaacagcagcagcagcagcagtcgatggggtccaacggcacattaaaccgaagtttgtcgtcgcccgaactgctccaacttccccggttcggcttccatttgctcgtaactccgtccaccgcgtcgccctccccgctgcctaccaatgaacttcttcagccattgctaatcaccagcaccgcactgtccaattcgctgctttttcctcccaaatcgtccttttccgcattgtcctcctcgtcgtcgctgcaaagtttgaaagaacagcaccaagaagaacacgaa

SEQ ID NO: 95511 - DNA, 475 bp, Heterodera glycines
  SCN-specific regions: Sequence locations=1-37,59-149,177-297,322-475
atttcaatggcatcgaagtcgccccaaaatacgctgccctcctccccaaatcacatctgccatcaaaataagcagctcaataacaatttgaaaagggtggggaatggcgcggcgtttggcacttttcactcggagagattttcgtcgttggaaagagagaagcaaagagaaaagaattccggagaaagcgatggaccaaaagcgaaacgaatgaccgaattttcaacggaggaggaaaagccggagaagaagcgggacggagaagacaccagtgaaaagtacaagggaagcagtgaccaacagcagcagcagcagcagcagtcgatggggtccaacggcacattaaaccgaagtttgtcgtcgcccgaactgctccaacttccccggttcggcttccatttgctcgtaactccgtccaccgcgtcgccctccccgctgcctaccaatgaacttcttcagccattgctaatcacca

SEQ ID NO: 95512 - DNA, 458 bp, Heterodera glycines
  SCN-specific regions: Sequence locations=1-25,54-247,269-296,318 -342,371-458
tgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaataaaagttaagcctaaaatttttcgcatatttaaaaagcaattaaaaatttttagattttttattcatctccctttttgatagtgaaagcatctgagtgcctaaaataacttataaataaaatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 95513 - DNA, 482 bp, Heterodera glycines
  SCN-specific regions: Sequence locations=1-482
atgtccaatttccatttgtcctcaaaagtgttaaattacatcgacacacgtccaaaggaaaacgaagtcaaaggggcaataaaattggacgtcaatttacggatttttattaaaaacgaacgttctgttgaaaaggaaaaaagccgaaaggaaatggcaacgaatatttacgcaactttggacaaaaaagaacctttggccgcatttattgcgcggattggcgacactttggcactgaccgaagagccggaaaattacgctttaatgttcgaagagaaacgacgatttgtgacggaatataacaaacccagcgtggcacagggctttttcctcttgctgaccgcttctccgtccaatttcgctaaacactttctggcccaacttggccaaggttcgtgctccgcttggccccatttgcctttgttcgtttctctctgtgccgaccccgcctttgccgaagcatttaccgctcttaacggtgt

SEQ ID NO: 95514 - DNA, 369 bp, Heterodera glycines
  SCN-specific regions: Sequence locations=1-369
gaattgcatggtacgagaaataattagcataaatttatacaaacaataccctatatcaacaaaacatattgaatcaatcaataagacctgaacgaaaaattgctaaaaaacatgtattaccataaatccaaaaatgctactttatccaactgagccaccaattttaagtgaaaacactgccaaaatttcgattttcgaggccctttaactcctggaaattttttcgacacctaaaacaaaattcacaatggaagtctgtctatccaatggtatataacctatatgcattttccgagttaccgatcgcgaggttcccttgtaaatactaatttgataggattcatgacaaggtgtctgaaaacgaaaacc

SEQ ID NO: 95515 - DNA, 462 bp, Heterodera glycines
  SCN-specific regions: Sequence locations=1-117,139-272,296-462
attgcgaaagcggattttatggatgaacgattttcgagggttattacggctaataaggcgtacaacctcttccaggcggccattctcaacggactgttgacgcatcacttggatttcatccatggcaaatgtgtggatttgcgcaagattgggcttttgttggaccattttgaccgattagtcctccgttcggaatgtcttttggcccaaaatgcgaacatttcgttgctccgttgtctggtcaagtgctctttctattgtcgtttcgctgatttcttactctgttcttccatttaccaacaatccttcaacgaattccgactgcttgcgatggcaatgttttgctacggtttggcattgaaatgggcatgccataaatcggtcaaaggaagtgatggagcggatagcgcgctcctttcactctgtgccgctgagttgacgacactgctcagaacgaatttg

SEQ ID NO: 95516 - DNA, 961 bp, Heterodera glycines
  SCN-specific regions: Sequence locations=1-355,377-790,812-889,912-961
ttgagttcctattttggtacatttactgatcaaaaggcaatgtctgaggaaaaatttgaagatgttgatggctctattattggacagaagcgacaaaatactgaaaacggcggcccggcctcgaagaaggcgaatgtgattgagtccgacaacctccaaatcaaagttttgatcccttcggcggcggtcggcgcactgatcggaaaaggcggcgaaacgatgcgaaatttaaagaacgactcgggctgccgtgtgcaaatgtcaaagaacttggaagtgtaccatgggacatcggagcgcatttgtttggtcaaggggaaacttgctgcgacaatgattgtaatgggcgcaattttggaaaaaatccaggaaaaaattgacgccaaccacgcttctgaccatttcgacctgaagggattggaccggaccaaagagatgaaatttgttgtgccaaacacttccgccggaatggtcataggaaagaacggcacgagcatcaaagagattcgggacacaacaacggcaaacatccaaatctaccccaaggcgggctctgaggaggccaaaatttcggccgagagagtgattacggttggccacgaatcgaacgaagttttactgagcgcagtgcaacgcgttctggaaaaagtggtggctgatccgatgcatgcgcagccagtcccagcggagagtcagttggcttcgggctttgaattcggcggatcgcggctcagtgccgggagcaatcagtttgggggaatttcaaacatgggcaacaattcggaagcaatgcatgggaaatcatttggagggccttccttcaaattcaatcccctccaggggacgggaaacaacgagctgttggcttttctcgacaatttgcagtccactttgcgctcttccggattcaacgaccaatcggtgtcagaggtgatgcaggcgatgcaagtgctggccaaat

SEQ ID NO: 95517 - DNA, 523 bp, Heterodera glycines
  SCN-specific regions: Sequence locations=1-134,156-299,321-523
attatttttaaaaccatttgtcaatgtttggtcttcacttttgggactcaatacggctttggtcatttaaatccaacttttcatttatatcacttcagatcacctgaaggagtggtcaggtcttattggtgtatttgacttttttgatcagaattgaaagattataactagggataagaatttaagtattacttttaagtaatttttcaacggtaggggtcagtttcggttttatgaaaccaatgaatttaaaatagtctttttttgtgtaatttgtggcgctgatcacaaatatgacctttgtttttcaaaattcagaaccccaaacccgaacgaaaattcgaaattcataaattacaatgaagacatatttttaggggttttcgaggtggctgaaaatggatatggcagccgttttgccctagaaaatacccgaactcgaacaaaaaaatcgattttttctcaacaaacactcggatgtaatgacaactcgtaagaaatgtaactcgtataattgcttgag

SEQ ID NO: 95518 - DNA, 476 bp, Heterodera glycines
  SCN-specific regions: Sequence locations=1-476
gcacattccaaagttgcaacaagaaactgcggaacaatgtgatgtttatgcatcacatttgggcccatgtggcccaacaaaagcacaccgactcggaagaacagtttatcaacatgcaggccgagcaacataacgccaacagcatcatcactaacggcacgaacaacggcaccgacacggccaccggcgacgagcatctcagcgatgtcagccgacttcacatgtgcccagagtgtctgttggaacagcccacaccgcaccgggcgcacctccattaccaccgcgtccataaacgcggcaaacgacatctgttggacaaaaaacccgggttgttgcacgtgtgcaacatctgtgagcaggtgttcgacgccaaggccatcgcttcgcactgtgccgtccaccatttgccggacaaaggcgctcagttggcactgccctacgggtgccggttcagcgccggcgtcaaatgccaattc

SEQ ID NO: 95519 - DNA, 1235 bp, Heterodera glycines
  SCN-specific regions: Sequence locations=1-529,551-715,763-886,919 -966,1001-1235
ttccatcacataaatcaccatgcgctgcttattcgccctggtgccgctttcctgtgccgttttgcttccatttttcgccgatgcggtgccaccccccgccgctgtgcgatctgcgcgaccggccgcgcgacaagcggtggcagcgcaacggcaaccgcccgcggggatggaaaggcagtgcaaatgtgcggagattaagccgtgcaaagaccgctatcagaagacgatggagccatgcttggacacgtgccaatctcatatcacttcgctcggtggcaacttccgccaggtgaaggcgtgcttcaccccaaaagagagtctgctcaattcggcgatgcgatgcaccgaaagacagcacgacaacgcctgctcccattcttcagctgctcaatttgtgccaaagcgatacggccaaacattggaaaacgaagcgatggtggaaatcgatcggatgatcggccgaatggggctggacaagagcgggtccatgaagaagctggtcagtgtgagcaagaaactgttcggttgtctgaagcaatgcatggctaaaagggcgggaaactgcgaaaagcagctgaagtgtggccttctgttgccctcggacagtgccatggtacaaaagaccaaaagctgtgccctgaacaacgggtttaacaccgcaaccgcacaacagacgtgccattgtgtggccaatgccggtgtaaagtaagcaaagaatttttatttaattaaatttaaattaatttatattttcaaaatttagggacttgaagtcggtctgtaacaaagtcgtcatttcataaatggacaaatggacgaatatattcgataaaattcatattttgatcaaagaatttaactctggaattttgataagcgaaattaaattattttgcaaatgaggaaattgaaaattaacgataaaacttttgcattacattagagaaataaaattcacgataaatcaaattaaataataaatttcaaaaatttaaattttgaatggcatttcaaataacacaaaggcatcgtttgcattgccacttttgactggcaattaaattgtaggcaatataaatttaaaatgtttgttcaaacaatttgcttagatttatgcccctgatatacttaatttcttaattctctctttctctctcttatcctctgatcattgttcccccgtcaatgtcagcccggggggcggtccttcttttcactaatcgagactctttata

SEQ ID NO: 95520 - DNA, 341 bp, Heterodera glycines
  SCN-specific regions: Sequence locations=1-341
gtttcttggtcgttactacacggtgtttgatgtgggccaaagtcgtgttggttttgcgcaggccaaagacggaaatgaaattccaattgagcctcaagtgcgcgattgcgtaaggggaggcgcactttgctttgatcattccaacggagttgacgattctgatcagcagatggttgagggcgattttgtaatgacggactgaagaaaattgattttatttatgcaattttcagttttatacaatttttaatccatgacgaagcctatgagtaaactatttttcctagtctgataattgtaatcaccatgtaattatcaatcgatgtgataaataaatcatt

SEQ ID NO: 95521 - DNA, 215 bp, Heterodera glycines
  SCN-specific regions: Sequence locations=1-215
gtttattgaacaacaaatcgcaaaatgcgatctgaacattcgctttataagctcaacttggggcggtgtgccaacaatttcttcctccacaaaatttcctccctcggcgactgttctttgcttcacacttcgcctgtcagggaaaatggccacacaaaactgacggtcaatgggttccattgcccgccaaaggaaacgaaaaattgggaggaaaa

SEQ ID NO: 95522 - DNA, 476 bp, Heterodera glycines
  SCN-specific regions: Sequence locations=1-476
gtcctctcaacgtgtttcgtcatttatccttgttcccccaaaatgcggcttcgtcttcggctttccccgtggtcctttcgcggtgccgtccccggagtcgtttgggtcggtgccgacgaggttttctccgtgtccgatgaccacagtctctgccgctggaccgtctccaaaacggaggccaattttctgtctaatgcgttgaaagactccattttccccacttctctcagtgccgcgtttcccttcgccgccgggcgttctccattttccggaggactgtcaattcgctcgggcaaaaagcaacagcgtacttccgccattcactcgtctcagtcagcagggaatgagctcattctgatgactgcctctgatggcaaaatccatctgatcactccggcggggaaaattgaacgaacaatcgaagcccaccaaggggcggccattttggcccggtggagcacttccgagcccggagg

SEQ ID NO: 95523 - DNA, 641 bp, Heterodera glycines
  misc_feature (249)..(249): n is a, c, g, or t
  misc_feature (252)..(254): n is a, c, g, or t
  SCN-specific regions: Sequence locations=1-641
gtgaagcaacaggaacgcatatcttttcccttctcagttgactcaaagcgttttttacttttgcccaccgattttgtggatgaaaaaagcaaatttttcaaccgtcagtttctcaccatttatcgggcacggattaattgtcttaaagacttaattaaaaaaaatgcgcgaaatattcttgcttctacctccaataattctgttcaaatcgatgatttatcaaatttttctgccggcaatgatattttngtnnncggtgttgttttcaagaaaatgaaattccgtcaaagcattctttacgagttttcggatgattcgaatgttcccattaaaatggggagaaaagcgggcgacaacctttgcgatgacgaggacatactccaattggaggacgaccagcagactgttaaattgcttggaaacattgacaaacattgttttgtcactggcgatgtcattggagtgatcggctgtcaggaggatgtatcagacaattttgaagtgcgaaggattatttacccggaaatgagccctcaattggaatggcctttggttgagcatgattgttatattgtttttatgtccggcatttcattagttggcaattttgacaacgatgttcaaacgttttcggcactgat

SEQ ID NO: 95524 - DNA, 901 bp, Heterodera glycines
  SCN-specific regions: Sequence locations=1-13,36-45,67-250,272 -272,295-455,479-513,535-901
caagtttgagccttttttaaaaactagcaatgaaattaaaaagaatgacttttgattttgaaaagagaggtgacaacgccgacgatgaggacagctctgccgatgaatgttcttcaagcactggtagcggtacaccaaacagcgaatattcggtggatgagataatcgggcacagaattgaaaatgggacggacaaatggagggtccgatggaaagggtgggcgccgaagtacgacacgtgggagccgcgtgagaatttctccaattctatgcatcttctggacaaatttgatgccaaacgacttgccggacaatgcaacgagaatgaggctgttgcaacccatccaatgtccaataataataatcagtcggattatgtccaaaagttgcgtccccatcgttcgctgtgccttcctccgacttccgccgctgtgccatcggccggcagaaaaggaccaaagaagaaaggaagtgccaaacgaacgacggcggcaaaaactcccgtttcaattccacttttggaggccaaggcgatgctgcacacgtcgagagtccgagtttttattcttgtatgcccaaggacatgtcggagcgtgcgaaggagtgcaaagaaattcggaaattccttttgaattgcgtcaaacggacgaatgcatcggcgaccgccgccgcgcctcgcgtgctgtacatcagcggcgtcccgggcactggcaaaaccgcagcagtgctgaaggtgcaaaaagaattgtgttcggaaaagaagacacccaagttcgactttttgaacatcaacgcgttggaactgtccgacccgcggcaattgttcaccaaagtttatggacaagtacaaaacaattgcacagggacgaggaagaaaatatcggcaagaaatgcacagcaa

SEQ ID NO: 95525 - DNA, 354 bp, Heterodera glycines
  SCN-specific regions: Sequence locations=1-34,59-111,139-199,225 -272,298-354
cccccccctaaatttgtcctcctcctgtgtgaactgtgaatgaatgaatgagtgatttattattaattattgtacatatatatggcgtagttttgtgttgtctaaaaccgtcggcgccgccgggccgccccgccgccgtctgctcgaaataatgcgcaagggactttttggtcacaaaatttatcaattgggggggctgtgtggtggtggtggtggcggcggtgtctcgacaaatttttttccccatttgctaaatttactccctcccgatcattatatatttatttttaattattacccgttaattagatgggaggaggagggtttgtaaatttgtcttcgatgtattttttc

SEQ ID NO: 95526 - DNA, 837 bp, Heterodera glycines
  SCN-specific regions: Sequence locations=1-396,418-441,469-501,525-837
ggaccatctaaagtcgcattttctactaccaccaccccgacctcggcaatttccactacggtccgcagcatccgatgaaaccggcacggttggcggccactcacagtttggtgctcaactacgaactgcacaagcatttgacgtgtgtccatccgcccaaggccacccaacatgacttggcccgcttccatgcgcccgaatatgtgcagtttttgaagcggatttcgccgctgaacgcggatcagtacgagggactgttcaatcgctttaacattggcgaagattgtcccgtcttcgatggcattttcgacttttgttccctttacaccggcggaacgctcgagggcgccattcggcttaaccacggccaagcggaaattgcgattaattggagcggagggttacaccacgcgaaaaaggccgaagcatcggggcttttgttacgtcaacgacattgtgatcggcatcatcgaactcttgaagtgccatccgagagtcctttacattgacattgacattcaccacggcgacggcgtccaagaggcgttcaacctcaccgaccgggtgatgaccgtctctttccaccgctatggcagctatttcttccctggcactggcgacatgtacgacgttggcatgggccatggccgctatttttcagtgaacgttccgctgagggaagggatggacgacgaaagttaccacagcgtttttaagcccgtcattcaggccgtcgtggacaatttcaatccttcggtgattgttctccaatgtggcgccgattcgttgggctccgatcggctcggctgttttaacctcagctttgacggccacggg

SEQ ID NO: 95527 - DNA, 641 bp, Heterodera glycines
  SCN-specific regions: Sequence locations=1-120,142-641
gtccaataaagcttattatgtttcgaaattgtctcctggatttaactcctctccgttgtgcatttattgcaaataaactggctcattattcttccaaaacaccaacattttcgaattgcattccttcaccaattttatcgggaaatcaattgtttcgaattattcgtgacaaaattcgcacctcaggcccaattacggttgctgaatacatgcaaatttgtgccacttctcaacttggttattatgctggtcaaaatgaaatttttggagagcgtggtgactttgtaacttcgccggagctgactcagatattcggagaattaattgggagttgggttgttcatgagttggaaatgacctcttggaaggaccggtggcaattggtcgaactcgggccgggctcgggcgaattgatggccgatgtgcttaatgtgctgcgccaatttgatgtattacaaaatgttgaagtttatttggttgaaagttccgagcgtttagtggagcgccaacgagaaactttgaagaagaaatttggcgaagatttacttagaaccattcgatggtacgattcattggatgatgtgccacaagggttctccgtgtttctggccaatgaattcctcgacgctttgcccgttcat

SEQ ID NO: 95528 - DNA, 466 bp, Heterodera glycines
  SCN-specific regions: Sequence locations=1-138,160-466
agtagtgctttatattgccattcttcaaattaaacttttgctaaaattccatggacgaatcggcgaaaaagacgctaaaacaaattccactgctgaaaacaaatgcagggccacgagacggacccctttggcttgaacggttgaaggaggagtacaacagtttgatcgcgttcattgagcacaacaagcagggcgatgccgactggtttcgacttgagtcgagcgcggatggcactcgatggttcggcaaatgttggacctaccacaacaaaatcaaatacgaattcgatgtggagttcgacgtgccgattacatacccaaaaactgctccagaaattgcccttcccgaattggacggaaaaacggcgaaaatgtacaggggaggcaaaatttgtttaagtgatcacttcaagccattgtgggcgagaaatgtgccgaagtttggcattgcccatgccttctcact

SEQ ID NO: 95529 - DNA, 552 bp, Heterodera glycines
  SCN-specific regions: Sequence locations=1-192,219-333,355-552
gagatgatgtttttccaattgtcatcctcagcaccaacatcatcttccgtcgatgggccacagcagttttttcaacatcaccaccaccaccaccaatttgtcccatcgatctcaccactgttcgacacctccggcaccggcatgttgggcacgttggcggcacccaccactgcctcaatcttcatgccgtccttgttcggcggctgcggcggggccgccgccggtgatggcaccatcaccgccgctggctcgctgatgcaaagtttgttgagcgcggcagtctgcagcggcgcattcccgttggtcggcacgactgttgcagcctcaccgctgactgctaccacctctcaacatcgcaaattgttcataggcgggctcagccatgagacgacggatgaacagttacgtgattactactccaaatggggcaaagtcattgactgcattgtgatcaggtagctgaaaaatgattggactggtctaatgagacacagctatcgaatatttcggattttttttaatttgataaaaaaatgtgttgggtaccctttc

SEQ ID NO: 95530 - DNA, 487 bp, Heterodera glycines
  SCN-specific regions: Sequence locations=1-179,203-273,295-487
caatggtaaagcttcagcgaattccagcggaatttggcattgagtgcaatgtttacggaaaatgcgaatttttcaatgccggcggttcggtgaaggaccgaattgcgctgaggatgttggaaatagcggagcaaagcggcagactgcgtgccgggatgacagtgattgagcccacctcgggcaacacgggcattggccttgctttggcatgtgccgtcaaaggatatcactgtgttattgtgatgccggagagaatgagccgagagaaggagctgacgctgaaggcactcggggcaaagattgtgcgcaccaaagacaaagcgcggtacgacagcgaacaatcgcacatcggcatggcgttcaaattgagaaaggaaacgcccaattcggtggtgttggaccagtacaaaaacatcgccaaccctttgacacacttcgaaggcaccgcggcagagattctggacgcgttggatggcaaagtggacat

SEQ ID NO: 95531 - DNA, 592 bp, Heterodera glycines
  SCN-specific regions: Sequence locations=1-592
gtaatgaaggcgagcgaaacaatgacaaattggtcggaacagtttcaagagtacgacccgttcatcactcaacctcaccccaccaatccatgggtctcggatgatccttcattgtgggcgctaaatgcagacaacgtggaagtgccgacagaacgaagggttaagcgatggggcctaagcgtcatggaactcgtgcgcgaccctatcggacggcaggttctcgaatcctttttggattccgagttctcgtcagagaacctccgcttctggtgttgcatccaggacctcaaattctctcccaattgtcaagttaaaacaaaaggccaacacattttggacgagtttcttgctcccggtgcgccctgtcaggttaacgtcgactctagaacgcttgaagaaacattacgatgcttggaggagtcggaccaagcattgcgaaaccagaggttcgctttctcagtttcggaggaacacgtgttcacactgatgagcaaagactcgtacccacgttttctccgatccggcatttacaaggctgttttggacgctgcccaaggcaaagggtggcagaaaacggatcattgacctgatc

SEQ ID NO: 95532 - DNA, 476 bp, Heterodera glycines
  SCN-specific regions: Sequence locations=1-476
gtggcggtcgatttggcggcgataattgtcgagaaaaatgtcaactcttttctgtcggttgtggacattcccaagccgtctctttacgtttatttcgcttttcttttcgcgttggccacaattttgtgggcaaatttattgtgcaaatcggacagcaacaacattttcaaagtgcatcgtctcatgttggtgctcgtcttcctcaaatcgctcactttgcttttccacggcgtcaacttttactttgtctctgtttatggccacgaacgtgagctttgggccatcatttactacgtcacgcatttgcttaaaggtgcgcttctcttcggcacaattattctgattggctccggttacactttttttcaaacaatttttgagtgacagagacaggcgactgttcattttcgtgttgcccctgcaaattttggccaacatcgcaatgataattctggaagaatcggagttcagcgacc

SEQ ID NO: 95533 - DNA, 494 bp, Heterodera glycines
  SCN-specific regions: Sequence locations=1-370,392-411,433-494
gaggtaatttaattttctgtgctttcatttttatttgttgtcaatctgatcagtttcttttttctcacaaacaatttgtgttgtgtcatcgaacaaatgtcgactgtcagcaacggcaaagctgaatcgtccatgcgccgatacatctacatcttaccctaccttcccactggcattgcttcttattatttttacaaagcggcacagttggcgcgaaaatgggccactgtccacaagttcgggccgttcaaagtgtcggcagcgcatggatttgcccttctcattcccatgccgcacttggtgatattggcctttcaaattgcgtacacgcgaatgacacgtcgtaccgatgagaagatcaaaatgaaacaaaatgtttccaaatagttgcctattttcatttcctctgcgctgtttccattttgtccttgatttttgtggggcaatttaaattcgttttgtttttcggcaattaaatgcgcgcttcttccaaa

SEQ ID NO: 95534 - DNA, 480 bp, Heterodera glycines
  SCN-specific regions: Sequence locations=1-480
catctgtccactcattacgaattggaccaaaaccttttcaaaaacaaaacattgcgcgagttttgtgccgcgattcacagtttctacggaaaatgctccaccaacattctcgatcacttcaaaaagcgattcaacattttgcaatttgcgaggcatttgccccatttctttgtcggcctcaattcagcatggatttacgaattcgttgtgctgctcgaaactaccggattaaatggccatattttggacaacgatttcgaaatggacgacaacgatcgattcattgtgaacacgcaactgcaacttttgttgcaggaggcgttccgcgtcagttggcttcagaacagcccattccatgacaaaatttgcgtctcactgatgcgtctttctcccacgagtgacgaccgactggcggaacacgagaaaagacttgaacaccgacttaagaacccaccgaagctggagctgaacatcgtcgtc

SEQ ID NO: 95535 - DNA, 1226 bp, Heterodera glycines
  SCN-specific regions: Sequence locations=1-7,29-445,468-485,507 -586,610-681,703-1041,1063-1226
ccggcacttccgatgaagaaatggttcgacaccaactatcatttcattgttcccgaactgagcactgatcagtccttttctgttggcctcaacaaaccgttgaatgactttttgttggccaaaaatgcgctgaatttggtgacaaagcccgtcctggtgggcccggtcactttcttacatttgagccgagtcggagaacggaaggaattggcgacggaggagcagcaaaaagtgcacaatttgaagctgctcccgtcgctgttgcctcattatgtgaaggtcgtccaatcgctggtcgacgccggcgccaaatggattcaaattgacgagccaatctttgcactgacttttgcggagaatgaggcgcccgcgtattacgacgcattccgacagaccgcgcgggcactgcagcaagtgacggcgaagaaggcgcacttgctgttcgccacgtacttcagctccatcgcgaagaatgtgcaaattgtcaaagaccttcccgagggcactggcattcacattgacttagtccgtgcccccgagcagttggacccagtgttgtccgcgttgccagccaattgctttgtctctctgggtcttgtcgatgggcgaaatgtttggctgagtccgctgcgtcagtgtcatgccaatgcgttgcgcgttgtgcaaaaattggcaccgggacgcgtgttggtcagcagctcatgcagtctgttgcacgtgccatattcgaccaaatttgcgcaatcgttgaccaaaaagccggtgaagggaatgctgacggggccaatgaccattttgaagtggagctttgtgcgcaacgaccaaccgcagaaggacacccttttccaggttgcgttggcattgcgcgacgatgtggccgagttggagaaggagggcatcaattgcatccaaatggacgagccggcattccgcgagggattgccgttggacctggcacagcacaacgaataccttaagatcaccgtacaggcattcaaaatttccactggttgtgttgcggactccactcagatttattcccacatgtgctactccgactttggcgacattttcacgcacattgccgagttggacgcggacgtcctttgcattgagtgctctcgctcggatttgagtctgctctcctgctttgaccgctttggctatccgttgatggtcggccccgggatttacgacattcactccccgcgggtgccgtccgtcga

SEQ ID NO: 95536 - DNA, 420 bp, Heterodera glycines
  SCN-specific regions: Sequence locations=1-191,213-343,365-420
cattggccactaatggaggaccaacaaggccaattgagatcacgaagggcacaaacacaacagacagaaacaacggtggaaggaccaactgacaacagaaatgggaggactgggggagaagaaacgacggcgaggactcatcgaaatgggggaccgaatgaggcgagttttcatggatatgtgaccagttttagaatttatgtccagaatttcaaaattcgcttttttgagtattattaaaaattaaaggagaattgaggaccgaaagaatgtaggcattgaccaagtaagaaaataaagttatgggccaaagaaactgaacattggatgcctaaaattagctgtccaaaactccaactttagggatataaatttttatcgtttttaatgaaaattaggaattttaaaggaaattgtgaa

SEQ ID NO: 95537 - DNA, 595 bp, Heterodera glycines
  SCN-specific regions: Sequence locations=1-595
caacacagcaaactgaaacagaaccaaaaattacactcgtcctccctgctgccccccgtcccacacctcaacaaaacccacctctcctcctccatcagcgcctggtccaacgcatgcgctccgcttcacgtcgcataaagattcgcacatggagtccaaggtgcagcggatggtggcagcccatcgtggtacgcgtgattcggctcagtcggccccagcaaagtgaacagcgctcggctcgtctctatttggcgtggcggtggaggaggacgaataattaagtggatggaatgaatgaacggaatgaacgtggataagcaaaatgcaattcatcttcatcaatcatcccttctctgtgtacaacgaaaacgacgacaattgagcaatgtcggaccatccaaatgttgcgctggccgacctcagctgcgtggcaaacgacgtttggctggacactctgttttggattgaccgcgtggaggtgggcacgaagtttgcactgatcgacgcacgtttcggcaagctggtggccacgcatttcaacctgcgcaagtggaggctgggcgagctgggcgttcatcgtgcaccaagcggatgg

SEQ ID NO: 95538 - DNA, 602 bp, Heterodera glycines
  SCN-specific regions: Sequence locations=1-105,127-150,172-602
gcttatttatgtttttacctgtattaatggatgtccatgacgacgaagttgaaattattgggactaagccaaatgagaggcaaataggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagaccattgcacattatatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatggaagcactgaatatgttttccggtacgatgacaatggtgcaaatttcgtggaatggcgaaggctttccattgctcgtcattttggaagacgaaggcaggagttgttgtccacaccgaaattcgaactttgatagcgcccgagattctcgaattcgatttcgacaatgaaaatgtgacggccaaggcaattctgaactctctaccaattcggg

SEQ ID NO: 95539 - DNA, 277 bp, Heterodera glycines
  misc_feature (141)..(141): n is a, c, g, or t
  SCN-specific regions: Sequence locations=1-277
taaatggctgaaactttttctcttttatctccgactcatctgctgaatgaaacaagcctgaaccttagatgcccatattgcccaaagaaattcctaaagaatactgaagccatttctcacatggatccgtgtctgaagagncggccttacccttgtacgaactgttctaggcggtttaaatctgcgcaaaatttgagccaacatgagaggattcacacaaatgttcgaccttataattgccaggaaccaaaataactcactacaaaaacgtgtgctg

SEQ ID NO: 95540 - DNA, 497 bp, Heterodera glycines
  SCN-specific regions: Sequence locations=1-497
atttgtgtacacgcatctaacgattatgagcggcggtcgaccaattaccacacttgcagaggctagggctgactttggcagagctaagggccagtttaaacgtgctgtcatggcacttccaaaccactcactggacggtaccttcagctctttgagcgcctatttcggcttggactcgagcgtcggtgttcagattgttcgtgacttggggctgaccgatccagcagccatttttgaaaaacgggtggaccatctatgtgagatggtgtcagaacactgggacgtccaaatgtttgggcaagcgactcgttacttacgtctccgctctttgaactacaatgatctcgcaggttgtttccgtcgtcccagcacttcgtgaaatctcgcattcgcatcacgaaaaagaagtgaccgttgattttgatgttttcatgcgtcaatttcgtattgttgatgatggtgctctgttgtcgttgaccataaagtcttgttcagat

SEQ ID NO: 95541 - DNA, 393 bp, Heterodera glycines
  SCN-specific regions: Sequence locations=1-262,284-393
gaggaaaagacgataattgagaggaaggacggcgagggtttgcgactgttgagatgccttttggacgaccctaatatttcaagcgtcgacctttcgacactttctgtgccgaaggccgtttccctttctgcaattggcaaaagcattgagacggccaatgcttacaaacaaaagttgctcaaggcggacaaagaccaggaagtcacgcgggtgaacgacttgcaagcggactacttcagtttggagcataatccgtacttgacagcagccgaaagagaggcaattggcaatcggaaggaggaattgagacagctcagtttgagtgtcaaaaggaatattctcgtcgatttggacatttctaccggagcaatgcatcagcaaaagcaaaaaacc

SEQ ID NO: 95542 - DNA, 401 bp, Heterodera glycines
  SCN-specific regions: Sequence locations=1-401
gctgcggtgattgaacagcaattgggacagtttagcacggacaaggaaaccacccataaagagctgtctgttggagtgaattatgtgcaaacacaaggagaacagcacttggcaaaagcgcaggaggcgttcgaccgttacggggaaaagagtcagcaattgtcggatatcgctggcgaatccaagtagttgtctgataggcaggagcagcgtcgccgggagatcctttcgttggctgagcaaattcggaaggagtcgcggcaatcgctcagcgacgccaacgaagcaatttttggagcttcaagcaccagtctgcaaatttctgctttgttgaccgaggtccacgagttggaacagcgactgaaagccgtccaacaaatggcgacggaacagtccctcga

SEQ ID NO: 95543 - DNA, 748 bp, Heterodera glycines
  SCN-specific regions: Sequence locations=1-415,437-748
ctgaccttataaaaactcaaattcgagacttggacatttcgtgggctcgacattttattttacgtcattacacagcttttttcgcatttggtgaacttaacttcatccgattactaaaaagcccgtctccgaaggcgacttgtgacttttgttttttcgccgaatttctctccgcgaccattttctcgatgtcagagtttacttcgtccgacggatcagggaaaagcgttagcagtaaggtcagtgagtcggaaagctacgacgcgaccacgcttggtaaattgatgaaccttgacgccaaagtggtcgaatggctcgagaaagagccatatacggacgaggatccgctcttggttcttgacttccttggtccgtttaacaatcttcatggcgactacaaccaaaacaaggcctttttggtgcagaagttggttgccgctggaggggctagaatcgccgcgaacgtggacaacgttatcaaatttgcgacctgggatatgttttacgaagcacgtcgcattttgcaggcggacctggaagtgcgtcactttttctaccatccaaatccggcaatggctcttcaactgaacattaaccaatttccgatcgtctctacaaccgtggttacgttttggtcagatgagtcgcttaaattgaagacgcagccgtatcagttcttcgagatttaaaggatgatccattgttcattcatcattttttgttgcaaataaagacttattacatactt

SEQ ID NO: 95544 - DNA, 709 bp, Heterodera glycines
  SCN-specific regions: Sequence locations=1-362,384-709
gagattttacgttattacacagcttttttcgcatttggtgaacttaacttcatccgattactaaaaagcccgtctccgaaggcgacttgtgacttttgttttttcgccgaatttctctccgcgaccattttctcgatgtcagagtttacttcgtccgacggatcagggaaaagcgttagcagtaaggtcagtgagtcggaaagctacgacgcgaccacgcttggtaaattgatgaacctcgacgccaaagtggtcgaatggctcgagaaagagccatatacggacgacgatccgctcttggttcttgacttccttggtccgtttaacaatcttcatggcgactacaaccaaaacaaggcctttttggtgcagaagttggttgccgctggaggggctagaatcgccgcgaacgtggacaacgttatcaaatttgcgacttgggacatgtttttcgaagcgcgtcgcattttgcaggctgacatggaagtgcgtcactttttctacaatccaaatccggcaattgctcttcaaaacaacattaaccaatttccgatcgtctctacaaccgtggttacgttttggtcagatgactcgcagaaattgaagacgcagccgtgtcagttcttcgagttttaaaggatgatccattgttcattcagcattttttgttgcaaataaagacttattgcctttaaaaaacaaaataaag

SEQ ID NO: 95545 - DNA, 950 bp, Heterodera glycines
  SCN-specific regions: Sequence locations=1-42,64-125,149-434,456 -710,744-950
tattgaagccggaacaagtaactgtgcagaatttgctgattgaaaatggacaactcattgaaactgtggcggaatatcagcggatgggcaaaatcgttgaagcgactaaataccaagagcgactgcacagaaatctcatttatttggcaaaactggctgattcgacatgttcttctcaccttttactggaaatcggtggagcgatacccccaacgaatgagtcgccaccgccagccgaacctctgttaaccgttaccaattccgctaatcctccgaacattgttgctacaatagctaacgcgggtttgcctcaccagcagcaatgccaacccgcggtgtctgtggccattgtcagccaaacatcgccgcccagtgggcatgcccaacagcgcggaatttcgactacgccacctgcccatggtgtgcagtaccaattcccctccctgcctcagccctctcctcatacacaaacaacccaacaacaacagccaacgactgccaatctccactactctcaaagtcaccaacaacaagcagtccctttccaacggaatttgaatgtgttatcgcatccgatgcttttccaacaccaacagaacgtccaactgtcccaacagcagcaacagatgggcacacaacaacactccgtcgtttatgctggtgggcatgcgatgccaacccaacatcaccaacaatactctgctgcttacccattgttgcaacagcagcagcagtcgcaacagttccctccttccactggcgctgcctttgcccccatggtaattccgctgcaaaacgacccaattgcagtgggaattagacaacaacatcagcaggtttaccaacacacgcccagtcattcggctctacaacacggaacgtcacatgccgggggttacttggctcaacaaaaatagtcggcggacgtttggttgaccaattctctttgt

SEQ ID NO: 95546 - DNA, 470 bp, Heterodera glycines
  SCN-specific regions: Sequence locations=1-470
attaagtttactttctgctttcctcttacaaatgaatatttgtgcatcaaagtgttgtttggcatcaccaattgcccatcgttctcattcggttgcgtttccgccatttgtccgtcgctttgcatcccatggacatgacgacaacaagccgcaccccattgatgacccggacattccgcgtcagcccgacatgtaccgccctggttccgattcgtttgcttatgaaaatccatggccaatgctgaacaagggccgtcttgattggcttttcaacgacggttggcgtcgaccactcgcggctgaccaaggcgctcacatgcgtcgccaatggatctatttcaaatgcatccctcgcgacgagcacaaagactggaagaagtggcacggcacaatgcccatcttcggcaccggatgttttgtcatgttgacctttgtgtggcaatactgcaattccgactggcccagcgcga

SEQ ID NO: 95547 - DNA, 640 bp, Heterodera glycines
  SCN-specific regions: Sequence locations=1-367,389-640
tgttgtcctttgtggaacggactgtccaatcgttactcgacaaaaagatgattgttcgacaagaaattgacatgttcgaagccacacaaatcggctcggccactttcaacgcgaattttaacccccaaatggcacttgacatgtgcaacgacctcggcgccaatttgggcaaaggcatcgtgctaatttcgcacttccatttgctttacaattgtgtgccgttggacgtcgccgttcaagtggactggaatttgttctacaacgaagtcatatttggggctgagcagcgaggagcggcagctaattcattcgatgggtttgtttaatcctcaaatggattcattttgcgcctttattgttggtttgctgactttttcatttttgctggtttattaggtctttctgaggctgttcttatccgtcacattcactcgcaccaccaacaaaaggacccgagcaaagggatgcgaatttacgttgtaattgttttgggtgttataattccgccattttttccacaaatctgttctttcaggtgtttatgcttcgtcaaatttggaatcagaagcccttgtgggaggtggcgcgttatttcggcgtcccccggggttggcttcagtccgttttgcagtccgccgtc

SEQ ID NO: 95548 - DNA, 517 bp, Heterodera glycines
  SCN-specific regions: Sequence locations=1-307,334-486
caagtttgagccaaagcatttcattgactttctgtttaaaaaaatgtcgcttcttgttttctctcgtctccgtactcttcctcgtcttgcgccgcttctgacgaacagtccttgtgcactcagcaccagtgccgttcgcaaagacattgacagtgccgcgaaatacgtcggagccggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctgaacattacgaagacgagcacagaggaatggataggaaatctttttttgttttttctcgcttccaataatagtatgtttttctatttttgtgttgtcagataaagttggactgattagaaaaaaaaaaaaaaaaaaaaaaaaaaaaaaa

SEQ ID NO: 95549 - DNA, 479 bp, Heterodera glycines
  SCN-specific regions: Sequence locations=1-115,138-154,176-479
cgatccgaaacacgcttctccttctcccgctggggctgcttcccacgctcatccgcccaatggcggcgccgcccacgcggccgaagtgagtcgaaatttttagagaaattagtacaaattaatttgaaaaattaaaaggcaatttaagcagctcattagcttgttgatttttgtgctttttcagccaaaacatgctgcggctcccgctatcaaaataactgatgaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaggaggaca

SEQ ID NO: 95550 - DNA, 603 bp, Heterodera glycines
  SCN-specific regions: Sequence locations=1-53,92-126,148-572,598-603
ctaatctggacatgtaaatcaacgacctttttccgctctttttttgttgcgcgcttttcaaaaaattttgggggacagatggtgtgggggcatgccgacaggcgccacagtggaaatttttaagtattttgttaagaaattattattaatttcattccaactttctgatcattgacgactctcttactacaatacttaattcagatgcaaagattcgtcttatatttaggtgaagctgaagcctccgccatggacacttcaatggttcaaatatgacgtcaaaggaatagaggacacttggacattggccactccatggttcaagaggaaattcattgcgtcaaaggatttgttggagctgagaaagtacgacgtcatccgccattatagggaggctggtcaagaattggagcatgatctgaaagtacagaaacggatgcttgagttcattgaagaataccgcagaaaacggggggagcccaagaggaaattgctgaaatctgccggaggaaaattaagggaaatttctttattcgtcacttcggaagatgttaaaagcaaatgattagtgttaaggataaaactctttgatttttcacttta

SEQ ID NO: 95551 - DNA, 785 bp, Heterodera glycines
  SCN-specific regions: Sequence locations=1-88,124-746,769-785
gtccaattaagcaagacaaataccttcaatcattttcattgtgtaaaatggccagtaattcaaatgcccaactgttggatgcatgcgaaaaaggggcggaattaaaaaacatcaaatccctaattgagcgcggggcgaatgtgaactttgccgataaagacggtctttcccctttgatgggggcatgcgtcttcggtaacgttgagattgcgcactgtcttgtcgagttgggcgcgacaattgagcaaaaagatgacgagggattgaccgcccttgggcatgctgtcattgcagggcagctcgagtccgtcaaaatgttgaccggaaaaaacgcgaactgtttggtgtttgccaaagacaatcgctcgccgttggtcatcgcctgtcaggaaggccgcatggaaatcctgagccattttcggtccgttggtgtgaatttgaatcactgtgacgagcacggaattactccgcttatggtcgcaactcaaaaaaagagggtggacgttgtctgtttcttgttgcaaaacggagccgacaaaagtcagactgatgccaaagggagaaccgcgctcgcatttgccgatgacctgcgcgattcgaaagaacgtaaccagcttttgaagttgttgagtgaccgctgaagtgagaggaaagggacggtgatcagaaaattctttgtcagtgattagaaaatgttttgccgttgttgattttgaccgtttaatgtgttcatttctaaattcgttggtgcttctttttactcatccataaagcgcctttacaac

SEQ ID NO: 95552 - DNA, 705 bp, Heterodera glycines
  SCN-specific regions: Sequence locations=1-705
gtcaaacgcaacacgaacgcggcaccaacgcggaaaacattgaaattttgaaggaccgacggcgaacggcttccaatgccaagcgaagtgaacgccgccgcgttggttctgtttgcgatgaaactgttctttgggcttgacggggaagaagacaagcagcagtcgcgcgatggcacaaatgaagcgactcaatgcgccgacgatgacagtccgtcgccggtgttcagcttcgaccattggctgctgcaacttcagctgcgcatgcactgctggcagggcacaacggttcagaaggtgttggacaagacgttttccgcctgccaattggagcgttccaacatcgaaattccctatcgtcgtccaaccgccggcttttgccttggcggttcgcgactgttccatcgctgtcggaggcaaccgtttgctggttgtgtgccgaatgcgctccacaaccgtgttcagcctcgtctctttgagcattcctttcctcgacttcaccatttgccggttacgtcttcggttttgctgccaatttccaacgaagagctttacgccccccttcagttccaaagtgtgctgaatcggccccttttggacattgtcaaccgcagccattggaacgaagccgaacaaacactcgtcgaacagctcgaccgaccgaacacaaaaatatttttccggaatttttataattccaatttgagc

SEQ ID NO: 95553 - DNA, 639 bp, Heterodera glycines
  SCN-specific regions: Sequence locations=1-5,37-302,324-461,484-639
cttgaccgacgcgggccaactcgtggcactgacgggtgccagtggggtggacagaaccacgctgttcaacactttgctgaacaggaacttgaagagtctgagcgtggagggtcaattgctgatcaacgcgcactctttgggccaattcatcaattacgccagcggggtgtttggttcgtcatttgtagtcagcaacattctccgtgttctgtctggattcccgattgtttttcgtattcagatggctgatcgcaggcgttatacacccactgagcgcatgcgggacatgcaacaaaacattaatgagctcattcgcatcaaccgagtgaatgctgagacaattcagagccaagctgagacgattcgaattctcatggggttgcctggagtccgccaaatgtatgatgaacatcaagccaatgccaaccaaaacgcgaatcaaaacgcgaaccaaaacgcgcccatccaaaacatccagtatgcgcaacctcttcaaattgcccaagccggcaattttcaaaacctcaatcagctcccaaatttgcaacaaaatcaacagcaatatggtcagtatccgtttgttcctactcctcttgggtatccgccggcgcctcagggaaatccgtaatttgttcgtcg

SEQ ID NO: 95554 - DNA, 359 bp, Heterodera glycines
  misc_feature (358)..(359): n is a, c, g, or t
  SCN-specific regions: Sequence locations=1-196,220-317,341-359
caaacccaattgatgctgggcggggggccggcagcggcgcagggactgccgccaacgcaaacgaaagcaattcgacgacgaaaacggggcattaaaacgtccggactgatcgccggggcactgatcggcacgggggcagccgttggagcgaacgcatacaaaaaatacaaagcgaataagggctaagggagcggaggacagacaaagagagagaaagggacaaatggaagcgacggagaattaattggaagtgatcaattaacactaatatgcatcattaaaagaccaattagcacacaattgacatttattatgaaccacatttaaaatcattttaaagagaaccatcacagtaccnn

SEQ ID NO: 95555 - DNA, 688 bp, Heterodera glycines
  SCN-specific regions: Sequence locations=1-230,253-643,666-688
aaagattcagtggatgtcggctcagtgatcatcaccaagctggacggtcatgccaagggcggaggcgcactttcagctgtcgccgccactcgttctccaatcatttttatcggcacgggtgaacacattgacgactttgagcagttcagagtgaaaccattcctgcaaaaattgcttggcatgggcgacatcgaaggccttgttgaaaaggtcactgaaatggggctggaggacaacgaggagctgatcaagcggcttaaacagggtcaatttacgctccgtgacatgtatgaacagttccaaaacattctcaagatgggcccgtttggtcaaattatgagtatgatccccggatttggcaccgattttctgtcaaagggcaacgaacaggagtccatgtccagactgaagaagttgatgaccatcatggactcaatggctgacaacgagttggaccacccaaaagccaacgatttgttcaacaaagagccaacacggctcgtccgagtggccaagggcagcggcacggcgccgcaggatgtcaaggagttgctttcacaatacaaaaaatttgcggacatggtcaaaaagatgggcagcatcaagggcttgttcaagggaaatgaagtgaacccgaggaacatcaaccagaaccaaatggcccgcctcaaccagcaaatggccaaaa

SEQ ID NO: 95556 - DNA, 839 bp, Heterodera glycines
  SCN-specific regions: Sequence locations=1-839
gtttgagataaataccgtaaacagtgactaattactgtaattatggccgccacaattgcgtcccatgcgccccaaatgaaacaacaaaatgtgcaggttgctgaagaagaaacattcggaaagacaaacggcggaatgccaaacggagcacagaagcagcagaatggccaagcgaaggagaagcaaaaagtgggccaaacggcgccggtggcacgtccgctgacagtgaaagattgggactacgacgagaggggccaatgcggaccaaagcattggctgcgcattgccaaatgcgaacatttgggcgatcaccaatcgcccattgacttccaactgtccaaaatgcgcgtccatccgctgaacattcacccgctgtgtttggtcaattttaaaaagcctttggctggccagctgatcaacacgggctgtggaatccaattccaacccgacccacagattgaaccgcccgaaatttacggtggcttattggaccaaaactatcgcttcgtccaataccatttccactgggcacagaatgacaatgaagggtctgagcacacaatcggtgggctgcgttacccagccgaacttcacttggtccactatggtgtcaagaatccgtccaaattggccgttttgggcattttcctgaaattggacaacgaatcggagaacggcgaaaagaagaaatttgtgttctccgccgaagaaatggaagcgctgaagaaagtgatcgaatttgagcagaatgccgccattgacactgaacattcgctgtcctcaaaattgccgcccaattgttgccaggaaatggcttcttccgcggaacattttgtgtc

SEQ ID NO: 95557 - DNA, 535 bp, Heterodera glycines
  SCN-specific regions: Sequence locations=1-141,164-493,519-535
ttaaaaaatataattcggaatgggattttcgacaaagccaataattattgacggaaaagatcatttgcttggacgtttggccgctgtcacttcgaaacagcttttgcttggccagaaaattgttattgtgcgatgcgaatccatcaacatttctggcaacttccaccgttccaagctcaaattcctcgcatttttgcgcaaacgctgcaatgtgaagccatctcgcggacccttccactaccgtgcaccatctcggattttctggcgcacggttcgtggaatgcttccgcataaaaccgcacgaggtatggaagcactgaaaaaagtgaaatgttttgacggatgcccgcagccgtatgacacaaagaagaaattcgtaacttccaatttctcttcgccacatcggcttgaaaacgcggacccaattattgccacagtcggccgcctccctcccgaaagttggtgggcaatatcaaggccgttttaaaaaaatttggaaacaaaaccaaaagggccaaggcccctcttttccctg

SEQ ID NO: 95558 - DNA, 475 bp, Heterodera glycines
  SCN-specific regions: Sequence locations=1-475
gttaaacatgggttagtggaggtgggataacaacacttaagcgggggagtcgccatcgaaatgggaaaatgattttggtttgaatggtaacgaatttcgagaaacacttttgatgaagactctcacgctttaaaataattaatcgtatttaacggtaatttttatttcattgacaatttaaatccccgggttcctttgataattgaaggaaaatggcatcgaccgatcgcaccagcggagcggcaagtcgggaagtctcgagccggagcagttccgaaaactgttcattggcggtctgtcactaaatacaaccgacgagtcactgcatgctttctattcccaattcggaatgctcgtcgattgcattgtgatgcgtgacgcacaaacaaagcggtcgcgcggctttggttttgtttcgtttcaaacagccgacgaggttgatgcggcgatgtccgcgcgtccacacacaatcgac

SEQ ID NO: 95559 - DNA, 578 bp, Heterodera glycines
  SCN-specific regions: Sequence locations=1-43,70-197,252-477,499-578
gttggtccaacttctttatcatcttttaacacatttcgtcagcccgttccaccaccaccgccgccgcaaaatcgtctttccttaaatgtcgattttgctgaccgcacatctgcctcttcgcctactccgttgccgcctacgtctccaattccgaagattcaaccccaaatgttgcagcaacaaagcagcaacaactttcaccatcatcaccaccacaatcttcatcatcaacaacaattgtcgtcatcgtccacattttccacctcaccgagcgccaaagtgccaatgccaccgcctcctttaccgccgccgccaccattcatccgacgcccggttgtaatgccaaccgaaaatctatcgccctcaaataatgcgcctttgacaaatggtagaggtgtcacgtcccctaaaaagtcttcttcttctgcgttgcgcttgagtttcttcaacggctctccgctgaacttcttcaacaacagcaaagtggtggctgaaaaatcggtgcctgcgcctccaatttcgccaccgccaaaggcaatgccatcggcggcagagacaaatggtctgtcgaatggcac

SEQ ID NO: 95560 - DNA, 481 bp, Heterodera glycines
  SCN-specific regions: Sequence locations=1-481
gtccaattaagaagctttagcgcagtcggtcgcttcgtcaaaacacacaaattcaaaaatggcgcgcaaaagccgccaagaacagcagcgaagaagccaatctcgggaacagcaagagaacattccgccatgttgtgcgcagatgcgtcacgagaacgagctgttgaggcgcgcgttgcgcaaggaacgcgagcgccgtatgttcactaccaacgcgtacagacagctgttggagcagttcaaccatttggtggacttccggcgcgtggttgtggccaacggagggggcgaacggtcggaacaactgcaacagtgccagtcatcaccgtcgagcgtcaatggtgcgtctgtcccgttgtcatcagaagcagaaacggcattggccatggcaccgacagctacggcagcggccgtgacaccgtcaataacggcaccggtggtgaacaatcaacacaaacaaattataacggaacagccggcg

SEQ ID NO: 95561 - DNA, 550 bp, Heterodera glycines
  SCN-specific regions: Sequence locations=1-550
aaagctggagctccccgcggtggcggccgcccccgaactagtggatcccccgggctgcatgtattcggcacgaggatttgctaaaaaaatttagttacctaaaatgcctgtgcgacaaattctctcgggtacccgcagaattgcgaccaaaagtttgtcgtttggaattggttcggcgaggttggccgattacggtgtctttaaggccctcctcgagcccttagtggtttccaagtttgaagagctatcgcgcattagagtcgaaaaaattacgatcttttttgggatcctcgttttcgtctcattggctgacgttgctatgaccctgcggaccaacgaacatgttggcgacgttgagcgccgtcttgaaagccgtcttgaagaccgttttgctgaccttcgagcgcttcttgagcgccgccttgacagcattgaccgccatctcggaacttctgacaaagcgacggatgccaagttgcccggccagtgatcccagtggaactctgacgaaggatctcgggtgttacctttaccgggtattgaattgacc

SEQ ID NO: 95562 - DNA, 526 bp, Heterodera glycines
  SCN-specific regions: Sequence locations=1-150,217-526
gttaaattcgtcagctacaaaaaatttcgcaaaataaaatgaattcatcaatgacagtatctcttctgctaatgttaatcattggcactgctcttttggcattgacaaatgccatgccaaacgcagatgcttcattgacgcgcgaaaagcgtggcagttacggtagtggcagttatggtggtagcagttacggtggtggacccagcggtggtggtgacgcatttggaagcggaggggccgcaggtttcggaagcggaattggcaacggtttcggaagcggaggcggcagcggttttggaagcggaggcggaaacggtttcggaactgggggtggcagctacggtggtggcagttacggtggtggtagttacggtaaaaggcgatgatggaaaaacattggtccatttgtgacgaggaaattgcaatgtgatcatcctttcttcccgatcactgcttttccaaatttatttgttgtattatttatacaaaattttaatgaaaatgaattgctgctaattgaaaaaaa

SEQ ID NO: 95563 - DNA, 480 bp, Heterodera glycines
  SCN-specific regions: Sequence locations=1-19,44-254,280-480
cagtgaggaaggcggtcgcattgtgaatgtgagcagcagtgtccatctccatgccgattcggtcgatccggaggtggtggagtcgcctcgtcgatttgggataatcgcgacatacgctcgctcgaagctagccaatgttatgcatgttgttgccctcaccaaacgcatccgtaccaatgacagcggttcaaaagtcagcgcaaacgcgtgccatcctggcagtgtcaacaccgaactcattcggaacaattttttcagaaaatacattaaaaaggcatttgctccaattatatggttcgttctggtaagtatttccgcataaattcatttctcttaaattttttattgtacgaattgccattgacccggggtgccaagcggaaatcctgggccttccctgatttaaaagaataaatttacagaaaactgatcgggacggagcacagacaccgttgtttttagcgctaagtagacaaatta

SEQ ID NO: 95564 - DNA, 462 bp, Heterodera glycines
  SCN-specific regions: Sequence locations=1-462
aacttcacaatcatggtatcattcgaaagccctagatgtttagaagatatttataagctatttctcagtgattaatcagctctcaaaaaagttgtcagttgaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggcgggacggagttggcccgttccgcgttccgccgtgttagtgtttcaaattttccaaagatttctatttttttaattttgtcattttctttcccctagactcccatcacttttccgtattcccaaattttccatttttttaaatttccccctttggctcccttcactttgccatttttttccataatttt

SEQ ID NO: 95565 - DNA, 335 bp, Heterodera glycines
  SCN-specific regions: Sequence locations=1-34,100-181,272-290,330-335
atagattcttaacatttctagttctttatacttcaattaatctttattttttaaaaaatgattatttcataattttataaaagaatacaaattattaatcaacatttttagcgacttaaattaattttcagatgtttttaaataaatctgggtgattaaaaaaattgcttattttttatttactgactgattgtccactgacggattgtccacttaccgacggattgtccactgacggattgaccactgacggattgccactgacggattgtccgggagcctaaataaggttttaataaaattattattttaattgataatttatttttccacca

SEQ ID NO: 95566 - DNA, 631 bp, Heterodera glycines
  SCN-specific regions: Sequence locations=1-346,375-631
actcactctctgctgcggaggtgcgcctcacacgtcacaagcgccgccatcatctggtgtatgctggggtggacgatgcggtgggggaggatgccgaggtacaggagcatcggcggcgatgccaacagcaattggtttggcggcgatggtgcaatactacgaacagatcaacagtgttccgctcgacagcggttgaatgcctcggcgatggcaaaaattagcttgcgaaagcaatgctcctcttttttgtgctgctacacacaatgctccactgatgctccacaaaaatgtcatgatgataatgatgcccagaaagcttttgatgctgttcatctccgttccctcaactgcttcttctcctctttctgtcctccatttcggcactttcttccccccaaagtgctcctccgtctctgtctgctgttcctttttgctgtcggcggctgtccaattgtgcctggcggcgtctcggcaacggcacgttcacggcggacactcgttccgctcggcatggacaaacagatgttcccgcctcagatctttgacgaaaatgcgcccatttgcactgcggaaagggaaccgtgcggcttttacagtttttcgctggacggaaaagcgcccctcaaatgga

SEQ ID NO: 95567 - DNA, 225 bp, Heterodera glycines
  SCN-specific regions: Sequence locations=1-225
aacgtaggcatcaagaataaatatgtgttgatggacgtacgcatttctggagcattgaatatcgtgagtatgtggatgcgtacgcacgcatctaccgtataacattaatctaccatagtcatgtagacaacgtacgcatcaagaataaatatgtgttgatggacgtacgcatttctggagcgttgaatatcgtgagtatgtggatacgtacgcacgcatctaccg

SEQ ID NO: 95568 - DNA, 314 bp, Heterodera glycines
  SCN-specific regions: Sequence locations=1-96,118-314
ctcacatctgggagccctgcatattgtagtaagactggtcccccctttttgaaaaaaaacaaaaattttaatgccattaaaacatgttctaggaagttttagggccaaaaaatggaataaaattccaaaaaacaattttaggagttaactgatgcgctgagcagaatcaatattttcaaatgttgaaattttgagttttccggatgttctaattcgggttcgggattcgaaatttgccaaaagggaggccggattcgtactcagcgcctcaaacaccattagcaacatgttattagaattttcagaaaagattt

SEQ ID NO: 95569 - DNA, 656 bp, Heterodera glycines
  SCN-specific regions: Sequence locations=1-214,236-656
gttaccaatctgtaatggacccctaccttcaagaattaataaacaaatggttatgctgggacaagaatgaaacgactcgaacagaaattgaacgactcgtaaaagagaataatgtgcacgaattgcgacttcggatggttgggaaattgtcttttgggacggcaggagttcgaacgcacatggaggcgggctttgccagactgaacgaattgaccatcatccaactgtcccatggaatggcacggtatttgacaagtgaaatgggcgaagatggcaaaaagaaaggcgttgtgattggcttcgatggccgacatcagagcaaacgttttgccgaattggctgccaatgttttcgtgctgaacggactgtccgcctttctcttttccgccgtcgtccccacccctgtcgtttcgtttgccgtcgtttctttgggttgtgctgcgggcatcatgatcaccgcttctcacaatccgaaggaggacaacggcttcaaggcttattgggccaacggtgctcaaattctgagcccacacgacacggaaatttgtcgaattgtcgcggaggagtcaaagcccgaagaagcctattgggacacggtccaactcggcacaagtgcctttctccactcggccgactcggttttggagaaatatttt

SEQ ID NO: 95570 - DNA, 631 bp, Heterodera glycines
  SCN-specific regions: Sequence locations=1-89,111-347,376-631
gtccatttgatttcatcgccgtcatccaccacaattcccctcccactcaatcgacggcactcaaatggcgaggacggcactttcgggttcggcgacgaggcagaggagcatcaccgacaattccaacagcaattgttttgccgtcgatgctgcaatactaggaacagaacaacagtgttccgctcgacagcggatgaatgcctcggcgatggcaaaaattagcttgcaaaagcaatgctttccgccggagtgctgctacacacaatgctccactgatgctccacaaaaatgtcatgatgataatgatgcccagaaagcttttgatgctgttcatctccgttccctcaactgcttcttctcctctttctgtcctccatttcggcactttcttccccccaaagtgctcctccgtctctgtctgctgttcctttttgctgtcggcggctgtccaattgtgcctggcggcgtctcggcaacggcacgttcacggcggacactcgttccgctcggcatggacaaacagatgttcccgcctcagatctttgacgaaaatgcgcccatttgcactgcggaaagggaaccgtgcggcttttacagtttttcgctggacggaaaagcgcccctcaaatgg

SEQ ID NO: 95571 - DNA, 499 bp, Heterodera glycines
  SCN-specific regions: Sequence locations=1-10,35-141,163-242,268-499
agcacattcatacaaatataatacatacttatatttaattatttctgtttttctaaattggcttaatcaacaaatgtcgtctcccagtgccggaaaacgaagaatggacacggatgtgctgaaattgattgaatcgaaccatgaggtggtcatcaccggtggactgaatgaattcctggtaaaattttatggcccaaaaggaactgcttacgaaggcggagtttggcgagtaagggtcgatttgccggagaaatatcccttcaagtcaccttccattggcttcatgaacagaatttatcatccgaacattgatgaagcatccggcacagtttgtctggacgtgatcaaccaaagttggacagcactttatgatctttccaacattttcgagtcgttccttccccaactgttgacctatccgaacccagcggatccgctgaacggcgaagctgcttccctgtacatgcacaagccggacgaattcaaggcaaaatgcatg

SEQ ID NO: 95572 - DNA, 638 bp, Heterodera glycines
  SCN-specific regions: Sequence locations=1-129,154-638
gtttgaggtccgttcatttttctgttcccaaaatgtcggctcttccgtcgccactgttggcttttgccacttcgattcgcttttgtacgtcgacgcgacaaaatctaaaaatcaaccaaaacacgaaggtggtcgtccaaggctttaccggcaaacagggcactttccacggccagcaaatgattgagtacggcacgaatgttgtggccggtgtgtcgccctcaaaagcgggcactgagcacttgggatagccgatatttgcaacagtcaaagatgcccggaaaaaaactggtgccgacgcttcagtgatttatgtgccggcgccctttgccgcggctgccatcgacgaagcgatcgacgccgaaatccctttggttgtgtgcatcaccgagggaatcccccaattggacatggtccgtgtcaagaaccgtcttctgaagcagaatcggactcagctgctcggccccaattgtccgggaatcattgcgcctggcgaatgcaaaattggcataatgccgggtcacatccacgaaaaaggcgttattggcatcgtttcgcgatcgggcacactcacttatgaggccgttcaacagaccactgagacgggccttggccaaactttgtgcgtgggcattggt

SEQ ID NO: 95573 - DNA, 530 bp, Heterodera glycines
  SCN-specific regions: Sequence locations=1-270,292-312,334-530
agacagcaggacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgcttttgcacaaacaaatagtttaactaataaatgtccgctccgccgccgtacaacccgaacatgcaacagtacccgcagcagccacagccaaactacggtcagccgggctacggtggtggcggcggtggatacggttacccatcgcaaccgtacccacaacagccgaactcatatggtggtggtggctatcctcagcaacaacaaccgcagccacaagtcgtctatgtcgagcgcgaccgtccgcaacagcaagggagcaacaactgttgtctgtgggcattgttggcatgctgctgcggttgctgtttggcggagtgttgtgactgatc

SEQ ID NO: 95574 - DNA, 656 bp, Heterodera glycines
  SCN-specific regions: Sequence locations=1-267,320-375,455-549,571 -602,624-656
gctcacttccctcctaatttgtgcttccctttgtccaaatgaccctcattagcaaatgttcgcttctcctccttttcgtcgcgcccttttcccatgcgtttttctccggctttgaggtttctcccaacgcggcacgtctccgtcggcagtgcggttgcggcgggtgccctcctccgcccagcggcggtggctctgtccaactcggcatcagctgcgactcgccgcgccctccaccgccccctccgtgctgcggttgtcagtcgtcttgcggctgcggtggcggcggtggcggcggatgtggcggcggttgcggcggcggtgccattaaactgacaattggctgcgactccccacgccctccgcctccccctccgtgctgcggttgcgggtgcggctgcggcggcggatgtggtggtggcggttatggtgcaaatggcggcggcggctgcggcggttccattaagctgacaattggctgcgaaggcccaaaagccccgccaccgccccctccgtgctgcggttacgggtgcggctgcggttgcggcgggtgccctcctccccccagcggcggtggctctgtccaactcggcatcagctgcgactcccctccgccccctccgtcctgcggctgtcagccctcgggcggctgcggttgc

SEQ ID NO: 95575 - DNA, 1028 bp, Heterodera glycines
  SCN-specific regions: Sequence locations=49-273,295-552,576-621,646 -701,723-885,912-1028
tgccctaccgggaccgggacctgagcttttcaaaacccgggaccgggaaccgggaccgcactgttggcggtgtgcttgacactgccaatgctgaagagttacgtgtcgaacgtgggcatgaaaatggactcagagctcagctcatgccagcacaatgccaaagacatttggtccgaagtcagtcagctgaaggggctgcctctgctggttttttgtaaccgtacggcgcgtagcgcatacggtagctgccaagagtgttgctccggtggtgcccaaggccagcccggccaacctggacagcctggacgacccggaaacccgggggcacccggctcaccaggacagcccggacaaaccccgcagacgccttgcgagcaagtgcacccgcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaagacgttaagaaaagcgattctgatcagtggaagaagaaaaagcagaaaaacagcagcgattgccctcccctcccccggtgcccttctccgtccccatttcccactgcctttcttttccttcctttttttattttgtttagcttttccaattctcccaaattcccccccccct

SEQ ID NO: 95576 - DNA, 1045 bp, Heterodera glycines
  SCN-specific regions: Sequence locations=1-55,77-1045
atcagttgattattggtctgctcccttccccccgcctcccttcaattgcgccgtgtaatccatctgtttgttagagtaccgtcccctttttgcattacagaagccccctgtaccgtatcccctcgcttttcccactgaacgttcagttaattgcccagcattggatggccttggccaaaaagcattcttattgactgagtgctaatgcgaattgccaattcccctgagcccaaatcgcccgccaatttcgacgcccgcgccgtcaacgcccgacgcgactcgcttatctttctcaacgattggacttctctgtcggtgatttgtttcggcgtttgtgagttggaaattcgctgttcgtacgccgagaaaagccagtgaaaggcgcccgagcagagcccacggaacccccggcacagattgaaaacagaagtctcttctcctccgctgcttctcctctcccgccgatgtccgcttttcctcccgcgtgcaatccctcccacgcgcgtgccatcggcgaacgcgtgctcgccaaaatgggaaatatgccgcaaacggacgaaggcacaaaaaggcacgcccaaacgacgacaaattttgagacgccgacggaggccaaagaaacgtcttcgtcttttgcgcttttccgtccctccgattgtcccccgtcggccgattgtccgtcgcttaagccatcggtcggccaattgtccgtttcatggccaccggccggcgtctccgctcgcaatgctttggccgatgcgtttcgcggccttttgcccgcctctgtagccgctgccgtcgctccggtgagaacaccgacagccaattgaccaatactttgaggccaaccaagtgaaaatggtctattttcatccaacaaagagagtaacgaccaatcgatgattacagtaatcaaccacattacagtgaagggttcattacagtacagcattatacagtatacgcattaattcccttccctcgtgacaaacatttgtaatttggtactttatttaggaccaataaatcacaatcacttgtcaaa

SEQ ID NO: 95577 - DNA, 475 bp, Heterodera glycines
  SCN-specific regions: Sequence locations=1-475
attggaagctgagaagaccgactgctgtctgtcaattgaggggacatgacgaacatgtgatcacgtgtctgaagctgcgaggcgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccatcaaagtttgggacattgttgcgggtcaatgcattcgaactcttttcgggcacgtggctgcggttcgttgtgttaaatttgacggttcagtgattgtgtcgggtgcgtatgacaacaatatccacgtgtggaatgctgcggacggttcgttaatgcacgttttggaagggcacacgaacagagtctattcgatacattttgtgagtgagaggaaattgctcatttcgggaagtctcgacacaac

SEQ ID NO: 95578 - DNA, 1040 bp, Heterodera glycines
  SCN-specific regions: Sequence locations=1-1040
tagataactcatttgttaattattgctttttcacattggaaaaccttctttctgctctgtaccaaaatgccgggcatcaaaaggctcttcgacggcattctccgtttccgcaaaactcttcgtcccagcatggtcaaagaattcgagaaggtccgcgaccaccccgacccgagtgcgatgctgttcacctgcatggactcaaggttacaaccgtccaaatttatgggtgctcagatcggcgaattgtttgtcgtccgcaattccgccaatatggtgccggtggcaaaaagttttggcgattccggcggagaagtgtccgtcaccactgaaccagcagcactcgaattggcgattaggcgtggaaatgtccgacgagtggtcatttgtggacattccgattgcaaggcgatcaacacactttacgacctttaccatgggcgtccgtttgacgccgagtcgccgatggaccattggctgcgacggaacggacaccaaagtgtgcagaaattgacccaactgctgatggcggggcccggaacagagttggaattcgcatcggagaacggactgatggcattctgcgctcacattgaccgaacggaccaactgagcgcggtggacaaactgtcgcaaattaacacacttcagcagctgaccaacattgcgtcccacgagtttctgcgggaatacatcgtgaccaaaaaggtcggccttgatgcgatgtggttcgacattttcaatggcgaaatttacattttttcgcgaatgcaaaaactgtttttgcccatcgatgagaaaacgtcggccgatttattgcgggaggcgatcgggcaaattgaggaggaaaatgaaaacggaggcgaaaagcggagagagtgcagaaaggaacggcacggacgaacatgaggaaaagagagagaaattcattctttgctcataaaaccattattaattaattaatcgtagggtctgtgccgtggccaaacaccgagggccaaattacaaaaaggctgttataaataaatatagatcgaaaatgc

SEQ ID NO: 95579 - DNA, 1450 bp, Heterodera glycines
  SCN-specific regions: Sequence locations=1-45,68-85,107-186,210 -279,301-572,601-605,652-654,677-693,734-756,782-792,814-836,866 -885,907-1302,1324-1450
gggcactgcagcaagtgacggcgaagaaggcgcacttgctgttcgccacgtacttcagctccatcgcgaagaatgtgcaaattgtcaaagaccttcccgagggcactggcattcacattgacttagtccgtgcccccgagcagttggacccagtgttgtccgcgttgccagccaattgctttgtctctctgggtcttgtcgatgggcgaaatgtttggctgagtccgctgcgtcagtcatgccaatgcgttgcgcgttgtgcaaaaattggcaccgggacgcgtgttggtcagcagctcatgcagtctgttgcacgtgccatattcgaccaaaacggaaaagcgcagcgcagaaatgccaaaaacggtggccactggaatggcctcgtcgaagataatccattggctatcatttggcattgaaaagtgcgaacaattggtgaccgtcgccaaaatgataaacggcggagactgcgccaaagaattggcagagaacgacgcccttctcaaagaccattccgtatccccgttgatacacaacggaacagtgaaggaaagggtcaccgccattgaggcttctggcgttgagtcatacttccgtaagtcgccctatgagcagcgcattgtgcagcagaaggcgtgcctgcagctgccgcccctgcccaccaccaccatcggctcgttcccgcaaagtgcgacggtgcgcgcgatgcgtgccaaattcaaagcgcacaaaatggcggacgcggattattgggcatttatcaacgcggagacggagcggtgcattcggatgcaggaggacattggtttggatgtgcttgtccacggcgaattcgagcgcaatgacatggtcgaatatttcgctgaacatttgcacggcttttgcgtcacttccaacggatgggttcagtcctatgggtcgcgctgtgttaagccccccgtcctttacggcgacgtgcaaagggcgggtccaatgaccgtggcaatgaccaaatttgcgcaatcgttgaccaaaaagccggtgaagggaatgctgacggggccaatgaccattttgaagtggagctttgtgcgcaacgaccaaccgcagaaggacacccttttccaggttgcgttggcattgcgcgacgatgtggccgagttggagaaggagggcatcaattgcatccaaatggacgagccggcattccgcgagggattgccgttggacccggcacagcacaacgaataccttaagatcaccgtacaggcattcaaaatttccactggttgtgttgcggactccactcagatttattcccacatgtgctactccgactttggcgacattttcacgcacatcgccgagttggacgcggacgtcctttgcattgagtgctctcgctcggatttgagtctgctctcctgctttgaccgctttggctatccgttgatggtcggccccggca

SEQ ID NO: 95580 - DNA, 828 bp, Heterodera glycines
  SCN-specific regions: Sequence locations=1-828
gacaaacttctcgtctgctacttggaggatgttaagaacgcgctctacgtgcactcactcgatgacgggcgtgagctttacaaactgccgttgccgatcgggtcggtgggcggtgtttttgcggaaaagtcaaagtccaaaatattcgtcggcttcgagtcgttcctcgtcccgttcatccttttccatggcgatttctcaaaatgtccgtcccgcgagtcgcctctccaactgactgagacccgtcgcgtgaatgtgcccgggttggactgtgatgcattcgactcgaagcaggttttctacccacgcgatgacggcacaaaaattccgatgttcattgtccaccgaaaaggcgtgaaattggatggcagtaacccggcaattctcaacggctatggcggcttcaacattgctcagactccatatttctccgttactcgcctgatgctcgctaaacattttggcattgtatcagtaattgcaaatattcggggtggaagcgaatatggggaaaaatggcacgaggcggggatgctcggccgtaagcagaacgttttcgacgacttcattgccgcggccgaatttctcatcagcgaaaaatacacgaacaacacgaagttggccatccatggcgggtccaacgggggattactgacggcagtctgctctcaacaacggccggacctcttcggggccgtcgtcacccgtgttggcgtccttgacatgttccgtttcaacaagttcaccgtcggcgctgcttggactaccgaatatggcgaccccgacaaaccggacgacttctccttcattcgcatgtactcgcccctt

SEQ ID NO: 95581 - DNA, 805 bp, Heterodera glycines
  SCN-specific regions: Sequence locations=1-805
ttgagatttaaaataatacctaatggcttcagcagtgagagctttggaaggtaaaattgcagttgtgactggtgcttctcgtggtattggacgagggattgcgcttcaacttggtcaagctggtgctacggtttatgtcactggacgagctcctgccgcttcgtactctctgattgagaagggacttccatctttggaacaaacagcgaaggaaatcaaaagtcgtggaggagaagctcatcctgtgtattgtgaccacgcgaactctgacgacgttcgccgtttgtttaagcgcgttgaagaagaacagaacggccgactgcacattttggtgaacaatgcctattccggagtgcctagtctgattgaaaatgccgggaaaaagttttgggaatgcgaaccggagttttgggatgacatcaacgaggttgggctgcgcaacgtgtacttctgttcaacgcttgccgctcgtctgatggttccgcatgaggatggccttattgtgcacatcagttcggctgggggacttcaataccttttctcggttccttacggagttggcaaagcggcggttgaccgaatggcatccgacatgggactcgaactcaaatctcgcggagtggcagtgatctcactttggcctggttttgttcaaacggaaattacgacgatgggagaaaaggcggaacaatttgcttctgccgctcgcatgtcaatggatgcattcaatgcggcattgaaaggtgccgaaacccccgaatttgtgggcaaagccatcgttggtttggcgactgaccgccagcga

SEQ ID NO: 95582 - DNA, 476 bp, Heterodera glycines
  SCN-specific regions: Sequence locations=1-476
gtttttgactcaaattacttgtcgcgcaaaatcacaagcacactcgatgcctgcattttggtgtcacaaatgtcgcagccgatgcatagcattggagcgctatgaggacggagtgcgttgtgggcgttgccacgagggattcattgaggaaatcgacgatattcaggaagaccattctcagcgttccgcgtccgattcaccgcagcaaacgccgccgccgcttgttttgcaggggcacgagaacccattcggcgcatttcccggctcaccgtttgctcggctcttccaactcatccacaacaatatttttcctaccaccaccgccgcggctgggaacgacggtcgtccaacggtgctcatccatcgccggtccgcaagcgaagggccgtccacggcgacccatcagccgcagcatcgccaggccgctgccacgccgccaccagtgccgatggatcagcagccgcacacgcaacgca

SEQ ID NO: 95583 - DNA, 690 bp, Heterodera glycines
  SCN-specific regions: Sequence locations=1-330,352-391,419-690
gaaagaaggaacgcatttctctctgttcttttgccgtcccttctccgatttttccctcctccccatttattcatttctcctcccaatttcttcctcaaaatgccctcctccgttggcccctcttcctcttccgatttgctcatccgtcttttcctcctcctcgactcggccgttcactttgccctcggcgctttcctcttcttctgtccgtccacctgtgcccatttccttttgaaacgcccttcttccgatggcgtccattggcaccttttgcgctgcgtcggtggccaattgatggcctccgccactctctcgtggcgttgcgcctccccccgccgtctccccgagctgcgttcgtcctgtctgatgctccgtctcctcggcagcgttctcttcgtgttcctcttcctccacatccgtgctgttcatcccgatttgatgccatttcttgtgttgcgacaactcatctggttctgcttttccatgattgctttgtgtgttgcgctattaattgtttcgggatggccaatcggtgataagctttttgctgcgaaccgttggggcaatgtgctgtaccaaattgatacaatcgcttccattagcatcggaatggcgtgggtaatggccccgcaatggctgttgcacagacaagtgcgcgtgcccatggaccaatcgcacgaattctgtggc

SEQ ID NO: 95584 - DNA, 353 bp, Heterodera glycines
  SCN-specific regions: Sequence locations=1-324,346-353
gcctttatgcggaaaacagtaaaattgccgattctttgttggctgctcacattgacaggagcaatcagaagggaacgatcaacttttgctgcattgcctccaaatgggaccatttgcgtgcgctcggcaccctccgcacgcggcccatttaccgtcggcacacgcgcgtggtgccgtccaacatcaaatatgagaagctgttcgccatgaatgttggcatcaacattttctgaacattgcgcaaaaaaagagggtgatcggaacagcagagatttgattgaacaatgaaaaaatcaaatgaacaaagtaaagtgatcagaaaagtttttattttaaattataaatgggtaaaa

SEQ ID NO: 95585 - DNA, 631 bp, Heterodera glycines
  SCN-specific regions: Sequence locations=1-84,106-301,324-335,364-631
tgccgaaaaaataaactgaattaaattggatttatttttgaagctcttagtttgccatgaaaaagcttcttctctgtgtgtttctgctgcttcagtttctgctcgccaccgatgcgatttcagtgcaaagcgaagttggccaaccattttttgaccaacagagcgaatttggcacagtgccattgagcgaaatggaaaaacgtcgccgtaggcgcttttccaaactaaaagccgccgccttgggagcagctgccggattgggagccgccgtcattgccaaacacgcgggatgaagcggaacgacggaagggagtaaaagaaaggagccgaagatcaaaaaaataaattttattttgtaaattagatggatttgtaaatttgtttaaaattgcttaaatgagaatcttgagaattaacttcctcatttttggggtgctctcgtctcgcgtagtcaattaattctcgaactcaatcttgacttggtttgctttttgcctatgactccctctcgccgttttccgtaacccttcgttagcaaatgatccaatcttttgcggaattgtcgtcctcgtgtttcttgctcatctaattgctttgtttaattgctctaattaattaattgactatgaaa

SEQ ID NO: 95586 - DNA, 487 bp, Heterodera glycines
  SCN-specific regions: Sequence locations=1-487
cactttggtgtttatcctttcccttctcattccttctgacattgtaaaataacaacaaaacaatcgcacggttcatttgtgactgccatattattgggcaagaaaatgaaacgaactttgaggaaaatttggatttgtaacgacgttttgatggacattctgccgttttttgaccatgctcaacttggtctcaaattggcactgatttcgcctcattttgatgcactggtggacacgcattttgatggcaaaagcgatttgacaatttggagaagaataacaatttggggcttcggcgaaccgaaaataattgtcgagcgcaaatcggaagaatttccattgccagaccgtccgctgcccagcaaaattcactttaaggaccttcacattcgcaacatttgctctcctgtctgtgaatttctccgttccaatcggcacatttttgacaaaggcatcaatttgcgtttggatatggatctgcctgcct

SEQ ID NO: 95587 - DNA, 901 bp, Heterodera glycines
  SCN-specific regions: Sequence locations=1-426,449-901
tacacattgaaacgcactcaaacggaggcgcgagtgttttgcgctgcgattggcgtcgcttgaaacacgacctgagctctcaagaactcaacgaatttgctgaggaatttattgatttgggcctttctgaactcagcaaagtgccgttgttcgtcatgtgtgttgttgaacatggcattgaatatttggaagatcttctcgaataccttggcacaaaacattcaaatatgcccgtaaagatgggttctttgcacaataaacagttggtggaaactattcaaattggacattactacgagaaagtgatctcatcctataagcagggaacatatcgttgtggtccgttgaaggaaattactttggtcggcaaaaagcaagaagaatgtggcgcctatttcgagcacttaattgaacgattagaggaatgcccatttctgaggattttgctgccatggagtgaacggactatctgttctgataaaaggccatccgaatccgatgatggaccaatttattggtgtcgtcctggtgagcaactgatccgaacggacgaatcgaaattcgacgaaataaagtcaaaacagcacaggaggggaagtgctggcactaaacaaactaaaagtgccggaattccgttgaaggcgttggagcggagggaaattctctttgaagatcgcactccttgccatgccgaccatgtgacagacgaaaacaaagcacacacaactgcagcagttggccttctgcaggcagtcagaagccccacggaaaaaggcaaaatcggcgaccgattagtgaaagatgtgatttgcttccatgctgcagacttcaaaagggtgacagatattttgaagttggatttgtatgagccgccaatgtcccagtgcacccaatgggttga

SEQ ID NO: 95588 - DNA, 414 bp, Heterodera glycines
  SCN-specific regions: Sequence locations=1-13,35-56,133-134,193-414
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactccaaaatcaacgattaacataacattaaaaa

SEQ ID NO: 95589 - DNA, 463 bp, Heterodera glycines
  SCN-specific regions: Sequence locations=1-463
ctttttttctttgccaaccatcgcttctctcacttctctaaatgtctcatcacactcaaatccaacaatacttttgccctccttcggcccctgctgtgacctattacaattacggcaacatcaccaacattgacctctcgccgcaacaagccgttccacagggctttcaacagcaagttcagctaactgcgccggcttatacggtggctcagtattggcacaacgtcccttcacaaaatggcggttatcaaatgccacaaaacaatggacaccacgcggctgcctattcgtcgggggatcacccgaaaatgggaaagcacaaaggcattgggaaacgttttcatccgcagaagcatcagcagcgcgcgtcggctccccacggaattcgacgcaacggaaagtactccgcgggtgccaccaccaaacagcagcaggcaaatgccgacgacactgaccatcagcc

SEQ ID NO: 95590 - DNA, 516 bp, Heterodera glycines
  SCN-specific regions: Sequence locations=1-36,58-64,86-298,340-516
gtttgaggcctaatcttaaaaacctgctcattggtaaaaaatgaaatccttctttaatttcccatttgtcttttgtgttcttttgctcattggctgcgttgacaaatgcgtcggaggagtcgcggcattgccgccaaaatatttgggcattgaaaaccatgacaaatgcttaaccgacgagccaataggctcttcgcgccggctttgtttgccagcgcagaaaaaaatcgaatgccaagatgaaacgttgaaagcgcttaatgatttggaagaaggccaacatccgccgacttgcgcatgaatccgaagacagaagcgaaagaagcaaatgatgaaagggattgaagaatgacagggaaaagcctggctgaacaaaattttgtctacaaaaatgaaataaaaagttattgaaaataaaaaaatttattgatttgattgaaagaaaaaaggctgtattctattgaaattttcggcgcccaattattctgattcggcataaaaaatttccatttaaaa

SEQ ID NO: 95591 - DNA, 331 bp, Heterodera glycines
  SCN-specific regions: Sequence locations=1-51,74-331
ctaggataaatcgcaccaaaactgcttgggaagacgcagttcgttctcgctctaatgaaaatgacaaacgtcagttgctcgagtcaattagggaccgtcttcaaaatgttttcgaagaaaccctgaaacacaaggctgttattgagaaattagaggagcgcgacaaacggatgggcaatatgttggaaagcgtagacaatattgaaaatctcaggaagtgaaccgacatagaatgtatgtagtattcccccacttcttatcccgatatcaccattattgcctcgttcactcctgatctctctacagtcaataaagcataaaacttatccgt

SEQ ID NO: 95592 - DNA, 480 bp, Heterodera glycines
  SCN-specific regions: Sequence locations=1-480
ggagctccccgcggtggcggccgctctccaactagtggatcccccgggctgcagtaatccggcacgagggcgacattctgatcaagcgcggctatgctttcgttgagttggacgatcctcgtgatgctgatgacgcggtgtatgaccttaacggtcgctcaatgatgggaatgagagttgtggtcgaaatcgccaaaagtcgtccatggcgcagtggcgattcttggagttcacgccgtcgctcgcgttctcgttcgcgctctcgtggcaaacgctcgcgttcgcgaagtcgctctcgtgatcgcaaacgccgcagtcgtagtcgctcgctccgccgtcgctcacgttcgccaaaacggtctcgctcgcgctctgttgcgtcgcgctctgcaagcccgccggaaccaaaaaaagcgcgccacacgccctcacgtagtcgttcgcccgacaacaaacgtcttcgttcggcctctccccgtc

SEQ ID NO: 95593 - DNA, 480 bp, Heterodera glycines
  SCN-specific regions: Sequence locations=1-54,80-123,277-321,346 -349,371-376,416-480
gccacgtggtttgaatgctgcgcgctctctgagcaaccgccgtcgtgatcagcgttgggctgacaagcagtacaagaagcgtgctctcggcactgccttcaagtcgtcgccctttgccggtgcctcgcacgccaagggcatcgtccttgagaagattggtgttgaggccaagcagcccaactctgccattcgcaagtgtgtccgtgtccagctcatcaagaacggcaagaagatcaccgctttcgtgcccaacgatggttgcttgaactacatcgatgagaacgatgaggttcttgttgccggtttcggccgtaagggtcgcgccgtcggtgatattcccggtgtccgcttcaaggtcgtcaaggtctctggtgtgtcgctccttgccttgtacaaggagaagaaggagaagcctcgttcgtaagaagttttgcttgccacgctcgccgctctcaactgcttgcttttgcgcgtgtgctt

SEQ ID NO: 95594 - DNA, 271 bp, Heterodera glycines
  SCN-specific regions: Sequence locations=1-194,219-271
gcaaaagagtcggcttcaaagagccgcacacggggcttgtgaaaaatgatttcttcgggtattggtacttacaatattgccttgtgaccggtctttacatgttggagccgtgggagaggaaaatgttcaatgtttttgtcacgggtttcattgccgttttatgcagtgccttttatgccttgtggaatgcgttgattaattaatttaattttttaaaagcgtaaatttatttatactgccaattttatttatttaataaagagtcaaaagc

SEQ ID NO: 95595 - DNA, 1190 bp, Heterodera glycines
  SCN-specific regions: Sequence locations=1-54,77-1033,1055-1190
caattaagaaaaatggttatttctcaaattgctaaaacactatggtcacacattaaagaagagcatttttgcagttattgctacggcttacggggcgaacgctttaagggcacgtttaagagatgaccgaattcgatacagttttgcagaacgagcccgtaaatatggtctggtaagttttgggcccgcccagcgacttcgccgtgtcactgttttggtcaatcgcgagtcgggcggacgacgggcggccgacctttttttgcgcaatgcacttcccctgctcaatttggccgggctgcaagtgaatgttgtggaggtctcttccgcttctgaattggaatcgctgtgccgcgtgttggacaattctgaggccgactgcatatttttggttggcggtgatggcactttgagtagggcactcgtcggattgagccaaaacagtgcgccattgccaattggtttattccctggtggtcgaaaaaacattgcattttggagaatttttcaatcaaaaaaccagaacagagattcgatggatttgaatgaccaagactcaaaatcagtgcgaatgttttgcgaaagtgcaatggcactgattgagggtgaaaatcgactcgtttatccagtcaaatgctcaatagctgaagaaatgaatgactcgccttccgaccatcaaacggtcaacactcccaacactttttggctgctttccgacctttgtgcgggatggttcgaacattgtgaacaaaaggcacccaaactttggtggtgggggcctctgcgctacaaatttgtgtatttttgggaatttttaaagcgaaaaccaatccctttggaccttcgaatttcttacgaagagttttgccccggttgtaatcgttgcgtgacgcccgtaaaacagaaaaacttgacaactttgtggtcatttttctctcatcttctgtggtcatctcctcccgacagcacaaaaatcaaagtaaattcggactttgcgttggttgaaaatccaaactgtggccagagacgggaggccaatgtcagtggtgccaatgttcgtctgaacgtcgaacagaccgaaaatggcagcaaactcaaactgcgagttggcggcgcgggggacgcattcggacgatgggcggcaatgcgtttcggatggaattccgtgggagtcgcaaacggagagagtaaac

SEQ ID NO: 95596 - DNA, 635 bp, Heterodera glycines
  SCN-specific regions: Sequence locations=1-384,406-635
gttctttcccgtgttttgagctgttcaaagtaatgctcgaccaaactccgtccacttcgtcgacggcagtcacttacgccaatctgagcatcgatgaccgagacactctgatgaaaaatctgcagaaattgttcaaaacgcatcaccaagaacaaaatgtgacaaatgatcaacagcccgggagcagtacatccaaagggaccgactcgaggacaatgaaaaccgccgcgaggggacaaaccgagtttccgtttttcactccacgagacagcagatattccacgctgaagtcgacggttgtggatggaaaggccttaggctgttttatcattggcggagaatgtcgcttgagcttcccacaaatgcgggcgttgtgtcttggtgaaattccaacccaaaaaattgacgaatcaatgaaattgttggccattgtaaacgcattggccaccgaagaccaactcactgtgctgaagagggccgggttgggccaaccatcactgtcaaagtgcgaattgatcaccaaaaccaatgcagaaagactcatttccctgttgaattccactggcacttctccaattgacgaggttcagcggtcgcaattgcattcgtttagggtagttcacgactgttttggc

SEQ ID NO: 95597 - DNA, 460 bp, Heterodera glycines
  SCN-specific regions: Sequence locations=1-165,210-249,422-460
aaagctggagctccccgcggtggcggccgctctccaactagtggatcccccgggctgcaggaattcggcacgagggtttgagggcacaatgcaccgcttctcttccacctgttgatgaggcaacacacttcattctcccggcttccggccgccgacagcatttcccaacaaaaccaacaccaacaacagcaggacatcaacaacaacaatgccgtagtcgatgataatgatgttgaagccgaagatgaagcggcagcagcggaaatgccgggggcgccggcggcgacggcacagcagcgctgggaggactcaaccggcggcggcgacgatggcatggaggaacagcgacgggacggaaatggcggggacgaagaggaggtcgccggcgatgaacaacaacagttacaacaacgacgacaacagatgttcaagcggaagttgttgttggcgcaggacaacg

SEQ ID NO: 95598 - DNA, 506 bp, Heterodera glycines
  SCN-specific regions: Sequence locations=1-25,55-79,101-104,126 -420,442-506
ctctgccatgcaccaccgctcactctaagcacaagcacaagcacaagcacaagcgccccaaccaaccatgtcctcaaccctcccgacctcgtcatccaccggcaccaccacctcggccgcgccgcttcccgcggccctgctagccgacctgacctcggccatcccgcactcgccgccgccacccgtgacccccgcgaccttactcgcgacccgcatctcccagcccttttacgcatccgtcagcacgacccgccggtcgggcaccactgccgcgcacgcgctggccctgtcgcacgtctcggaaacggcccagtttgtcgtcggatacacgtcgcgcaatgcgcccattctcaacgacctcaagggatctaacgcggccgaggtgctgctgtcctcgccgccgcccggcacgtcgctggcacgcggccaagtcccgaaagtcatccgcatcgaagctaaatgctacctggcgtgctcgccgcagttgctcatgcggtttccgccac

SEQ ID NO: 95599 - DNA, 680 bp, Heterodera glycines
  SCN-specific regions: Sequence locations=1-249,303-352,374-423,453-680
aattaagagctattacaactgcacaattcgactatttgtttaaaaacgccattttaaacgccaaattttcgcggaaaagtgacggcactcattcacttttactcattcttcccacattcacttcacttcactcatccatttgacctgtgacctttgcgctgtgtgatggacgttgacggtgctgcgcaggatgagatggttacggatggtcccggttacattgccaactgtccgaccggcagcatggcccagcagagcagcaacaacggcggcgggagcagtacaagcagcagcagcggcggtgggaacggtgccggagggaacagtgcggtcggctcctcccaccagcagtaccggtccatgtcgccgctgagcggcctgggcatggcggccgcttcttcagcttctggcaccagcagcacgtcctcctcctcctcgtcgtcctcctcctcagtgattccgctggacattggcctgggcatgttgccgattgcggagaattggtgcaacacgcaggtcaaggtggtcaagtttaactacatgtggacgattaacaacttttctttttgtcgcgaggaaatgggcgaagttttgaagagttcgacgttcagtgccggcccgaaacaaaactgaaaaggtgcctgggcatcaaaccgaaagggctcgaacaagaatccaag

SEQ ID NO: 95600 - DNA, 291 bp, Heterodera glycines
  SCN-specific regions: Sequence locations=1-291
gtttgagtaactcacattccttgcgcgactgaatggctctgactgtgtatttgcccagcaaaaaggtggagaagcaaagggacagcgcgagagatccgtactgaagaagagaaagggaaaaacggacgagcagagaaagaagggacgaaagtgcggagaacagagaaccaattttgcccatttgggtgaagaagaaagtgtaaatcgtagtaacaaagcgaagaatggaaggaatgaattaatctgctgatttggaaaagttgggtgaaattggtaataaaaaacagaagc

SEQ ID NO: 95601 - DNA, 475 bp, Heterodera glycines
  SCN-specific regions: Sequence locations=1-475
caaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataa

SEQ ID NO: 95602 - DNA, 503 bp, Heterodera glycines
  SCN-specific regions: Sequence locations=1-446,468-503
gccgaattcagccctaaaagcatccttttatattaaatcagcaaataaattaggaaaatggtgtcagtgaatggacgaaaggtgaaaattgtgaagaagcggacgaaccgtttcactcgtcacgagtcggaccggtacctccgcgtcaaacccaactggcgtaaaccgaagggcattgacaaccgtgttcgacgccgcttcaagggccaacgacggatgccgaagattggctacggtaatgctcgacagacccggcacatgttgcccaacggattgaggaaggtgttggtgcacaatgtcaaggacctggacgtgttgttgatgcagaacaaacgctattgcggtgagattggccacgcggtgtccagcaaaaagcgcaagcaaattgtggagcgtgcccaacagttgcgcattgtgctcaccaacggaaatgcccgactgcgcaccgaagaaaatgaatagacggcgacgaacagacggaacaagaagaactgtcgaaattt

SEQ ID NO: 95603 - DNA, 415 bp, Heterodera glycines
  SCN-specific regions: Sequence locations=1-415
ggcactgattcgaccaataacggacattacactgacaatttgaacattgcggcgcctggcgttgttactcagcatgtgtgcaaggcgtccaacctcaaccagttccagctgagtcagatcaattcgctgcacccggacactggcgttgtcggcgtttatctgtcgaccgaagggaccaaagttctcccatttgtcaaagccgctgcccagggcttacgcgaaatggcatccaaaccgatcagtgacgagcttctccaggcttgcaaattgttggccaagggaaccgcactgacacccgacgaattcattgcccttctgaagacagtgactgcggacgatgtgaaaaaggctgcttccccaactttgcgccaaagcccatacttggcaggcgaggttcaccaggccgggcccaccg

SEQ ID NO: 95604 - DNA, 397 bp, Heterodera glycines
  SCN-specific regions: Sequence locations=1-397
ggaagttaaacataaatttgtgcttttttgctgtttggataattactacaaaatttgttgatgttatcattttggtaattttcaatgatttttgccccttttctcttcgttttgttcctttttggctccaatgaattaaacttattattggtggacagcagcagaaacattggaccaccagaagcaggcgaaagttgcgggtgcgcagataaacagcccgggactcttctgttggtgtgcattatcaaatgccgggacgaattggtgaaaaatgtcgaaaaaaagaacaatggatgattaaagtgaagacggataaataaagtatttaattagccaagttattaattatgcatttcaattaatttaatacgcaatttaataaataaaaattcatttt

SEQ ID NO: 95605 - DNA, 479 bp, Heterodera glycines
  SCN-specific regions: Sequence locations=1-479
agaaaaggaaacatagtaaaaagattaattcttgttggagacctgacatttcactatgtttcccagaccatccacgtctttcccaaagatattgaacaggaccaaattgtgccaagcttctgtggtcggctcgaaccggacaatgtcgtccagcgacaaactgcagcagcaaaaggtgctcaccgtggacacgatcaaccccaacgttatcaccatggaatacgcagtccgtggcccaattgttatccgtgcggttgaattggagaagcagttggcgaaagagtcgttgccgttccccagcgtgatcagagcgaacattggcgacgcacatgccatgggacagacgccgatcactttcattcgccaagtgattgccggcattacggagcccgcactgatcaagcaacagcccaacctgttcccggaggacgtgcagcgcaaggtggcctcactgttgcgcgcctgcggtggcggcagtg

SEQ ID NO: 95606 - DNA, 513 bp, Heterodera glycines
  SCN-specific regions: Sequence locations=1-74,98-221,243-513
ttgagcaattttacttccatttggttagcaaaactaattataagacgcaaacaaaaaatgccagtgaaaatcgaaacactcaaagcgggagatgaagcgacttacccagcggttggtcgaaaggtcgtttgtcattacgtactgactttggaaaatggccagaaaattgacagctctcgcgaccgcggaaaaccattcgaattcactattgggaagggcgaagtgatcaaaggatgggacgaaggcgtggccaaaatgtcagtcggtcagcgggcgaagctgaccatcagcccggacatgggctacggagccaaaggaatccccggaacgatcccagggaattcgacgctcatcttcgacgtggaattgatagccgtaaaataatggagagaaatgacagtgatgaggggaaggaccgactcaattgagccgcgcatttgcattaaatgtttaggatttcattccgtttttctttgtgttcactaagtaaatgggctttcgagtgttaaaaaa

SEQ ID NO: 95607 - DNA, 655 bp, Heterodera glycines
  SCN-specific regions: Sequence locations=1-81,102-198,225-339,361 -478,506-655
gtttttcagatgatgtttttccaattgtcatcctcagcaccaacatcatcttccgtcgatgggccacagcagttttttcaacaccaccaccaccaccaccaatttgtcccatcgatctcaccactgttcgacacctccggcgccggcatgttgggcacgttggcggcacccaccactgcctcaatcttcatgccgtccttgttcggcggctgcggcggggccgccgccggtgatggcaccatcaccgccgctggctcgctgatgcaaagtttgttgagcgcggcagtctgcagcggcgcattcccgttggtcggcacgactgttgcagcctcaccgctgactgctaccacctctcaacatcgcaaattgttcataggcgggctcagccatgagacgacggatgaacagttacgtgattactactccaaatggggcaaagtcattgactgcattgtgatcagggaccctgtgacgaggcaatccagaggctttggctttgtaacatatgcaacaattgagatggccgactccgcgatggcagaccgtccccacacaatagctggcaaggtggttgatccaaagcgtgcaattccgcgcgagcaaatgctgcacgcgaccagctgtccacccgcctttctcgacgttgagcccccct

SEQ ID NO: 95608 - DNA, 1265 bp, Heterodera glycines
  SCN-specific regions: Sequence locations=1-365,388-692,725-1265
attatttgaaataaaccaaaatggctgtccctcaggaagtaattgacaaaattgaggctggctacaaaaagcttcaggcggcggctgattgcaaatcgttgttgaagaagtacctcaccaaggacgtcgtcgatgcatgcaaggacaagcgtaccaagctcggagcgactttcttggacgtcatccagtcgggggttgccaacttggacagtggtgtcggcgtgtatgcgccagatgccgaggcttacacactcttcaaaccattgttcgacccgatcatcaacgactatcatggtggctttggaccgagcagcaagcaaccggcaacggaccttggtgaggggaagactcaactgctgactgacttggacccggaagggaaattcatcaattcgactcgcgttcgctgcggccgctctcttcaggggtatccattcaacccatgcttgaccaaggagaattacgtcgagatggaatcaaaggtcaaagcggtcttcgagcagctgaagagcgatgccgagttgggaggcacctactatccgctccagggcatgaccaaggacgtccaaaatcagctgattggccgaccacttcttgtttaaagagggcgaccgttttctgcaggaggccaatgcttgccgttattggcccaccggacgctggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgccgacggccctgaaattgcaaatcccgcgggattcacggcgaacattccgagagcgctgggcggcgtttacgacatcagccaacaaggcccgtcttgggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttcaa

SEQ ID NO: 95609 - DNA, 623 bp, Heterodera glycines
  SCN-specific regions: Sequence locations=1-527,549-623
gtttgaggcaaggtcgaaaatattgttttattatggcaaatgaattaatttctcccacacctccggacattgagaacatttttaaaagactacgagcgaatccatccaacaaagtctgttttgactgtggtgctcgaaacccaacgtggtcttcagtcacatacggtgttttcatttgcatcgattgctcttctgtccaccgtaacctcggagtccatttgtccttcgtccgttccaccaatttggacacaaattggtcatggattcagcttcgtgccatgcaaatcggaggaaatgcaaatgcggtggctttcttcaagcagcacggatgcgagtcgaatgatgcgcaagtgaaatatcacagcaaagctgctgcgatgtataaaggtcgcatcatcgacttggcaacgaaggcgcagcaacaagcgggtagcaatatatttttcgatgctttgaaggaacaacaatcgccacaatcaaaaggtccgaatgaatccgaattttttggatcacatgaaactgaagagcataccaaagaaatgaaagaggcgtcgctttccgaaattccacacgcgcccatccaaaaaacgaagaaaataacgcttggccaaaagaaaggcggc

SEQ ID NO: 95610 - DNA, 621 bp, Heterodera glycines
  SCN-specific regions: Sequence locations=1-211,233-621
caattaagatgggtctccttttcatggctcgtattaattattttcgtgctttttcttcaactgtttcaagatctttcaagcaggtaaagcataccgtccaggacaatgttacaaccattgaattagtcgatgttcctattgcgtcaactcatagagaattgaaggaatctgctgctactcaatctaaaactccggatgactgttcttgtgttttatgcaaaattccaacaagcatttcctacaaagatgtgcttattctggaacaattcatgcgattggacggcactgttttcccaagacaattaactggtctttgccatgaccagcaacaacgacttgagcggtgtgtgatgcaagcgcattggtcgggacttttcccggatcggactataccggaatttgaccgtgctgggtacaagcgattcaaccgacattgggacgacgatttggcaatgtttcggctgaagtacaaattgcaccctggcagttggttttacatcaaacggtacaatccacgaattcgagagtaccgcccattcaaagccgacgaaattcctgacattgagagagagtgatttattgtgaattctctttatttcatttgataaacgtaaacggatt

SEQ ID NO: 95611 - DNA, 816 bp, Heterodera glycines
  SCN-specific regions: Sequence locations=1-152,174-498,521-624,647-816
gtaattctacgtgtgtggttttttatgaatttaacctcactcatttgcttctttgactttttgccctgaaaaaatgagtcaaatttaaaagttgttttcggtcaatcatgatgagatacctatatatgaaattatgctcaaaagcaacattctttgtgttgaagtttttaaagttaaattttgttgccgaatggacattggcaactgttgcatttgcctgggtgggttcggcgttgcacagatgggcgtgctgccgtgcctgcacactttccaccactcatgcattcagcgcgcactgggccaaaatgcgcagtgtccgctttgccgtcggcacgccatcgacacgcaaattgtgagaccgaaatacgaaggaagctgccgcgaggcgggcgatttgccaagaaaggccatgcgtgccgcgttagctttttacgaccgcaccgttcgccaccgcttcgccgatggttcgtcgggaggcgaagcacagcgcgaggaattgaaactttgtctcaattcattggtcagcactttggagagcgctgacgcggagagagaggcgaaatgggaacggctgaagcaatttttgagggtgtgcggaacggccgcaatttttgccgttttggcatttctgttcactttgtattggccgttgatctcttctctggcggttggcgttgtgcgcaccgtttggactctgatcagttctctgcgcgatctgttggtcgcccattggcccgatttgctcttcggcggtttgctcctcagcactttcgtcgacatggaatcctccgactcgcagcaacagcaggcggaaac

SEQ ID NO: 95612 - DNA, 356 bp, Heterodera glycines
  misc_feature (356)..(356): n is a, c, g, or t
  SCN-specific regions: Sequence locations=1-356
cgttcatctgctgttgatgctcgtgagcgctgttgtgttcatcatcttcagccaatgctgcggttgctgtaagaaaaagagaacgattcaaagtatgagacattggccagtttggatgcaaacatctttgtgaagtccggatcaccacaaccagcgccaaatgaattccagtcaaaggtggccggctccaaattctcaccgaatcctaatccacaacaggcaaaggctgggggatcgcaattcgctccgagtaagagcaacaaccgcaacaactcggtccgggcaaagagcaatgtttttgtgttccatccaaatgcatttctgtccccattttcagtaaaagattcaaagtatcn

SEQ ID NO: 95613 - DNA, 660 bp, Heterodera glycines
  SCN-specific regions: Sequence locations=1-660
gttttaatttgacaaatttaatattttaactaagccaccaaaaatgcgtttgtcatttctccgtgccagcgagaaacattttggcaatttgtcgaaggtctgttttattatttggtctatatgtctatttgcatggagaattcttataagtcataaccatgactgtattatcaaagcaattcaagctcatttcatgtagactcgaaatgcattcaacattttgattaagtccaaaaagttcactgtcatttagactattaaaaattaatccacgggatgcaattttctattgttttaggcttacggttggtattacgttcgcattgctccggttgaacagaaagtatggaagggctttttctttgatgcgtttgttaagccggtcaaagagcagttgccccactggtggatgttcttcttccccgtagtcacttactttttggtcaccgactgggccaagaaagagtaccgtcgtctgggacggatcaaagaattcactgacgaagaatgaatgtcgaattggccattcggactgttatttgtaggaaagaccaccgagtcgacagaatataaatcgaaatgttttggtactgtcaaattgtgtgttatgtccaaataaatttattagtgttgaaattccaacagtttttggaaagcacc

SEQ ID NO: 95614 - DNA, 478 bp, Heterodera glycines
  SCN-specific regions: Sequence locations=1-151,177-478
gccttctttcacgcggaagttgagaagcggcggcaatgcgttcgcgaaaggccgacgccgcgcaagacggccagctcatgggttcagacgcagtcgctgctgaagcggtcgctgattgacaattggcgaaaccccggcctcacccgagccaaactcttccagaagctcatcatgggcgtgttcatcggactgttgtacatgaacacacagttgaacggtgtcggcgttggcaatttgaacggggccatgttttatatcatcgctgaactgacctactccacgctgttcggtgtgctcacctttttccccgccgactttccgctgctcgcccgggagtaccacgacggattgtactgctcgggcgcctattttgtcgctcggtccgcctcctatttgccgctgttcaccatcgacggcattctgatggtgaccattgcctattggctgatcggactggtgcccaccgtgggccgctttc

SEQ ID NO: 95615 - DNA, 632 bp, Heterodera glycines
  SCN-specific regions: Sequence locations=1-38,60-632
gtttgagctctcatccgacacaatcatccttcttttgccaataattccaccactttcctaatggtttccacgtccccatccccaccaattgccatggcccaacatgcgccactttctcatcgccaacatcgcgccccgttggccaaagtgttggcctcggaaaaaagtctctatctatcgatgaacgcgataaaaacaccaaaaaaggcgaaaatgcagaaagttgccccaattcgagcccaaatcggcgaccattccgaatggattccgttgcgcgcctcgaaacattcgcgccaaacggtgaatccgatccgtcgcttcaccgattcgctgtccgttgaaccaaatccgaacaaaactccaatccaactgaaccttggcgaccccactctgaccggttgcttgccgccctcggagtccgtcgtggccgctcttcgggaggcgatcgattcgcatcgcttcgacggctatggcccggcgattggaacgcaaagtgccagagaagcaatcgcagagcatttttcttgctccgaggcgccgatttcggccaatgacgttgtgttggccagcggatgctcgcatgcgcttgaaatggcattgtggcgatcgccgacccgggccacaatattttg

SEQ ID NO: 95616 - DNA, 528 bp, Heterodera glycines
  SCN-specific regions: Sequence locations=1-68,90-232,254-274,296 -323,345-528
gaactagtggatcccccgggctgcaggaattcggcacgaggaataagctgactaataatgtcgctgcttttttcgcttttcagttctctcgtgtcggatttgttgaagggtctgatgaaattattacttttcttcgagcagtgggcagggcagtgccaatatggtgccgagaaaacagtgaccttcgtgggcgtgtcactccgctcatttgtatgtccatcgaacaaccgttgggtgagcattttagaaagaagagagctgaaaacccgacgaaataatcttctcattttttcaattgtattgctgctttggacatttcagtctttttgctacgattcctttcaaatatcaaaattgtcacccaaaattctcaaacataaactgttttcaaactgatgataaccaatcaaagacaaaaagaaatgtccctcgagggggggcccggtacccaattcgccctatagtgagtcgtattacaattcactggccgtcgttttacaacgtcgtgactgggaaaaccctggcgtt

SEQ ID NO: 95617 - DNA, 616 bp, Heterodera glycines
  SCN-specific regions: Sequence locations=1-616
attcggtagaaaacccccaaatagggaccggagaagacagtgctaacgcacttggtaatggtcagaatcgcaggatgagagacaaatgcataccgttgacctgtctcaacggttcatcgactcacttccctcttctttttttctgggtgaacatgcaacttacaaagaccatgccgccatttcactgcttaatttggctcacaaccattttgtcactgtccccccgttggtggcacagttcatcaatctgatcagcctcgatataagcaacaatcacttggcattgttgccaaaagagatctcttcgttgaaaaaccttcgcgaactttcacttagaaacaatttgctagagaatttgcctaaagaatttcaacgactgcaatgtctacgggaattgaacatttccggcaatttgttggagcatttcccgcgagaactgctccaaatcaaatctctccgtgtgctttatttgggtgccaatcgtctacagtcttttccgtcggacatatgccgtttgtccaaccttcaagtgctttacctgggtggaaatgcgttagtcgatgtgccggatacaatcgggcagctgtcagagttaacttcgcttggtttggcggac

SEQ ID NO: 95618 - DNA, 295 bp, Heterodera glycines
  misc_feature (295)..(295): n is a, c, g, or t
  SCN-specific regions: Sequence locations=1-239,268-295
ccaagtttgagtttgctaaataaaatggttaacgtgaagaagggcaccgtcattcgttgtgacccggcaatgcgacagttcctgaagcatttggacgagacacgggctctgggcaggccgttcatcgtcaaggaccttgacgagttttgtttgttcgtggagcgtgacattgtgccaatgttggagcagagaatggatgcccttatggatgctttaacacccgacactcaaacataaaacccacaattttttgtttctcatttcctcaaatatttattgaaaaatttaattcgcn

SEQ ID NO: 95619 - DNA, 373 bp, Heterodera glycines
  SCN-specific regions: Sequence locations=1-373
caagtttgagagtgatgcaaaattctatctacatcaaccccgatatcgaaaacaactacaaccgggctgtgccaccggctccgaacaacgcggttgctgtgccaccggctccgaacaacgcggttgctgtgccaccgcctccgaacaacccggttgctgtgccaccgcctccgaacgatccgaatcgaggcggctttgacgacacggtgtcgttgcttgggactcacccggtgccgcgtcattagaaaggagatgcgccggtgattcgtgtaatttcatcgtgtggatgaattgatgggcccacgtttgattattggatcatcataaatgattgtaaatcttgtgtttaaaaaaaataaatcgaagtaggccg

SEQ ID NO: 95620 - DNA, 613 bp, Heterodera glycines
  SCN-specific regions: Sequence locations=32-572,594-613
cctcgtgccgaattcggcacgaggtctaaaaacaaaaagctggctaaaattgatgaaatcgtcctgagccttgttctcccatttcaattttgtgatactttgacgcgtttctgtcaagggatgaccatctataacctctatttcttcaaccggcacggcgtttgtttggcctacaaagaatggtgccgtgaaaaaaagtcgggcatttcaccggacgaagagcttaaactcgtaaatggcatgttgctttcgttgcgttctttctcgcataaattggcaactcgggcggaccaagtgccaatgatttcctgcttccgaacttcgtcctacaaaatgaattacatggagacggccactggacttaaaatgatattgaacactgaccctgacgccgtttcaattcccgaacttctacagtccatcttttgcgtgtttgttgagactgttctcaaaaacccattcgtggacacatccaaaagaatcgactcagaactgttcaacaaaagggtcgacgaattggtgcgggctcatttttgtttcacataaaatacatattcgatttagcacaaattgcttttatttccattgacttttttctgcataaaatttcgac

SEQ ID NO: 95621 - DNA, 634 bp, Heterodera glycines
  SCN-specific regions: Sequence locations=32-468,492-634
cctcgtgccgaattcggcacgaggattccgcttgccaatccgatgaacaaatggcgcttggacctttgtgggtccgccgggtcgcggacgttgatgctgagaagtgcagcagctgaccagagtctgaacccgcctggttataatcccggactgagcactacacaacaaaatgaatcggcgaacagagccgagcaacagcagcagcatttgttgagcaaaagggcgtgggatttggccctgcagccggtgaaatccttgccgatgaatatgctgccctttaggtttatgatgtacatggcgggcaacacaatctccattttcccaattatgatggtcgtaatgatggcgtggagaccgatgaaaactttgatgtcagtcaatgctgcttttaaaccgctggagcaagagcatgtcggctcactttggatccacaaaattgtttttgccttggggaatttatgcgcaattgcattggccgtgtacaaatgtcacacgatgggtcttctcccaaaccatgcttccgactggctcgattttgttcctcccctcgaaagagctcaatatgcactgtttaatgacatctaataaaaccctttgattgtttttaaatcgatttttctccataaatatttta

SEQ ID NO: 95622 - DNA, 474 bp, Heterodera glycines
  SCN-specific regions: Sequence locations=1-254,276-474
ctgagattcactcttttgaagaagcttttgtccacaacaaacgcttcaaagagttcgaaggattactcaaaacgaatcacaaagttagaaaaagaaaaggaaaaaagaaaggaaaaagttacagacttacgaaagtgtcgaagcgaaattcgacctgcaaaaaatcgaaaaaatgagcactttgacgaatcgactgaacaaattggcggatcatttgggggaaattggccatttgcattttgaaaagggtgatcttaatgcaatggatttggaggagaagccaatgttcgaaattgttcggcttgcggaacaaaaacagcacgaaattgaagaaggacgaaggaatggcaaatcgaaagcggagaaagtgaccgaagcgatggcaaatgaatgattttcagtcatttgtttgagttcatttttaatacctttgaatgggtttctgttcgaatgtctgtctggtcaaaatattat

SEQ ID NO: 95623 - DNA, 984 bp, Heterodera glycines
  SCN-specific regions: Sequence locations=1-24,46-354,376-405,433-984
gtccaattaagttaacaacagatttttgctttttgacacacaaatcaattggaaaaagggaaaagcgtgctaattgaaccaccaaaatgaatcgacgttggatttgtggtgatgtgtggatggacattctgccatcttttgaccgtcctgaacttggtctcaaaatggcattgctttccgaccgtttcgatgttttggtggacacgcatttcgatggaaaaaacgaattgacaatttggagaacaatcaatattagcaaggacaaaggaccaaaagcgaaactgtctgtggagatcggtgccaaatttgtggcatttccattgccgaaccattcgctgccaaacaaaatctgctttaaggaccttcggattgactacattgaccattctgtgttcgcatttctccgttccaacaagccaatttgggacagaatgggcaccaaattggaagtgtttgtgcatgcaattgatacggatgtccaaccgatttgggatgtttttgtccgtgaaatttggcccatttttgcgacaaacattcggcatttgagctttgccggtgccgatgctttggacaatttgcgtcgccgcatttcaccgacacttctcactgatcttgttcaattgtattcaatcacttcctatggactgtgccccgatggaatttctgacgatgggccaaatgcaactgccggccaagcgttgtccaaatggttgcacacgccgagcaaaaatggaaaagcgaatgaattgtattgctgtgcttatttttgtgaaataacatggatcaacactttcaaggagacatttctccgtgccaccacttctgtcgcttacaatgttcggcttgaacttctagtggctaacgaaatgaatactgttgaacaatttgagttggtgaacgaaatgacccaagaaaagttgacactgacgaaggacgaagagatttgtctgttgaaacggtgtccaattgttggggagacggcgg

SEQ ID NO: 95624 - DNA, 726 bp, Heterodera glycines
  SCN-specific regions: Sequence locations=1-15,37-726
taagaatcgggcagcaactttttaaatttgcacaaaataattttcacattaaatgacgtcagaaaaagaaatgctgtgggacaaggcgtgtcttctcacgcggttggtcgcctcgtcggtgcgactgtccgaagcggcgggcggaattattaaggacataatgaaaagtggcgacctgaaaattgtgaacaaagaccaaacaggacaaatgaaggatttgcaaaccgaggccgatcgttcagctcaaatttgcattgaacggtcactgcgtggcgaaattcggcgaaaatcttacgattattggcgaggaagacattgcgcccccatcgacgccctttcaaacgcttcaacctttgccatcttcacatcattttcacattatcttcaatgagaatgccaccacggcggtgccgtcttcggaagtgctgagcaacgacgaaagagtgcccaacgaattgcgcagcatcgaaatgaaagacgtcgtcgtttaggtcgatccgttggacggcacttccgaatttacaaagtcaaaagaaaacccggcgctcctccgccaagtcactgtgctcattggcatcactcacaaaggccgaccggtggccggcattgttcatcagccgtattatgagggacaacaaacggctgacggattggcaccgaacggtcgcaccatttggtcgattgtcggagttggtacttttggccatcagaaaacggcacaacaaa

SEQ ID NO: 95625 - DNA, 447 bp, Heterodera glycines
  SCN-specific regions: Sequence locations=1-447
atctcttactcctgtattattcgatcttcatctactcattttgtacctcgtgctgcagtgtaagtggcctatgcccttctgtgatttaatacagacaaaaaaacgctcacgttcatgttagcgcataaatttgaccaaaaatgagcaacccaattaaaattgtgcgaattgttgagattattgaagcagacgaagctgctgggcaacctaagcaagtggtggctgagtatgtggacggtacgggcagacgagttaccatgaaagcaagcggagaggtccgaattggccaacttgttgctttctttgaaggtcctgacagaaaccgcattcagcgatgcttcacgaacaacaacaacaacaactgatttgaaggatttgataaaaataaatttgaaaaacgtatgtcatcctttttgaaagcgcaataaaaaaagcacatttctaaaa

SEQ ID NO: 95626 - DNA, 463 bp, Heterodera glycines
  SCN-specific regions: Sequence locations=1-13,35-463
gacctaaaactccccatccttttttgcactgtttttgtgacatttcctgcttaaatgcttttcaaacgttttgttgtccccgttgcgacgcgttctgtgcgcgcggtgcatttgcccggcactcccggcatttacaacaccaaacccgtggaaatccccaattgggagccggcaacaccgaccggcccaatccgtgacggatggccgaaccaccttgcgcctttcatgcaaatcaaaagttggcgttggttcatcggcgcttttctttatttggcgagcggattcggcattccgttctttgctgccgagttccaactcaagaagcaaaaccaatgagctgagggagaggaagacgatggttagatgaagtgatgttattgcaaaaagatcagttacagacagccgtatttcaaatgtatgtttaatgttaggaaaaacgaataaaaacaaggcatgttcaaaa

SEQ ID NO: 95627 - DNA, 563 bp, Heterodera glycines
  SCN-specific regions: Sequence locations=1-25,48-364,387-404,426 -458,480-492,514-563
tgagattattttcgttcgaattttatcattaaatatccataataatatatctcttctcccaatcaacaaaatgtgccgtccttcgttcccttcaatgtttgcttttctgctgctcgttgctgctgccattgctctgatcattttgccttccgcttcttgtgcccctctcgacaatgcccaaggcgtcgttcccgacgctgcccccggcatcggttccgccagtgccgttggcatcgctccgcgacatcggaggcaatggctgtcggccgcccgcggtgccggcggagactccggcagtttttggagtctgttcggcaaaagatgaaaagccgtgaaggttccgtgccaatcgagacaaaaaactggtctttcaatgcccagaaacaacgagattaatacaaaatcattctctttttgtatattttacgggataactaaatttagaattccaaaaaatatctaaaaatctctgcttttcagtttaattggaattttaaatttattacaattttttcaacatttttgtcatattgacaaatattcagaataaattttacaaaatg

SEQ ID NO: 95628 - DNA, 476 bp, Heterodera glycines
  SCN-specific regions: Sequence locations=1-61,84-476
ggctggtgcactctgtgcctaagtttcctgccagcactggggccgattacctttacccacagagcgggaagagaaacggtcaatcgatgctttgcatcactctatcgagcacagcgcttaaggaaatcggtcagcaattgttcgttgctcagcccaatgtctacgacttccaattgcccgactctttcgcccgccttttccccgacttggccaaggcggtcaatcggacgacatttccctacaaaaaaagggttcccttctctgtcaccgacgtccattctctcaagggacagtcattcaccacctttcacaaacacaaacaattcggaaaggatttatacagtgaattggtcgcccctcggctgaagtcgtccatctacgtcgaaacttggctggtcggcagaggcgacctcccctccgattgctcctcttcatttaaggtgcacaatgtactttccgtgaaggcctcaaaattc

SEQ ID NO: 95629 - DNA, 474 bp, Heterodera glycines
  SCN-specific regions: Sequence locations=1-399,423-474
gtttgagaaaaaaatttttgtgatgcgaaagggctaatgagattctcgcccagaatttttccctcatttttgcagcaattaatcaacagaaattttctagccttgcactgtccccttccggcaacttcggcggccaaattctcaaccgacggaaagtcggacgtattttgcgcttcgcttttgcacaacgaactttgcgaaaagctcgataagcgtaaggaagagtggaggaagcaaaggccgggaacgaaggaatatacggcgaccaaagaacagcttaaccaattgcaggaagaaatcatcaaaatcgaaaactccaaatacgaatttttgcatactgaaagggacaaaatgagcattgctaaccttgttttggcgccaactcaagtcacactggaggtgatcagcaacgggaccacccacctgcgcccgtcggtggtgctccgtacgccgttgaatgcctacttgttcaac

SEQ ID NO: 95630 - DNA, 690 bp, Heterodera glycines
  SCN-specific regions: Sequence locations=1-460,482-664
caattattgaagtgccactgaatccgacaaatcccagccaaccgaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcggccctgccttccccgtttttgttttttccatttgtccatcctgacattaaacgatcgttcgtattttttctctgtgcccatttgaattcctttcgtctgtttttgctctccttttcatgttttgtgtccgttctgctgagctttcccctgcttcttctaatggagtttgtttctttgcttctgattgtctctactcgtctgttttggtgagagatttgattgtttctgagtgtgttcctccatccgttttgctttatgaattcgaccattgtcgaccctccattattcttagtctgtcatctcttttttaaatattttttgtctg

SEQ ID NO: 95631 - DNA, 475 bp, Heterodera glycines
  SCN-specific regions: Sequence locations=1-475
gtcgcaatttgtcccttcttttgccttacttttcgtcttcatccgtccaattcgaaatgtccaaacatttccttttcctggcccttctgttttttgtcggacaaataagcgctaaatccatccacagcaaaagcgaagaaaaggaagacccattctttggggaagaaacggacggaacggaggaaccgcaagagacggacgagccgaagccgtacggctgggagaacatctacgaaaaatgcatggaccaatttgacgaccacaaaaagtgctgcgaagtgtcgggcggaggcgacgaatgtttgctggaggacacaacgacggaagcgggcgaaacgacgacggaggaaccggaatattcggacgaaacgttcaaaaagtgtatggcgaagctgaaccaaagcaaggacaattgctgcttcatattcgaggacaaaaagttgaaggaatgtgaacattggcaaccgcagacaac

SEQ ID NO: 95632 - DNA, 674 bp, Heterodera glycines
  SCN-specific regions: Sequence locations=1-643,665-674
gtaatttacaaataaatttcgcaaatatttgaagtcaagtcccgttttctgtttttttcccgtcgatctcgaggcattattttgtgccaatgcttccgtcgccgtcattttccattcaattggtgtctcgtcttttttcccagttttttaatcgacccttatgttcgtccgcacatttattgtcaaaggacccttcaaattctcgcaattccggtcgcgatcacaactttttcgaaggcctctattttgagggagagataccacgagatcggatcaaacagaagtacactttgtccagcggaccgggcggttcgaacgtaaacagtcaccccacaaaggcggaaattcgtttcactgtcgacgaggccgattggattccgcggagagtgcgcgaacggctggtggaacgatacccacgctacatgaacaacaggggcgagttcgcattcacttcgcagaagacgcgctaccagattcaaaacatgaatgactgttttgatcggctccataacatgctgctgaactgctccgaggagttggtcaaggaagagcaccgaacgcatgtttcaccacaacacatcagcataatggaagaacggaaaaaacgctccgaagaatttcggttagcatcaaagaattctcattcgcggaaaaaacaaaaccgacgttcgggc

SEQ ID NO: 95633 - DNA, 266 bp, Heterodera glycines
  SCN-specific regions: Sequence locations=1-228,252-266
ccgcttcctccgatggacaacaattggtcggtggtgttgatgaggaacagcaacgagcgcgaccagcactcgtccttgaactcgacgaccaccgtggcattgatgtgctgtacagtgttcagaatgatccgaatttgggccccctgccgactcagacaaagggcgaattctgacggatgggcggccgacggtcggtccaggaaaacgtggcgaagcgcctccagaattttgctggaaattgacaaattataatttgtttctttcat

SEQ ID NO: 95634 - DNA, 682 bp, Heterodera glycines
  SCN-specific regions: Sequence locations=33-323,345-682
cctcgtgccgaattcggcacgaggaattttgtaagtgaagaagagttgcaaaagcagcgtgaagctggcgaagaaaagcctgagagttcagagccggtggacaaacgaacactttacgaacggttgaaagagcaaaaggacatcaagcaattggaatacgatgaaacgcacgcattgaagaaccaattccgtggcattgacgaggccgagtcggactttcttacacaagtggagcgggccaaggaggagcaggaggcacgcaagcgcaaggaggaacaggaactggtgcgattgagtcgacaactgacgcaacaacacgcgaccggtgccacggctgagcagcaacaacacgcactgttggagaagccacaaaaagcgagcaccgccgcttcgtcagggatcagcagacaggcggcacttatcacatcgctcgtccgccgcaaaagaccgctttcaactgattctgaaccaaaatcggcgcgtggcgaagtgccatcgccgccctcgtcgtctgacagtgacaagcgcaagaccaatgaaccgtcgaaggcttcaggcggtccgccaccaaaacaacggcacgaatcgcattgccaaatcattggagtgcttcccggcttaccgaactactccgattcgagtgacgaggccgagagtagcaacaacagcgagagtttggagt

SEQ ID NO: 95635 - DNA, 368 bp, Heterodera glycines
  SCN-specific regions: Sequence locations=1-368
ccaagtttgaggcattaattccattgcttcaaatgtggtacgagagattgcccatgattatcgcggccgttagtatccccgcattttgtaccagcgactattacccactgcattggtatgggacgaatggctgcaaacatcatcgagttctgaaaggacatgagcagtcggctctccttatccgtgacagagagttgaccggctacgaatacaatttgatgggcatcgactcaattccggaggaggattaactgaccaacgagtgggattttagaacattagacgatgacgaattcctcgattatccattatgctgtctaattgtggatataatgtttaaatgaaacaatgttatgtgcaattcaaaa

SEQ ID NO: 95636 - DNA, 1007 bp, Heterodera glycines
  SCN-specific regions: Sequence locations=1-331,353-354,376-715,737 -1007
agccttaaaatgctcactcatcggaaataccgtctcttgcaatttgcatccgtttctggtcgggcactaacaataagtccggaattcaggcagctcagttctgtttcgtccatcccatcaaattcgcataaaacctcaaagtcagatggaaaggcgcccaaatcgagcactctttggcttaatttgccctccaatgcggaagaggatgtgcgaacacgtgttcggagctctttcttcggcacttacgtcgctttgttattcccagccgccacttttgctttgggttgttggcaatggaaaaggcacaaatggaagaccgaactcatcgaaaaactgaaaattgcaacaaaaactgcacctgtggaattccctgtggacaatttgtccgcgattgatgatatggagtttcgcaaggtgcacgtcagagggtattaccttttcgaccgccaatttgtcattcggtggcgctgtcggttggaccccgcaaataccggcacttcgaattcggaaaaatatggggcgtatgtgatcactccgatgagactggagggcacaaacgttacaattatggttaaccgaggatgggttccaaacgaaaacatcgaatccgaactgaagaagggcaagcaactgcgggagtccgagctgaaggatttgaacgcggtcgtcagaagtgctgagaagggctctcctttcgtcaaaaacgacccggaaaagggaatttgggccttcaaggatttggaagaaatggcaaggcaaagcgacgccgtcccaattattgtggatgccgatttcgaatcgactgaaaaagacggaccgatcggcggacagaccattgtcgtcctgcgaaaccagcactacagctacatggtccaatggttcggattgaccgttggtgtgcttggcatgtgggccttgcgtttcttgtgacgctgcgaacaggagggaccagatggcatttgtcatatcgtatttagggtctttgctgtccatctctgttgcctttc

SEQ ID NO: 95637 - DNA, 589 bp, Heterodera glycines
  SCN-specific regions: Sequence locations=1-589
caagtttgagaataatttaaatggcaaactttccgcctaattctgacgaagagttcgaccgtggcaatttttcatcattgtcgggaatggtcggcatgaaccaacgacacttggactggttaatgaaaaacatatcccgcgaagacatggccgaactccaacaaaggacggggcaatgcgcccgaaagtgtgctgtgacgtatggaggtccgatcgtcgtcgttaccatcggtttcctcgagtttttgcgccgtaaacagaaccttccgatcacagcgccgcgctttttgatcggctaccccattatgtgtctcacttcggtggcccttggctcttccatcggcttcaaaaggtcgggttgcggtgcggaaatgcgactttttctcgacaagctctacgccaaatacgactcccaaatgaatgccgctagcgctcagatggcgccaggcgttggcggtggcacttcgccaacaaaaacctacgcccaattgcgcgaggccaaccgcgccggtcgtccaattgaattgggacagttgaagcaacagcaaacgcgacaacagcagaagaaaatggacggcagcaaagcgac

SEQ ID NO: 95638 - DNA, 476 bp, Heterodera glycines
  misc_feature (471)..(471): n is a, c, g, or t
  SCN-specific regions: Sequence locations=1-476
gttaagaatgtcacccaaacaattcaaactgacccattcgctgttttcgttccaacgcatttcgcaagcggacggagtcaaacggaaacaaatgaaagccgacgaaagcatttgcccaccacaaaggaaaaaaccaagcacttctctgaaagaagcggacggaagcgacggcgccgttgagaatgtccaaacgaaggaaaatatgcggccaattttggaagcggagagacaccaacagaacgacgatggcacaggggaaatccgttcgcctccgtcgtcttctcccactccgtggcatccttcgcatgcgctcgctgaaccgacgtggcagaaactgttgaggaaggaattccaaatgaaatacatgacgaacatttgttgctttttggaggaacaagccaaacagggtgtctccgtttttccgcctcgtcatctcatcttcaacgcgttcaatctgacaccctttaacancaatc

SEQ ID NO: 95639 - DNA, 608 bp, Heterodera glycines
  SCN-specific regions: Sequence locations=1-123,150-608
gggctgcaggtatcaaagacacgaggcatcattctgccacaattggtcatcagtgccgagcgtggtgagcgtgagtgtcacattgtggtgttgctggacgaggacgtggtcgactgggacgaggagtacccgccacagatgggcgaagacgtgacccaagtggtgtacagtacgccgctctacaaattcttcaaatatgccgaaaaccgcgatgtggccaagcgcgtgatgaaggaccgcgagctgaagaagatccggcttggcatcgaaggctacccgacgcacaaggagaaaatcaagcggcgcttcaaccgttccgaagttgtttacaactatgtgcagcgtccattcctccactgctcctgggagaaggaggaggcgcgttcccgccatgtggactttgcctgcccaattgtgaagagcaagtccaacccgagtttggcttccgccgcctccgaccctttgccgcagcctgcgccgttgcaaaacaacatcaacaatgggtgggcggcggagaatggtgccggcgaacattcggccaatttccagcaacggccgacgaatgacaacgacgggagcagcggaaatgagaatgaggccgttcacca

SEQ ID NO: 95640 - DNA, 403 bp, Heterodera glycines
  SCN-specific regions: Sequence locations=1-208,232-333,355-357,379-403
ggaactcaactcgctctcttcgaccgttccaacatttcctttgcggtgtcctttttggccgggggtttggccattggctatttgctcggctggcgaaccgcggcttcaaaattggcccgatgcaacacgcgagtgcagttgagcaaggacaaagtggtggacactgtcgaattggaggacattggcgagaaaaaggcatattgtcgctgttggcaatccaaaaaatttcctttgtgtgacgggtcccacaatgagcacaacaaaaagacgggggacaatgttggcccattgattgtaccgaaggcgaagtccgcttcatgagcagcggaggacagaacaaaaaatattaaacaaagcattggattttattgtttggttggaaattcgctcaattgttaagaaa

SEQ ID NO: 95641 - DNA, 475 bp, Heterodera glycines
  SCN-specific regions: Sequence locations=1-15,37-475
aaaaagtggaaatacaatttattttattatttgtaatggaagaacaagggcctttcttaattgattggaggacattgttcggaaaggcaccatttgagcttcggaaacaatgcattcgaggacatttgcgaaattcacatctgagatccattgtttggaggcttctcttaggagttttgcccatggaggacaggacacaatgggtcgaagtcattggtcaagaacgtcgaaattataccgaattgagacatcggattgagtcaaacccaagaattaataattcgccagaaggaaagaattttgatggtaacaatccactttcgctcaatgcagaaagtccgtggtgcagacattttgagaatcaatcaacgaggaaaaacatcgagaaagacgttgacagaacgtgtctgaaaagttcgaaacaatgccttcgtcagcttcacattaccgtccaatccgcggaggaggcaaaagc

SEQ ID NO: 95642 - DNA, 569 bp, Heterodera glycines
  SCN-specific regions: Sequence locations=1-569
ttaagatataaaaaagtccccctaattggtaatgtcttccgaaaatcctccgtcaccgatgcaacgccaacagtcatcggtgcagcttcaacagtcatcagtgtcggatatgggcgacccggacgattgcttctcaatgttcctggttttcatgagctatgtgctgctgttcttcacctttccgtgcactatcttctcttgcattaagattgtccagcaatacgaacgagcggtcatttttcgactgggacgtattcgtcgtaaagcgcaaggacctggattgttcttcatccttccatgcgttgatgaatatcgctgcgtggacttgcgcaccgtgacttgtgatgtgccgcctcagcaagtgctttccaaagattcggtcactgtcaccgttgacgcggtcggcttccttagttggacgaacaaccgtcgtttttgcatctgataagcacatgaaaatacaaataagaggaaagaaactaataaactcaaaatttttttcttctgcaaatgttgtagtaactttggctctatttcagtttacacgaaacgacaataaaataatacga

SEQ ID NO: 95643 - DNA, 456 bp, Heterodera glycines
  SCN-specific regions: Sequence locations=1-456
aacagttttcactcggatcggaccgctttggcatcttcctccatcgtttgtcgtaaacagtgtggactttgacggacctggtctttattttgagaaagatgtgttttctcccttcaaatagcactgtttttgggcgttccattggttttattcaccaattcggtcgtcgctttctcttcccacccattgcccaatgtgaacacgtggccggactcaaaatggacaaaatgcttcagctccaatgccgattttgttttttcactcgccgaaatggtcgttggatagtcgaatgcaccaaatttggaaggcacaggacaattttacgcgatttcaacgccgatctctattggtgatgtgagaggaaagactaaaaattattttcgaatgtggtcgaatttacaaataaaatttgttgtagaaacaaaccgaaagagaaacgatcgaattgtatgaaaa

SEQ ID NO: 95644 - DNA, 1015 bp, Heterodera glycines
  SCN-specific regions: Sequence locations=1-572,596-993
acttcagcgggtactgctacaaggcgttcaccaacgcggacaaagaagtcaaatattcggaagcgcagaagatttgcaagtcggacggggccgaactcgtgtcgatgcactcggagttggagcgcgagtttgtgaatgttgtggcactgactgcggcgaagaaatacgaatacaacgccaaggtgccgggattggccttctactggaccagcatgcagttggagtgggacgagaagaagctaaagaacgccagctgggccgacatgacgccgatggactacttgagcccgatggagtggggcacgaagaagcgtccggtgtacgtggacaactcgaacggcggcgagtacaacaaagaaaacgaaaactgcgtgttcattggccaatggccacgcgagggcaagcagtacctgaagttggactcggcagtagacaagtacggtctggacgtgctgtggagagacgaggtgtgcgagaagccgggcgaggactgtccgcgcggcgccgtgtgtaagaagagggctacggtgggcgaatgctacggcacgggggcgtatctcctggacgcggccgaggaggaggagatgaagaagctgctcaaattcatcactgtcggatccggcacttttgtctatgctgaaaagaacacatacatggtcctcctgctgaaggacttgtacggcaaacagatgaaggaggaggacaggaagaaggtgtgcgcttactacaaggcggagtacgtcactgtaaaggccgagccgaacaaagtgcaagaatatgtggacaaagtgttgtccaagcagaagcagatgtacgcggatgcgagcgaccacatgctgtgtaagttcagcgggacactcggcggatgcggcgactattgcaaaacgggatattgagaagggacggacggaagggaaggaacactttctcattagcatttagtcgtcctttgttttagttaaaatggtgcgctttttctctctgatttattgcataaataaaaaattttaaaaat

SEQ ID NO: 95645 - DNA, 871 bp, Heterodera glycines
  SCN-specific regions: Sequence locations=1-107,129-333,355-546,570-871
aagctggagctccccgcggtggcggccgctcttcaatagtggatcccccgggctgcaggaattcggcacgaggagaaattataataattacggagtcattgaaggcccattaaatggcttcataaaatgaacatttccaatggcagcgattggctttctgttcctcttctacctaatcggcctttcttttcctcagatttaaacagaagtggcgaatgttcgtcgtcgtccgctgctgccttttcccccccgccgttcggcgctccgttttgccaatgtcggccaatgcgaacggcagccaaagccaccacttccattgtcggccattaactctctttgcattgggcaacaacagcagcagaaaaaggcgacaaaaagccgaacattccgccgctggctcccctcagtcgctgacggactgttcttccgcaatgggcgtggaacttccgccgacgataaccgagcgactgagcactttgaagaaggatgtgatcgatgctttgctggacaaaaacgcggtgccccccgaactgatcacttcgctgatggccggcgtcggcggctcggctttcagcaaagcgctcgaattggtcccgtcgtacaaccaaaacttgcagaagatggccaagtattacttcacggcaaaaggcggcaaactcatccgaccaacagtttcgctgctgatgagtgccgcgtgcaatcaatgcgcgaaaaggccaacgacgccggcggacaccgccccgggcaggacaccaaccagcattgtcaatgagtcggaagaacagccaattgagatcagtatgaatcagtacaggatagcgatggtggccgaaatgattcacaacgccactttggtgcatgacgatgtgat

SEQ ID NO: 95646 - DNA, 411 bp, Heterodera glycines
  SCN-specific regions: Sequence locations=1-385,407-411
attcagtctcgaaaaagaaatgaagccatcattcaacttcaagcttttcgcatccgtctttcttgtgctttgtgtggcctcgcttgtcctctgtgagcataagcgagcagccgcagcagaagcatgtaatcaccccaaaagcgctggaactggcaacttggcactcaaacgatggtggtgggacggtcgtcattgtaagcaattcacctacaaagggcagggcggaaacacaaacaatttcccatcaaagaagcattgtgatcaagtgtgcaagccatgaaatgtgccgtggaatgatggtatgaagcgtgaagagacatgcaaagaagaaaagcgaagaaaatttaatgaaatttttcattaatcaccaataaataaagatttgattgaataaataaaattgcatcgttc

SEQ ID NO: 95647 - DNA, 283 bp, Heterodera glycines
  misc_feature (279)..(280): n is a, c, g, or t
  misc_feature (282)..(283): n is a, c, g, or t
  SCN-specific regions: Sequence locations=1-107,129-181,277-283
caagaaagggccaaagaacactcgcatttgatccaactcggcgccattttcctcggtttcctcgtaattaatgcgctgcaactttacgagcagctgaccaattcgggccatcatcaccatcaccactgaatgaatgaattgaatcgtccaattccaaggagcgaatttatcaaaagcgggcaatatatttattattttaattgtttttataataaatttaaaatgaatatatttgtacaaacttttttatttttttaagaaataaagaaaaatattgcnnann

SEQ ID NO: 95648 - DNA, 916 bp, Heterodera glycines
  SCN-specific regions: Sequence locations=1-363,385-916
gatcactgtcatatagagatacagtgatattttcgtttgttatgagtccgattgaccctgacaaaatggcattgctaaagcgccttttccccgtcctcggcaaacaccttcgcaagggcgactgtggcaaaatcggagtgatcggcggttcgcccgactacaccggtgcgccttatttcgcttcgatcaccccaatgaaaatcggtgccgatttggcctttgtttacgcccattccgacgctgctccggtgatcaaaagttacagtccggaactgatcgtttaccccagcaccgatttcgccacgaatagacacagcattgagcggttggacgcgctggtgttcgggccggggcttggccgacagaaacacacacaaaatttgctggcggacgtcgtaaacttcgtcaggagcaaacaaaatctttgtttggtcattgacgcggacggtctgttcttcgtcaaagaatgttcgcaactgttcaaagggtgcacagacaaagtgatcattacgccaaaccacagagaatttgttcggctttatacccaaatgttccctaaccagcagaagggagaggacacggacgaattgaaaattcaatgcgaaatggcggaacaattggcaaagcatttggaagtgactgtgatgagaaagggtcggtggcacagaaacgcaaccgaaaaatatgaggagagattgacataatctccaacggttcctcccaaacgcgaattgtccaagcggaaacttcgatgcgccgttgcggtggccaaggcgacattctcagcggcgcgacggcacttttcgcattttgggcaaggaaagcctcagatgccgacatttattcctccgagcatttgctggacggggcggaggccgcttcgcttttggtgcgcaacgcatcgctacggaccttt

SEQ ID NO: 95649 - DNA, 686 bp, Heterodera glycines
  SCN-specific regions: Sequence locations=1-347,369-455,477-493,515-686
agacagcgaatgtcagtcaaagttctctttccatttatccgacaatcacaaccagttgagttgggccgagtgtcacacaaaaataaatcggcgatttggacttctcctcatttaccaacaaattcacctattagcgaagccaacaattattcataccttccattgttattgctccaaaaagaagaccaaaaatggaagcacccgctgaaattgacgaaatatacaggccacatgaagccagaattcacgaagccttttttaatacgctttccaaaccaattcatagcaaaaacgaaagaaggaaccgagcagaaggaatcttcacaacatcggaaagtcaacaggacagggaaagaatacacgtcacatggcgccattttggtcaaaagaccaagttcttccttgaccgtaatgaacatgatttgtttgaggcgcttcaccggaaaattcgcagtgaattgccaaattttcggggcaatttggccttccgagatgacaatagtcgtgaagttattctcaaatgcgatcggcaaatcagagaagcggctgcccgaagggacaatcgcctgcacattttcaccactctctccgaaagcccttcccttttcttggccgcgtctgagattggcactttgagtgcgagtcgtccctcctcgagggcaccgcttggctctccgatatccgcg

SEQ ID NO: 95650 - DNA, 314 bp, Heterodera glycines
  SCN-specific regions: Sequence locations=1-232,256-314
cacagtttgggccatttacgccgactggtctcacactagagagtggaaaaattcccttaaactaaaaaatgtcgatgacatggccaaagtatctgggtagctacatcacgctacagaatgcatttcggatgaccctcgcagccctcattcctgctgttgcaaaaatgtatgaagactctgaagtagcaaggctcaccaggtttcgggaccggtctgccatgtttggcagaccacctccacctcctggtgttgaagaaattccatcatggtaacacttatgttacatggctagtttgaataaacttctcagttgc

SEQ ID NO: 95651 - DNA, 419 bp, Heterodera glycines
  SCN-specific regions: Sequence locations=1-12,40-152,174-362,385-419
aaaacttttggtgtaaaatcaacaacaacaaaaaatatgcgcggcacattcaacataaagaaatagtccggcggtgcagataagctattgacaagaataattctgtaagatggctggctatgtatggccttaccttttttgctttttgggtcttatttttcttacagatttaaggtgataagcgttaagtatcaaaatgtcgaaccgggcgctcctccagaagccaccaaagctatgacgattgaggcatcgatgttcgatatgggcttgggttgtgtggcatggtgggaaccgcagtgcgcaagtgaattgaaacaggaagcaaatgatccaagcgaagatgaatagtaacaaacgaattgaagattttgttattgttttatttgttctaacggattcttttttaaaaatttaccatg

SEQ ID NO: 95652 - DNA, 539 bp, Heterodera glycines
  SCN-specific regions: Sequence locations=1-539
gaatgaggtgcggagcgtttgtcaatagcgagcatgcgaatattgagcaattagtggctgctggccgccgtaatcgatcgagtgtgagcaaagcgaaatacctatttaactgaactaaaccgcatcacaatgtctgaagtctacggttttctcgacaggttcacaaaaagaataacgcgacgcagaggcaccactcccgcagcttcgggatttggagcggacagttcgatggatggtggcggtgtttcgaaggtgtgcatcggcctgtgcgtctgcattctgatccttttgattgtgttcgctgctctccttttgactgctgcgctatcgcctaaaagtttcgaaggcgttgctgtgctggggggcctcgcgagtcttttcgcagaataaatcgaaatgcgatgttcttcggtctttctgttgttgtcccataaggcataagccttaactactagtacttcattttcgagttgtgccctctattgaataccgtacatttgcttgtttatttgtactattgtcgttaaataataaatgcg

SEQ ID NO: 95653 - DNA, 1867 bp, Heterodera glycines
  SCN-specific regions: Sequence locations=1-138,176-340,362-362,398 -515,538-637,663-846,872-1475,1505-1867
acaaccaagagcccgtgaccaagcgaggcttctgccaatttgtgttggacccgatcttcaaagtgttcgacgctgtgatgaacatcaaaaaggacgaagtggcgaagttggtggagaagctgaacatcaaactgaccttggaggagaaggaacaggagggcaagcccttgctgaaaacgatgatgcgcaaatggttgccagccggtgacactatgcttcagatgattgtcatgcatttgccatcgccagtcactgcgcagagataccgcatggaaatgctgtacgaagggccgcatgacgacgaggcggcggttgcaatgaaaaactgcgaccccaacggaccactgatgatgtacatctcgaagatggtgccaacctctgacaaagggcgcttctacgctttcggtcgcgtgtttgctggcagagtcgccactgggatgaaagcgcgtatccaagggccgaattatgtggtcggcaagaaggaggacctctacgagaagaccatccaacgcacaattttgatgatgggccgttacattgaaccgattgaggacattccggccggaaacattgcgggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaaactggtcgaaggattgaagcgtttggccaagtcggacccgatggtccaatgcattttcgaggagtccggtgagcacatcattgccggcgcaggcgaactgcacttggagatctgcttgaaggacttggaggaggaccacgcttgcattccgctcaagaagtctgacccagttgtgtcctaccgtgagacggtcaccgaagaatccgaaattgtgtgcctctccaaatcgcccaacaaacacaaccgtttgttctgcaaagctaggccgttgcctgatggactgccggaagccattgaacgcggcgacgtcaatccgaccgacgacccgaaaaatcgtgccaaaatactcaccgagaaattcgaaatggacgcgaccgactcgcgtaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcaccgtggcggtggccaaatcattccgacggcgcgtcgtgttttctacgcttcggtgttgaccggcaaaacctcgtctgcttgagcctgtctatctcgtggagatccaatgtcccgaagcggctgttggtggcatttacggaatgccgaaaccgccgccctggggtcctccttggaggaaaaataaaatgctgggaaccccgatgttcatcgtcaaggcacatttgcccgtcaacgaatcattcggattcactgctgatttgcgctccaacactggtggtcaagcgtttccgcagtgtgtgttcgaccattggcaagtccttcccggcgacccgtttgatggcacttctcgtcctggtcaagtggtcactgagacgtgaaaacgaaagggattgaaggagggcattccatcgcttgacaatttttatgacaaattgtaatacatggatttaaattatggcggtgtttttgtttgttggctgacacaatacacttgttgtccttttattatgaaatcattgtggtcgtatgtaattttatcttgttaaaaaatttaatgtt

SEQ ID NO: 95654 - DNA, 371 bp, Heterodera glycines
  SCN-specific regions: Sequence locations=1-371
aagcagcgcaaatggcacagcacggaatgaaaaagaagacgactttacctgcgggggcaaaacaaaaatcaatgaagcgggcgcaaaagggggcaccgacaagaggacccaaaaagggctttaaatcaattgttccaccaaaaaaggcatcggctgtcaaacaagcgaaggtaaatacggaagtcagtcggatgatcaacgagaagaacgaagaaatggtcagagaaagggccgacagagacgtcggaaaaacgacgaagcaaacaaaaaacacttgactatttttgattttgtgatgttacgggaagatttatgacaattggtacacaattttttttttgttttagtgtattaattatgcatttaatatg

SEQ ID NO: 95655 - DNA, 331 bp, Heterodera glycines
  SCN-specific regions: Sequence locations=1-331
gacgactcggcggaagagatgcgattggtcaaaagtcggatgaagggaataatggcacacattcgtgccaatgaacagttgttcacgcaaattgtacaatcgctacaattgaacactcaccagcgaactgtgctggagcaaattttggcctgaggggggaaagcggtgacaagcgacggaactgatcagagtgatcaatgaaggaatgataagacggacattaacatcggacgaaacggataccaattaaattcaccctttattatgcagatgttgttttgttatcactatcgttatattaattatcaccatacaaatgcgcttttctgtt

SEQ ID NO: 95656 - DNA, 635 bp, Heterodera glycines
  SCN-specific regions: Sequence locations=1-276,298-586,609-635
attaagcgccattagtgatgatgtcaaacgcagcgacaccaaagttggctaaaaaagtgcttcgcaagaaaataggggaaattattgcgcagcaaatggcgggagaaaatggaggaaatatccgcgagagggaaactgcgacggtggcacaaaagctgttggtcaacgaatggttccgaaattcgacgcgactgtccatttacgtaagcaatgagcaggaaatttgcacggacgacattgtgcgaactgcgctcagagagggcaaagaagtgttcatccccagattcaaaaagggggccgaacgaatggaaatgctccgattggaatcggagaaggaattcgattcgttggagggcactctttggggaatacgccaacactccgccagtctcagtcccccctcatttgaagaaacatccgccaaagcacctctcgatttggtcgtaatgcccggcgtggcatttaccacaagcggaaaacgacttggccatgggcgtggattttacgaccgatttctgaatgaatacgcacaaaaatacggaacagtgccgagaacaattgcattggcattgaaagtgcaattggtggacgatttgccaatggaaagcaaagaccgaatggtggacgaagtgatc

SEQ ID NO: 95657 - DNA, 468 bp, Heterodera glycines
  SCN-specific regions: Sequence locations=1-468
ccgccaaatacttcttctacgacccggacttcgccttcctctccctgggcacatattcggcacttcgtgaaattgcgttcacccaacagttggcccaacatcgtcccgacctccacttctattacatgggcttctacctgttcgactgtccgaaaatgcgttacaaaaatcggtttcggcccagcgaattgttgtgcgaccactgctttaattgggtccccgtgacggaatgcgaccgaattctcgaggcgaacggcggccgtttcagcactttccatccgtccgctgagcccactcgtgccgagttggacagtgcccaaatggaccaaattctgtgccttcacggcgaccccccgcggccgctgactttcgccagcctttgcaactcattggaaacggccgctgctcatccatcatcttccacagacagtcaacgacagaacggacggggcgaggggccggagatgg

SEQ ID NO: 95658 - DNA, 637 bp, Heterodera glycines
  SCN-specific regions: Sequence locations=1-92,114-120,147-637
gtttgaggtgaatatcgcacaatacataatatgtttcgagttgccaaaacacccgcccattatcaacaatctgttcgctcattcgccaccctaaaggacatttccatccgtctcaagtcgatcaaaaacatccaaaaaatcaccaaatccatgaaaatggtgtcggcggcaaagtatgcgaaggccgaacgcgagttgaagggcgcgcggacatacggcgaaggggcgcaattcttcgtcagcaatatcaccgcgggggaccaaacggagccggtgaaagttgccgaaagtgttgtcgaatcggcgggccgaaaacggcttctcattctgatgagcagcgaccgtggactgtgcggatcggtgcacacttcggttgccaagaccgcaaaaaacattatggccaacaaaccggccgacgtcgactacaaaattgtgtgcattggggacaaggcgaagatgctgatgcagcgactctacgcccaaagaatttctgttcaccgtcaacgacattggccgctctccgccgaccttccaagacgcatcaattgcagcaaatgccattctctcctccggctacgaattcgatggcggtgaaattctgttcaaccgattcaaaacggtcgtttcgtttgagaca

SEQ ID NO: 95659 - DNA, 241 bp, Heterodera glycines
  SCN-specific regions: Sequence locations=1-185,208-241
atttcacacaatccttgggttaggtgatgcgcaacagaggcacaggggaggaatgcgaacagtggggtttcgaatacatcgaagtgccggtcgcctgtgagtgttatctgagcaagagatcgatgtggcttgaagcggtgcctccatcaatcggagacgaacatttcttataaattgtttctcgaatatttaaatttacaattctaacaaatgttggtttacattagaatacacagaattc

SEQ ID NO: 95660 - DNA, 605 bp, Heterodera glycines
  SCN-specific regions: Sequence locations=1-446,469-523,552-605
ctcaaaaattgttgaaaaactaataactaattcgaatgtcaaccatcccaatgccaccaccaccaacacaagacgaaaaggaccaacaaaagaaatcccaatggaaaccgctggagataggaacaacgaaaattccggacccagaagaattgcctttcggaattgtacagactgcattccgagcttcagatcggatgcgcacgacctcagaagattcggccgagtcttttgacgcctatggaccggattcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagtcattagaggaaaacaaagtcggaatggatcaaagggtagaaaagggaatgacaatttatttatttgtttattttatttaacacttcttctgatttttcaataatgaaataaagacaaacccaccacaaaaaaaa

SEQ ID NO: 95661 - DNA, 636 bp, Heterodera glycines
  SCN-specific regions: Sequence locations=1-23,45-279,309-510,532-636
cgaccgaataaaatgttaccttcaatgtcaaaaaagcaaagaaagccagaacagaataaccggcaactacgcataattgaagtccaattgttcactccaactgcccgacggtacccacactttgattacgaagaaatgtgcaaggaattgggactcgaaatttcgaagcaaaaggaaactgcggagagcaattcttttcacgaccaagacgcagaagaaattgtgcgaagattggaggcgaaatatggctctcaaaccgttgtgtcacttccgtctacttggaagaaaccaagaaagaaaaccaaaaaagccatcaaatttgcgcctgaagatgtgatggacaaagggttaggctacgatttggaggacgatttcattgacgacgaacaagcgtacgatgaatgggtgcctacgacaatggacacggccaagcgaggtcattacgtgaacaaaggaccgttggagttccgacaaatcgactttgaccagacgacctcggaggaagacgaagagaaggacggggaggaggagagcaatgggacgagacgagagacgagcattttggaagcagacgaagaggaagcgatgaatatggaatgatcaaatttctataatttacatcattaatttattctg

SEQ ID NO: 95662 - DNA, 661 bp, Heterodera glycines
  SCN-specific regions: Sequence locations=1-661
ggcgctttctccgcctcacatttcagctattccacttcagtcactgctgcttcttctgccaactcgaaaactccaacaaattgttcaactatttctgacccgaagactcaaagaccacaaagttcgcctgccggcacaatggccgaggggtggcagaacaggctggagaaccttgagtttatcgatgacgacattatttccggcgaggagtgtccattgattaggccgaattcgtctgggaaagtgccgacggcaaatgttccgtccaattttttgtcgaacacgacaatgcctcacaaactgcagacaacttcaaccagaaaagactcaaattgttccgtcacttctctgcttcccaatgctgaaaaagaatccgacaaatctttcgctggcgttgctttgtcgtgcggtggtggcaaaaaagcacaccaattgaatgacattaaggcagttgtggaaaagctgtcccggttggctttcgaactgtccgccactcgtcaccactcctcaacaattcattcgactctttctcatgtccgactgaaaccgagtgcaaaatttgaactgctcgacattgacctggagaagtttcaaacactgcagaacagtcgctcttccgcgtcgccatcctccgctggcactccctctgaccaattgccgt

SEQ ID NO: 95663 - DNA, 1474 bp, Heterodera glycines
  SCN-specific regions: Sequence locations=1-475,498-578,600-778,800 -935,957-1058,1080-1474
gtccaattaagccacctggtttttgtgctaattacatatattttgtcaattttaatgtcagccaccacccattcgttgagcaagcaagaaattgccaggttcagccggcaattgatgctgaaagggattggcccttcaggacaagaacgcattcgagaaacaaaggtgctaattattggcgccggaggattaggctgtcccgtttcaatgtatttagttgcggcaggcattggacgccttggaattgttgaccatgatgtcgtttccattgacaatttgcaccggcagacaatgcacgaccaaaaacgggtgggccagtccaaagccgattcattgaaagaatcattgtccagaattaacaatgaagcgaatgttgtggcttataacgtgttgctcaccagcaaaaatgttcttcaattgtttcgtgattatgatattgttgccgactgttcagacaatgttgccactcgatatttgatcaatgatgcttgtgtgttgagtggaaaaccgttggtatatggaagtgcgcttggttgggagggccaatttactgtctacaacaatggaacgaattgtccttgcttccgctgcatttttcctgatcccccaagtcctgaacatgtgatgagttgctcagaggcgggtgtgcttggccccgttgttggcgttattggaagtttgcaggccttagaaatcatcaaaattgctgtcagcggaaaatcatcatttgccggaaatttgtggatgtttgacgggtttgaaggcatatcaaaaagaatttctttgagagagaaaatgtcgaattgtgcgatttgcagtgaaaatccaaggattacagaattacaagattatcaaaagttctgcaggtcggatccctcaaataaggttcgctcattatgtttactttcggctgaacaaccagtgtcgccaacggaatatttaaatttgaggaacaaaataggcggttccttcattttgttagacgttcgacctcccactgaatttgaaatatgccatttgccggaagcagaaaattttccctgggaggaattgagaagagcaaaaatggaaatgataattgacaagataaacaacagcatggaacgcaaaagtccgacaattaacggtgcaggaaacaatgggaaaacaaaagtccttgttgtgtgccatcatggcaacgactcgcaattggctgcgtgtcatctgcacaaacagttgtcagaggccggcattggcgaccggttcatcgttcgtgacattgtgggcggaatggatggatgggcgttggaggtggacgccgacttcccgcgctattgatgcagctgatggtttagctgttgaatgtgagtggactcggattaatgccttctttaaattaagaaacaaatctgccacaattggaaagaattcagaatcccatgggaaccccatttttatgttatttgataacacatttttacattttttgcttacg

SEQ ID NO: 95664 - DNA, 637 bp, Heterodera glycines
  SCN-specific regions: Sequence locations=1-322,344-345,368-483,506-527
ttcatgttaatgacttcgcgaattttaagactttggcagcccggagctccccgtcctagggtatttttgcctgatttctggataaaattggttgagcaaccgagcaagggttacaaccgtcttccaaaaaatgccgctgcgtttgaggtcgacctcaaaatgtcgcgaatggatgtccgcgaatatttggaaaaaatttacaaatatccggttcgggatgtgcggattcgtgtcactatgggggatatcacatgggaccaccccaaagaccgggacaagagaagagcactttggaaggaagaggaccgaaagattgctatcgtcttttttaaaaagggtttcattgctgaagtcccggatctgttccccggccgtggcaccgatgctgaaattgatcagatgaagaagttccaagagcaggacgcaaatactttcaacagtcgctttgtcaataggggaagggcagggataggagaaatgctacctatttaatgctggaatttttgttgataaaatgcgatgaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 95665 - DNA, 420 bp, Heterodera glycines
  SCN-specific regions: Sequence locations=1-420
gtcccgagtacatcttcatcttccgagacggtctttcggaggggcaattcgcaatggcatgcaaggaagaattgcgtgcactgaaacagggctgtgttgaatacgactcccgctatcagccaaagtttgtgatgattgtcgggactaagcggcacttcaaaaagttcttcctcgaggaggagggacgcaagggccgtccgttcaaccagaatttaacaccaggctccataatccaagataaggtgactgcgcgcggacatcacggaattctttcttcagccccacgcaccgattcacggaacgggcaaacccgtagaatacaccatgttggaggatgagattggcatcagcatggacgaattgcaaggagtgattatggcgttgtcttactcgcatcagattgtcaatgttgaggtgagc

SEQ ID NO: 95666 - DNA, 410 bp, Heterodera glycines
  misc_feature (409)..(409): n is a, c, g, or t
  SCN-specific regions: Sequence locations=1-410
gtcgttcgtacctgctccgccaccaattccgccaatacctccaccacccgtgccgttgaacgccatccaattgtctggagttaatggaatgccaaagaagaaaggccgtcgtccgatcccatctcgctcaaatgccacttatatttcgcaggcgtcccaagacatttaccaatcaaatcttttgagcggaggaggcatcagccaaatatcccaatcaagccaactttctcagccttattttggcgattaaaccaacttccgatggatggaaagagaaaggggtcgacggagcaaacgacggaaatgaaggattgctgttgattaatggaaatcacgcgataaagatttcatcctcattttatatgaattctctgagtcaagttaatttcgataaatccattgcagtttnc

SEQ ID NO: 95667 - DNA, 224 bp, Heterodera glycines
  SCN-specific regions: Sequence locations=1-224
atgagaaaacagagttttcgatgtatttaacctcctcctcctcccccccctggcatggaattatttttaacacaaattttgcacatttagtttttttccttttgggtagggtacaccaggcatacactgtagttgggcattacggtaagagaatttgtattattttcgagggtgctatatgatgatactgtatttgttcattgtactataaatattttaagaat

SEQ ID NO: 95668 - DNA, 397 bp, Heterodera glycines
  misc_feature (133)..(133): n is a, c, g, or t
  SCN-specific regions: Sequence locations=1-109,131-216,250-328,352-397
gcgtcttgagaagtgttggttttgttcatcaacaatttatccgggccacggaattcaattcgtacgtaacgacgcaacggttttcaagttttgtaggtcaaaatgcaacaaattattttaaaaagaagaaggnccccgcgcaaattgaaatggaacaaaggcatcgcgggcgaattcggggaaaaagaattggtcaacgatgtttactcaggccatgggaaatttgcaaaaaaccaacccccaaaatttgtaggaaccctttgggaaaatggcgttgggggcaataagggaaatttcagcgtttttccaccgccggtgccggaaaaccattaaaaacccccttgaaccgggaaaacaaaccgtggaaaaaggcatggtggagaagaccccacaaaaa

SEQ ID NO: 95669 - DNA, 432 bp, Heterodera glycines
  misc_feature (427)..(427): n is a, c, g, or t
  misc_feature (430)..(430): n is a, c, g, or t
  misc_feature (432)..(432): n is a, c, g, or t
  SCN-specific regions: Sequence locations=1-334,357-358,398-432
aagaaatattcggggctgtgatgttgattttgccgttcaaaactgaacaagaagcgattgcacgagcaaatgccacacaattcggattggcgtcgggattatgcaccacgaatttagcacgagctcatcgcgttgctgctcaattgaaagttggcactgtttttgtcaacacttacaatgatgctgaggtgcacatcccattcggcggcttcaaaaattctggtcacggacgcgaaaactgtgttgaatgtttacacgaatattcacaagtgaaatcggtgtacgtgaacatcgacgaaggattgcaacacaatttgggatgaaggaagcggagagagaaaaatgcaatagaaagagctcaaatacaaatagaatatttttaaaattttttcacatgccttattttactaactaataaagagattanctnan

SEQ ID NO: 95670 - DNA, 488 bp, Heterodera glycines
  SCN-specific regions: Sequence locations=1-488
gagttgcggttgaaagaccaggcatatttggtgggagcgttggacaaagtggagaaattggctgtccgggccaatgacaaaacgaagaagttggagcacgacactttgttgaaggtcaaagagttgctggagacaaagtttgtacggcaacacgaatggaatgagaaggaaattgaagtgctcaacaaacaccttttcctcaccgcaaagccaatcgtttatcttgtgaatttgagcgaacaagacttcatcaaaaagaagaacaaatggcttccgaaaatcaaagcgtggatcgatgagaatgacccgggcgctgtattaatccccttttcgggtgcctttgagttgaagtcggttgaactggaccccgaggcgagggcccaattcttcaaagatacgggtgcttgcagcgcacttgacaagatcattaagactggctacaagaccctttgcctcgagtatttcttcacagccggcaaagacgaagt

SEQ ID NO: 95671 - DNA, 426 bp, Heterodera glycines
  SCN-specific regions: Sequence locations=1-266,288-289,311-426
ttgagttttaactaaaattttatcgaaaccgttaattcgcaacgacaaaatgccggcccaatcgccattctttctttggatgaatgagaacagggagagattctacgagccgggaatgactcaagcggacgtggcgaaggccgcaggcgaggaatggcgccgtttgcccgagtcagagaaggccaagtggggacagagatcggcggaggaacgaggacgtcaaggggggcaagatgtggaggaagaggagcagtaaaacggagaacaaagggagtgaggggggaaaacaaagagaaaacgaaaggaagaaaaccccctttgatcatttaatttgatggcactccaacacattctcatgggcatttcagcctttcttcttaaagaagaccgaaaaataaagcaataaagtcggaaaaaagtttaaaa

SEQ ID NO: 95672 - DNA, 407 bp, Heterodera glycines
  SCN-specific regions: Sequence locations=1-382,404-407
ccaaacaaaaaacttaaaacttcgtttccataaaatcaaaaaatgaaaagccttactcaaattacctcaattattctcccaatgtgttttttgcttctgcttttatcaccaccaaacgcaatcggccaaaatttgtgccaatgggaaggcaaatgtgtggactatggttgcccaactgcttgcacttcagagtgtgtgtgtgcttcgcttgagaaatttgtaaatgcatcaaacttggcgccgggaaagcaaaccgattagcatcgaagccgaaaattcaacaagaaaaagcttggaggcgggtcagaatgattgatttgtttgcaattaattacttggaataattaattaataattccatttgatgatttgaattcgaaaatgataaaaaggggaacttcaaaaaa

SEQ ID NO: 95673 - DNA, 447 bp, Heterodera glycines
  SCN-specific regions: Sequence locations=1-447
gtcttccgctctccaatcaacaaatgcctcccccggtgtcacaaaaaaatccgatcacagttcaactcaaattgaccaacagcacggacacatgcagcgattactcgttggaatttacgaacacttgctttaagctggtggaccaagtcaaattccatgtgaaagtgccgaaaacgtcaaaattggcaaatcattggggcatcgttccgcttgccactgacaatggcactgctgatcagcaacagttgttcacattgcccaacaatgtgcacctttacccgggcaaatcattcgcttctgccggcatttcagtgaacggtgctgaccgtccggaaattgttattttggatgtgcaatcggttctttgcacggaaaagcatgacgatgcagccacaaattgagcagaatgaaaactgattgggaccaaagggaaagtgccgaaaatgt

SEQ ID NO: 95674 - DNA, 841 bp, Heterodera glycines
  SCN-specific regions: Sequence locations=1-679,701-841
ccaagtttgagcacttaattaattatgccttgccaattgcctaatgaaattgcgacggtcactgacgacgtgttttcgtatatgtgcaatttggcaatggaaaagtgttcgaaaaaggccgataaaaagaaggcctcgtgtggtggggcagcaatgcggaagagacttttgatcaaaaacttcgtggcacaaatgctcgcgcaggatcgccactcgcgagagctgtcttcaccaacttctgactgttcctcccacttgaatcagaccttcgacgagtcgttcgactttccgtcgtgtcaaagcggtgcgaatgcagtggaccaatttggagacgacatggaaatggacgccatcggagaggaagttccatccaatgcgacaaacgatgcctttctgtgcctggaccagccgtcgtcattgttgaccgacttggacgacgtttcgtgcgaccctcagcagcagtgccattcatcgtgcaatcggaagcggccctggtcgttggtgttctccgccgatgccaccgccactgctgactctatgccgatgccgtcgctgtgttcgatgggtgtcgtcgtcgaccagtacaaccaccaccacctgagcaacaccaacaacagtgttgtcgacatgttcacggctgcaacttctgctcagcaccaccacttcatcaactccaccgcaaacaacatcaacaacaacggcgttctccactcgtcggctcctccgctgttgtcgccgctgtgctgcggcatgctgcagatgagtccgttcgggtcggccactgctgctggcgaggccatgctgttcaatggtgctggtggcggtgccggtggtgttggca

SEQ ID NO: 95675 - DNA, 621 bp, Heterodera glycines
  SCN-specific regions: Sequence locations=1-621
tgaataaactgcaaatttttgttggaaaattacgcttaccccccgctccggggccaacaaatgcgcatccttcggtgcgccacagtgagaaagccctcgtctgtccgtctgctatcttcaccgtcgatgagcagcaaatttattgggagaatgaccctttgcaacagaatggtgcactctgctcgtcggtcgtttggtccgtcggtctcttccaacggcaccgtttccgcaacggcacaattggggcactgtgtttggagtgtggccaagtgttgtgggagatggacacggacgcgcagttgacggaccacattgtgaacaaacaccccgaatacatgccgaattcgttggcagcgaacgtggcaccggcgacggctgactcccaaattgtgccaacgtacgtcgatgaacagggcgaactgtggcgatgtgtggacatcgcaacaaatggcgaattggccgaggaaatgttccaacgcaacggagcacaaccacttcagcagcagcaacagaatgaggaggtgggaaggaagggcaatttggacactaatttgctcattaattacaataattgcttttttactattattacgtttgtctccaaataaatttttttagctg

SEQ ID NO: 95676 - DNA, 759 bp, Heterodera glycines
  SCN-specific regions: Sequence locations=1-249,272-385,407-759
tgagcgcgccactaagactggcttagcggctgaggcccaacaaaaaattcacagcaaatttgacttggaattatcgaaacaaatatttggatggatttctcaagtcactggagaatcttttactgtcagtggcgaagtggaagaatatttgacgaccctcaaagatgggactggtttatgccagctcgaaaatgatctgtcgcccaattcgataaagaaaataaacaccagtaattttccattcaaacagatggaaaacatttcattctttttgggttttgctgaaaaatatgtgaacaaaagtgaactgttccaaaccgttgatttattcgaagggcaagacccaaattctgtgctcatttgtctggctgcacttgctcgaaaatcggagaaatcatttggaaaggcggggcttggtcccaaagaagcggagggctcgaagaaggaatggacgtcggagcagctgcgtgccggtgacgctatcatcggcttgcaaatgggctcaaacaaaggcgccaatcaaagcgggatgattatgggaaacacgcgtcacatgtgaaaagaagggacagactgtgaaggaccggaattttgtgtaattacttcacttaaaagccttttgtttgtgatagtgctgaattgaccttaccacggatgacacccttaatacattccttcttgccttgacacttttgcaattccatttaaaatccaagatgcatatttctaaattatcatagaataaattagtatgttttg

SEQ ID NO: 95677 - DNA, 482 bp, Heterodera glycines
  SCN-specific regions: Sequence locations=1-204,226-289,316-436,458-482
taccacagaaaaaaagcaaacaaagaaatggcagggaaaatttttgtggtcactggcgcaaacaagggcattggttacggcattgcgcgtgggttggcccaacaagtgaatggtgccaccatttacatgacggcacgaacgccttcactaggcgaaaaggcattggatgacttggagaaggaattgggcataaaacgcatttcaaaattggcatttcatcagttggacatcactgatgagaaaagttgtgccgattttgcggcatttttgaagaaaacccacggcggattggacgtgctcatcaacaatgccggctttgcatacaaacataatgcgacagagtcggccgcaatccaagccgatgttacgattggtgtcaattattatggtaccaaattgatcagtgatcagctgggcccactgatcagagacgggggaagaattgtgaatgtgtgcagtcaaatgggcgtaatgggcagtca

SEQ ID NO: 95678 - DNA, 609 bp, Heterodera glycines
  SCN-specific regions: Sequence locations=1-295,318-420,442-514,536 -542,570-609
ccaagtttgagtgaacaattacaacaatctttcatcgtcaaacataaacaacaaaattcaatcctttttaatattaaatggttgttctgcccattttcgccgccgtcgccggcgccgtcggcgaagataagaaaaggcaacggacgggggaggccgaggagcaattggacggagacggagtgataacatcggcggagcagccgacgacgacggcgaacagcgaatgttcatcaattgtcggcgaagcgaccgacggcggcgggaaaacgccgacggggggagagacagtgacaaacgagtaccagcagcagtgccatcggaacaacatcattaacagcggcggcagctgccctttggcactttcgtcgtccgagcgaatggtcagcgaactgatcgcagcggtcattgagcagagcagacaaaggcaacagctgcagaaacaccagcaacagttgctgatcagtacgaacaaagtagaggagaccaataacagcggaggaagcgaaaatgaggcggagggggaagaaagaggggacgaaatggcaccggaggaggcgcaggcggcggggacattctgtccacgctgttcaacgcggtcaaaggcggtga

SEQ ID NO: 95679 - DNA, 197 bp, Heterodera glycines
  SCN-specific regions: Sequence locations=101-101
accttgattttcttaagcaagtcatagcctgtcatgccaggcatacagtaatctgttataacaagattcacctccacctcctataaagacacaaaaagccgaaaacaatctcagaatcccagaaaaagaaactgatctgtggccaaaaataaacactgaacacaacacaacaagttggttaaaatttttaaattact

SEQ ID NO: 95680 - DNA, 753 bp, Heterodera glycines
  SCN-specific regions: Sequence locations=1-242,264-296,318-388,410 -418,444-531,556-753
aaacatcgcttgaggacagagaggaaaagcgtaagaaactgctcaaagcacagcttaagtcggcgaaaatggtcgtgccaccggcgcctcaaattccgaaaaaaatcgccgaagagcacaaaaagaatggcacccaaccacaaaaggaagagtcgaagaaggacattgggaagaagaagcagccgcagatggcagagcgaagagagtcaagtggcgagagtggcaagaggggaagaggcagtgggatgagcagagagagcagcaagagagcccaagggaacagccgaaagaggggcagagagaggagcagagaaagcagcggcgacaaaggcagaaagacaatgcgacgttcgtcgcgaagtcgctcagtgaaacggcgcaggcgcgactcttcctcctcctcctactcgtccacttctcgctcccgttctcgctcccgctcctatcgccgcagtccaaagcgatcgcccgccagggatcgccgccgcgacagaacaaggcgttcaacttcgaattcctctcgctcgtcttcatcctcttccgcctcgtcctcttcacagtattcttcgtccgaacggtcacactctcagtcgcgttctttcaccagcgaccgggacgaggaggaggagcgcattcgcgatcgaatcatcgcacgaacgctttccacaagtgtgacggcggcacccgcaaaacagcctcaatcgaaggatgacggcgttgcaatggatgaagcgatggaatacgggccaaagc

SEQ ID NO: 95681 - DNA, 534 bp, Heterodera glycines
  SCN-specific regions: Sequence locations=73-534
aactttttggatttaacccttccaaaactatccgttttcagcctgctatactcgcatcgccaaaacaaaactaaaaaaaatgttcccgagacttttcgccgttggtggtgccgttacggtaatggccgttttgctgtgcatgcatacggtggtggaaagcgcatacacctaccaaaaattggacgatttaatgccggaactgcgtcaatatttgggccgaacccatcttggcacactgaaggcgcgtcaatactatgacgatgacacggcatttcaacagcaaatccgtgagcgcaaatccaacaatctgcgcaacttgatgaggattggcaaacggagtgtgccaatgccatcacaatcattgccggctgactccggtgccaaacatgcggcagagctcggtgttggcgccgccctcggtcccatctactacatcccaaatgacttagtccaggcttttcgtcctcagtctgtgtggctccgtcgttgaatgagcggcagcacaaaaagctttgtgcaaaaaatccgttgatg

SEQ ID NO: 95682 - DNA, 636 bp, Heterodera glycines
  SCN-specific regions: Sequence locations=1-104,126-225,247-440,462-636
gagaagtccaatcactcggcccaattaaattagccatccctttaattggccttaattaagagaatttcatatctctgaattaacctcggcaatgcattctctcgcctttatttccttcgctttttgcctttcactaacggacgcttttcgtactcaatcgtccggcgtccgggggacacttctctgtggaggtaaaagacgaacaaaaggccctctctctggcctaggttttagccttaggcttaggcctaagctttaggctaggcttaggcttgcccaaaaaaagacgagaagggcaattccccgccggtctccactgatcggcactctctcattaatttttgttttgtttttcttttgtctgaaggaaaagcactcgcggacacaaaagtgaccaattcctttgatttgtttattgttcggtaagaaagaaacaaaattggaatgaaggtgaaactttacgaccacgacaaagggccggacgcggacgatttgatggggacgacgacaacggacgagcagggacgattccaagtcagcggaaagaccaccgaactgaccaccatcgacgtccaactccgcatttaccacgactgcgatgatggcatgatgccttgccaacgcaaggtgaccttc

SEQ ID NO: 95683 - DNA, 1221 bp, Heterodera glycines
  SCN-specific regions: Sequence locations=1-139,161-551,576-644,666 -1221
gtgcaaaatgagtttggaagacggcctttgctcggctatttggccagcctaagcgacgaattggtgcagcaattgttcgagtcgcgtccgtgcgtcgtcgccattttccgtcttttgcccgcctttgcccaacaatctgtgcttcagctgatgttccacaaatccagcgattggcgttcgtggactcggagtcgcttccatttggccatgtccagcgccgttcagctccttttccgactgcgcattttggaaggcaattcgaacggcgactttcaaattaatcttgatttccgcatgaattacgtctccagccttttggccaaccctttggaattgtccaacctcaaaatgcaccatttggacgaggaaaaagcgcgcaaagcgaccaaagacttaatgggcaaaagtgtggagcgatgggagagcattctgtgctatttggcactgccgagcgaagcggcggagaaaagcgtttcggagacgacgaaggaccttttccaattcatcggattggtgcgcggaagagccaaagagcccgaaatctcttcgattggcttccaatttttgcttttgggccgctccgaacaaatttgggcctatctgatccattacatgcgcttcatcgcttcaaagggcgaagaagtgtttcccgttttggactttctgctacggctcacgctttgcatcaatggcgacgatgcgcttgcccaaccgctgaggctcgacccgaattggcccgaaattgtgcaggcattcgttgtgactctgcgcgaattgggactgattttcatacgcaaacggaaggacggttggtttctgctcactcctctgatgactcagctttccgttgccgcctcagctgaacccttagaggaaaatgccggccaaaatggcgtcgctttgcgcaattctccacttacaaattcacacgcaacaaatgggacaaaaggcggacgaaatggcgacggttttttaattgtggagacaaattacagagtgtacgcgtacacaaattcgaccctccaattggccattctgtccacattcaccgaacttctttaccgtttccaagacattgccattggcgttctctcccgcgacgcggtcagacgcgcttttcagaccggaatcaccgcccgacaaattacccaatatttgtcgacaaatattcgacagccgccgtcagctcggaacaattcgcaattgtccgattcttctgtg

SEQ ID NO: 95684 - DNA, 592 bp, Heterodera glycines
  SCN-specific regions: Sequence locations=1-592
gtttgagttcatattattgtatggttggtcgtgttcagcattcaacagcatttaaagttcgaaagtggttcagcgtcttcgtttggcccgtttttgttatcagttatatccttggcgacaaataccaatattggcaattgaaaaccgggagacgaaagaacctttttgacgaattcgcatttcttcaggaggcacaaattcgagagcaaaaggcactttataacagtccgtacgggccgagagcctgagcaaatacaccgttttttggatttatctgtcaatgggcaccttcacccttaaatatttcttcaaaaaggccgttcttgagcgcccgtggtactttttccccgcctttatcaccattagttggcttgaatattcctactataaacatggtcaatggaagattggaatgatgaagggacacagcaaaatgtggagagaacgccgtgaagaaatcttacgctgggacccaaatgccgacctgtggaaatattagagaggaggacgaattggacagacttttcgatcggacttttaggcgccactgatttgatttgttctttaaaaatgataaaaacaattgtttgaa

SEQ ID NO: 95685 - DNA, 465 bp, Heterodera glycines
  SCN-specific regions: Sequence locations=1-7,33-136,163-306,328-465
gagggacaaactttattttaattctaaaaaagcaacaacaataataagtcgaagtcgcacgaacgattagacaaaaaggaactgtcgacccaaagaacgcaacaatttttccacaaagagcgaacagcacaaaccgtggtgggggtggtggaggcgggaaaatgctgagagggcgtgccgctgcggttggccacggcccccaacatcgtttgccccacgcgcattcgcacgcccatcttccgccacagcgacccaagcaaaaaggtcatcagcttcagcaacaacagcaagttcaaacaggtgcagcacaaattgtagcagcattgccaccttcggtgccccaaccgccgcagcaacagccccaagcgaccaatgccgtggcagcagcgagttctttggcggatttcccaaactgtgccaatgatgtcctttcaaagattggcgattttgtccgacaatggggtg

SEQ ID NO: 95686 - DNA, 564 bp, Heterodera glycines
  SCN-specific regions: Sequence locations=1-58,82-564
ctaaattttgctgaaatgtcggccaaatacttgcgcagaatgcccccctctctttcgcttcttttggccctttcgatggccttttgcctaatcactttggtactgaaatgccccgatgaagaatgcaaaaacaatttgagggaaatcatttcatttccaatggacggcgacgaaacaaatggaacaaattcatcgtaagcaatggaaaaaacggcggaaaatgcacaagagtttttgctaaaaatgtccaatttcgacaaattcgcatgtaaaattggggacaaatattgaaaattaattgaatggattgatcatttgattattatttattttcttttctttcaatttttcgttttgttctgctgccctccggccataggccattcattcgttcattaagtcaattaattaattcaattgttttatatttgtttattttccttcgcttcgttttcattgtttttaattactttttttatttcctatcattcgctgaataatgtcataatttgaaagtgcatttcaattttggattcgttacataaattgactttttccccaaaa

SEQ ID NO: 95687 - DNA, 290 bp, Heterodera glycines
  SCN-specific regions: Sequence locations=1-249,275-290
gtgtacactgacctgaaaatgggcgttgcgccgtcactgcacgacgcgttgttttggtacaatttgcaccgggacggaaacggagacctgcgcacgagacacgctgcttgtcctgtgttgaccggcgttaaatgggtgtcaaacaaatggatccacgaacggggccaggaattcatacggccatgcccgctgaagaaagaatataacgaaaaatatgtgggcgacgttagaccattttgagactcataaattttgtaaaaaattgaataaataaacatttttttatcgtt

SEQ ID NO: 95688 - DNA, 229 bp, Heterodera glycines
  misc_feature (229)..(229): n is a, c, g, or t
  SCN-specific regions: Sequence locations=1-44,122-188,211-229
caccaagctatggagccccagaaccgccaagctatggagcacctccgccaccgccaccgcctccgccgccgcctccgccgccgccaccaccgccgcctccgccaccaccgccgcctccgccacatcaaccaaaatatcctccacagcaataagcgcaagatggatgcaatacggatgagatttatggagataaagctgatattgataattaaatgcgctcactttgttn

SEQ ID NO: 95689 - DNA, 630 bp, Heterodera glycines
  SCN-specific regions: Sequence locations=1-535,563-630
caccttcggaacactccgcaaagtcccgcagcgacggcaccgccgacgtcgagtcaaagccaacacttccaacagcgaccacacgtcgcataccatcagccaccacagcagcactatccgttgcagcaggagacgaaccaaagccaacacatccgtccccagcctggcgtaaggccggcacatccgcagcaacacccaaccgagcagcagtacccatcaatggccgggccattgttccaatcgcaaccgtcgagtgtccaagcccttcaagagcatgagattggcaatgttggacagccgaggcttgcgcagcatggccacacgcacatttctcaccaacaacaagtgatgatgggacaacgccacgcgacccatcacccgtcgcagcagcaaacactgatcagccaacagcaaagccaacacccacagcagcagcatcccaccacggcgattcgaatagaacaatccggccaagtggtgcatatgcacgcggcccctccggcgccaccgcagcaccaaacccagcgaatttttgtacaacagcagcagcagcaacaaatggtgcctacattgccaccccaaagtgcgcatgacccgtccctgcacccgccccctcttccgcacccgcac

SEQ ID NO: 95690 - DNA, 639 bp, Heterodera glycines
  SCN-specific regions: Sequence locations=1-420,442-639
attatggataggagattcactgtcttccttgtgatcgcattggttacttctatttatgaagtgcttagtaatggaaatttgaacgatggcgacgactcatttaaacaattcgatgaactcgaagaaaacccagcgcataaatattcaaaagaggcccagaaggggttcgaaatggaggaggaggaagtcacaatccgagaaccttcggggacgaaggaatcgttcaaattgcccatcaatatgccgccagtgaaattttctttttgtgtctcatgtggttatcgccaagcatatgaacagtttgcgcagattttacgcgaaaaatatcccggaattgacatccacggcgaaaactatcctcccggcattcttcgcacggtgggagcgcaggtcatcggaatggtcaaaattgcactgattgtgtgcgttgtgtccggaaggagtcctttccccaccttgggacttgaaaccccaactttcttccaatggatgctcagcaatcgtttgtctgccgcacttatgctttttttattttccaatgccatcgaagggatgctccaatccacaggagccttcgaaatttacattgaaagcgaacgaatttggtccaaattggaaagtggtcgcgttccgtcacct

SEQ ID NO: 95691 - DNA, 441 bp, Heterodera glycines
  SCN-specific regions: Sequence locations=1-441
aatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacaatggaaggaacggaaacagcgcggattgttaacggacgaattgctttggaaggagcggctgctgtacgcccgcaggcgtgagtttctcactgctgttgatggttacggcacagttgacaattggaaacacccgagggcgacgatgggagcgtcgactttgtccagcaaactgttttaggaagaaaagcaaacaatccaaccttcgtttaatgcaattattaaatcggattaactccaataaacttt

SEQ ID NO: 95692 - DNA, 639 bp, Heterodera glycines
  SCN-specific regions: Sequence locations=23-639
ctcctctcctctctttcctccttcgccacttgcacagcgactcggcaattcccgtcgcgggcggaagcaattaggccaacccatcgccgctttcattagcatcgcaccgcttaagtcagtcagtcacaaaccgacaaaagaaacggcaaaattctctcgcacattattcagaaaagtcgaggctctgccaaacctccgaacagcgaaaaattcaatcggaaagtgagtctcgaggaaagggagtcgagaggggacgagcaaaaggtacggcacggcaaaacaccacggcacacgccggtcgatgagatcggatcgggatcggactatttcagcgacgaactaaacattgacggcgcctttgcgatgaacatgggcatgcccgcgggcgcgacggaagtgcccgagggggtcgtgcagctgaatgtcggcgggacttgttttctgaccacaattgacacgctgaaaagggacagcggagcactgctgtcccagttgttgacgttggaagggttggagaagaacagcaaagtggccaagcgaatgagcaacggcaccattttcatcgacagagacggcgaactgttcgcctatgtcctggattacctgcgcaccggcaaattgcttctgccggagaatttt

SEQ ID NO: 95693 - DNA, 573 bp, Heterodera glycines
  SCN-specific regions: Sequence locations=1-86,109-573
tggagctccccgcggtggcggccgctctcaatagtggatcccccgggctgcagttatccggcacgagggcttattcttctaggcaacgaattgttaaatcaaacaaacggctgaaatgctaattgcttgtatccccaaacgaattcatctcaatttgaatgtggtcggtgctgcacttcgtcagcgtatgccgttttctgcggctgtgcttgaccctcacgatcagctgaaagattcagacaagccgatgtcggagcagatgaacccttcattctttaagatggtcgattactacttcgacaaaggcgctgctgtcattgagccgaaattggttgagaacttcaaagcttcgcatgggaaatcgaaagaagagagggtcagctctgtcaaagggattcttgcggcgattaaacccgttaacaaggttctttacgtgaccttcccgcttcgacgcgatgacggatcttatgagatgattgaagcatggagggctatgcactcagagcatcgtactccaacaaagggagggattcgcttttcaatggatgtgaatgaagatgaggtgaaagcgct

SEQ ID NO: 95694 - DNA, 319 bp, Heterodera glycines
  misc_feature (319)..(319): n is a, c, g, or t
  SCN-specific regions: Sequence locations=1-319
aattgttagcctattaaaatgcgctttttccttctcctaatgcttattattgcctttttatgcgcttcgccagttgttgctgcaaagaaagcgagatcggtgcctctggtaaacgtgccggattggaacattgagtcggcaaatggcggcgacgggacgaccgatacttaatgtgagatgtgccaaaaacatttggtcaataagtcaatgtgatatctgatatgatttgatggatttattgattgatcactttgattaagcaaagttaccctgcttaatgtgttaacaacctccacgaataaataaaacattttaggcn

SEQ ID NO: 95695 - DNA, 550 bp, Heterodera glycines
  SCN-specific regions: Sequence locations=1-255,284-329,375-498,520-550
aaattaataaaatttgaagaaatgaattttcaaattatgtgatcaaaataccgacctattaggccatagaattacaccaattatgtcaagaaaagtgcgagaatttatattttttgaaacgacctaataaaaggaatagtcatggtttacgtcttccacgggtccaatggttgctgctgttcgggctcattgaagagatgttgttgcggcatgtcgtgcacttctgacatcgcatccgatgggcgcggcaaaacagtgccagcagcaccgacagagactggtctacttggcatccgttgcggtggcggcgtttgtggcggtcggggctgaaaattttttttaaacaattattttttattgttatttcttttatacaatagcagtatttttcttaaagataagtggaggggaatcccaccacaacgcgctgaaaatgacggtccgtcgcgtcgccggtagcgcgacgatggccagaaacaccaccgctcctgtgttggctggcattgtcatcagctttgtcaaagcctccgttggaaacaccggacatcgg

SEQ ID NO: 95696 - DNA, 1250 bp, Heterodera glycines
  SCN-specific regions: Sequence locations=1-612,634-1250
ggcggcgacaaccgcttggatttcgattggttcgcctaatgacctcaacgaagagcacttccctgatgaatatgagccccccgatgtgccgaattatggcgcgaaagtcaaagtgtgctatgcccgagtctgacttgctgacaaggaaatcagtcgcgcaagacgactacgactaactcccagcgctcaggacaccagactctttccagactacgaagtgcccggagtgatccacgacctaggccccgaagcacctcccggagagtacgactcccaagtcgcccacttagtcattgaatgggcctctgattagatgtgccaacatggctatgctgactatggggcagtgccccatttgccacttcttgccgagattcccgacactttggcaatgcatgtcgcgacgagtcttcccgccagcgcttcttgggcactctcagctagtgtgcatgcccaacctgtcgttgaggacatcaccagcacttgaggatgctgctccattttcactgctgccgctggtggacttggactttggatcctgacgttggcctaagcttttcttaccgcgggactggataacacaatcaaactgattgttgctgcctctatcgatgagagactttgcctcactgaacatcatgtaccagactttctagtgcattgtgacgattcggagtctttcgaatatatcttcctgcgaaccttggctcgtcttaccaatggccttcacattgtgttcgatttcgtcacttcccctcgtacaggcgcccgttcactcaagtgcctttctgaaggtggtgtccttttcattggcggtatctccggtttggacgttcagctgccaatccaattagtggccaaaaaccgtttggccattatgggcgttacgcgtggttccattgagcaactgaagaacctggtcacattgctttcagagggacagctcaatgcccccaattatcgcgtttatccggtggaccaggcatcacaagtgttgaagcaattgagcatgtccgaggttgaaggccgagccattttggaggtgtttaatccggacacagaagttaagaaggccgaggaagagcagaaataaacggattgtgataaaccgagtggaggagcctttccctcacctgtgcgcttttatattatttgtgacctttcctttctagtgattcatattggagaaggcacagttctatttaatcccggcggacgaaatttgcacagatgtaattaaggataaattt

SEQ ID NO: 95697 - DNA, 242 bp, Heterodera glycines
  SCN-specific regions: Sequence locations=1-55,83-131,184-242
gttacctaagggataacagcgcaaaatttttgagaagttctcatttacaaaataaattgcgacctcgatgttggattaagaacaacttataaagaaaaatttataagagttggtctgttcgcccaaataaatcttacatgatctgagttcagaccggcgtgagccaggtcagtttatatctttgattaaataattctgcactacagtacgaaaggatctagagaagtaaagtttttatatag

SEQ ID NO: 95698 - DNA, 453 bp, Heterodera glycines
  SCN-specific regions: Sequence locations=1-453
ttttttaattatttaaaatggttgccaataattccgacaacgctaaccccaattcacatgaacagaaagtccaattttctgcaccgcgacgaaattcgatgaatgaactttcgatcaacgaagatattaacagaaaagaaggctcatcaacttcagcttcacatccctctgatttgtccaccaatttgacaattcatgttgatgaacagtcacaaatgcttatgattcatccaatgactgaaccatcggttgacggcaaaagtcaacaaaaaagtacggcttcagcaccagcggaatttcagcgtgccaaatgtttagctgaaagtgaagtgattaaggaaaagccgagcattcgaactcggctcattgtttttgtggtatgtggtgcgatcattgcgttctgtttgatcaaacttttcatatggaaatgattattttgttcaaaaaatgaag

SEQ ID NO: 95699 - DNA, 507 bp, Heterodera glycines
  SCN-specific regions: Sequence locations=33-85,107-301,323-507
cctcgtgccgaattcggcacgagggtccaattaagggattattcatttttcctgcttatttgatggcaagaaagaatttatgccgcaaaacatttgctacttttaagcaagaagagaggtatcccattgtccaacgagcaattggagcccgatggggcagaaaaactattcaaacgccgaacatcgaagaagaagcactacaatcagtcgaattgcgaccatcaacatctgccgaagactttgtggaatcaccgccgttaacgccatcaattgcgacaacttcggaggttgacgttctgtctgcggaaactgtggaatttggcgggtcgttctcagcgactgctgcgcaaatggatatcttcgagtcgaccccgtcaacttttgtagttcaaatggacattgaagagacgactccatcaccatttactgtcaacgaccgctcacagcgaatcgaacaactcgagaatcaattgaacgatagggacgataaaaatctgtgggaggatg

SEQ ID NO: 95700 - DNA, 476 bp, Heterodera glycines
  SCN-specific regions: Sequence locations=1-8,32-199,223-435,457-476
gtccatttaagttgttgttttttattattacttttcttcattttgataatggcatccgcaaagtgtgccagggaagactgtggcaaaacggtgtaccctttggaggaattgaaatgcctggacaaggtatggcacaagacctgctttaaatgcacagactgcggcatgattttgtccatgaaaagctacaaaggctacgacaaaaagccatactgccaagctcattaccccaaaacggttccgtcggccgtggccgcaacgccggagatggaacaagcgaagcgaaacacggcctatcagagtcaggtgaaataccacgaggcgtatgagaagcaaatgaaaggcacgaagatggaagtggccgatgacccggaaacgatgcgacacaaagccaacatggtaaaccaatccttggcccattaccacggcgaactgcagaagaaagagaagcaggactcacagagggacaccactgc

SEQ ID NO: 95701 - DNA, 434 bp, Heterodera glycines
  SCN-specific regions: Sequence locations=1-26,48-286,311-324,350-434
aacactacaaataattttccgcttttaataatttcaaataattttccgctttttccaaatgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgcggcggatgggatgagcgcattttgggcggtcgtgaacaatgaatggatagaatgagtgaagaagaagaagaagaagaagaattcgggatggatgccaaaaaagtaaacattcattttcaattcaaactattgaacatacacaaaacaatgaatttctttcctggtcattttccaattaaataaattgaaatatttaccagaaaac

SEQ ID NO: 95702 - DNA, 193 bp, Heterodera glycines
  SCN-specific regions: Sequence locations=1-3,25-193
ctctcatactgtgcattctttgctctatttggtgtaatttttggcccatttgctatttttgttgttgacaagcgtttttgtttttccataaaaatgcttttcctaattcccttaattgtctcttcctttctgtccctgcatttctttttgtcataaattatttttggctgcaataaatttcgctgacttcaac

SEQ ID NO: 95703 - DNA, 395 bp, Heterodera glycines
  SCN-specific regions: Sequence locations=1-98,120-395
gaagtagccaccggaagacgtcgacaaagcggagtgttttctggcgaaatcaaccgactgaacgtgcaataacaacgttttggagaaagttgcagcgatattggttgccttttatcaggtgcatccaacccatggccggagatgcaatgctgtttatttgtcgtctatgaacatgccgaacagcagaaaaaactacatgtgcagaggcaattcgatggcttggtgaccattgcgcgccaacaagaagttgacgagcagacggcaggcactttttccgcggtcacttcgatcggtcggccaccgacgtttacatcgacttcgcggtacacaccggccgcttccgccccatccggctcgcgcacccaaatgtggtgatgcagggctttgatggtctc

SEQ ID NO: 95704 - DNA, 549 bp, Heterodera glycines
  SCN-specific regions: Sequence locations=1-64,86-549
ggagctccccgcggtggcggccgctcttcaatagtggatcccccgggctgcaggattccggcacgagggcttgacattattttggttaccatcggatacaaatcattttcgttgtctgagcatatttcagaattttccgaatgcggcatttccgactttgaacccgaatttcccattgcaccaaaagtggaaattggcacaaatcatatattcaaaggaaaaacaattgtggatgacaaatcattgccgtggatggcaagaattttaagtggagtctcttgcactgcgacaatcatcgggccccgacatgtgttgacagcggcgcattgtgttgaaggccaagcacttgaaaacttcgttgtgtcatatggaagcgccgatgcttcaaatcaacaacataaatccggcgttgaagcaattaaatatcatccaaaaacacaacattatgaaattaaggataaatttcgaaagaatacaagagcatacttatttttgaatgacattgtcgtaattaaaattaaaaactcaatcaagttttcacaaaatgcc

SEQ ID NO: 95705 - DNA, 549 bp, Heterodera glycines
  SCN-specific regions: Sequence locations=1-549
aaagctggagctccccgcggtggcggccgctctacaatagtggatcccccgggctgcaggaattcggcacgagggtttgagcgagtaatttcaagtccaaatggacgccgttaaagcgccaactttggcttcgattcaccacaaaaatcgtctccaatctccgctcaatgcccacggccatcctttgatcattgaaaatggcactgtcgcagaaacattagtggacaaagaagaagaggaattgacggaacaagtcggcacttttttgttcacttccgaatctgtgggcgaaggacacccggacaaaatgtgtgaccagatttctgatgccattttggatgcgcatttggcattggaccccgcagcaaaagtcgcctgcgaggttgtcacaaagacaggaatggttttggtctgtggggaaattacttcgagcgcaaccgtcgattaccaatcggtcgtccgcgaaacgatcaaaaagattggttacgatgactccagcaaaggatttgactataaaacgtgcaatgttttggttgcgttggaaaagca

SEQ ID NO: 95706 - DNA, 359 bp, Heterodera glycines
  SCN-specific regions: Sequence locations=1-314,352-359
aaaacgaaaagccgaaaagaaaagaacagaaaatggacgaaggaacaacggaaaataataataacagaaagagcggtgcaaagaaaaggaagcagaaacagaagcaacaaagcgttgttgctgaagtgactgaaccgcacaacaaacaatcggagacagaagaggcggaaaaggaaaagtcgaaaaacggcgacagcgagaaagacggaaaaaaagtgaacgaagcgtcaaaaccgattccttgccaatcaatttcggtaattggagatacagtcaaatcgacaatattattcatcacctttatcctttattccaaaattttgttttatttttctttaattattaaattttgtttagcc

SEQ ID NO: 95707 - DNA, 687 bp, Heterodera glycines
  SCN-specific regions: Sequence locations=1-618,641-649,672-687
ttggagggcgacccggctaaaagaggcatcataccaaatgcggcacaacaaatcttcgatgaaattgagggaaggcgtgaacaggcccgcagatctggcaaagtgatcccctctttggaggtttccgctcagtttattgagctgtacaacgaagaactcattgatcttttgtcaccggaccggggctcatcctccatcaagatcatggagaacccgacaagtcacgaaattttgctgatgggcgcatcatcgcgaattgtcaaatcgcaggaggacattatgtccgcgctggtcattggtgcccaaaaccaaacaaccgcacagctgcagcgaaagtacgccgcattggagacgcgtgtgcgagaatacgagacggaactcgaaaacgggcgggagcagatggaacgtgccaagcgctacattgttgaccaggagaacagaccggagaaggacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaatcggggaaagatcgtcgatttttctgtatttttcttaagactaatttacataaaatgtatttttaaataaattaactgtttgcaaaa

SEQ ID NO: 95708 - DNA, 631 bp, Heterodera glycines
  SCN-specific regions: Sequence locations=1-603,625-631
gttttcccccgcagagtctgtcgacgctcagcctggcactgctgctctcgctcgtctattacccatcctttgaaggccgaaccaacgcgtacaaacagatgctttcaatcttccaaaatgcacaagaagtgtcctcactcgccaacctcgaggccagcttcaagttggacttcacccacctgtacaaccgcctttgtgccacactccattccgaaagaatgccgcttctgctgctctatctgctgctccataacaatgtcggcttccgcaactttgtgctctcccgcattaatcttgaacagctcgtgctccccgtcgtccgggttttatacgacggaatgtgctcagtgcctggccatggatttcaacgttcttcccccacgtcctccccgaaaatgcggcgacagtcccaattcagccacaataactcaacagttcacacccaccaaacttatttggcactgattgttctgctcatgctcagcgaagatgacttctttaagaaagtcatccatgaaatgacaatcaaaaacattgactggtacactttggaccgaacaacgcatttggcagaaaccacgttgggcggtctcattgtgctggtgttttcaaagacaattcaaatcaatac

SEQ ID NO: 95709 - DNA, 635 bp, Heterodera glycines
  SCN-specific regions: Sequence locations=1-200,222-635
gacacaatgaattttgtcaagagaattgatttttattatgatgttacgacaatatcttcttggataatgttcgagcgtttaaatgtcacgcgaagactctgtccttccattgagtataacttccgacctgtgcattattcgagcttattaacttctgctggaagtttggtccctttctccacggcggcattgagaaaaaatttctttgaacagcagagagaattggcccgagtccatggcattacaattgggaccagacatggcgtaattgatgatttactcgcaaaattatcaaacacagtgctgccccaatgttttatgaatatggttgcgtcggaaagtgggcacgaaagcctcattgaactttcaagaagcttttggcgcaaattatggatttcaaatgtacacctggaccatgaggagtttctcgagagtctcagacaattgaatattcaaattccacccgatgaaattattttcgataaccgatgggggaaattgatcgaacaatggcattgtgaacttctgaatcaacatcaatgtttcgatgtcccatggactgtgcttcactttgacaatgatacgactaagaatttcaatagctttgacaaatggcctcttattgcttcgctatt

SEQ ID NO: 95710 - DNA, 661 bp, Heterodera glycines
  SCN-specific regions: Sequence locations=1-631,653-661
ttgttggctgtgcctcgttcggtgctggcaacaaatacagggactgtgactttccgagactgatttatccgtcggtgggctccgttttcacggactcatactgctggtacgtcaacgtgacgtgcgaagaggcgaattatggcctcccggcgtacattgaattcaatgaaaacccaagcacaattgtcgccgcaccggagccaacacttggcagacgcataacggtcactttgcaatgcgtgggcaattcgtatgggcaaagagtgtggaccaagttcggcgtggacggtgaccccagcgcagtggtccaagtgaaaacggttagatgcgggacaaagtgcgcaacgaatgtaagcacaacgcctgccacgttaacatctccaaattcggaggggctgccgtactgtcgcgacagttgtgccgcgagaattgggcacggcacacgtggccaggactgtgatcaaactctgctaaacaacgctttgattgtttatccaagttatccgtacattctgtacggttgttggtatgttagcgtcacatgcgaggcaaaagccaacggcaacccaatttacatcaaactcaatgacgaagaaaaaacaattgtcacctcaactcagccaccgttcaacaaaataacggtcaatttgcaatgcgcgtg

SEQ ID NO: 95711 - DNA, 636 bp, Heterodera glycines
  SCN-specific regions: Sequence locations=1-46,68-636
caaagatttctgcattatgtaattcttgattatgtcgagtgttggaaaaagaggcacaagaaaaaccacgcggaatgacagcgacggcagttgtaattccgcggaaatgcaagacagcgaaaacaacgccgaaaatgagaggagaggggaaagcggaggcgccggtcgtggagaagaagacggggcatttgaaccgggcagttgggaatgtacagtttgcacatttcgcaaccgttacgaagcattcaaatgtttgatgtgcgacactcgaaaagggacttcaactcgaaagccgcgactaaatccctctgttgttcagcagcaaactttggtgcaaaaattagcggttgaagttgaaaaggcacaccaaaatccgtgtacttcggcaatggccaattcgccgaagccctcacgtgccccatcggccaatggtggactgtccaacaaacaacagtccaaactgaccatccgtcgtcggcccgtccctttccgagatgccctcgtcgttcggagtgcagccaagaaaatggtggtcaatgtgagcggtgtttcgttcactgtcactgagtttaaaccgcgcacatcgccgcgagggcgcaagaaattgccggtcaatcaaaacaatggcaaacacaa

SEQ ID NO: 95712 - DNA, 589 bp, Heterodera glycines
  SCN-specific regions: Sequence locations=1-17,47-375,400-402,439-589
caagtttgagctatacacccgcccccgccgcctccggcgcggcgccaccggtgcctggggatgatgatgaagtggaagaggaatgagcccgcatttgagcggccgctcgaagaatggcgggagcgccgcaaccaacacgcgcaaaacaatattcacccgcctccggcgccaccgcaggaggaggaggaggagcactgggcccaggcatggcctgaggaggaggaggcggcgccggaggcggcgttgccccgagagggtttctacctaatcggaggtgtccatgacccgatcagtcttcgttttgaggctgcgatttgcgcgagatgatgcggaacgtgtggcgccgcattgacccttcgaaacgtgccatgttcggcggtggccgctcggccggggtgccttcgcacggcggaggagcgcgtggcgggcgcggcggtggaaacttggccgaaaaatgaccaacgggaaaggacggtttaatttatctgatacatggcatttatattgagcctgcaattgtttcgttgctttatcctttttgaattgattgtctgtttttgatttttaaaaactcacatttttttgtttc

SEQ ID NO: 95713 - DNA, 479 bp, Heterodera glycines
  SCN-specific regions: Sequence locations=1-212
caacattcagatttaaaaaaggtattcagatttaaaaaaggtatagcgcttttattattgctttctacaacaatgctcgcatgtaatgcttctaaagaacgctgccgatcagaaaaacagcaaggatatatgcagaaaaataaaataaaaatacaaaaaacaagtaaagcagcacaagaaagaaaagaagcagcaaaagcaaaagcagcggaaagaagaaaagaagaagtaaaaagaaaaaaagaagaaaaagaaataataaaagaagcagaaagaagaaaagaagcagtagcaatagcagaagtagaaagaaaagaagcagaaataaaagaagaagtagaaagaaaagaagcagtagcaatagcagaagtagaaagaaaagaagcagtagcaatagcagaagtagaaagaaaagaagcagtagcaatagcagaagtagaaagaaaagaagcagaaataaaagaagaagtagaaagaag

SEQ ID NO: 95714 - DNA, 540 bp, Heterodera glycines
  SCN-specific regions: Sequence locations=1-89,111-233,255-540
aagctggagctccccgcggtggcggccgctctacaactagtggatcccccgggctgcaggaattcggcacgaggatgtaaaaatggtacttaaatttataaaaaaaaaatgctgacatttgctaataatgttacggttttcacatcaattacggataatacggtcgtatcagcaagctttatgtggaatgtttcaacgaacgcgagaagtgtttaacggtcatcggagggggcaaaatggctactgctttagtgcatggattagtttccgctggttttatcgacaagtccgaagtgaatatctgctcaagatccaaagaaacggcctttcgttggacggtttttaaagactgcgactgactgggaacggtttttaatttcagacacaaggttaccaaaatgcatatacaaatgatgaattttacagcaaagtgaaaaagccacgtggaattgtgattgtcgcagtaaaaccacagatctttcccgggtttctcgacgaactgcgtaaaaatggttggcttaactttgttgggcctgaagt

SEQ ID NO: 95715 - DNA, 476 bp, Heterodera glycines
  SCN-specific regions: Sequence locations=1-476
tgaccggtctccaagtgcacggcaatgccaccgtcgagggttacatttcggcacttcgccggggctcacggctgttggaattggatgtgtttgacggtgaacatggtgagccacaaataacgcacaaacgcacattcattggggcgatcagtctgcgcaatgtgttgaaatgtgtcaagaattacgcatttgtacaaaatccgtacccagtgatccttaccattgaaaaccatgtgggctttgtgcagcaacggatcatggccgacattttccaagagattcttggtgaccatttgctgattccatcggacgacttgcacaccaagccattgccatcaccgcagcaactgaagcacaaagtgttgttgcgtggcaaaaccgccggcggtgctaccactgctgacataaacggcggcggaacgcacgccgaaacgacagcggcgacaatggcaccggcgagtgttgccgcaaacaac

SEQ ID NO: 95716 - DNA, 616 bp, Heterodera glycines
  SCN-specific regions: Sequence locations=1-616
gtttgagatggattcgcccaaatgccaaactttgaattttgcccggccgtttttcccaaataattttgtgcttttggaggtggaaaagtcggtggctgatgctttttcttcgtccaatatgatcactgatcaatttaatcacgaaagtctttcgcttacaatccgtggccattgctctgaccctttggtcgtgtgcacttcgtcccgaacattcggcgcaaaggacgtcgaagtgtccaacactttgctgttgctcgacgggacgccaaacggcgccggagcaaatcagcaacatatcgtctccatcacaaatcgctttgtggagctttccgaagcttttcttcccgaccaaacgttccgtctgaaggcgcttttggagcaaaatttgctcgatttttacaatgaaaatgcaccggcggcggaggaatcgaaaggaatcaaactgaatgaactgctcgaccatgtgcagatcagtgagcagcaattgcgtgaagaattggccaaatttgccgtcgttgaaccggctgaaggcattttccatttgttgagcgacgaatgtcagcagaaatttctcgacgaattggtcgaactctttgacgatgccgacacaattggg

SEQ ID NO: 95717 - DNA, 291 bp, Heterodera glycines
  SCN-specific regions: Sequence locations=1-17,40-291
cgctgctgctgggctcagttcgtcgtccggctcgtcgccaaccatcctgcagcaacaacaacatcgacagttttcttcggcaatttcgcagcaaaaatcgttgacaccgccgcctctgtcggtgggcagttctaccttcaacccgacgcttgaacaactgttgcaggcaacgcagaacatatcttactcgctcagtccgctcaactccaacgggggaatgaatggcagcggtggcgagcaacacgacggcacaaattttaattctaacggcacgaacaacagcaacggcgg

SEQ ID NO: 95718 - DNA, 446 bp, Heterodera glycines
  SCN-specific regions: Sequence locations=1-446
ttgaatcttttatattttaaatcatttaattgcgccaaatgtttcgtccctttgtcattttggcgttttgcctttttttcctttgcgctgtcgaccgttcaaatgccggcggaatgtttgaggatttgctggagggaataagcgacaaatttagtgaggggctcaagtcaatgcagcagggatatgagaaggcgaaacaggcatttgaagagtcggaggcacgcgcatggctaattgagtcagtgctcccaacgatcaaacagaaatttgaagaagtgaaggaatgggtccatgagaaaacgacgacagtttctgttgagggaccgcaggagaaagagaagtacaaagtgatcgaattggacgaaaaataggaaaacaatcgaaaaatcgctgaacaattaattgtttgattattattatccatttggaataaatgctcaaaactt

SEQ ID NO: 95719 - DNA, 412 bp, Heterodera glycines
  SCN-specific regions: Sequence locations=1-412
catttcaattgcgctaaatgtttcgtccctttgtcattttggcgttttgcctttttttcctttgcgctgtcgaccgttcaaatgccggcggaatgtttgaggatttgctggagggaataagcgacaaatttagtgaggggctcaagtcaatgcagcagggatatgagaaggcgaaacaggcatttgaagagtcggaggcacgcgcatggctaattgagtcagtgctcccaacgatcaaacagaaatttgaagaagtgaaggaatgggtccatgagaaaacgacgacagtttctgttgagggaccgcaggagaaagagaagtacaaagtgatcgaattggacgaaaaataggaaaacaatcgaaaaatcgcgattattattatccatttggaataaatgctcaaaacttaaaa

SEQ ID NO: 95720 - DNA, 596 bp, Heterodera glycines
  SCN-specific regions: Sequence locations=1-596
gtccaaataagtcaaaaagttgcgtaaaaatgcgtttcgttgcggtgattggcgatgggaaagcagtggatattttcgtcaaagtggcagcggtcgtttcaaaattgtgtcggaagagagcggtcgtccgaatcacgccgaatgagttcagttttgtcaatgtgtacaatgtccgtgagggaatgcacgtcgacttccgcattcacaaggataatttatttaattcatggagctttgacggcctttccctggacaacaacgcgattttcttcgaattgtccaccgacgacttcgtccgttcgctgcattcgcgtgccactcaaatcaaattgaaaatgaccaaaaaggacggggtgccgcaccttcgcgtggagctcagtgccaattccctggtcaacgaaattcccattgttttggttgttctacgacaatggcccgacttcaacccaccaaacatgggcatttctcagttggcagttgcacttccaaacgtcaaaacattgacaaaaattgtctcgggtgtgaaggacattggcggaaggcatttgatatttcgcgcaaacaatcgtggagagttcaacatcattggttatgcc

SEQ ID NO: 95721 - DNA, 539 bp, Heterodera glycines
  SCN-specific regions: Sequence locations=32-104,127-431,462-539
cctcgtgccgaattcggcacgaggattaagtcaaaaatggatcctccgtcagtaattgcaagtgccgatgcaaatggtgaccaacgccagcagggcggcgatgtcaaaattgagcaagtgcgaaatcaactcgacggcgtcacaacggtgatgtcgcaaaacgtggagcgtattctcgagcgtggcgaacgccttgaccaattggacaaccgcagccaggcgctgcacgagtcgtcgcagtcgttcacccacacgagtcagcgagtgcagcggcgcatgtgtctccaatcgatgaaatggtccatcattttcggcctcttcctttgtgttatgcttgtgctgctcgtgctgaccattctccgcattttcaacgtcatctgaaggcgaacggagcggcgaaacgaaaaacaaaacaaaactaacaaaatgagaaaataataaataaaaacatttattttttactcatgaataaatttacattctttacaaatgagatgaatctgtgcgcatattttaataaatcatcaaatagataaaaa

SEQ ID NO: 95722 - DNA, 664 bp, Heterodera glycines
  SCN-specific regions: Sequence locations=1-33,56-400,422-664
agaagaaattgtgttcatttacaaacttgcagcaaaaaacaaaccagcaaaaagatgaaacgcaacggaaattccatttgctcagaaaccaagccaccgcttttggaattgacgccaaagaatgcattaactttccgtggcaaactcggccacgtcggttccgtctctttggacatcaaaaattgtgagatctgctccgtttacttcaaagtcaaatcaaatgccaaccacttctattcggttcgtccaaacaccggtgtgattggggcgtacgggcgcgtgaaggtggtcatccaattgcacgacgacagtctggcaaagttggacgagattgaggaaaacaagcacaaattcctgatcatggcagcgattgtttcggatgcgtccattggaacggagaaattttggaaaggcaaaaaagaggggatggatggcatttactcgagcaaaatgaagacggaggtgcacaaagtttgtcggtgggaaggagggaagggtgtgctgagccaacagaactcggaagaaaatgtgccgaacggaaagaactcagtgtctgtggagaaagtgccgaaccaaattttggagttgtgttcggagaaggaagcgccgaaccaattctcgaacttggaggaaaatgtgccgaacggaaagaactcaatgctgc

SEQ ID NO: 95723 - DNA, 602 bp, Heterodera glycines
  SCN-specific regions: Sequence locations=1-285,307-602
attaattaatgtccgtttggtgccgttttcccttccgaaaagcgtttctttcctccgccttttttcctaagtgtgtctctgcttctgactttgcctttgttcccacttcttccgcgcttcgttctttccgcctttttgtcgacggtccgatgtcttcggatgctctctctgctgaccgagtcgccgctgttttgcgttcaaaatttcctgcgaccgatgggtcggcggtgcacgtggaggacacttcgggcggttgcggcgcaatgtttcacgtgcgggtggagtcgcctcaattcagcggagtgtcccgcgtcaaccaacacaaaatgatcaacgaagtgttgcgaagtgaaatcagagatatgcacgggataaccatcgaaacgaaagccgtggacagagggagagacagcggacagtgattagcgaagggaaagggagagactgatcggagtgaagggagagactgatcggagtgaagggagggactgattggcgcttgttttgtttttttgaactgttaaagttatgggagttttaaattctttcgcatcgtcagtacttgtcccattgtttgtatgtaacaaaagtctaaaaaccaa

SEQ ID NO: 95724 - DNA, 470 bp, Heterodera glycines
  SCN-specific regions: Sequence locations=1-430,467-470
gcagtgccaatggcacaaaatttccgccttttttgccaccaaacgccaccatccgtcaattcggacggttccgaggcgaaacggcgccaaataaatgagccaccaaaggaggggtccggcggagctccatccctttccgtcgacccgttcggctgggagccgaccaaatgggaacgctttttcctcgtgttgacgcggtgttacgagcgcagtgccgacattcccgcaattattcctctccgagttggtaaacagtacacgaaacgaatgcgcctcctccgcttttccttcgctttgctggtcgcgatcatcgtctgctttggggccgagttttacatggccagttgggaccgacgcatgcgcaggggccaactgagcgatggcgacgtgaaatttttggaaaagatgcgcgataaagttagatgacaaaagagacacatacacacacatatatatattattttttcgca

SEQ ID NO: 95725 - DNA, 462 bp, Heterodera glycines
  SCN-specific regions: Sequence locations=1-55,79-133,155-424,451-462
tctcgactttgtcccttccaatgcccattcttccgtgcccttattaatcgtcgtccttcctcgtgttcttcttcctccgctgctctgctgatgttcccctacagttccttctccaccgtgcgtccccactccatctcttcccaaagttcatccactttctcctcccggaatttcacccaatcggacaccgaagcggaagaggagaagaagtttcagaagcgaatcgtccaccgaagagaagtgctgacaccgtcgagaatgaaatgggactgggacagaagagaaatgttggcctcgtgttccacgccaaagtcaagtcaggaggatttgctctgtcactttcgccttttagacgaaacttcggtgtattttcgacctaagcccagcgatgataaccaacagcaacggcatgggaataataaacagcgccaaaaacgggcaaaatgccaacagaaacagcag

SEQ ID NO: 95726 - DNA, 550 bp, Heterodera glycines
  SCN-specific regions: Sequence locations=1-550
aaagctggagctccccgcggtggcggccgctcttcaactagtggatcccccgggctgcaggatttcggcacgaggcttcggcgtcgtcgcccaccaccggctcatccgccgctggcacttctcatctcggagcagcggtggcccctcccaaagccgctgtggcgtccgacagcggagcattgccgactggcacaccaacaacgacagaaaccccaccgtcgacgacagcaagcagtacaacgacgaaagccactgcgaatgaaaaacgaattgcggaggagggctccggcggtgggctggcgttcgtcaccatgttcatgctgctcggcatctccgtctccgtttggctgctgtacgcctacttcaacccccacactcggtccggccaactgctgatcaaatatcgcccttcaaaatggcaaattccgagcagtcatgtcagatactcggcatctgtgcacatgtgatgaatggttttggtggtggtgctgcggcacagacagagagcagcgaaggccgggtgcagtgaaaggcggtgagcgggtgccgg

SEQ ID NO: 95727 - DNA, 408 bp, Heterodera glycines
  SCN-specific regions: Sequence locations=1-305,327-408
agcactttaaattataactgttcactcccaaaagtgaaagatgactgctaaaaatgtgtccccatcttccaaagagagcagttgttcaaggacttcttgcaactctgaaacgagtgaaactcgtccactttccatttgcaacgcacaatccatcgtcaatttccaaaagtcattgcgcgtttacaacggcaaatcgaaatttgctacgaagaaattggcttcctctgcgtccgttccgaccaatgcaaacaaagcaacaaccaaatagaggacaacagaacactcacaagcttttgttctaatggaattttcttacattctgtgtaattatgattgtctcatcttttacgacttcgatctctgatgtttttatttccatgaacattgaacaataaatcattacaaaaa

SEQ ID NO: 95728 - DNA, 685 bp, Heterodera glycines
  SCN-specific regions: Sequence locations=1-685
tccatttgcactccatttcgcttctcattttcaatggatcaattagaagtttttttgacctatcctcctaccgtggaggacaaggaactgatcgccacttattctcttgcgggacgtttgcttcgtcctcttctgccgcgcgatgagaaccaccgacgactggtttatttcaccgaggaattgaacagcactgattactttttttctgatggtcagaacgggagattttgtgtggtttctctgcgacttatgcgtgccgataagcgtcagagaatgcgcgagtattttaacgagaacatggcagttttttctgaaacgtacgactgttcattcggtttccacgaactggaggcgatggagtgggacgtagcggtcattaaagtgtaccgtgagcacatggctcgttgctggaacgacatgatgggacagcttctgtacgtcgttaacatgtacgatcggggtcttgacccagtggatatggtccgcacgccgtctgctggtgagtcgtcgaacaatggctcggatcagtctgatgtgtctcataatgatccgttgccttcggtgtagcaaagagaatttggacggacattttcactccatgttttgaaacgttaagcatttttattgttacaccaaaagttaaaaatatctcgcaatttttgtggaataaagaacatcccaatgc

SEQ ID NO: 95729 - DNA, 812 bp, Heterodera glycines
  SCN-specific regions: Sequence locations=1-193,220-240,287-812
gacccatcttacacacaagttcgattagtacaaaaattttatcatccaaaactacgtgatgcgacatgctgcagctccaattcgtgactatgaccatttgttcaagttgctcataattggcgatagtggagtgggcaaaagcagtttgctccttcgcttttcggacaacactttctccaccagttacatcacaacaattggtgtggatttcaaaatacggacgattaccgtgatgggcaaaaagattaaacttcagatttgggacacagccggtcaagagcgattccgaacaatcacttccacttattaccggggcactcatggtgttatcgttgtgttcgacgtgaccagcattgagtcgttcaacaacgtaaagcgttggcttcacgaaattgacaccaattgcgaaaacgtgcaaaaaatactcgttgggaacaaagtggacgagccgagcagacgtgccattcccgaagctgaggctcgacgttttgcagagtcaatgagaataaattatttcgaaacttcggccaaagaaaatctcaacgtggagcagatgttccaatgcataaccgaaattgtgctcgagtcgtgcgtggaccgggagaagaacaatccgagacaggcgacggatgtgctcaaattgcgacagagaccggagaagaaaaggaaatgctgcggctgacgcccccccccctcccttgggaccgctgtttaaataacttttgtttatatttggactgtatgcattacatccttaaattttatcattaatttatatgatcatatttcatcatttgaagcttttacttttg

SEQ ID NO: 95730 - DNA, 489 bp, Heterodera glycines
  SCN-specific regions: Sequence locations=1-360,384-489
gtccaattaagatcattgatatttattgctaaacggcaaaacgtttcccaatctttaaatggaggatcaaccacaactttcacaaggatttttccagacttttttggatgaaaaagtgccggccgactttcagccgattttgcaagtgcttgagactcgtaccattggctcatcgtcggcgatgggcggctatccgccacaggggcagcaaatgcgggctcgtctcagcgacagtttgtactcgtacagcggttgcgtcattccacagacggtgacgcggcggttccaagacgacgggctgagcacccacaacggcatcatccaagtgaccagttggaaacgggtcgacggtggaaagctttgtttcttccaagtgttggattatacgctgtactcgcttgactttcctgtcattggcaacccgcaaccacacagtggaaacccggcggaatttcgccgagttgttcagcctcaaaaagatcccgacac

SEQ ID NO: 95731 - DNA, 489 bp, Heterodera glycines
  SCN-specific regions: Sequence locations=1-125,147-325,347-489
gacacgctgaaaagggacagcggagcactgctgtcccagttgttgacgttggaagggttggagaagaacagcaaagtcagtcagtccaggggcacagcgacgcctttggtcactgattaatttggaggtggccaagcgaatgagcaacggcaccattttcatcgacagagacggcgaactgttcgcctatgtcctggattacctgcgcaccggcaaattgcttctgccggagaattttcgcgagttggcacgccttcgagaggaggtgcaattctaccaaatcgacgaattaatgcagcagctgatccccttttacaacctcaaattccccccaaagacacccaccggccaaaacaacggaagtgtcgctttgaccgctgcggtggcggcagccgtggcgaaaacgaatgctttgtacgaaacgggtggcttcatcactctcggctaccgcggcacttttgcattcggacgagacggacaagcggatgt

SEQ ID NO: 95732 - DNA, 583 bp, Heterodera glycines
  SCN-specific regions: Sequence locations=1-583
attccatccccttataataaatattacttccttctcttccgaattctctattaaaatttgattgccgtgcaaaaaatggacggggacggcgacgaaagctattgcgactcggacttggagttggagcggagctcgtcggcgaacaatgtcaaccaactgccgttggtgcccaccgaattcacttccattccggaggccatgcagaattttaatgccgtttttgactcgagatacggggcccagcatgcgccgttcttccatggatctctgcaggatgccattgccgaggcgttcgactcgcccgcgggtggcgctgaacatcgacggcctttggccatttacctccacgacgaccaatcagttgcggcgcacatcttcgctcaaacggtgatgtccaatgtgaatgtgagcaacctgctcaagtgtcagttcattttgtgggcttgggacgtttcgttggcggacaacaaaaagcatttgttcgattggttggagttggccaacctgaccgaagtgtccaactgcatcggaatgggggccgcgttccgaatttccgatgcttattgtgctgatcaaggatcgt

SEQ ID NO: 95733 - DNA, 485 bp, Heterodera glycines
  SCN-specific regions: Sequence locations=1-220,242-485
attttcctctgtttattagtcatcaaaatgggaaacattgtctattctgacaagttgtcctgttacgaaagtgccgactattgtgctcgttcatgctccgcatcttcgcagtgcgtttacgtggacaattgtggcgactcggccaatgcgcattacgcgtgtttgcccttcgacacgcgactgctcacgtttgttctcgttccgatgatgtaaaagcattcagagagagaagaattaaaacaacgatagatagaaaaagttgtccaatgcctcaacaattaatcaggtggattttggtcgtttccttcctggtaatcgtcctctgctgctccgctttggtggtgttctacgcccttagggtgatccgacgatcattccgaaatccggtccaaactgacggagacatcgttttctacaatgccagaaacgtgcacaattttccgcaccctgcagcaatgaaacagccaacggtcgaagacgacggc

SEQ ID NO: 95734 - DNA, 1016 bp, Heterodera glycines
  SCN-specific regions: Sequence locations=1-674,697-844,866-1016
aatcattgatgagtcacccgtcgcaattggcaatggcggcacagaaacacagctgtcaactccattccgtggcgttttggacgtgcgctttgagcccggccaaactttgacagtgaagggaatcgtcggggagaaggcgcgccaattcagcgtcaatttgcacagtcggacggccgacttcagcggcagcgacgtgccgttgcgcgtcgcggcacgcgtcgaccgggcaaagattggcctcaattcgatggtgaacaaaatgtgggggaaggaacagcggaaggggcactcgttgaagcccggcaagcccatcgacttgcgaatccgggcgcatgacaaggaatttcagatcataatcgacggcaaagcgttcaaacggtacgcctaccaatcgccgcttcagtccatcacccatttgtccattgacggcgacttggccatacagcatattcattggggcgggaaagtttaccctgtcccctatgaaacgggccttccccacggcttcccaattggcaaatgcctgaaaatgtccggcactccgtcgctgagaaagggcgggcgctttgaagtcaatttgttgcgcaaaaatggtcacattgcgttgcatttaaacgcgcgttttgacgaaaaagcggtggtgcgcaattcgctcgaggcaaatgaatggggaaatgaggaaagggagggcaaaatgccattcgaaaggggccattgcttcgatttggccatcacaaatgaagccaatcattttgggattttcgtcaatgggcaacattttgccaattttgtgcatcggtcaaagcccgaagacatttttggcctgctaattcagggagacatcgaactgaccggactggaaatggaatgactgacctaattaccgtcattatgaaaaaaacttttggccaatctcaaccaaaataaattgggaaatatattcataaattaatgaccacaatttgttgacatatcttttaatcattaattaattggcaaaatactgactaattttc

SEQ ID NO: 95735 - DNA, 379 bp, Heterodera glycines
  misc_feature (379)..(379): n is a, c, g, or t
  SCN-specific regions: Sequence locations=1-252,322-379
cggcgaagagacgcaaaaggaaggcactgaaagagtcgggcggaggagacggcggcgagtcgcaggagagcgagcacaatcagtacagaggtgggcaaaccatcgttctgaactcgttcaatggcgcaaatgggggcaatgggatgaggagaagcggaaacggagcgaacggaggggcggaaagggcggcgcaacggcaaacgattgcctcgagaagcattcccgtttagagacagcgcaacggcacaagccaattaaggaattaattaacgaattaattaattaattaatgaacaaattagctaattaacgaattaattacgaatatttgttgatcagctcgttttgtttacttattaaatataattttgctcaaaan

SEQ ID NO: 95736 - DNA, 379 bp, Heterodera glycines
  SCN-specific regions: Sequence locations=1-351,373-379
tttattgtgaagtcactaaacttgcgcaagtgattcactttcaccagcagcaagtttgaagaacaccttcgattaattatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcggcggaccatggtgaggaaatttcggaaagaaatgagaagggagcaaaatgtggtgatcaagacgaacagaacaagccatttgattgaatatttgtgaaaatagtcaatgtaacaattagaaagaaataaaattacaattta

SEQ ID NO: 95737 - DNA, 360 bp, Heterodera glycines
  SCN-specific regions: Sequence locations=1-360
ttttaatttttcaccattcgctaccttcgccaatgcttgcaccaattccaataattgagccggcaactgtcactgttccgcccaatgaagacgttgtgggctcatatgatgagaatcagcaaagagaagaggaactcctggtcaatcaatttgtcatcaattcggaagcgatcaagcgcatattggacgacccgcgctacgctgacaaaaaggtgtgtgtagtcagcgtggcgggcgccttccgcaccggaaaatcgtttattttaaacttttttctgcgttatttgcgttggcgctcagcaccaagtgtcgatgagatggtgaacgattggttgaaaatggacccgaagttggaggggt

SEQ ID NO: 95738 - DNA, 476 bp, Heterodera glycines
  SCN-specific regions: Sequence locations=1-377,399-476
gatatcttgaatttattttgtttcctcatccgatggcctcgagaacgttttctcgttttgcgagcaattttcgtcttttcggttcagttatggcgacaaatttgtcaggaaggagtcactgtttcgttgccaagaagtccttaagcacgtcccctttggtctatgctactgcagcagccgcttcgcagccgaccactccaaaggcgaccgttaagggaaagaaagggcgtgtcgttgctgtcattggtgctgttgtggacgtgcaattcgatgagggacttcctccaattttgaatgcgttggaagtgcagaaccgcgcttctcgcctcattctcgaagttgcacagcacttgggtgacaatgttgtgcgaacaatcgccatggatggtactgaaggtttgattcgtggtcaggaggttgttgacactggtgacccgatcaaaattcctgtcggacctgagactcttggtcggatt

SEQ ID NO: 95739 - DNA, 477 bp, Heterodera glycines
  SCN-specific regions: Sequence locations=1-477
gtttgagaagccactgttatttgtaatactcacttttcaaacgggtctcagcgccgccggcagagcacaaattctgaacagcgactcttctcttccttcgactttttcttccgtcctttcaattgcattgagcgatttgcacgtccgaatgcaaaatgtgcaagaagaccaagtccgagccttgctgcaagaagttatcgtcttgcttcagcgaagagatgaaggggtcccagatgttcagacaagtggtggagctgcgcaatgacattgccaccaacggatgcatcgccgggggcgtcgaatgctgtgatttgacggcgcacactgtgcagcgaagaccccaaacgactggccaactgtttctggagaagctgtacttcgtcaagcacgtcgacaacaattcactcgctgattctccccgcgagcgtgaaattctggccgaatatcgcaatttgctgtactccatcattctgaatg

SEQ ID NO: 95740 - DNA, 411 bp, Heterodera glycines
  SCN-specific regions: Sequence locations=1-260,282-361,388-411
tatttcatttcatctttaaatctgccattaataaagcatctcaaataatccgccactgaggtcaaaatggtcgaagttcagcaactgatcgaactgatcttctgcattcttttgcccccggtcgccattctgttgcacggcggcttggacattctgcatttgatcctcaacattgtgctgtgcattctcggctatgtgccgggcataatccacgccctttggtactgcttcttctcgtgatgttaattgattcactaattgatgaccaatttcaaagtattatgccgtagacaaaatggatacccccgcattactcatcaaatcagatagcatttagctgaatttcaaaaattttgcttaaaatgttaataaagacatttcctaccagagaacaaaaacacactgacaaaa

SEQ ID NO: 95741 - DNA, 388 bp, Heterodera glycines
  misc_feature (384)..(385): n is a, c, g, or t
  misc_feature (388)..(388): n is a, c, g, or t
  SCN-specific regions: Sequence locations=1-62,84-188,211-242,362-388
gttttgccattgctgtggtcgcctccactcttttccatttggactaattgaaaacataagaataatttttatcccaaattatgttttctcatttgaccttttccccatttctctgttcatttgttttgtacacctcagaagcattagccaaaggacggcttaaattttgttagcattcccactgagcattagtaactgttatttatttactcataatataataattctgaattgtttgtccatttgtcttttccacttttctattctttgttatttattggttttcttgtcatttttccttttctggtgccattgtcatttatttttgaattttctattttttatttttctttaattttttaacaaaaataaaaacattttctnnaan

SEQ ID NO: 95742 - DNA, 260 bp, Heterodera glycines
  SCN-specific regions: Sequence locations=1-212
gtccgtccgaactccgccgtaatgaaaaaaccgctttttgcttccttgccttacccgaataatggcgttcatcccgcgcaccattccaacgcttaacgcaaagagcagaacggacagaaggcattcggcaaatgggaaaaaactggtgatggctacggaaaacggcaaaaattgggacggcggaaacatttctggcatttctcgttgtttcgaaaattaattaataaataaatatgctaaataattttttataaaaaaaa

SEQ ID NO: 95743 - DNA, 512 bp, Heterodera glycines
  misc_feature (477)..(477): n is a, c, g, or t
  SCN-specific regions: Sequence locations=1-372,394-472,504-512
aaaaaatgatgcgggagataatgacgaacggacccatccaagttcaagtggattggtatgtggatgcctatttatatggccaaaacagcacacaggtcaatgtttacatgcacaccatcgtcaatcagactgacaagggtgattaccaagaaggatcattgaaactaatcggatggggcgaggaaagcacggacaaaggcgagctggtcaagtactggttcggcgtcaatagttttggcactgactggggactgaatggactgttcaaatggcgtcgagggacggatgaatgccgcattgaatcaaagggtatcagctttggcacccccgatgtttgagaaggcttaacgatatctgctagatgtcaattggaaaaaagaatttgacttaaaacccacgcgtctctaataacataataatgttaagtagatggttaaatgttgttgatacagaataaaaattaatagggctgaaacnaaaaaaaaaaaaaaaaaaaaaaaaaactcgagggg

SEQ ID NO: 95744 - DNA, 475 bp, Heterodera glycines
  SCN-specific regions: Sequence locations=1-475
ggaatagccgcatggcaaacgacgtttggctggacactctgttttggattgaccgcactgaggctggtggccacgcatttcaaactgcgcaaatggaagctgggcgagctgggcattcatcgggcaccaagcggatgggactggggcggcacggcgactgtcaccgttatggacgaccacccgttgatgaatccactgccgcttgccaagtgtcctgcaccgaacggcgtgattggcttccgtgccatctacatttggtgcgtcgacctggaagtgatcacatttctgcagtgcctgcaacgcgttctcaacctcggcatcgctgtgcagttcaccatccattcgaaggatgtccgctgctggtatttcgaagcgccgagtgccatttcggtcaattacgtcgtcgtttgtcatcgcgtcgcaacaccgaggtcgttgagcgggagaatgaacggacgggcgagtggctgacgct

SEQ ID NO: 95745 - DNA, 538 bp, Heterodera glycines
  SCN-specific regions: Sequence locations=1-538
attaagtaataatcataaatggtgtttgcgggtgttaattgttctaccaatattcggtgggtgcatcgttgggcatggacgtctcgccgtttgtgctcttcgaccaaaattatttatgagcaaaacgggaatcccgctgaggtcctcaaacttagcaacgaaaaaatcgaccaaaatgccattggagcaaacgaagtttttgtccgatggatggccagtccgataaatccgtcagacatcaatcaaattcagggggtgtatccgattaagccacctttgcctgccgttgcggggaacgaaggctgtgcccgagttgagaagattggttccaacgttcgagagttgaaagtgggcgacatcgttcttcctaccaatgccggccttggcacttggcgtacccacggcatttatcagtcgactcaactgttccctattgacagttctttgcaactcgactcaatcgcaacggcaatgctccaagtgaatccgtccaccgcctatcgaatgcttcatgactatgccaaattggtccccggtg

SEQ ID NO: 95746 - DNA, 475 bp, Heterodera glycines
  SCN-specific regions: Sequence locations=1-40,62-475
attttctcaaccatacgctgtcttcatcatcgacaatcctttcggcggcggccgccggtgccaatgaaacgaccgaacgatttcgactggcattggatgactttgtcactgtccatccccatttgacttgtgcactcatcgccgtctccgtctcgttggccacccatctggcgctgttcgtcttcgcccgtctctttgactttgcgttggcaaagtttcgcccatttgtccgtcgttgtcgtcttcttcgtggaggaggacggtcattccgcgttcacatcagcgatgcgccactgttgtcatccaacggaccgttcattcactcacaatttacgcaacatcagcaacgggcgagtggcaaaagccaactgctgcacaaagtgccaacaattgaagcggatggcggagacgacgacggtggcattgccaacgctgaaaaagcgaaacggacgacgacgcccgtcgccacgtctcg

SEQ ID NO: 95747 - DNA, 633 bp, Heterodera glycines
  SCN-specific regions: Sequence locations=1-633
gcgctcaagtttgttgttctggcactagccatctctgctgcggcaggaaatcatccctttctagcgctaacattcaagagctgcagtaccgggtggagggatgtgccgcagacttccccggccgctgggccggctccttcaacagctcaccccagtaacagtgcgttacaaacgctaaatacaatgccaggaacggatccagcccccaaaaccaaattattaaggaactgccaaagtgtatgctatccgccggcgccgctgaatcccacattacgaaactctcaaagtgtctgaacaaaaacattcttctgccatggaccttcgtcgaaggtgacaccgtctacacccaattggaaacttttacgcacatgttcgccattcaagactgcctggaatcgtctgcggatgtgaagaaggttgactcactcgtgggcaagacctgtgcctaccagctgtacttacaatatggctacggcgcttcagaggacgcagcaaagaagtggttggaagcgtgcttgcacagagcgaacgttggtaaggccaccgacgccctgaagtgctatagcagtgctctcacagaccccgccgtcatccagcgcgcagcggactacattgctaagatgaggggttagg

SEQ ID NO: 95748 - DNA, 477 bp, Heterodera glycines
  SCN-specific regions: Sequence locations=1-159,181-284,313-477
ctcagcatcagtcatttccggcggcgaataacggccgcatcgtaccaagcaaaaagtcgggcaaaaagaacatgcgaaaggagcgcgggaccaccatcaacgtgaaggagttagctggttactttggagaccgtggcttggatgaaattttgcgcgagtttcaacccaatcagccaaacaccggcaggacggcaccaaaaaaggaaaagaacggcaccgatgccaatgtcgtcgccaccgccgctggggccgcgtcagcggccgtggcagtgccaccaccaccagagcaaaagcagcagcagcagccggagatcacagctgacaacaatgagccgagcacaaagaaagggaagccgaagcacgtttcctccacggcccatcgccccacgctgacgaaacagcagcgacggcgtcagcagcagcagttggcgactcaatcgcgaggcagcagtgcagaggaggtggaggttgccatcg

SEQ ID NO: 95749 - DNA, 545 bp, Heterodera glycines
  SCN-specific regions: Sequence locations=1-545
ctggagctccccgcggtggcggccgctctagaactagtggatcccccgggctgcaggaattcggcacgagggagcgcagcgcaattgatcgagccaaccgggcagaaattaacaaagtgaagatgcgcctctgtctggcattatttattgccgcttcagcattgtcacttggccgatggattgaagctggagtggtcgaggatgtaaaagactacgtcgatgccttttccgaaataagcgcaccggcagcaaccattggcgagcagctcaggaaaatttcagcccgagtttcaaagctggttcagttaggaggtccggtcggaagcctcgcagcattggctatgcagaaagcccttgaaccggagagcgaggaaatggtcgcgttgaaattgttgcactccaccatggtcaagagattcgatgtattggaccgtcgagttgagcatttgggcaataggctagttcagcacatggcattggtcgaatatgaccatgtatgagtattactattcgattaattactgtgttaatatatttaactagac

SEQ ID NO: 95750 - DNA, 625 bp, Heterodera glycines
  SCN-specific regions: Sequence locations=1-625
caacaacatcaaaatgcaccggcgacaatggaaattgacgagcagcaccaggcgaacagtgcgggccatgttgttgcgtcgggggaatgcgtacagcaaagggagcagcaacaggaaatgcccgatttgtcagcaatgaccgaagaggaacatttggagtatgttatccggctttccatgacaggaaaccaaccgacgcaaagtgctcaagatggacagcacaatcagcaacacactcgctctccttcgggcgcaatgagtacacctgctccaactccgatggaagtggaggagggaactgctggcggtaacaatgctaaagggccggctggtggcggagtccaactcggcgatttgttgcaacacccggaaatgcttcatcaattggttggtcaagtgccggttgatagcagtgaggcaacaacgaaggaccaaccgacggaagtcaaagaatctgatgagaagaaaacgagtacgaagaaagaggcggaacgaaaggacgacaacaaaaagggaaattccagcgaaaattgaagggcaaatgctgcgaaacgtcgtattattcgataaactgaactgatccatcatctgttgcttgctgactaataaagtttttttttttgtt

SEQ ID NO: 95751 - DNA, 347 bp, Heterodera glycines
  SCN-specific regions: Sequence locations=1-292,314-347
gtgggccgggccggaaaacggcaacaaattcgaggctcaacgctatgaacatggccaaacgtgttggaatggaccggagaggtccactttggtgcagttcgagtgcggtgaacagttcgaacttgtggaaaccagcgaaccgtccaagtgcgaatatcactttttggcaaaatctccgaccgcttgtgctaacccggaagagctaaagggggaacatgctgaactctgaaggataatttagcaagactaatgttgttcttctaaatgaaaattcttaatttaattcgacttgtttggttaaatttgtaatttcctgacattcaaatcctgagaattggagaaattgt

SEQ ID NO: 95752 - DNA, 662 bp, Heterodera glycines
  SCN-specific regions: Sequence locations=1-662
gagcttgaatatttccaccacgaatggagtgcatcggctgcttggctttccgaacttcgttctctgttttgctcagaccattcagttcggccaactttggtcagggagcacgggacattggttcccgtcacaatgtttcgtcacgtcattcggccctccttgaaaaagctttggctccctttgtaccgcgtacggcgaaggaattggccgaatatttggccaaaaatgtcctctaccattctgtcggcgatgtcctcgtggtgcacaaaccttacggcgttggctctttgggctatgttcaaaaggaatttggcatttttccgacaacgcaatacaaattcaaagatcgaatggacctatttaacggagtgaaaaaggatgattcggttactttggaggatgcaattccgcacttaaaagaaatattccacgagccaaagttacacttttgcaccggtctcaaacgttgggtgtccggccccgtggtgcttccctgctctgagaaggcttttaaaaacatcggtcacagccttttccaaggagagtccatcagtcacagcaatgagcattggacagcccagcacatgcaccgagcattggcaatttgcatttcgcgccctcccagagacgaaggtgccgtcgatggctacgccacgttccaa

SEQ ID NO: 95753 - DNA, 574 bp, Heterodera glycines
  SCN-specific regions: Sequence locations=1-139,171-288,310-343,456-574
ggaaaaaacaaaaagacttcgtcttataaagaaaggaaggccatttcgtaccagcagggcagtgaccctccgtttttggcacaattcaaaaacaaactcggatacaaagaatggaccgtcgaggataagtttgccaaaagtgatgacgaggaggaggaggagggggcggacaatccgacggatgacatccgaaagatgcgagaagaggaaagaccccaagtggtggtgttggacccgagaacggatctgtcggcggaagaactgcagaaagagattgagaagggaaacgaggaggaagacaagcgcaaaataatggaaggaaaaattatgtttcggaagcccgagaaaaggaagacggaaaatggatgtgggaaagaaggaagcaaagaggaggaggagaaggagaaacgagccaaaagagaagagaaaccgggacagcagcagaaggagcagaacagacgacttctttcgtttggagaggaagacgaatgaaccaaaggatttctcgatttttatgcgatggtttaaaagcatctcgatgtaattttagtgaataataaaaaaactcgactta

SEQ ID NO: 95754 - DNA, 580 bp, Heterodera glycines
  SCN-specific regions: Sequence locations=1-53,75-160,182-402,426-580
ttacttcgaaagtgcgcaaagcgtttgtttggagtgcgacaagtcgtgcgcaacttgccatgggcctggtccgctccaatgcgacgaatgtgcacagggctttgccaaccatacgatgggttactgtcgccagtgctgttctcccgaccaattgactcagaaggacttgcactgtgaagattgctccaagagttaccccgaattccgcacgaaaagccatctgtcaatgctttctcttttggccaactttttcacaatcattggcctcgtccttttgggcactgttcttttttatttgtgtcgccaattgatttgctgttgtttcgggattggtcgcaatggaaatctttctgatctcgagtacactcctctgacaacaattggtgatgatttggacggcagaaaaaaggaccaaaaacaaaacatgggttttgcgctagaagatgatgaatccgaatccgacagtgataatgcggagtcattgatggaaggtgaaaagagttcgccagaagccgagaaagagcagaaacagcagcggaaagtgccgacggaagaagccgagagctaaaaagcgtcggag

SEQ ID NO: 95755 - DNA, 662 bp, Heterodera glycines
  SCN-specific regions: Sequence locations=1-171,193-297,324-662
tgagctttgacaaaatgagtgtaaacgtaaaacaaaagaagacggcgccgaaaagagacgtttcgtcgtcgccgagccaatcgtcgacgagcgactcgagcgaagcttccaacgaatcagttgacgaagcgaaggaagaaacgacgccagccaatgacaaagtactgacgaagtattccatggcagctgaaattgtgaataccgtcctcaaagaactcatttcggaggtcaaagaaggcgtcgaagtgggccatctctgctcggttggagacaaccgattgcttgaacttaccggcaatctttttaaaaaggagaaaagtgtgcagaaaggaatttcaatgcccacgtgtatttcggttgacaattgcgtgtgccacttttcgcctctgaagagcgaacctccagtgctgctaaagcagggccaattggtcaaagtcgatttgggtgctcacgtggacggatacatcgccaccgccgctcattccgtcgtcgttggtgcctctgcggaaaataaaacgaccggcaaaaaagcaaatgccattttggctgcttacaacacgatggaaatggtgctgcggatgctcaagccaaccaagtcgttcaaaaatgctgaagtgactgatcgtattgggaagtttgcaaaaacatacggaacgacacct

SEQ ID NO: 95756 - DNA, 476 bp, Heterodera glycines
  SCN-specific regions: Sequence locations=1-2,24-476
tgtttcttcatgtatccaccgaaagacagcgacagcaacttcttcccgaatcgaatgttgagtgtggacagaagccggagcagcagctcccatctcgtcggtctcaatgctgctctgcaaggctgccgttcggacattccgttcatgttgcagcgtgtctcattttccaaggacatcaaattgcatcggatgcttcgctatctgcgcgcttgcttcgtccgtgacatccgtgaacacaaccgtggcttcaacaatgggacccaacaaaccacaaaatgccaaccggagatgatcgaccaaacgaatggcgtgttgaacaagcgaagctggctggagcagaacgcctactttgccgagaacaattgcttctacccattctacggccaagcagtgttttacgcatcgtttggccagcacagtgagggacgggtggtgtgctgcagcgatggacgcattgatgaggaagagagcttcaa

SEQ ID NO: 95757 - DNA, 425 bp, Heterodera glycines
  SCN-specific regions: Sequence locations=1-98,131-388,410-425
aaaaatatttttgtgccatgacttcaccgccattcattcacgtggaaattcagcacaattctgtgcgtgaaggaggatttgacattaagattttcaagaatgggatcaccaacaaaattttctgcctcactcacacggacagcaaggagaaaatggtcatcatgccgcgttgcattgtcccggctatttgccgttaattggcagcgacgaccaaagctggggatggaatttggtgaacaatacaattgcgcacaacggcgaattcgtggaacgatacccgcgtctgaacaagaggaggaacgacgggagcaagcagcggaagacagaacgaacgaagaaagtgatcaagacgccgacatcgatgtcgttgactgatcgaggattgatggtttattttcactacacgtataaataaaaatgttaaa

SEQ ID NO: 95758 - DNA, 487 bp, Heterodera glycines
  SCN-specific regions: Sequence locations=1-487
gtttgagccatttaaaaaaaaatctgacaaaatgaatttttctccgatcactctgtttctgctctcttcacttgccattttctatgcagcggttgcattccgccaacaaacggtcgccgttcgcggccgtttaatgtgtggggataagccattgacggacacgaaagtgaagctgtggaataagaacaaaattggccgtgatgatcagctggcggacgtgaaaacggacgcgcagggaaatttcgcattggacggcggcgtcgggtccattttcggcatgaatgtgcacctgaaaatttatcacgactgtgatcgtggcatccttccgtgccaacgcaaagttaacctcggcattccgggcgagtacgtcacgcggaccagcaccgttcagcgatggttagacgccggcacaatgaacatgcagctgaagtttcatgacgaatcaacttcatgcatcaactaatttaatgtttaagaggatgagatg

SEQ ID NO: 95759 - DNA, 628 bp, Heterodera glycines
  SCN-specific regions: Sequence locations=114-123,174-195,217-226,369 -393,428-454,510-510,535-536,576-628
aagattcaagacaaggagggtatcccacccgaccagcagcgcctcatctttgccggcaagcagctcgaggacggtcgcacgctgtcggactacaacatccaaaaggagtcgactctgcatctcgtgttgcgtctccgtggtggcatgcaaatcttcgtcaagaccctgaccggtaagacgattacgctcgaagtcgagtcctcggacacgatcgactcggtcaagaccaagattcaagacaaggaaggcatcccacccgaccagcagcgcctcatcttcgccggcaagcagctcgaggacggtcgcacgctgtcggactacaacatccaaaaggagtcgaccctccacttggtgctccgtcttcgcggcggcatgcaaatttttgtcaagacgttgacgggcaagaccatcacccttgaggttgagtcgtcggataccatcgattccgtcaagaccaagattcaagacaaggagggcattcccccggaccagcagcggttgatttttgccggtaagcagctcgaggacggccgctttgtcggattacaacattcagaaggagtcgaccttgcacttggtgttgcggttgcgcggcggtcagtaaaagtgcgtgtgcggtccgccctca

SEQ ID NO: 95760 - DNA, 823 bp, Heterodera glycines
  SCN-specific regions: Sequence locations=1-195,217-823
accctttaagagcaatttcattataccgcgattcgcttttttccctcataggagtgacaaagatggagccgtcaaatgaaaatgttaacggggacaacgtgccaaacgccgcgttgactggcgggcatccgccggccgaaaaaattggttgcatgcgcattgcacgcaaggagcgcaacctgagccaacagccggaggagcgggagaagagcggcggcaccacgcccgcctcggcatcggagagcggcgactcggcgcacagcgagggcgagacgcgtgtgcggccgggcgcaaccaatgtgcttgcgtacaccgacttggccaaacagaccaagttggtttatccgactgatgcggtccgccactgccatgagaagccgttcccaagcaagcaggcatacactgcgcaccgtaccaacgcggcgcagatgcaagcgcaccagcagttccagccaagacgctttggacacctgaagttccagacacgcgagtacggcccgttgcacaaacagtgagggggaaaatgaatagtgccaccgacggatggatgggagagggatgcataggaaaacgatcgacggatgatgagataaaattgggcgagagcaaacgacgacgagatgccaagagttgtttattttgttgttttgattccagtgtctgatggagcactgcttttctctttctttcttttctgtcatttccacacttttcccttccttttttcttgacatggtccaaaatgttgatgattgttttcgtaacaaaacttcaaattgtacaaatgcaacatttctcatttatagtaaattattttgttttg

SEQ ID NO: 95761 - DNA, 575 bp, Heterodera glycines
  SCN-specific regions: Sequence locations=1-575
caattaagcccccgttccggtccaaattcggcccgctcgccgtcctccgcgcacggagtccttcaccaatacgctgatcagccgcaacaccaattggactccgcccgttcgttgagcattgaattggcctctgccacccattcgctttcaaacgctgtccaaatggcttccaccgggtcgaccaaaaagatggctttgcatgcctcggaatgcattgaggagatgacacgcgcatgtgacaaattgatcggcactcggcaattgatcaacaacgaccccgacatcagcacggacgaacggcgtcttctgctggagggtgttaaccgtgccatctccgccttccgtcaacggcttcattctgtccttggcaacggtgacgaaggtggcgccgggatggacgacggccaaacatcagcgactgctcacgtgggcaaatgggacggggaagaaagcggtggcctgagggtttgagccgaacgcggaggcgtcgtactgtataatatttggcgggtggacagaacgccaatttttgtgtttgaatctgtgcaactccaccatggttgtgtgtgccctcc

SEQ ID NO: 95762 - DNA, 475 bp, Heterodera glycines
  SCN-specific regions: Sequence locations=1-191,213-475
atacgaacagtcaagcaaaagactcgtttcgcatttccatttttttcttcttccattcctatggcctctgccccgtcctccgatcgcttttcctccgatcactttttctccgatcggtcccttcgcccgcaatgtctgcccaattgcgcttctctctcttttggctttgtagtggacaaattggcccagcattgtcactgctttagccatttgttcgaatgcggccaacgcattttcgaagtcagtgccaccgaattgagtcccaccaacggattcacttcacgagtgtttcgctgtgaattcgaatttggcacatttgtcggagaaaagcgaatgccaacgccaaagaagcggacaatgagtgcaattgcaaaagtgatttcactggagagaatggacactttgtgggagaatttcgttggcaaaaagcaaatggaaaagatgcgaaatagcagagagcagacagaaatgataa

SEQ ID NO: 95763 - DNA, 298 bp, Heterodera glycines
  SCN-specific regions: Sequence locations=1-49,72-95,125-154,205 -217,275-298
caggatttttgtccaggaaatcaaggtccaggtcaaatgtgaaaaaaaatccaggtccaggtccaggcaaaacaggaaaaaacctggattttcctggacaaaatttttgaatttattttttcaagtgaccgatgtttgtcaagttttcaaaaacaatttatataaatttaaaaacacattatgatttttaattagatatttttagatgcttctaagcaaataattaatttttttcaagattttttttgatttttaaaagaaatttcaaaaaaatccaggtccaggcctggatccaggt

SEQ ID NO: 95764 - DNA, 365 bp, Heterodera glycines
  misc_feature (359)..(359): n is a, c, g, or t
  misc_feature (364)..(365): n is a, c, g, or t
  SCN-specific regions: Sequence locations=1-281,303-365
gaaggacaaactttgcgtgatagctgaacccagcttggctgagaagggagacagcggtggccctttgatgtttaaaactggcaaaaataataattgggcacaagtgggcgtcgctagcacatcgacgtgtaacccggaaaagcccaaaagcaccgacggtcttacaactgactacactcaaattgattgcaattggatagaagaagcgacaaatggagaagtgaagtgcatagaataatgaacgaagttgatatatttgattgaactgaaacttttttaatgcttttaaatgcactaaaatattctatttaaataatttttcaattctttcaaaaagcatatttaaaataaaaacgaanctccnn

SEQ ID NO: 95765 - DNA, 751 bp, Heterodera glycines
  SCN-specific regions: Sequence locations=1-751
tcgggcttctttcgttggcggatcgtattgatgtgctcaattcacttactaccgaagatcgcaagttgatggtccgtcttcacagtcttgaaattcttggcgtttcgaaagttttcgatggaatcagaaccgcatacttggcactcaaacacaggaagaatcgcaaccatcgtcagcgtattgtcgtattcttgggcagtccattagacccgttgcttgaagaaaaggaaacgtttataaaattcgctaaaaagctaaaaaaggaaaaagtgagtgtcgatcttgtcttgtttggggaggccaccgcctgagaataacaatatcattgccgattttgtcgaccttcttaacggggctgaagagggaaattcgcatttgttggtcgtgatgggtggagacaccaaactggatgatgttttgctccgttcgcccatttttgcgggttcgggggctgcattaggcgcaggcggagaatttggcatcaacgaggaggacgacccggaattggccatggcattgcgcatttcattggaggagcagcgtctccgtcaacaacagcagcaaggcggcgaaggaacggactgaaagatcgaggcgcattcaaccccaatttacaccatcccagacaattctgaaacattggacggagggaaggatgatggtataccaaacgatcatgttgttgggaagtttcggactcactttattttgtgtacgaataaacaaaaattgaaataatgtgttaggaagt

SEQ ID NO: 95766 - DNA, 642 bp, Heterodera glycines
  SCN-specific regions: Sequence locations=1-70,92-269,292-642
catccgtttatttccttctcacccatttaatctcaaaaactgaattaatccaattttgtcatggatccgtccgccgtttcttcttcgtccagcaccgatcagcaacaaaatgcggaagaggcgcaaaagggcgatttgacattggcacagcaaattgcggaggacaaacagaaaatgtttgaacgctcccagcagtaccaacaggaaattgaggacgaaattcgcaagactcagccgttggtttcgtccaagcaaaacattgtccatttggttggcgaatttgatgagaagacgagctctcagtacttcaaaaaggcgacggagcttgccggcgtttactcggacattcggcgaatccgtggcgatggcaattgcttttaccgcgctgtactcaccgcccaactcgagcgctgttttgaggacgccgaggagctgaaaaggttcaatgagcttgtcaaaggttggcgtgctcgtctgatggccgtcggctgcttccccgaattgaccaccggtgacttttgcgattcgatggagcaactgatgacttcgctgctcaatggcacaatgctaccccaaattttgctggacgacctcaacaaggacgggattgccgattattacgtggtcttcattcggctgatg

SEQ ID NO: 95767 - DNA, 642 bp, Heterodera glycines
  SCN-specific regions: Sequence locations=1-642
tccatattttattgttttattggaaaccttttcatccattccccttcaatgatctcctttcgtcattcggtcaacaaatgtttgctgccacaaattacaaatcggttgacttccaatttgtccgccatgtgtctttcaacggctgcagctgacaataaagttgtttcaaaatatgacgactatcagaaggaaatgcgtcttaagcaaatcgaacgcgcttttgacgaggcgatgcctaaactgttgcacggctcctacaacaatttgatggcgttcctcgacacgaattccttccgttttgaagacaaagtttggctctttgagtctgatagcattcacaagacggtttttcgcatggcaaaagtccgtttgtatttggccttcaaatctccgcacaatcgttttgagacattgggcacacatatttgcctcgacgagaatttggtgacattaatttggcagctttcctggccaaaagatgcaaagtctgcctatctattgtctccaaagtcactggctgccaacttttctgctacgtttaccggcggccctcgctcccaaattggacgcattgagcacaaattggccacgagtgagtcttctgatcgcccgccctccaacgcgacaacccaaaatggccga

SEQ ID NO: 95768 - DNA, 504 bp, Heterodera glycines
  SCN-specific regions: Sequence locations=1-117,139-165,187-201,226-504
tggatcccccgggctgcaggaattcggcacgaggaaatcccttgcctaagaatgttggtattaagatgtttgccgattagcttatacaatggtcctttatctgggtgaaaataacacaaaatttatttattttcttgatggcgaaccattgcagaaacaaaaggatttgggcattttaatcaatcaaatccttttctaaccatattaataaaattttaaaaaattccatatttttcttgttatcagcttcaccgagcattaaaaactcgaagcttgaaactttaatttcggcatataaaagctatagcagaccatagttaaaatacgccaaagaaacttggaatctattaaaaaaagaaaaatgcacgcaaaattgaagcagtccaaaaattttacaagaaaagcattcaaaaaagtggccttgttcccatgccgtatgaagaaaggcgtgcattttcacctctcgtcccaaaaaacgagaggtgagaggcgagagtcccaaaa

SEQ ID NO: 95769 - DNA, 462 bp, Heterodera glycines
  SCN-specific regions: Sequence locations=1-462
gccaaattccctcgcctccctttgccctttgatctgttcctttttgttttcaaatgtgcggttgtccaacttccgcaaatgtcgtccacagttcgcccgaaccaccaaccgaaaaaagtgccgagttggccaactcatcgatcagcagatcggtcggcaacatcagcacatcgcctgccaagggattggcctgctctctgtcggtcaaccaaacgttcaaattggtcggcatcggctgctgtttgacttgcattacgaactttcccagcgcatttatgcacacttcggtgaacactgccgtgatggagttgaactcgtacctgaacgagtcgtacacgaaccgcggcactcagctgaccgaccagcacttctcgctgctccgctcggccatcaacagctgctggtacgccggccaaattgtgggcgcactctgttcgccgcgtttgtgcgacaaatacggac

SEQ ID NO: 95770 - DNA, 751 bp, Heterodera glycines
  SCN-specific regions: Sequence locations=1-449,471-664,686-751
aaatgaatagcagtgaagaaacaacggaaaatgttgggattggcggaaataaggacgaacggcagacaacttcaaaagatgagaccgacgaaagcagcagcgaaaatcaacggaatgaacaacgccaacgacaaatggacagcgaaaaggaggactcgaggttcgaatgcaatatttgttatggacatggccaaagatgcggtcgtttcgatgtgcggccatttgttctgttggccatgccttttccaatggatggacacgcgtccctatcgccagctgtgccccgtgtgcaaatcggcgattagcaaagacaaggtgattccgctctatggtcgcggtggtggggacagcgacccgcgcgagaaaattccgccacggccgcaaggtcaacgcacagaggagacaaatcagggctttcccgggatgttccattggggcggcgacaacggtggccatggcggcggcggtgtgcaattttcgaccccgatttctctttggccgaccaacttcgtccgacacggaagcgccatgtccattctctgtcttggcaaagtggccgatgtttatctgatcgacgagcccagcgcgtacttggacttcgagcagcgcttacatgccgccaaaggcataaaacgcaaaaagagtggcttcattgttgagcacgattttatcatgtccacttatttggcggaccgcgtcatcgtttttgacggccctcaaccgctggtgaacggaatgaaccgttttctga

SEQ ID NO: 95771 - DNA, 617 bp, Heterodera glycines
  SCN-specific regions: Sequence locations=1-108,130-301,323-617
gtttgaggtagtctataagtgataatttatcactgttaattattatcattaacaatggtagccgcgccagatgaagcgcaatttcatatttcgttttacactgacgaagaagagtgtaagaatttgttgcctgccgagtccatcaatgtgcccgcgtcttcgcactcggaccaactcaatgtgttgatcaaccaaatcgggtcgatgaacgatgacagttggaagcccgtccaattcgactttctgctccattccgtgctgttgcgctgctctctgctcgagttggtcgagcagcaacagttgtccctggagaatgtgctgcgcatcgaatgcattcgccagtcgcccgctccgcggccgaccgccgaactgaacgaagcgcaatgggtggccgatcttagaacattgagccacaattgtgttttgtccgtgaattttgccggtctgctgaatgtgtgggaattggccggtgaatggaccagagccgtcgtcaaacaattggacgacgaaccgttgaaatgcgtggacacattcactcgggacgacggaacaactttcgctttgagtggaggtcaaaaccaaactttgactttggtgcgactgcgggcgcagaatag

SEQ ID NO: 95772 - DNA, 462 bp, Heterodera glycines
  SCN-specific regions: Sequence locations=1-462
gtatttatgagctctatagaattcagtttgcctgtgttttgttcgccaactcagctaaattttgtgattggaaagcgagatttatgcgagagcaaaccgatacaaatattcaacccttacaatcatttactgcgctttaaattcttttcaaatgcgcctgagcgttggcgcgtggaaaatgctcagggcggcatccgggccaacaattacgtcacgacgacagtccaactgcgcgagccgcacacaatccgacagccgaccagcgactgtctccgcgtggaaattttcagggacggcgaaagcgttgcggtcggaagaaaagacattttgctcaacattttgacggttgagccgccctcttcgtccgtcgatggcgcaaattttgtcgaattttctgacggcaccgacgcggcattaaacagcacggcacagcgcggcgaggccaaattgcggacgaattcc

SEQ ID NO: 95773 - DNA, 519 bp, Heterodera glycines
  SCN-specific regions: Sequence locations=1-463,485-519
gagctccccgcggtggcggccgcttttcaatagtggatcccccgggctgcaggtaccaggcacgaggatttgttccaattttaatatgaatttcccatcaagaactcgaactcagttggtcacggactgcatcgattactcgaacgaaatcgaaggaattattcgtgctgttcccctaatatggcaacgatttgaagaagcatccaaattctttagagtgatcaacaaatttgtcggctatttcccaccacttcgcgattcatttcctacgccaggcaacgaaacattggacgaaattctgcgctgtgctggtgtcggagtcagattgttagttgaggcagagagtgtttcggactattccctctcaaacttacgtggcgccctgttcgccatttattattcggccgtgtactacatgccaacgactgatgactgattttgctgatggacttattcgtgacgaaaataaaataatttgttgttgcatttctctgttgttctgataaaaatttatttctc

SEQ ID NO: 95774 - DNA, 613 bp, Heterodera glycines
  SCN-specific regions: Sequence locations=1-486,508-613
aatttatatttctttgctctgcatataacaatcaacgagagaaatggggaattgtaagcccgcggatgccactgagtcggagaacgcgtcttctgtcgagacggttgaagttgaagtacctccggaccctctcgttaacccattctggaagatgcaaaaagccttcgagaagaaactgcgtaatctgttgaagcgtgagaagaagcttttgcaactgaaggaagaacgcgattccgacaagccgatcactaccgaccaacacgaggctctcagcaaattggacgaagttaaaaccctcattgggttcgttgatgagatgatgaagttgaaccagcagcagttcagccagtataagaaagccatcaaaaatcgtgaacgccaactgaaaatggagaaggcgcgttctcaaatcggtactccacaattgtcggatgagctgaaaaagtcgacggaggtacagacgaacggagtcgccgaggaagtgcaggcggcggtgggcgtcgtgggaccttccagtgaggtttagaacgtgtgcatttgggacgaaagagacggacaaattattgatgtttatcaatcagatgcttttgttggtaaataaatgtgaattgtc

SEQ ID NO: 95775 - DNA, 254 bp, Heterodera glycines
  SCN-specific regions: Sequence locations=1-11,33-83,105-254
gacaggccgaggcggaagccgagagggcgatggacaacaaccaaatgaccgctgaataccaagcacgctggtttaagaaggtgcaagactcccacacgggctctgtgatccatgttgttcgggacgaagaatattggcgatgcaaaataaaccgggactggtctcgatgtcctgaaattttctaattaaatcggatgggtgcacggggtaacacacggattgtgataatttgccataaattatttcaacatttc

SEQ ID NO: 95776 - DNA, 387 bp, Heterodera glycines
  SCN-specific regions: Sequence locations=1-141,176-365
gcagcaaatttcacactgaaaatgtcttctttgtccaccattcttgttcttctgctgataatttccatttgcttgtcattaacaattgccatgccagcagtggacaatcaaattgaaagtgttgcacttcgtcaaaagcgttatgactatggctatggctatggctacggctacggcggcagaagagtctaattgacggcggaatgggcatggatgggctttgatggacgcatgggcatgggcggcggatttgaacgccgaccctgacccatgaagaatataatattgtgaatcatctgaaatagattatttacaaaatgccattcgcaattaaataaattttgaataaaaaaccccaaaatacgagaagaagagaagacatgaaaa

SEQ ID NO: 95777 - DNA, 323 bp, Heterodera glycines
  misc_feature (323)..(323): n is a, c, g, or t
  SCN-specific regions: Sequence locations=1-290,312-323
ctcgcgtagtgttgtcagttgctgtctgtcccattctcgctgccccaattcattgacaaacttggccattctctcgccacctttcgtgcatcctccacactacgcatctgcacgactctcatttcgccgaagcggtctgtcaaccaagaaatcagaatctcatgtatgacaactgagaatcaccgccgacataaccagcaatttccctgcgcccttagagctttgccttgccgcttttgccctcctgatgcttcttgagatactggatcgtcttctccacgccacccgccttgccaattacaatacatacaattcaagattcn

SEQ ID NO: 95778 - DNA, 481 bp, Heterodera glycines
  SCN-specific regions: Sequence locations=1-301,326-481
gtccaattaagatgcccgcccctttggctgttcaacagaaaatgataagcgaagacgggtcggacgcaaacattccccagcaacacttttccgccaatggcaccccccagcaaccgccgtccgccactgtccctcccgccgccgcggctgcgcaccttttgaagaattcgctgtccgcccctctgctggccaatttgccgcccgtccctccccaatgcggccccccaaccgtttctttggcattgctcatcgatttcgccatccattggaactaccgacaattcgaaattttgtccgaactgaacagcaaaaagaaggagacggaccggaagatcagcgtggtcgagtttgctcacaacactcgtctgattttcgtgcgtcttctcgccattgtccgttggctgaaaagtgccaaaaaattcgagccgctcgcctccattcgccacttgctcgacgaacaggcgacccgttacgtggagac

SEQ ID NO: 95779 - DNA, 477 bp, Heterodera glycines
  SCN-specific regions: Sequence locations=1-41,63-477
cccttttggttctttttccgctgtttctctgctcctccgctgctctctcccacctttcccaattgggcaattcgcccccgcgtcagtcgtccatctttgacagggtcaaggtcagctgaaacacatggaaaaggaaaactgaggaggcggagattgccaaaaagcgatggagccaaacttaaaaggattatttcaaagttggggtaccaacgcttctccccccaggccccgctctgccatcccatcgacatttcgttgtgccgtgacatcccttacaatcggacaattcttccgaatccgttcatcgatggattggacccgcaaagtctccaagcgcaaacagaacatttcaagccgctgattcgcaccaaatgttccccgcacattctgttcttcgtttgctcagtgttcgtgccaatgtgtcccgcacaattgccacaggcagtcacttcgtgccgttccgtctgcgaggaggtt

SEQ ID NO: 95780 - DNA, 677 bp, Heterodera glycines
  SCN-specific regions: Sequence locations=1-677
aagcagcttaacatttccttgcaccgcacttcggtcactctcttttctatgaagggcccaaatgatgccaattcgtccatgcaatttgaactgaggctggtcagtggccgaacagaattcccttccgttttcctcgccactcgcgccaattttctacttcaaaaaggcgaaaatcgcaactcggccattatttcgctgagggaccctttggatgggccgcacgaagtgcacctggaacttgtgcttcgtctgagtgtccgcggaatatttgccggaaaatacatggccaatttgacggttttcgtctcccaacaaaaagcgcaaccgcaccatccgccgcaattgcagcagaaaaacagcgcaaaaagacatcggaggaggagacggacacaccgtaacagagaagaaagaggcgcaagcggacaccgtaacggaatacgtaccgtaaccgaaaaaatcggcggatggtagtcaagtcacaaatcaaatcactcactgtcagcaactgcttttaaccggccatttcggtgtttgttctgccgaatacctcaatcattggaggatgctttttctctttttgttcatttgttttgtgccgcgaattgcaaatttcattttggcatttcattttcattttggcattcgcttttattctgattagataaatcgctagagaa

SEQ ID NO: 95781 - DNA, 962 bp, Heterodera glycines
  SCN-specific regions: Sequence locations=1-852,875-892,918-923
gtccataaaaggttacggaaattgtggcctatccgaaaaacaacttccataaaaaacgaaacttggcttattgtcatagagagagaattctttgctttgcttttccgatgcttcttcgtccgtgcccttctcttccgctcctttcaaatgcgctttctttcgttgtccatttgccttttcatcagcaaaagacaatttccacttcggtctttgccctcacagtgtttgaccctcgaattttcaccgagcccatcgtttctactgaggagttgaataaaccacttccgccaaatgacaagcgcaattatatgtatctgaaaccaatgttatttgaccaaactcccgttttctacagggatgaaattgtggacaaaatggtgcgcgtatttttgatggagggcaaaaaggaattgtcacgcgtaaatgttctttcggcactggaaattgtcaaacgaacgcaatacgaaaaatggcttaatgaaaaagacgagaaaagacgtgccgaaatcattttggaccccatcgaagttgcgaaccgcgccattctcaattgtcgtcctttgatgaagttggaaaagacgatcaaagccggcaccctttacttagtgccaatgccaatcagcgaaaaggtcgccattttcaaagcgatgaaaacaatgcgcgacatttgccggctaaaggcgggaaagaagcgcaatgagaaaaggccgcactacccgcactttaaggatgtgctcgcgtccgaattgctcgccgcgatggaaaacgaaggactgaccattcaggcgaagcaggagctgcacaaaatgtgcgagcagaacagaagttactcgagcatgaagaaattctgactgtttttctttgttttgtgatttggtctaaatttgatccgtttttattttatttatttattttttggtcgcttttccttccatttccttttaaatattaatttatttgtt

SEQ ID NO: 95782 - DNA, 716 bp, Heterodera glycines
  SCN-specific regions: Sequence locations=1-540,562-716
gtttgaggtacattttcttccactgatcagtcacttctgatcaatcgttcattttgcttcttcgtttccctaaaccatgatgccctcgtcgccatcctccgcccccctaggcgcaaatgttttggtgaccggcgccaaccgcggcattggccttggcattgtcaaggaaattttaaaaactgacggcatcgtccatttgttagccggatgccgaaacccaagccaagcggaggaattgaaagagctgtcaaaatgtcacaaaaagctgaaattgatcaaaattgacgtgagttgcgatgaaagcatagcaaatgcggtggccgaagtgcgcaaaatgttgggctcagaagaggaaaaaggactgcacacactcattaacaatgccggaatattggagaaagagggcggcactttgttggcgcccgaccgcgccgcgtatttgcgccatttcaatgtgaacgtcgtcggcaccgtggccaccaccgccgcctttttgccattgctgcgaaaagcggcggcaacaaattcggagggccaaacggaggagcagcaggcggcgcccgttgtccgcgtggtgaacattggcggagcgttgggatgcattggcaaagtgttcttaaagccatcggagtgtccgtatcagaacatggcctatggcatgagcaaggccgccgtccatcacttcaacaaaatgttttcgattgatcagcccgact

SEQ ID NO: 95783 - DNA, 659 bp, Heterodera glycines
  SCN-specific regions: Sequence locations=1-537,559-659
cttttcacctgctgatctcattgccgatgtgcgcttccgctgctctttccgcttttgcttttttggatgattctgaggccgaaatcgactgggacgaacgatgcccaattgtttattccgaggattacaacatctcctttttcggcattgagaagtgtcaccccttcgactccaataaatgggcaagtggtgccctcgtcgaaagtgccgtcctccgaccaatcgaagccaaaaaggagcatcttttgctggtccactccaaaaaataccttcgctcgctgaatggccgcttcactttgactcgcattttggaagtgggcctcgtcctcctttttcccatttgcctaatcgaccgtcgcatccttcgtccaatgcgaattcaaacgggaggaacggtgttagccgcgagagtcagcctaattaggggctgggccattaacatcggtggcggctttcaccacgcctcagagggaaaaggcggcggattttgcgtttatgctgacgtcactttggcaattaaacttttgttcgctaatgaattgatcaaaagtgcaatgatcgttgatgttgatgctcatcagggaaatggccatgagactgattttgcctctgacagtcgcgtgtatatcctcgacctttttcacgcgtccatttacccc

SEQ ID NO: 95784 - DNA, 292 bp, Heterodera glycines
  SCN-specific regions: Sequence locations=1-221,254-292
gagaatttccatttataatggccttggcccattacggctttttggcacccaaacgacgcattgagccggccggcatttcttatgaattctcgttgatcaaagatcggctgatcctcggcctttccacacttcccgtccttcaaattgtctttcaaaacagcaggacgacggatggcgacgacattgacggagccgctgttagtggaacaaaaaatggcatatattggccgctttattttcttgatcaaattttttgtttggatttcaatgcgttaaaatcataatcaacgcg

SEQ ID NO: 95785 - DNA, 1199 bp, Heterodera glycines
  SCN-specific regions: Sequence locations=1-51,73-320,342-672,714 -1152,1174-1199
ccaagtttgagcgaagatcactcaaaaggggacgcccatggagagcagcgacgccaacaataacatcaacaacagcgagggggaggccgaaaataccaccaaaaacggcggagaggagggcgtcgagaagaagatcttgagcaaaggcgtcagcggggtggtcaaatggtttaacgtcatgaatggatacggcttcatttgccgtgatgacaccaacgacgacatttttgtgcacaattcggcaattacagcaaataatccatccaaaattcagcgatcattgggcgatggtgaaaaggttatgttcgacattgttgatggtgctaaagggccagaggcggccaacgtgactggtccggacggagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcagaaaacaatggaaaagaggctaagaaggaagaggttgcaaaggacgccaacggaggacgtggcggtgggcagcgtcgaggccggggcgttcgtttccgcgggcgccgcaacaatcgtcgaaacgtcgcgggctcaacatctggtggcacagaaaatgaaggcgaacagaaaaaagaacaaacgcagccggaggaagagacgaaagtgaacggaggcgaatgagcgaaatgcgacctcttttgtttagcgataattaaaaaagtaataagtctgcttcctacgatgtgttatgaattgtgtcgacaatttaaaggatttgctgacacaaagatattacaatgctttttcccacctctcaattggattgaatgatatcctcacttttttaatcggttttacatttggactcatcagcacaataataattcaaaaaatagtttgaatattttacgcgaaacaattaaacaaatcattgagttgcccatcgggaagtgcttacagccctttcacacgggtttgtagtcaagactggtctccaactttttggcgtccgcaactttacggactgccttcatgaagtcctcctgtaccacgccgtccctctcctttcggatcgcattcagtccagcttccgtgcacacattgcgcaggtctgcccctgagaatccct

SEQ ID NO: 95786 - DNA, 557 bp, Heterodera glycines
  SCN-specific regions: Sequence locations=1-46,68-557
taaattaaaaccctaatcgaccgtttttctatctgcaaaaaatgctgcaattcgaagaggtttgtcctaatgtcgtcggtgattcgccatgaaatctgttcgaaactttcatgcaggcaatggcccaattcaacgcaatgtttccaaatttgaattcgtccgtcgttgagtcagtgctgcgcaattgtgacggcgatgtgagcagaaccatcgatgaattattgcgacgaagtggccaagaagaaggaaataattcggagacggatgaacggcgaaagagtgtgtccactccgccgagggaccaatgtgccaatgacgagaaaatcgctttgctggtccaaaaccgcgagtttctgaggtatctccgtcgcgacccaaacttccaacgtgaaatgctcggccgttccaattcatctgattatcgacatcggcaccattcttcgactcatcgaagacgcaatttgcccgttctattaacgtcgtctcgcacttcccaatcgcctaattcaatccgtttttttcgtacatccgccgatgttatgaccaatccagcggaa

SEQ ID NO: 95787 - DNA, 476 bp, Heterodera glycines
  misc_feature (384)..(384): n is a, c, g, or t
  SCN-specific regions: Sequence locations=1-51,74-476
caattaagaattttaaatactcatatttattacaaatgtcggattgtatgaccgacgacgacgccgaggaggccctccgacagttcgctgaaataactaatacggacgaagcatttgcccattttattctccaggatgtcaatttcgacctcgatcgtgctttggcccgttattacacggccgatgaccccgaggcctcctacaaaaaattccaaaccgaaggtttggacagcgcacaaaacacgggcagtgaggtggatgacgaggaagggtcgggtggaaccccaaatgacaaatcaaagggtaaacagccgccgcacaaacgttcgcggcatgaggacgaatcgaaggaaagctcgaaattccctgccgaactgacgctgnatcacttggaatgtggacgggacggacggacgcaatttgaacaaacgattctatgcggtgctttacataattgcaagaacgaaccccgaagt

SEQ ID NO: 95788 - DNA, 1126 bp, Heterodera glycines
  SCN-specific regions: Sequence locations=1-172,194-1126
gaaactctggtataattttgggctttcaattcaaaaaaatttcgccatccctgtgcgtaaatgactaaaaaaggcgacgacgaaagcggcggtgaagcagcggcggcaattcgtgtgctcgtgacgggtggcaccggactggtcgggtcggcaattcgacaggtggtgacggaggaagagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggcgatctgtcaaaatgttctccaatgctgccatgagactgacgtggaacggtgcgtttcgtgcctttccacgtgcattttccccgacaaaacgccgtacccaattgacgagacaatggtgtacaatggaccgccgcatgacagcaattttggctattcgtacgccaaacgaatgatcgatgtgctcaaccgcggatatgctcaggagcacaatcgaaagtacacttcggcagtgccgtgcaatatatttggaccgcgtgacaattacaatttggagaacgcccacgtggtcccggcactgatccacaagtgctttttggccaagcgcgacggcggccctttggtggttgccggctcgggcaaaccgttgcggcaattcatttactcgttggacctcggccgtctctttgtgtgggcaatccgcgaatacgaggacgtggaacccatcattctgtccgttgacccttccgacgaagtgacaatcactgatgtggtcaccgccattgtcaaagcaatgcaatttaagggcgaagtcattttcgacacgaccaaggcggacggacagtacaaaaagacctcgtcaaatgctaaactgcgcgcccggctgcccgacttcaaattcacgcccttcgaacgtgccattgcggagtctgtgcaatggttcgaggccaattacgagaaggcgcgcaaatgaacgaatggacaaacggccgacggacaaacgaccgaaaattcttagtgatagacaatta

SEQ ID NO: 95789 - DNA, 481 bp, Heterodera glycines
  SCN-specific regions: Sequence locations=1-212,235-354,379-481
cacaacagtacaaatttgatggagcttttgtctcaacaatcggcaaagtcggcggcgccggtcgatggcccacaaaaactttggcaccaaatcaatgacgaaaacggcaccgaagcatgcgaccgccacaacaatgggcgacggtgctgcttctgtttagactgtcgccgtcggcattgttcctttaccatttcgcccatcgacggcatggagtggctgcagcagtgccacccatcgtacggcgttgacgcggatttgtcggcaaaacggttcctggaggaaaagaagttgaatttgtcgcgccgtttccaactcatcgagcggggctatgtgctcaaattgaagaacgacgacggagaagggccggggggagggaaagcgcagcgaaggcggtgctccaaatgcgggtgcaagggaagtttgttcgatcagctcactgtccgtttgatcgccggtagcgaaatcgaaaacgaaggcaaaa

SEQ ID NO: 95790 - DNA, 475 bp, Heterodera glycines
  SCN-specific regions: Sequence locations=1-191,213-282,304-475
aaatgacagtcgcgtgcatttgtacgatttgcctgccaacggcggcgcatttgttgagaaaaaagtattacaacatgcaggtgccataacctcggtgaacttcagcccaaatgggaagtatttggtggccacggacattgccagaaaagtggtgccttacagtgtggacgacggtttcaaagtggcatctgaaaaagaatggtcttttcatacagcccggatcaactgctgcgcctggtccagcaacagtcggtacatcgccacgggttctctcgacaccaatgtgatggtttgggacttgcaacaaagcggtgaacatccgctagtcatccgcggtgcccattcgatgagtgccatcaacggagttgcttggctttccgacaatcgactgcttactgttggccaagactcgaatgtgaagcagtggacactgaaactgtgaagacggtttacgcagacaatgagaaaacggcct

SEQ ID NO: 95791 - DNA, 1245 bp, Heterodera glycines
  SCN-specific regions: Sequence locations=1-1009,1034-1245
tttatctttaaaatgattccggactcggcgtacatcgaaatcatgaaaaactgctcaaaatggaatagccgaacaatgggtggtagaactcggtcacaaacggctgttttcgatcaacaaaccggaattgtgcacagaccgaccgagcatttgtttcgccatccctccgaacgctgtcgggctcaaaatccgatgcaggtcttcacttatccgcctgtccgatgggttaaacccaaaaataatccctcggccggcatcgaaatgaattattttatgcgtgcgaatccttcactgaaaagcgcaatatcatcaagtgttgaacagccgcaaaatgcctcaagcggagagcaacaaatcgcagaggcacaacaacaaattggcaccaatgttccgtcagttcgaagtgccaccggcggaagtggcacaaagtcttacattgagaatgaattggacttggctgaatacgacctcgatgagttggaaaccaacgatcagtcggacgaggaagattggggagccagtcgaaaaaaacgcaagaagacgggaccaggttttggtggaaatgtaccgggccgaactgcgcgaaaagtaccgtcaaacatttcgtctgcgaccgccaaaaaggagcagccgactgacaatgggtcaaatgggggaacgcctactgcagcaaatgtcatcggcggcggcgcgggggtcgcaacgacagccacggaaacgcgcccttacgtttgccagttgtgcggcgccaaatacaaatcgaggcccgggctcgcctaccacaaattgcacgttcatcaatcggactcgaacaatgagacgccgaaaagtccgataatctcgccgaaggtgcaagtgtctgaatattgtgacttttgcctgggtacgaatttgcaaaatgcggagggcgaggcggagccgctcatttcgtgccatgattgtggtcgttctggacatccgacctgtctcaaattcactaaaaatatgctcgtctccacaaaacgttacggttggcagtgcatcgagtgcaaaagttgtgcaatttgcggaacatccgaaaatgatgaccaacttttattctgtgacgactgcgaccgtggcttccatttgtactgcttgaagcccccgctgaaagaagcacccgagacggattggagttgccatctgtgcgtgaaggaattcggcgccgaagcgtccattgcgaaggcgacaaaaagcacggaagacggcacatcatcaccagcc

SEQ ID NO: 95792 - DNA, 454 bp, Heterodera glycines
  SCN-specific regions: Sequence locations=1-395,425-454
ggcccctttcatcaaccccgacgagcagtcgatgatcgactggcctcattaatttcggaccgataaacgtgggaatttcggttcctcccgacatgaaaccgtacaaatcgggcatttaccatccgtccgatttcgactgccaatttaaagtggttggcctccattcgatgcttgtagtgggctatggagaaaatatttatggagacaaatattggatagtaaagaacagctggggacaaaaatgggggcaggagcacggatatctgaactttgccagaggggtcaatgcgtgcggaattgaggacgaaccaatcggactgatggcgtaaaggaacggacggaccaaaacatttgaattgaagagaacagaaaacgaacaaacaaagttaatgacaaaatttatttttgtattgaaattttaaatacgaaaatggaaattaattggttctattgt

SEQ ID NO: 95793 - DNA, 480 bp, Heterodera glycines
  SCN-specific regions: Sequence locations=1-14,37-226,253-276,302-480
cacacaaatcaaaatgttcttcctttgccctcccattgttcttcttccattgacccttttctgcgtcgcttcccatggcttaacaaatcattcgaaagcatttggaaatgaaagcgaatcgaatagaacggacttttttggcactgaacccatggaaattccccgtcataaaagtgccgacggattcgacccaatggtggacgacgtattcgctttgctttctgctggagaagagggggaagaggagggaaatgggacgaaggtgggaattacggtggaggaggaggaggaagaggaagagcagcagctgcttctccgttgtgccgatcagctgtcgccctttgtgccgcttttgctcgtgccgccccattaccatcgctgggacttcagttgccattttcaaggcaatcagtccgaaaagcccgccgatctttccccaaacaatgccaatgaaaatgccgacctcttcttgaaaatgtc

SEQ ID NO: 95794 - DNA, 483 bp, Heterodera glycines
  SCN-specific regions: Sequence locations=1-483
attcgccagtcgacctttaaccatcagaaagcattgaagaatttgacagccataaaagaatatgtggcacatttggagcactttttcgactcaccgcaaatgaaggaacatttgaagacattggaatccttcccggaggcgcagttgccgcgcaatttcgacgcgcgtgacaaatggccaatgtgccctagcatccacgcggtgcccaaccagggcggttgcggatcatgctatgcggtgtctgcgatgggagttgccgccgatcggacgtgcattcacacgaacggcaccgacggcactcagttgagcgcattggacgtaatcgaatgttgcgaagtgtgcggcaattgcttcggaggcgacccgctgaaagcgatggtttattgggcattggaaggcgtcgtctccggtggccccgacggatgccgaccgtacgcagtgagcagcgcttgtgggacgccgtgtacgcccaacctttacgcg

SEQ ID NO: 95795 - DNA, 437 bp, Heterodera glycines
  SCN-specific regions: Sequence locations=1-339,362-376,411-437
caaggacggtggaaaatttctgtacacacgcacgacggggttattataacggacacgcctttcacagagtgatcaagtcattcatgatccaaacgggcgatccgacgggccgtggcaccggcggacagtccatttggggcggtgattttgaggacgaatttcacccggcactacgacatgacaaagcattcagagtttcgatggcaaatgccgggccaaacactaacggttcccaatttttcatcacaatttgcccggccgaatggctcgacggaaagaacacaatttttggccaagttgtggagggattcaacgtggtacaaaagatcaaccaagtgcccgtctatgaaaagagtgggagaccccgagaagagatttcaatcatttccatttctctgaagagtgtttagcttatataaattcattgctttacaaaa

SEQ ID NO: 95796 - DNA, 120 bp, Heterodera glycines
  SCN-specific regions: Sequence locations=1-120
tgatggacaattacaaggtcaatccaaaggacattggctttctcgcggttggcaccgaaacattggtcgacaaaagcaaaagtgtgaagtcagtgttaatggatttgtttgccgattcgg

SEQ ID NO: 95797 - DNA, 423 bp, Heterodera glycines
  SCN-specific regions: Sequence locations=1-102,209-423
aaagaggaggcggaaaagcggaaaaaggacaaaggcttaagacaatttcaatccgtcgaaatgaatggccatgacaacaaattagcgaagtcagttgagcctgaagaagaaataatggggcgagaagagacagacgaaagtgagggggaggaggaagtgacggatgatgaagaggaggaagaaaaaaagggaagggacgaaagaaaagccaattgcaaggacgtctttaggcacagaccgaccaaaatgccattggccactcattttggccattgacctgtcacggtctttacgaggaagaaaaggagacggtgagcacgcaattttgaaaggaccagcaaatttgaaattgcaaaagtcaccattctttgaaatgtacaaaacaccatccgattgatcgttaattaatcacctgctgagatc

SEQ ID NO: 95798 - DNA, 446 bp, Heterodera glycines
  SCN-specific regions: Sequence locations=1-87,109-373,395-446
cgtcgatttcctccctacaaaaagcatcaaattctcgaagaagaaatgaagccatcattcaacttcaacctttttgcatccgtctttcttgtgctttgtgtggtctcgcttgtcctctgtgagcataagcgagcagccgcagcagaagcatgtaatccgcccaaagacgtgggaactggcaacttggcactcaaacgatggtggtgggacggccatagttgtaagcaattcatctacaaagggcagggcggcaacacaaacaatttcccatcaaagaagcattgtgtccaagtgtgcaagccatgaatgagccgtggaaagaaggtgcagcgtgaagagaccagcaaaagaagaaaagcgaagaaattcaaagaaatttttgaaaaataaaatttaccgctaatagttaaaatgattttggtggaataaacaaaaaatttgcaaaa

SEQ ID NO: 95799 - DNA, 761 bp, Heterodera glycines
  SCN-specific regions: Sequence locations=1-402,426-715,737-761
atttaagtcaaaatccaagcttaataaataaaaggaaggcgacgagacagaagacaaagcccattttgatgagcagtcactgcaaaactttggaggaggacgaagaatggatggccaatttgcacttcgtccgctcggacattgacccggcgacggtgaaaccaatcgactcccgacaattggcttctttggtcaatgaattccttctccgttcggcagacattctgaacagattttgtgctcaatttgaaaatcggatgatggaattggactttcgtttggacacttttgaacgaatgttggcacttatggaaagaaaacttgaaaatgttaatgttgacgaagtgaaaaaacaatcggcggaagagaaagaaacggcggagaaagcggagggaatgacgcgcaaagaaaaaggggaagaaacgcccgaagggacgggggaagaaaaacgcacagacaaaaggcaggggaaggaaacggcggcggaagggacaacgaaggcgaatgaacaccccaaattggccaagtatttcaaaatgctcaaaatgggcgtgcctgaggcggcggtaaggcaaaaaatgagaagtgaaggaatggacgacgcactcctaaatgacccagagaaggaattgccattggaatcaccacaaaacaaagcgcaaatggtacatgatgcattggcagaggacgacgaatcgtcctcaaactcagatgaatgatttcctggccttcattcctttttatttaattttataactgaa

SEQ ID NO: 95800 - DNA, 640 bp, Heterodera glycines
  SCN-specific regions: Sequence locations=1-640
caagtttgaggtattttcatgtctgaccatttttgggacgaaaatgtcttcgatctgatcgttgaactagagaaggaaggccgccatgtacggcttgattggctgtcgtcaaattcagcgttggtcgaccgctttcaaacggacattgcgcgattgtccgaggaggaatattcgctctatgccgcctccagcagcaaacttcagcggatagcagcagccgaatgcgcgtacaaatacaaccggacggaggagttggataaactgtttgagaaggaccgcgactcggaggcgttgagggaaacaaatgtgaggcactttctgattaatcgcattctcgacgagttccggccgaacatccgtcgcctttctgccctgccaattgagcggacaattgacgcgttttgtttgaatcagccaaaggacattgaacagcacgtgttggatgtgtacgattttctgatggattgccttgagcttcgaccgccgatcagtgccgacctccgctggctttggatttgcgtcgtcaccggtgaccaggcggaccaaaatgatgatggccaagtgcgggacaatgtgcgcaaatttattgacaaatgctgcaacattttcagaaatgacgtccgttccgaccagtacaaac

SEQ ID NO: 95801 - DNA, 263 bp, Heterodera glycines
  SCN-specific regions: Sequence locations=1-263
cgtgcggatcattgacaacggcggacagtacaaagcggcaattggtggcgaacggtgagtggggggggcgacggacgaacgttgcgctggtccaaaaacaatcgtttgggatgggttcgagtcgacttggcctaaagggtttttcgggcatcccatggcattctgttgtaccctcatcagttcatattttctttcccttttttttgccttttcatttgcatttatttgtccattttttatatatttttcatccattcgtttat

SEQ ID NO: 95802 - DNA, 476 bp, Heterodera glycines
  SCN-specific regions: Sequence locations=22-189,211-310,332-476
aatttaaattaaataatttttcatttgctgtatgatatggtccataagcagaaccagttagaaacaacagcagtgccaattgctgtggcacataatgacaatggcacggccgacatatttgagcaattcgaaattatgttcaacggtgacaaatcggtgttctttggcaacgaaacagtgacaggcagtttgaagatcaaattgaagcaagagaccgttctgaatgctatccatttgcattttatatgtgtagccaaatggattggcacgggacgaaaggaggacaaggagggccaaaccgagaagatttattttgacaaaaattttgttttgctggaacgtccgcctggccatcccgggcctggccacttcaaatttgttgcccattttgcctattcattgccatttgagtgcccattgcccagcgggtgcgagacaagctacgagagtgggtcggcacacattcgttactttgc

SEQ ID NO: 95803 - DNA, 386 bp, Heterodera glycines
  SCN-specific regions: Sequence locations=1-17,39-160,231-239,261-386
attccttgtgcgcttcgtctttttaattctctttttgcaatatgaatccaacgtacccaatggtcttttttctgctcgttttggtggccgttgttctttcgtccgttcatctgaaggaagacaaaattgatgtgccgcagcgcgttaaacgcggagaatacggcggcggtgcctatggcggtgacggcggtggcgttggtgcgcctgccccgggcggtggcggcgcggcgaacattgccaatgtgttcataaaccaacagaacggatgcaacgggcggggaccgcagtaccaatgggcgtacacgcggaagacgggatgggtgtgcatcaacatcataaacgtgatcatcaaccagcaaagcggcggaaagtgatgagaggagccg

SEQ ID NO: 95804 - DNA, 494 bp, Heterodera glycines
  SCN-specific regions: Sequence locations=1-11,33-169,192-284,308-494
gaaataattaattaattcaatttgtattttctcgcttcttatcaagtgctattagtagaaagaaatgaatcgtattggttcagcactttcaaagtcggttttcatccctcgtttgttctgtcaccgtttcttcgccagtggacccaccgatgcgcgacaaaatgtgctcgttgtcattgtcgatttcaacggcgaacagcaattgcttgtcaacggaaagtacagcgaattgctcggccgttcccccgactttccatttccgggcaacgtgaaaccgttggctgaaatgcaacagcaacaacagcagaaatttccattccctttggacgccttgccaaccaaacaactcggcaatggcttgggtgctgtcatgccactccacaaaatcgtcgagccttcatttgttgtttcggacgatcgtaccgccataccacgagcgttaaggcatcaccgaatgtggcaaatgggtgaagatgatggacggatgacggcta

SEQ ID NO: 95805 - DNA, 341 bp, Heterodera glycines
  SCN-specific regions: Sequence locations=1-35,58-341
catggcaaggttgacaaggtcaaacggatcaaggactacgcatttgtgcactttgaggaacggtcagccgctgtacaggcaatggaagcattgaaaaacacggaagttgatggtgccccgatggaagtgtcgttggccaaaccgcaaggagaccaaaaccagaagaagaagctggccatcaagtcacggttcaacccacaacagtacggcgctggtgttacccccggcattggcccacgtggacgcaaagggtacgagtacatgggagcttttcgtggtggacgcggcggtgccggcccaagcatgcacatgggttatcaccaaccgtacccgggctaccc

SEQ ID NO: 95806 - DNA, 485 bp, Heterodera glycines
  SCN-specific regions: Sequence locations=1-485
ctttaacaatttgtcgtcaaaatttttgaaaaacggaccgttcacaaaagtcgcacttccattttttagtcgcttttgtttttcaaccgaagcatttgagaaggcgcaaaaggacatgaaacagctgaaggacgagccggacaacgacaccaaattggagctgtacgctttgttcaaacaggcaaatgaaggcgacgttcggggcgatcgtccaaaaatgctcgaatttgtggcgcgtgccaaattcttcgcctgggaaaaagtcaaagggatgccgaaggcagatgctcagcacaaatatgcggagattgtcaattcgttgttgaaaaatgcggggattaacaacgcgaacacttcggaaacagaatcggacggaatccgacggacgaaggagggcaaagtgtacaaaattgagctgaaccgttccgacaaatacaatgccatcacttgggagatgtatgagggtctgatcagcgcacttggcg

SEQ ID NO: 95807 - DNA, 203 bp, Heterodera glycines
  SCN-specific regions: Sequence locations=1-74,118-203
aattaatccagataaacaattctaacttacgtcgaattaaactaatttcacgtttaaaaaatagaagaacagtcttaaaaagaaaaaaaactaaaaattttacttatttataaaaaacaacaccgatgtaaaaaaatcctgttaactctagagaaattttaaaaaccaaaaagggtcacaaaaattataaaaaattttaccct

SEQ ID NO: 95808 - DNA, 873 bp, Heterodera glycines
  SCN-specific regions: Sequence locations=1-11,33-379,401-478,500 -582,604-614,636-639,662-718,762-873
atttcgaatttttaaaatccaattaaaatggcccatcaaatggcacgagcggcgatcaacaaaggggcacgagtgctgagtgtacttgagaaggtcaaattggtctgctggtttgaggagacgcattcctttgcgcaagttgctcgaagatatcgggccgagttcggcatggagccaccgcaaatggaccaagtgaagaagttgcaccaacgattcctgaacacgggctcaattctgaatggcaccaccacaccgcagacgatggcaacggcattatccgccggcatcgatgacgtcgtggtcaaccaatcccagcaaatgtcggtggtgtgcgatgcgggcgcgttggatgccgaggaacagctgagaatggcacggatgtgaaatggtgttgttgttgaacggcgagtaccaagaaaaacaccaagacaagttccaacatttttgtaaaatgtactttttatacatagtctccctcatttttaatgccttttcggtgtcatgacaactcatacaattggcttaggctaggcctagaattaggcttaggcctaagctttattcctatgcttaagcttaggctttttgtaaaaaattttactgtacgagttgccattgacgtgccttttcactcccccattgccgtgtcttatttttgcacgaacgctcatctctcaatctctaggctagggctcaatacatacacacctatttattgatttgtttttctttctgaatgacctcccccacccctcccgaaaattgttttttcttccgccgtcggttaacctttaccctttacacattttcccaatacttgtgacattggtacgttcaattcagcagcaatgttttttgatacataattttgtc

SEQ ID NO: 95809 - DNA, 951 bp, Heterodera glycines
  SCN-specific regions: Sequence locations=1-915,939-951
gtttcatttgctgtatattttacaaaatgtccgtctcgtggggcactcaatactccaaactgaagacaaatcttcggctggctgcaaatcgactccgattgttgcagaagaaaaagactgagcaggcggtgaaggcgcgctgtgaaattgcggactttttaagcacggacaaagaggacagagcccgaattcgcgtggagacaatcattcgcgaggattttgtggttgaggcctacgaactgctcgaaatgtattgcgaacttttgcttgcccgattcggcatcattcagcagatgaaggaattggacgatggcatcgcccgaggcagtgagcagtttgttgtgggtggcggcctcgcatcggacacgaaattgcggaattcaaggtgatcaacgacgagctgacccacaaatacggcaaacaattcgcggaggccgcccgtatgaaccaattgccggagccgagccgagtgtcgaccaaattggtgcagaaattgtccgtcagcgcaccgtccaaattgctcgtcgaaaagtatttggtcactattgcgcaatcggcgggcgtcgatttcgcgccggacgccaaagtgatgcgtgaagacgacgacgaaattgcgcgggcggaacgcaatctgatcaacttcatgaacgaggagcagtacgggtggacggtccgtcacaacgacgacccaaacagcaaaggcagtggcggagggcatttcgctgctgccgtcgctggcgccgttggccccgccgatccgttgatgaaccagggcagcaacaacaacaatggcggtggtgctactgcaatgcctatgccaccaaatggtagcggtgcgtttgccatgtccccctccacgtttgtgccgtcgcatccgtctcccctcgccacttcgtcgtctcctccgcccgaatacgcgccgccgcctccgctgccggcccatggcgctgg

SEQ ID NO: 95810 - DNA, 329 bp, Heterodera glycines
  SCN-specific regions: Sequence locations=1-13,36-176,199-329
atgtcgatgtttgctttaattttcttctttttattcatcaatatttttattgagcccgtttcgatggcaatgaaaaaatcgagcaaaagctgcaaagttggcgtaggcaatctgacggacgaaaatggcaacgtggtgatgaaaggacgattcaaaatgtgcccaaaaggattcaaaaaatgtgccaaaaatgaggcttttggcaccacggcattctgcgttgagctgttggaatgaatatgaagaaaattggaaaaatatgggaaaatgatacttaattaattcaaaatgttaataataatggaatataataaatgtgacattgttgt

SEQ ID NO: 95811 - DNA, 503 bp, Heterodera glycines
  SCN-specific regions: Sequence locations=1-9,31-39,61-113,135-503
gtttgaggcattaatattacttttgttgcaatgctgccatccaatcttttcttcttgctgatgaccatgctcagcagttccctcctccatcagacattggcaaataaattttcagcagagaccgacgcagtaaatccgacgcgattaatccagagacggcatttgattcgaagccgcgcaattcacaaagaaaaaatgcactcgaacgtaaatgaaggctatttacagtgggaaaaggataaattccacgaagcactgggagaaaagtgcggaaagaaatcaaattgggaacagagagattttggcattttaaggattttgccgaagagttcccgatctctgatggaccccaagtttttgggatcggtggaaccgcggcttttgaaaacatcggcggatgggacgcggacaaaaagcgattcggaagaggaaaagtggcggaattggctgcgcaggcatttcccagctgcgagaacaatttctgatcagtgatcactgatcac

SEQ ID NO: 95812 - DNA, 325 bp, Heterodera glycines
  SCN-specific regions: Sequence locations=1-173,195-230,252-266,310-325
ttactcggcaacgaggtgaatttgcttacggtttaatgaatacagttacagtacaataactcaatgttcaacaaataaaaagctggaaaatgaagtcccattatttgttcgaattcttcttgtccaaatttgtttaaatgttgctgttgaatggccgcaaattggacgtatagaataaagaaggaaggaaggaacccagcagctcgtctgtaccccaaacagaccaacaaggaacaacaacagcaggggggcggaccgtccaacggttttcatgacatcacatccattggaggcggtggtggtggtggctcggcattgttccaca

SEQ ID NO: 95813 - DNA, 671 bp, Heterodera glycines
  SCN-specific regions: Sequence locations=1-186,211-405,428-671
gtttgaggtaaaaacacacaaattatcgtgtggattattgtaatgcatccctacgaattcaaattggacgcgatactcagcagatcagaattacccgtggaaaaacttgaaaagcacgcgtggaacccggaggaccggtcgttgaatttgtacgtgaaggaggaggacgtgctgacgatgcaccgacacccggtggcccaaagcacagacggaatgcggggaaaagttggctacacgcgcggcttccacgtctggcagctgaattggccggtcaaccaacgcggcacccacgcggtcgtcggcgtggccaccaaagacgcgccgctgcacgccccgggctatgtgtcactgattggggcggacgcggagggcttcggctggaacattgtggagaacaaatgctaccacgacgcacagaacacaaagccatggtccttcccttatgagcagccattcgtcgcgccggagaagcttttctgcgtgttggacatggacgagggccaattggccttcgccaccgactccaaatatttgggcgtcgccttccgcggcctcaaaggcaaaaaactgtacccggccgtcagtgcggtgtggggacactgcgaaatcactctcagatatttgggcggactcgatccggacagtcacttgatggacacttgtcggaggtc

SEQ ID NO: 95814 - DNA, 632 bp, Heterodera glycines
  SCN-specific regions: Sequence locations=1-178,200-339,361-473,497-632
gagccctttatggcattttgcaaattggcattttgtttggtgcccagaaaacgcactttgaattgcttgtagctaaggtcgcgcaattggatctgaatttccttggtagctttggcgcctttgcaactgaaaaatgaaaaaattaaaaagttacccaatttcttttgaaaacatatgcttaaaaatagggaaaataaataatcgactgtcaaatatgcgatcacagtagtatatagcgtcaaaaggttgcgggttggttgcgggtgtttcccgcacgagcccgtgcctatgggaggggtgcagccctttgaagttgccgccccatcaaaaaatccacgatgtgggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaatttttttatgatgattttttcggatcctgaaattaaaaattctttttgaaaattagc

SEQ ID NO: 95815 - DNA, 483 bp, Heterodera glycines
  SCN-specific regions: Sequence locations=1-35,61-138,162-483
ataaaccaaaatatcaccatggttttcgtcaaggccgtcaagaacaaggcttacttcaagcgctaccaggtcaagtaccgtcgtcgccgcgagggcaagaccgactactacgcccgcaagcgcctcgtgacccaggccaagaacaagtacaactcgcccaagtaccgccttgttgtgcgcatcaccaatgccgacgtcatctgccagatcgtctactccaagatccagggtgacttcgtcttgaccgctgcctacgctcacgagctcccccgctacggcgtcaaggttggtctcaccaactgggctgccgcctacgccaccggcttgctcgttgctcgtcgtgccctcaagaagttgtcgcttgacgacaagtacgagggtttcgtcaaccccgacggcaccatcgccgaggtcgagccccttgaggacggtccccgtcccttcaaggccttcctcgatgtcggtcttgctcgtaccaccact

SEQ ID NO: 95816 - DNA, 508 bp, Heterodera glycines
  SCN-specific regions: Sequence locations=1-307,330-508
gggctgcaggtctctcggcacgaggttaagatgttgagtcggagtcctgaaatggaagaagaacgtttgcccattgtttcgatggtaattgtcgcggacaaaagtcgtgcgccggccaatttcattacgctaacgaaaacttacgacgacggaagtgacgcagatttatggaaggatgggttcggtttcgggttgttcaaccgttccgttcgttatatcgctgtaagccgacacatcgccgaaacgccgcccagcggtttggaagtgttgactgacgtggccgtcatttcggacaaagaagcagttccgtccagcttcgtctgcttggacttcaccgttgacaccaaagaacgcgccctgaagaagaaatatttgtgcgcccgcttcactcctcggactgatgcaattgacgcggtgaccaatttaattgttttggcgcggtcgcggaggccccccaaagggtacactttggccggtgacattgacggcatggccatttgtttccgag

SEQ ID NO: 95817 - DNA, 789 bp, Heterodera glycines
  SCN-specific regions: Sequence locations=1-143,165-759,787-789
gaacgcattaagagacggcaaatccataatataatgaagtttcatttcaacggaggccttgactgtcccgaatggatactgtcgcaaattccagaaattgcaaaaactgacacaaaaatgttgcaaacacttggcagcacaatcattgaaatggccaaagtcaaacagacggaatggcatgagacggacatcaaaaaattttgcttcgctgaaatgagcgttgatggtctcagggcattgaaggccaaaactgctgcattgtgtttcatttttgagaagacaaccaaaaatgattgttcatgcaaagatttggagaaggaactgctccaacttgggctgccctccgaccatgtcagtgtactggttgaactctacaattcaaacagggccgcattgtgtgacagtttggcagggcctgcaatcaaagccccttcactaacagtggtgtgcaaagagcaggttccaacggctgccgacccgtcagtgaaaagtgactattttcgcttggacacaacaagttcggacgggtcaacagcaaccctgctcatccaccgagatgagttggtacagttgagaacctgcatggaagatgccgtgaaagtgctcgagtcgttggtggtcaacaaagaatgatgcccgcttattggagacacgccccatgtccaatttttcaatttgtgacttgccacttaaactaaagcatggcacttacaactagtgccattccaaattctgccattcatttcttccgcgcagcacattttatttaatttaaaatattttattgtc

SEQ ID NO: 95818 - DNA, 580 bp, Heterodera glycines
  SCN-specific regions: Sequence locations=1-436,469-580
tgtccttttctgttgaccttgaacagttggaaaaggagatccaggcgaaagaagccgcttctaaaagggacaatgtgacggacacaaaagtgcagcccgacttaaaagggaacattggcagcggaacttcggcacaaacaaaacggaagagcaatgtggtgggattggaggaggacttcgacacgttggacgagccaatttgtgatacattaatcgggacttgaaaatactgtacggaaagttctcgcaagtgcttttcccggccaagagtgaacaaaatgtgctgaccgactgggacttgtggggccctctgttcatttgtgttgccctttcgatacttttgcaaggcgcggacagaggggcgcaattcacgcaaatattctccttggccttcttcgggacgtgcattgtgacgcttaatgcgaaattattgggcgggaaaatttcctttttccaagctttgtgtgtcattggctattgccttttgccgtaagttttcgcgtccggtggcatcaaaagtctgtcgcttcttttctggcacaaatcttccgccaatttgcttcttcgggcacttgccact

SEQ ID NO: 95819 - DNA, 769 bp, Heterodera glycines
  SCN-specific regions: Sequence locations=1-330,354-769
ctcgattttgctttaattcagcaaatttttgttctaagaaactatttcatcttacatctgatcaatatgcttaccaacaaattggcaaaatgtgccgctatgaccatgacccgttgccaaccgctgaacgcgttggcaatgttgggcggggcccgactgtgccaccacacgccaccaaactgcatggacgccattcgtccgcttggtccgaaaagcagtgtgccgagttttaagggccaggcaattgtgaacgcggaaatgaagaccatttcgtacgacgactacaagggcaaatggttgatcttcttcttctacccactcgactttacgtttgtgtgccccaccgaaatcattgcgttcagtgaccgcgtcgccgagttcaagcagctcggctgtgaggtgatcgcctgctcatgtgactcgcagttctcgcatttggcttgggtgaacacaccgcgcaatgatggcgggcttggcaagatggaaattcccgtgctcagtgacttcagcaagaaaattgcggctgactttggcgtgctggacaaggagaccggactgtcctatcgcggtctttttctgattgaccccaatggcactgttcgccattgtttggtcaacgatttgccggtgggcccgaagtgttgacgaggcattgcgcattctgaaggccttccaattctttgagaaacatggcgaagtttgtcccgccgattgggaggagggcggtgaaacaattgacgtcaaatcgcccaaggagtacttcaaaaag

SEQ ID NO: 95820 - DNA, 441 bp, Heterodera glycines
  SCN-specific regions: Sequence locations=1-9,31-269,294-307,333 -359,381-441
tccgcttttaataatttcaaataattttccgctttttccaaatgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgcggcggatgggatgagcgcattttgggcggtcgtgaacaatgaatggagagaatgagtgaagaagaagaagaagaagaagaattcgggatggatgccaaaaaagtaaacattcattttcaatttaattccccctttccgcccccatttgagcccctttttccaaatttcaattatcaaatgcataaacctgttctttctctcccaataaatgatccgattttgccaaaac

SEQ ID NO: 95821 - DNA, 479 bp, Heterodera glycines
  SCN-specific regions: Sequence locations=1-296,318-413,435-479
caactctcagcggtacagcccgaaattgaacagccaaacgaaggagacgctgacggagaacagcaaccggcggaaccgattcaattgatcgataaggaaagagaatatttagcggtaaaagctgcgagtagggcagtgatctcacatctctcagagtggagcacgccgattgaaatgcggttcgcaatggacggcaccgtcgaaacaaaacggaaaatgcggaggcgtttttgcatcgaccgtcaacaaatgctgcatgatattgaatgtatgtatgcgccaaaaataggtataaaacagattctcaatgtggacattgtcgggtgccaagacgaaatcagccaagctactgaaaatgtataccaaatggtctacgacggaggtttcttccgcaaacaaactgggttatgcaatttcaaggttctcaagcctacaccaaccactaaaaatgttcttgacaatgttattaacgggatttt

SEQ ID NO: 95822 - DNA, 518 bp, Heterodera glycines
  SCN-specific regions: Sequence locations=1-55,97-200,222-225,247 -284,316-518
ttccgcaccagaatcccccgggctgcatgtatctgaaacgagggtttgaggacccaatttaaaaatgtttaaattttttgctctacttttcctcttcatgagcaccaaacaacaacaggcagcaagtgcgcaatttgaaagcgatgaggtgagcggaagagtggggcacggacagaaaaatgcgcggtcgcgcatcgctatttggaaaataatttcactatgattaaaaaaccaaataattttgtattattttcacttgatataaattaaaatttgaattttttaaaaaaaaaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatg

SEQ ID NO: 95823 - DNA, 420 bp, Heterodera glycines
  SCN-specific regions: Sequence locations=1-18,47-420
ataaggggttacacatttccctttctcctctttcctctctgttgttatcacaacacaattccaattcgtcaacagcttcttcactcatcgacgagatgacttcttcaagatcgcgaacgcgtcgtgcgacttccaatactgcttcaactactgctactgctggccgtagacgcagccgttcaagacgccgtacacgtgcagaacaagtacgagaagcgactcgccgcgcgttacgtcagaacaacggcggcaacgcgaccaggacgaggaagaagcgcggggcagcgatgcgtcgtccgcccaagctcaaaccgctccgtggaaggccgaggggatcgcgcaaatcgagggcggcgccgcgcactgctggacaaaagcgtggccgtggacgtccgaggaccgtgaaaaaaggccgtgccc

SEQ ID NO: 95824 - DNA, 475 bp, Heterodera glycines
  SCN-specific regions: Sequence locations=1-63,87-260,289-327,373-475
atcaaaatggctgtcgacgcttcgtccgctaccatccgtactcgcaagtaccttaccaaccgtctgcttcagcgcaagcagatggttgtggatgtgctccacgccaacattgccaacgtccccaaggacacgattcgcgccaagttggccaagatgtacaaggtcgagaaggaccttgtcgttgcctttggtttccgcactgccttcggtggcggcaagtcgactggctttgccttgatctacgactcgattgactcgctcaagaagttcgagcccaagtaccgcctcgtccgcctcggtctcgccgaggaggccaagactggtcgcaagcagcgcaaggaacgcaagaaccgtgccaagaaggcccgcggcaaggccaaggctatcgttctcggccaccgcaagtaaggtgttttggctgttttcaaatcatggcacttgtgtctttgtgcttttcttgtggtgaactcgttgt

SEQ ID NO: 95825 - DNA, 492 bp, Heterodera glycines
  SCN-specific regions: Sequence locations=1-492
gctaaattgacccaaaatggcggccacaagtgccaccggttttcctgtttgcattttgacgccctgcagcaactcacatccatttgaggaacggagaattttggtcacacggacggaggaagacgcggtgaaaattggccgatcggtggtccgactgcagccgtcatcgaacaacgcgatttttgactgcaaagttttgtcacgaaaccatgccgttctgtgggcgaatggcgccggtcatttcatgatcaaagacacgcgctcatcaaacggcacattcatcaacaacgaacggttgagcgccagcggggaggagaacgagccgcgcgagctgttctccggcgacattcttcagcttggtgttgaaataattgacaccgcaaagaaggtggccagcggctgtgtgacgtgcattgtccgactgctcaacgaacgtggcgaagaatgcgcgggccgacccaagccggaccatggcacattcccaacactgtt

SEQ ID NO: 95826 - DNA, 808 bp, Heterodera glycines
  SCN-specific regions: Sequence locations=1-43,85-808
gtccaattaagagttttgatacctccttaaaagcaaggagcataaatatatttttgtgtatttttccttcatttattttgctttgctttcaaagttagtgctgaaatgacaacggaagaacccatcagcggcggacagccgaacacgccgccaatccccgccatcgaattgtcttaccccgtctccgtcatttactgtggcgaatgttcgatgcccgtcgaatactgcgagtacagtggcaaatttgagaggtgtcagcagtggttggaacgcaatttgcccgatttggcggagaaacaaatgaaaattggggcaggagatggaaaagcggcggaggaagggaatggggaagagacggaggcaaaaaagcaccaaaagcgaggcggaaagggattgccgaaggcgagtgggggcgggaagggctcgaaagagcagtccgctgcggtgccgcggattacgctgaagacggaagtgcggagcaaaaacaaagcggtgaccgtcgttaaaggcctcaccacttgcggtgtcgacttgaaaaccgcctccaaattcttcgcaaatcgtttcgcctgcggctgttccgtcaccgttggctcagccgacgaattggtcattcagggcgactttaaggacaaactcttcgtagaaatcccgaagaaatggggcgtcgatgaggaagtcattgaggatttggacgaccaaaagaagtgaccactcccctttcacactgcttgtttttactttaatttatatactaattcattgctttgttgtcgtgccgaaaagataaattttaattcatttaaaa

SEQ ID NO: 95827 - DNA, 639 bp, Heterodera glycines
  SCN-specific regions: Sequence locations=1-639
ctttttagctaattaactaaaatggcaacaacggacggaatggtcgaagatggcaaagtgggaaatgacctccaatcagcaaagttcacaaaggacaaagaagtcgttgacattgtgcagccaacggccaaattgataggattgacgaaggagcagctcgagcagtaccgaaatgaccccttttggaaggcgattcgttactcacttttcgtcgccttttggctgatttggctggccatgttcgtgggcgctgttctgattgttgttttgagcccaaaatgtcagcaagtgaattggaccgaaaaaatggtcgcttacaaaattttcaccctcgcatacaaagactctgagtccaaaaatgggttcggagactttgaggttattgagaaaaagttggaccaaatgaagggaattggagtcaatgcaatttggccaactcccgtgctcaaatactataaaaatgcgcttggcccagaggcaatcgaaaagttggaagtgtcggaccaactcggcggggctgaggggttcaaaaaactgatcaagcgggcccatgacaatcaaataaaagtgatcgtcgatttgccattgacagtcaatgccaaaggaaattgggccaacaaaacttctgatacaaaaaat

SEQ ID NO: 95828 - DNA, 1164 bp, Heterodera glycines
  SCN-specific regions: Sequence locations=1-98,120-464,486-799,821 -1077,1101-1164
tttcttcttctcaaaatggcttcagaagatgcttccaaaatcgtcacagagcaacgtaattttttcaaaaccggcgcaactcgtgccgcggcatttcgcaaggaacagctgaagaaaatgcgcgaaatgattgttcaaaacaaagacaaaatttgcgaggccatttacaaggacttgcgacgtaacaaggagacaaatatgaaaatggaggttgatgggcctttgcaagccattgactattgtctgtctgagttggacgaatggatgaaaccccaaaagctggatgaccaccaattgggcaagccgttggtcatttttgagccgaagggcgttgtgttggtgatcaccgcttggaattatcctgcagccctcgcttttcaaccggccattgaagcaattgctgctggaaacaccgtggtgatcaaaccgtcggaagtgtcgccgaacacttccaaattgttgaaggaaatgtttgatgccacttttgacaaaaaattcatcgccgttgtggagggggcggcccccgaaacgcaggcgcttctcgaccaacgctttgaccacattttctacaccggaagctcgtcaattgccaagctgataatgcaagcggccgccaaaaatttgactcccgtcactttggaactcggcggaaaatgtccggtggtcgtggagaatgacgccgacttggagaaggctgctttgcgtatcgcagaagggaagtggttgaacagcggacagacttgcctggcgccggactacgtcatgaccacggccgagatgaaaccgaagctggtgaacgcactgcagaagagcattcagacgctctacggagagaatcccaagaagagcgagcagtattcgagaatggtcaatcaacgccatttcgaccgagtgaaggcgttgctggacaagacgaatgggaaagtgctgtacaagaatggggagccggaccgagacgatgtgttcattccgccggtcttggtggatacggacttgaaggacgcactgatgcaggaagaagtgtttggacccgtgctgcccatcctcaccgtgaagggacttgacgaggcgatggacgtgatcaacgacggagaaaagccgcttggggcgtatttgttcacgaacgaccaacaaaaggtggacaaatttttgaacgaaacttcc

SEQ ID NO: 95829 - DNA, 480 bp, Heterodera glycines
  SCN-specific regions: Sequence locations=1-480
cacttggacaacaaaatactgaccgcatggaatgcccttgccatctcgggcttttgtgctgctgctcaggctgtcccaacacgcgcggccgagttccaaaaacgtgctgaaaaagcggttgcattcattcgcagccatcttttccatgggggcgaattgctccgatcggcttacttggacaatttgggacaagtcgttcaaataagacatcccatcaaagcgtttgccgatgattatgcttttcttatcgaagcccttctcagcctttactcgctgaacttggatgagaatttgcttcaatgggcgcataatttgcagcttcaaatggacgaacttttttgggatagcactttcgactcgggctatttcatgtcgagggttggcgatccgtcgataatcgtccgaatgcaagacgaacaggacggggctgagccctgcaccaattcggtggccgcttccaatttgctttgccttggcttt

SEQ ID NO: 95830 - DNA, 362 bp, Heterodera glycines
  SCN-specific regions: Sequence locations=1-39,65-362
agcactatggcattatgccacatttcctcttatttccgtctttgtcaacagaattactaaatttggcatagctaaatgtcacatgacaaaattcacgctgcacgctgattaagataaacaaagtcattaataaccggatattcacaggaaatggtacctcattattgagaaagatccccgacatttttgcgctccctgactctgcttcccgacctgtcatccccgagaatttcttcactgacaaatgaggggccacaactacagaacagacaaactgattaatcactaacaatttttgttgtatatggtagttaatttttttattattatcaggattttttaaaaaaatagcactaagtgtt

SEQ ID NO: 95831 - DNA, 482 bp, Heterodera glycines
  SCN-specific regions: Sequence locations=1-482
cacagtctcgcttccatcacatcaacgcccacccaatccaccagtcaaaatggccttcctttcctacttctcccggaccttccgccaataccccgagattctccctctcgtcggtgccgtttgcgttgtcacctcattcggtatctactcatccacggccaagatcttgggcgatcaagacttgcgcatccgtcaaaaccacggccacatcacttgggacgagcgcctcaggcggtgggaggaggccaagaagcactaagctgctccgctgtttcgagttcccgtcctcaacctgatcctctccataccaagtcaacccatcatcctactttctttcgtctaccgacatagacgaccgccttcaccactcgcttgtggttgcgtgcctattcaatttgttgttggttcccagcctgctgttgcagccatcgtcgcttcacactttgtacatgtcttttatgaaccccactgtttgcacgctt

SEQ ID NO: 95832 - DNA, 474 bp, Heterodera glycines
  SCN-specific regions: Sequence locations=1-474
gtccaattaaggtcacaatgagtaacagtaatgacagtgacgacctaattatttatgacgacaatgaagacattaaagacgtttcatccgattcgggtgacgaagtagcgatggaggaagtcaccaatgcaggcacttctacagctggggccttatctaacgaagaaatcagggactaccaagtgctttctcagacggagttggtcgacgaactgaataagctttcatctgaaacttcagcagtgttgcgtttcaatggctcaatttgcaaggtacttcttcatcacttcaaatggaacaaagtcacactaattgagagattcttcgaatttcctgagacttcaaacaccgattcattcttccgcaatgcaaatcttctcgatcctacaaagcataccaaaatcgagggaaaggttgattactgcaagatttgctacgatttaagacagctgactggattgctgtgcaaccatt

SEQ ID NO: 95833 - DNA, 654 bp, Heterodera glycines
  SCN-specific regions: Sequence locations=1-654
gggacgacgaaatgtgtccttcaaaaacgcaacacttggaacagttccattcgcttaatattcctatgattttcattctctccgcacttttctcactttctgcgacattcgcacagtttgtcccggccaaaaatcgctgctacagttgcgcatcggacaatatgaaagaaaatttcctcacgcgcagccgcggacccccggggcgcgtgcgcgagccgcgtctgttcgattcgatgtgcgactcggacacgtgggtaattcgggaaaaaagtgccatcgaatgtcagggcgcttgcttcaaatggcagcagacgctgaacaattcgggcgtcctttcatacgccaccatcagaggatgctacgaatggatgttcgattcgtccgttggtggccccactccctcctccgacagttcgtcgtccgtcgccttcaacactgaatgcaaacacacgcaacgcgcgttggtctgtctggacgagttcagctccgtcgaggagtccacctgctggtgcttcggcgacttttgcaacgcggcgacggcgaaaggcgacggaattcgaaatgccatccgagcgacggcatcggcactttttgcatcatcacttttcatgtcattttggaaattgcaacaaataaattgcaaataaatatacc

SEQ ID NO: 95834 - DNA, 634 bp, Heterodera glycines
  SCN-specific regions: Sequence locations=1-634
ggagtgccttagaagtcaaaaaattcacttttatttttgtttttgtgccgtcatttcccattttgtgccaccgcgctccgttcgcttcgttttgtgccgtccaatgcaaaagggaggatgccaagtctgctgctgaacccgggcccgtcaacaatgaactttttctcctcctccctgccgttgccttcctttttcttccgtaaccgaaaaaaatgttacgatttgaacccgccggaagagagccaccaagtgacatacctcggcaacatgttgacaatcatgggcaagggcgacacgtccattgaccgtccgttggaagtgattacgcgcgcgtggggcgccaccgtcgccaaaggcgcgacgcgccacggcgccggcgccacttttggccagcaacaggcgcaacagttggcgatgcgcctgtgcgtgtgccggtctgggctcagggccgagacgtgcattggtgtcactgaatattttacgcaccgaatcacttggtcggcggcgcccagtcaatacccgcgcgtgttctgctggatttacaagcacgagggcaagcggatgaagcccgaactgcggtgccatgccgtgctctgtcgccgggcggacgagccccaacagatgcaccaaacat

SEQ ID NO: 95835 - DNA, 420 bp, Heterodera glycines
  SCN-specific regions: Sequence locations=1-286,308-420
actttctcttccgttggcactgctgggcagcgctgtacgagcacacggcgactgattatccatgaaaaagtgtacgacgtggtgttggaacgggtggtcaacgcgtacaaacagctgatggacacgcgcatcggagacccgttggatgagcgcactttgatcggtcctttgcacagtcgcgagtcggtgctcaaatacaaaacggcgattgccgaggccattgccactggcggtcgaattctgtgcggtggcaaagtgttggaggagtcgaagggcaattacgtgctgcccaaggtgatcactgggcttgcgcacgacgcaccggtggtgctcagagagacatttgcgcccattgtttacgcagtgaaagtggccgattttgaggaggccgttgcggtgaacaacgaggccagccagggc

SEQ ID NO: 95836 - DNA, 475 bp, Heterodera glycines
  SCN-specific regions: Sequence locations=1-475
ggaatacatcctttctgtaacattggtgtactgcgaaagaccgatgataaatcattaatgaatggacagttggcgttaaaggggtgtgaaatcatggcactttatttcggcgctcacatgagtcagcgatgtcgtgaatttataccggtgctcaaacaattctacgatcagttgaaaaaatctcccgacgcagtgccttttgaaattgtttttgtgccctttgaccgttccgaggatgaattccgcaactctttgcgcgatttgcacgacgattggctgtacattccctatgggagtgttcacattaactcattggccgcgaggtttaagatcattaattggggagtcattccgacattggttgtgcttaaggaggacggcactttgataaccatggctggagaagcaaatgttaagtatttgtcggcatcagaagcaatggtccgctggcgttccttgtgaagcacagcagaag

SEQ ID NO: 95837 - DNA, 475 bp, Heterodera glycines
  SCN-specific regions: Sequence locations=1-349,371-475
gtccaattaagccgttcaattccaaaatgggcactaattactccacttcaaattcggctccgtttgattacggaatgacgtcacggaagaaaggcaaaaatcgaacatacgaatccaatcactttgataagaattatctgatcgaaggcaccgaattttgggcagagaacgaatatcgcaaggacagttatttatttgagaggagaaaaggaagcgatcgggcaaattttgccgaaatttacgtaaaaactccggcggagtacggaagtccgcgcgtctcctgctgggcattttcctgctcaccgtgcgcttcttcaaaagaaagtgccgttgccattccgtcccattccctccctccttcttccgccccgtggtcttcaccaattcaaccgaatggtgccaaaagtgctcatggctcccgcccggtgggcgtccgatcgaaatatttgccaacctttgggtgaatttggccaat

SEQ ID NO: 95838 - DNA, 628 bp, Heterodera glycines
  SCN-specific regions: Sequence locations=1-328,350-492,516-628
aatcctttaaaaaaaaatgcacattccaaaaatagaattccccaaagaaattgttccaagtttggccaatttgtcgctaaatcgtcaaccaattgatgaccgtcttttgaagttactcgaacggacgcaaaaggatgtccagcgcctgacgaccgccaaccaacagctcaccaccgccaaccaacagctcaccaccgccaaccaacagctcacgacaacaaaccaacaacagcagaacacaatcaaccaccagcagcaaaacatccaacaactccaaaacttattggccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtgttcagcagcagcacatgcaggagcagcagggtccccctcctccgccgccaccgcagtaagacgttgcaagtggaagtcgaatgatgagttgacgtttgaccttttaacctcttatgttttaacgttattttgtctgatgaagaataaatctaatgcctcgtaaaaaa

SEQ ID NO: 95839 - DNA, 650 bp, Heterodera glycines
  SCN-specific regions: Sequence locations=32-260,282-650
cctcgtgccgaattcggcacgaggcttacgtattcccttttttgtttttgtacttcaaatttactgctaatttcttagaattgcttcacacaatgtcggcgatcgaaaatgacgagacaaagagcagaatttggcagcaactgaagaccaaactccactcgacgatggtcgccttcggaagcgggtcggtgcagttgcccaagctgatggacacgttcaggcatgattggggctccgaattgacttcgtacgcggtccaactcggcttcggctgcaacgacgcggcggtgtacaaaatgttgctgacgatgcccgacgaaattgaaagcggcttcatatcggccactggcaccttcgcgttcaaagtgattccgaaggcggagaccagcgaaaacttgacgaagatcgaccagagcaaccaataccaagatgaaatgcgaagaatatttgcacggcgtcgctcctcaatgtcgagcggcttccatcgttcattccctttcaaccagtctttccatgtgcgtccgcctgtcagaatgcctccaccgccgcctccgatgcccttcaatttgagtgcacccatcttaaacggaccgaaatttccaggacttgtcattcagttgcctaactgtgcggatgcgcagcgtcgcgtt

SEQ ID NO: 95840 - DNA, 261 bp, Heterodera glycines
  misc_feature (261)..(261): n is a, c, g, or t
  SCN-specific regions: Sequence locations=1-206,232-261
aaggtgttgtagcagtaattgctgtttgcatgttcaacttctgctgcttcggtgccatcgccctcatcgtcgtccgttgaggtgccaatgctccgattgaaaattcggccgtgccctcaaaaggtgcggtggtgccaacttcggcctcgttgagattgtcctcgtcaatgtacttgaaagaagcaatttatgacaaaaacatttacgtgtatttattaatccattaaaaaatgtacttttatcattaaaatagcaattatn

SEQ ID NO: 95841 - DNA, 635 bp, Heterodera glycines
  SCN-specific regions: Sequence locations=1-598,620-635
atttgacccccgtcggcccttctgtcgctccgttggctttttcttcgtcttcaaccgatgcttcagccgttgaattgccatatgccgtcccaaactttggcacacccactgaaaaattgttgctgggcggggagctgattgccgtgccaagcgctctgttggccgatgagaaaatctttcgttctgtgctctgtccaaaatcgttttggtcactttcgcaggcgtcgcgcgaccacctcgagcattttcttcccctcccttccatttcgtccgccattaaatcatcgtcagtttctgtcgctcgtcgcaattgtggcgccccgctcgacgagttgctcagttgcgcattcaccagcgacccaaatttttgctttggcaatccgttggccaaattttttgcgcgcattcgaaatggttacttcagttcacccgaacaagtccaactgagggaccaccggcgagtgctgtacgaccattacattcgccactatcagatgaacttgctgaagaccctgttgatcaactcccatgtgctgctcgagcagtccaccatgctcaactcgtttgatgagcacgtacggttgaacccacgcactttttgctccctgagaaagttggccaagcacaaggaagtc

SEQ ID NO: 95842 - DNA, 632 bp, Heterodera glycines
  SCN-specific regions: Sequence locations=1-632
gtttgaggcttatattcgtctggacatttcgaagctaatcacagcagagagccgaatgacagaggagatgcgttcattggtccgtacgcgcaataattttgaggttgaacgcatcaaactcacttgtgagcaaccacttgcccaatcagtcgccgatgcagtgaaagaaagcgaggagcttgtcaatgtggaacagaagccgaaaaaaattccaatatggaggaggaaggattctgaactcttttcaaggccttgcacctttttggaggacacccgcttttatttgctctccaagcggcaaccaatccccgccgcattacgccgcaatggacttacatcgaaagctattgatgccattgtgaaggatttgttcggcaaagcaaaaagtggtgaagcaaagtcgccctcccccatggaccataagccattttctgccaaatcgtccacgaatgccaacaccgccgccaaaacacccgccacggtgggcaagcgcttgcgcaaggcccgtttgcggaaattgcagtccgccaatccgtcaacatccgccgcaaaattgttggtgtctttggagccgttgaatcgcaaagttccgcctcagcttcggcagtgcaattttacgcccaattatgcag

SEQ ID NO: 95843 - DNA, 815 bp, Heterodera glycines
  SCN-specific regions: Sequence locations=1-13,35-728,750-815
caattgtatttcaatttcatttttaaatccattttgccgcactttcgcaaatgccaaaatcgaaacgcgacagagttgtttctctcacaaaagtgaagaagaagagtcgcgagggcaaagaaaacattttgaaagaggtcagagaatgcgttggtcagtacaaacatttgtttgtcttctccacggagaatttgcgctctgcaaggctggcggaggtccgccaacatttcaagcagaattcgcggattttcttcgccaaaaacaatttgatggccgtggcgttgggcaaatcggcacaggacgaacaggcaaacgaattgcacaaagtgagcgcacttttgcggggccaaagtggactgatgttcaccaatgcgaaggcaaacgaagtgcaaaggtttttcgccgagcacaccgaggctgagtttgcccaggcgggcgccgtcgcctcggcggacatttcgctgccggccgggccaatgccggcggaattgcacttgcacggcgccatggaaccgcagctgcgcaagttgggcatgcccacacggctggaaaatggtgccattgagctgttggaggagttcactgtgtgcaagacgggtgaccaactgtccgcggaccaggcccgcattttgaagcagttcggccaccggttggcccaattccgcgtccgtctgctcgcccgatggagcaaaaagaagggatttgaacagattgacggaggagcggaagaatgaatgaataattgttgtgtttttcggatggacccatctaccaatttactttgttaaatttgttttttttatttaaattgaatt

SEQ ID NO: 95844 - DNA, 419 bp, Heterodera glycines
  SCN-specific regions: Sequence locations=1-211,236-311,333-419
gacacgttgaaatgtgttcggcaattgattttgtacgggcacgagaatcgcatttcctgtcttcggtgcagtccggacggaacggccatttgcacggcgagttgggacgcgcccctccgaatttgggcctaacacttcgcattggccattctcttctgatcagtgatcacattttgtatttagtgcgctattgctttaacatccgttcgatttccttcccttttttctcctttttacctcagaaattcggtcccttccgtcaaatcatttttaattctcgtcaaatgttagctttttcggcattttggtcattcttcccctcccccactctctcttaatgctttagtcataatatttcttctattcagttatatccgacttccaattaatctctgtcaaaatagttttaaatgattagt

SEQ ID NO: 95845 - DNA, 478 bp, Heterodera glycines
  SCN-specific regions: Sequence locations=1-270,292-478
gcgcattgtgctaattgacacaaaatgaaccgacgttgggtttgtaccgatgtttggatggacattctaccattttttaaccgtcttcaactcggcctcaaattggcacttctttcgccacgtttcgatgttttagtggacaaacattttgatggcaaatgcgaactgacaatttggagacatatcaatattctaaaaggcgctggaccagaaccagaattatctgtacggattgatcgcaaaactatgaagtttccattgcccgaccgtccgctgcccaccaaaatccgcattaaggaccttcatatcgagtacactgaccattccgtcatcacatttctccgtgccaatcagcaaatttttgacaaaggcatcgatttggatttgtattgggatgatgctctgcatgacaacaacagcgatgatgttcagcaaatttgggatgtttttgcacgtgaaatttggcccatttttgcgc

SEQ ID NO: 95846 - DNA, 473 bp, Heterodera glycines
  SCN-specific regions: Sequence locations=1-473
attttctaacgcaataattctgcaattattcttccctttgtgacatctttcggaactcggccaaaattgtgctaattgcgaaaaatgaacagacgttggatttgcaacgacgtttggatggacattttcccatcctttgaccgtgcccaactcggcctcaaattggcacttctttcgccacgtttcaatgcgttggtggacaaacatttcgatggcaaaagcgaattgacaatttggagatcaatctataattagcaaggacaaaggaccagaaccgaagctgtctgtacgaatcgatgacaaatttgtgccatttccattcccagacgaccgtccgctgcccagcaaaatccgttttaaagaccttcggattgattacatcgatcactccgtcatcgcttttcttcgttcaaatcaccaaattttcgacaaaagaggcatcaatttatatttgtggattccatcaccacaca

SEQ ID NO: 95847 - DNA, 606 bp, Heterodera glycines
  SCN-specific regions: Sequence locations=1-317,340-606
ttacccaagtgattcctattcaccacctacctgctgtcctgttgggctagcgttggcaccaccaaatgcccccgtccgctgacgggcacaggtcgttcgagctgacttgtggacgctgcccaacattacggggcagctgcctcacgagccatgcttttggggtgcttccatacgttggagctgtggtataccgctcagtgctgcacatgttaaagcctgtgtatggctgctgcgtggcaatgtgtcggtggcgggctgcctcgcttggttggttcgctgcgccaatgtggggtgcacgctcgtggggcgacctaacggctgtgttggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggat

SEQ ID NO: 95848 - DNA, 770 bp, Heterodera glycines
  SCN-specific regions: Sequence locations=1-770
gtttgagccaaatgtttcccgctaaatacaaagcctttcgactggaaaataaagtcgcggtgatcacagcagcgacaaatgggattggattggcaattgctgaacgattaggccacgagggagcacgtctggtggtcagcagcagagacgaagacaatgtgaagcgggcgatcgatcggctcgtctcttcgggactgaagcgttcggaccttgccggttgcacttgccatgtgtccaattcggaggaccgaagtcgcctgctgaaactgaccatccaacggttcggaagtgtgcacattttggtgaacaatgctggcatcaacccaattttcggcgatttgttggacgtggacgagtcagcctgggacaaactgttcgacgtgaatgtcaaggcgggcttcatgatggccaagctgttcgcgccagaaattgaacagagcggtggagggtccatcgttttcaactcgtccatcggcgcctatcggtccccccagggaatcgctgcttacggcatcacaaaaacggcactgctaggtcttaccagagctctggcagaatcacttgcacccaaagggattcgcgtgaatgcaattgcgccagggattatcaaaacaaaaatgagcaaagcgctttgggaaggcattgactaacggaccagtgactaagccattgtcacacttatgggacggctgggaatgccggaagaatgtgctgcactcctcgcttttttctgctcttctgacgccagttacataacgggcgaaactgtg

SEQ ID NO: 95849 - DNA, 494 bp, Heterodera glycines
  SCN-specific regions: Sequence locations=1-143,165-409,431-494
ttttaaatgatgtcttcgagttcttttgagcaattatcgtgcgaaattgccgaattggagaagttacgccaacaatcacaactcccaaatgttcaaaaggctatcgatgagctaattggaagatggaaagtgaaaaaggaagaacagaaaatgaaaacggacaaagggacagcggagacactttcagccccgacagaagcaccgaaactgatcagcggaagtgtccacgttcgtccgacaaagaaactgaccacttacgcgtttgatgagagtgacaagttcgtgaagctgtactattccctgcccggtatttccgactccgtccccggcacaatttcgaccgatttccgtgaaaactctttttccattgtttgctccgacgtcaaagggattgactacgaaattcgagtgcaaggactttgtcaggctgttgagccggaaaagtgtgtggtgaagcaaaaaagcggtgaccaattgttaattatgctgaagaa

SEQ ID NO: 95850 - DNA, 356 bp, Heterodera glycines
  misc_feature (355)..(356): n is a, c, g, or t
  SCN-specific regions: Sequence locations=1-356
attggtttgaaattcataatactcaattttatcctcctcattttgcgtgaatcgcaccacacatgtgaatttttcttgagcagagaatccatcaaaatatgcaaatttatgggccaatggcgacaaattttgcgaggaatggaacatctgaagggtggaaaaacatgctggcgcccaaccgtgagcgcccaactgacgtagaccgtttcctccacctgacaaagtgtgccctcaacaaattgccgacaatgccaagcgaaagaaggcacaaataagcggacaattggaattgcatgatgcaaaaagattgatgcgcttttgtatttctcaattagctgaaaatttttgaaaatcnn

SEQ ID NO: 95851 - DNA, 710 bp, Heterodera glycines
  misc_feature (698)..(698): n is a, c, g, or t
  SCN-specific regions: Sequence locations=1-651,673-710
agtttgagtgcatttcctttaatttatttgctttctgaacaattgaaattgcgaccatatttaagcagtttgatgtagttgaagcatgtccttgcagtgcctaacacaggaagaagtgaacacaatttgcaaagacgtcctcgaaaatctgatcggtgcctcaacctatcagcataccgaagcagtaaaatggaaccaaagtgtcgttgagaaaatcaccgccagattggtccagcttcaaaaaccctataaatattgcgtgtgtgtaattttgatgcaaacgggttcgggtgcgggtcttagcgttgcgtctatgtgcttttgggaccgacggtgtgacaattccttcgtcgtccgttgggagagcaaagccgtgaccgctgtttgcaacatttttgcgattgccgtcgactccggcgctgtgtcgcccgtgccaatgatggacaacgacgccgccactgatggggagggcggcactgttgctgcatccgccaccgcaaccaccaacggcggggacatcgtcggcggcggcaaaagcgaatgcgagtgacagcgacaaaaatgtgaccaaacgcggcggacggagggacgggcgcgaacgacttgccatcatttcaatgccccagcaaaaaattagaggaaaagaaatgcaaaaatttgatttgatttttattgattgatttgtgtgtgacttttanatgacgggagag

SEQ ID NO: 95852 - DNA, 581 bp, Heterodera glycines
  SCN-specific regions: Sequence locations=26-581
gggctgcaggttttcggcacgaggatttagctaataattctgcaaatgaagctcttttgcccttttgtgtttctcgttctgctgtccgccactgcttttgcgttctcaaatctgaacaaaacgccaaagactgtccattgggaagacgcgtgcgacgagtgccaattgatcatcaaacgcgttgtcaatgtcgccaccgacccggaaaaagttgctgagttgaagatccttctgtcggcactgtgtcaggagacctcctacgtggaggagtgtcgtctgttcgtcagcaaattggaccttttcctcggccgtctgttgccctttttgagggatgcccaccacgtgtgcaaagaattgcggatttgcaacaacggacggctccaacagtttcacgtgctcggcttacactttgcacgtgtaaatgcttcgttccaacgtaaggatttgatctgcgaggagtgtcaattggctgcccgggaattggcacgtgaagtcagtgagccgaaattccagcagtacgtggaggaatggctgcaggggaatgtgtgtgtccatctcggcactttgaaatcatcgtgtga

SEQ ID NO: 95853 - DNA, 631 bp, Heterodera glycines
  SCN-specific regions: Sequence locations=22-96,128-155,177-201,223 -330,356-631
ttttttaatttaataaaataacagtcgcaatgtcttcaaaaagagttcgtttcaccgaggaaagaaatgcaacagaaagagtgaagagaagtcggacggaagcggcggaggaggagaaaagggaacgattggacgacgaggaggacggaggaccagccgaaacggcggaaggaatgaagacaaaacggacgaagaaacacacgttggactcggacgaggaggacgaaacggagggctaccaacggctggacatggacaaggtggagggtcaggaggagtcgaccctcgaatatgagggacacgtgaagatcatgcctttcaacatgaaagacgatttggaggaggggcatttcgacgcgaacggcacattcatttttgacaagaagcaaagtgtgatcaaagacgcgtggttggacaacatcgagtgggacaatgtgaagaatgcggccgggaaacattggggcaaattggatgacgaggatgacaaaaaggcggacgatgagaaggaagtggagccgaaggaagtgtatcgacgacttgtcgaattgctaaacgaaaaagagacaattggcgctgcgctgaagagactgaacaacgaaaaaaagtcaaacgcagcggaggagcgcaaacg

SEQ ID NO: 95854 - DNA, 624 bp, Heterodera glycines
  SCN-specific regions: Sequence locations=1-373,395-624
tgagaatgttttaaatgttcgctggtattgatgggcagcaaaatcttctcctttccgctcaattacagcgtttactttgccaccacggagaaacggcgaatgcattcgttttctgtcaccaaatgcaaccggagctgcaaaaggggccgacttgcggattcgccgttcttttgatggcgttgcgctgttccgtcggcgatggtacgttggaccgattggtggaaatgggcaaacatttcgggatcacttacaacggcgaactcttttccgctgattggatgtgtgaatttgtccaaaaacattggccaaacgcttgcgaattgcgagtggcccaatttccatctccaaattccatcgtgcggcatttgatttctgggaaaaaagctcatcatcaatgtacaacgacagttttggtgccgtacgattgtgacaaaaatttcgagccatgcaatcggcagggcgttgctgcacattgggcaatcattattggatttgttatttttgatgtcaccgctcaaaatgggccagaaaatcaaaatgcgaaagttattgcatttgacgaaaatgacttccgctgtgatggctttgacaacgaacaccttttgtatcttatagcgcttcagg

SEQ ID NO: 95855 - DNA, 498 bp, Heterodera glycines
  SCN-specific regions: Sequence locations=1-498
attttttcctacattttttgcatttcccgtttttgttcgcaatgtttgagcttgcggaccagtctgacggtaccagcggcataaagcagttgtgggctttgatagacccaatttggaaatttgaccgtgccgaattggtcgactgcatggcaaaacgggtcatctacgagactgatgaccttatcgcactggacaaaccattccaaatggcattttcgtcgggcccggatgaccagccccaacttgacaggattttacaggacttaaagaagcacattgcgcccaaaattgaccggctgtttctcgtcagttcgttggacaaaaactgcagtggcgtcatcgttttcgccaagagccacgtcaagcagttggagatgaaggcccaactgcagaacgacgccctccttttccgttaccgagccatttgcaagggcgtcccgaagttggccaaggcgcgcatttcaatcccattgatcaaggttttgcgcggctccaacc

SEQ ID NO: 95856 - DNA, 344 bp, Heterodera glycines
  misc_feature (344)..(344): n is a, c, g, or t
  SCN-specific regions: Sequence locations=1-189,211-344
cccaagccaattggaccatctcaaaatctgcttaatttgccatgaacaaaaaattcatcaacgcacttttccatcaacaaatgttcaaaaatgcagttcttcttccgttccgccacttcgctgctttgactgccacgcaaacgcacattgatcccgttcctttgtcctttcttcgccaatccgaagatgaaagcgaacagaagacgacgattatgccaaaatggaaggaggagggactgaaaattgagaggaactgctcaaatcgcattttccaaaccattgccaaagacgtaaaattgttgactaattgatcaacatcatttattaatcaatggctaatgacn

SEQ ID NO: 95857 - DNA, 289 bp, Heterodera glycines
  SCN-specific regions: Sequence locations=1-266,288-289
atgcgtttgctgtgctgttgttgctccaacaatgcacaacatcatcagcccatcaaccgggaaggacaagacgaattaaactgaagatttgatttttttgaacgcccgaaaatgaatcatatggcgaagatttttatacaaaattggcattttaaattttttttgatcccacattttttgctttatttttcttcgttttgcaacattttttcttctgcttttcctattctcgccttcttatacaaattgattgtttcaccttctcagaaaagaaaaattcttcttttat

SEQ ID NO: 95858 - DNA, 491 bp, Heterodera glycines
  SCN-specific regions: Sequence locations=1-11,33-491
aaaaaaactacccaaacaaaataaaaatacaatagacgcacggggcttgtaccatacaggtaaacacaacaagaaaccaagccgagctatcctggaattgcctggatggcaatgggatagagtacctataccgaaagacccaacggaagaatgtggtaaaatagtttttgaaattaaggtagatgcaaatggggaggtggttgcagttcgaaccatagagaaaaccattacgcccctcgtagaaaaaatctatgcggatgaactgcgtagccttacgtttagcaaaacaaaccataataatgcgtcttatcgtaacctatctacaggaaaagtgatcttcatactcgtagcaaagtagtagctgtttgctcgagggggggcccggtacccaattcgccctatagtgagtcgtattacaattcactggccgtcgttttacaacgtcgtgactgggaaaaccctggcgttacccaacttaatcgccttgcagc

SEQ ID NO: 95859 - DNA, 494 bp, Heterodera glycines
  SCN-specific regions: Sequence locations=1-494
attaagcaaaaatgacttccaattctactgatggttggggatgtaacaacagtgggtggggtcaaagccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctactgacggttggggatgtaacaacaatggctgggctccgagccaagcaaaaatgaccaattctactgatggttcgggatgtaacaacagtgtgaggggtccgcgcgaattttctcggagtttcagtggacgcccaggatttaatcgccaacctgtgcctctaatgaacaagttgcctccaattcctccgtccaca

SEQ ID NO: 95860 - DNA, 630 bp, Heterodera glycines
  SCN-specific regions: Sequence locations=1-630
cacaattaataaatttatttgacaaatgccactttttcttggcattgacctcggcacaacgtcagtgaaaattgccctaatcgatggagacaaaaagacatttttggaatgggacagaaaacacaacgcattaattgagagagaggagaaggacaaacacgaacaaagcccaaagaaaatattggacaccgtacagaaattgatgggagagatggaaacggacaaattggcacaagtgaaaggcattggcatttcgggacaaatgcacggagtgatgctgtgggaagccgactcaattggtttgggcgtggaccgttgccactgctcccctctgatcacgtggatggactcgcgctgcgacgagcaattcctgcggaaactgccaaacatccctcttgactcagtccaaaagtgcgtttatttcctcacaaaatgccgagtcgtggggtttcgtctccgacttcatttggaccgtccaacagataagctgattgatgccctccctctgtttcccatttcattttgcttttcctcacgcccatttccccactcatttgctgccctccatcgtttcccccggcactttcattggccgcacttcgcttcccttcgcccatttgccaaaaggtg

SEQ ID NO: 95861 - DNA, 118 bp, Heterodera glycines
  SCN-specific regions: Sequence locations=1-81,104-118
tgggggatcgggacaaccaggacaacccggacaaaatggagttgtgtataagaccgttcctggaccgaagggacaacccggcccaaccctgggagcaccccggggaaccaggcctggg

SEQ ID NO: 95862 - DNA, 773 bp, Heterodera glycines
  SCN-specific regions: Sequence locations=1-773
ggtaattcaattactacaaatttctttttcaacttgaaaaaatcgccgctatggccactaaagcaggaattttcattgtgagtgcaaagcgctgcgctttcggtgcctttggcggctcactgaaaaatcacacagccaccgatttgggcgaaattgcggccgctgcggcgcttaaatcgtcctcaatcgcggctgagcacatcgatcacgttattttcggcaatgtcatccaatcatcgaaggacgcggcttatttggcccgtcacatcggcctccgagttggcgttcccgtccatgtccctgccgttactgttaacaggctttgcggctcgggcttcgaggcgattgcgcagggaggccaacaaatcctcgcgggtgactcaaaggttgttttggcgggtggaactgagtcgatgagtcaggcgccgttcgcagtgcgcggcgctcgcttcggcacacagctcggtgccaagattgagttcgaagacgtgctttggcaaggacttaccgacgcgccacgcgaacatgccgatgggaatcactgcagagaatttgggtgcgaaatacaatgtgacacgagaggaggccgacgcttatgccattcggtcgcaaaaccgctggagactcgcaaacaatgccggctatttcaagtccgaaattgtgccggtcaaattgcagggcaacgcgcgagggaaaactgtccaggggaccaacccccgggaaagcaccgccgacaaatggcagctgaaaccgttttaaaaaggaggcctctc

SEQ ID NO: 95863 - DNA, 338 bp, Heterodera glycines
  misc_feature (338)..(338): n is a, c, g, or t
  SCN-specific regions: Sequence locations=1-91,129-138,170-338
gtcaaaatgaatttgttttcattgactccattggtcctctgttccctactttttgttggggcacctgttgtgcaaagtgccggaaaagttgcgccgccgccgccaccaccgccgcctccccctccgcctccagcgtacgagccaccagagccgccaagctatggcgcccaaccgccaccccaaccagcgtattagcctccaccaaagtcgaaaaagccgaattgatgagaacgagatgagaaacaacattttcccaattttgaagatgattaaatttctttgtgctcgattatttaacaaattatgaaattggctgtttaataaatatttgaatgacn

SEQ ID NO: 95864 - DNA, 228 bp, Heterodera glycines
  SCN-specific regions: Sequence locations=1-50,72-228
tgccttttcatgacataaaagcattaaagatgaaactgtggttagccatccaaaacaaaacaatcgattgggcctcacaacatctccacacacaataatatatacttgttgagcaagatactacacgttactctctctcaaagaaaagaatctaaagtagcaaaactttaacaaaagagcttcaaatttgcttcggaccttccatttacacaagctcctacctcaagc

SEQ ID NO: 95865 - DNA, 479 bp, Heterodera glycines
  SCN-specific regions: Sequence locations=1-479
ccgacgcggtcgcaaagcataaaaaaagtgactgaacatggcagttcgttgaagcggggccccggcggaagtttgggcgcggcggacagcagcggggcaatttcgcaactcgccattccgacggtgggggcgctgaaggccagctcagccggagacatcgcgcaacagcagtctccccactcttgcttggctggaaccagctcgacctcatgtgttgagctgaacgcggaggcggaggagcgacgcctggtcgagctggtggagaagttcgacatggactggggcagcgatttggaggttgacactgaaattccgagtctcgagtcgctggtcagttgggaaattctcaagcatctgaagccaaaagagaagaagcgccaggaagtggtcaacgaactgtaccaaaccgaacgtacccacgtgttgcgtctgaaggtgctttacaaagtgttctatcggcccatggttctgcagcgggt

SEQ ID NO: 95866 - DNA, 908 bp, Heterodera glycines
  SCN-specific regions: Sequence locations=1-36,64-86,108-112,134-908
ccgccgtttcgcttccacaccgacaccgacacgcacacttgacttgacttgacgacttgacttcaccaccaaatcttcccaacatgtttggcttccgcaaccccgctggctccacccacaaccccaacatccttgtcactgaaggcgacacttggaccggcttctacgctgcctggtcgctcttgcgccaccaccgcggcggccacgactcgacctccgcacccgcgccaaccggccaacccggcatcaccccgacgcaccacggccatgtcaacaaggtgattgtcgatgtgcgcgactccaactcggactttgccaaggaactgcacaagctcggagccgagttgcgtgaatacgacccctacaacatggacaaggaccagatccaaaagcacctgctgcgcaacgacgtggacggcgtggcctttgttcccgtgcacgactcgattggccacatgatcaacatcaactagatgctgctgcgcgcctttgaggaggaggagcggtgcaagtgccttgtcatgtggtcgtcgattgggacccagattcatccgggcagcggccacgatgacgacgaggatgtgcttgccaagagcaagggcaagtcgacggccacgcggacctcggccacgggcggcggcatgccctcttggggtcagcttttcgagaacaagtcgcagattgaagggccgtgaggaacagcaagtttgagcacgagtgtatcttgcgcattggctttgtctcgcaacaattctttggcctctcaaacgtgatccagtcccgcggcatgttccccgtcacgtcgcgctccaacaagtgggctcccatcaacgccaaggacgtggccatggtctctggtgctttgctagccaacccgtcgctcatgtccaagttcaccaagcaaaccc

SEQ ID NO: 95867 - DNA, 494 bp, Heterodera glycines
  SCN-specific regions: Sequence locations=1-494
attaagccaattaattcatccgtaaattattcaaatcattccgccgatggcatcaattgtggacagcgcaaaagtgaacaattttggaattggcactgttgttgagccgattctcgtcaataaaaatggatccaccggcggtggcggacggaggaaaaataaaactctgttcggcatttcacaagcagtgcatgccgaacatcctcaacagcaattgtccgaattcgctggtggcatttcgcctgtcgacgccgtgccaatgccaaccgcggccaatgactgcaacaataattccatcgaagacattcaatcggaccgccgaaggggcccaattgatccgacaaacttcgaccatttggtccgtctgagtgagctcatccgttccatggccgaccttggcactttgcagcccgagttcggcataatctgtggctccggattgggcgcaattgccgaccaaatggagggggcgcggattttgcctttctccgagg

SEQ ID NO: 95868 - DNA, 148 bp, Heterodera glycines
  SCN-specific regions: Sequence locations=1-148
attaccagcatatgtttgtgctgttcgagtggcgagtggggcgcattgtcggcgtgttcaaccgctcctccgaggcgttgttcggcgcgttcgagcggcacaacgagcagttccgcaacgggcacattgtgcgcacaatgttccccac

SEQ ID NO: 95869 - DNA, 622 bp, Heterodera glycines
  SCN-specific regions: Sequence locations=1-235,258-437,459-622
gtgtacaattatttaaagaaaacagcgctttctgttcttttctcgcttcaaaatgtctctttttcttcttcgtgctttgcctcttttcttccttttctctctgtgcttcgctgcctctcccttcaattttcgcgcaaatcattcgcttggtgccgaaaccactcaacagattgtgcccaccgtggcgactgaaacgaccgacggaccgaagcctacggaaaatgttccccttatgttggagaatgacaatgtcaccgaagttgccaaagttgaaggacggaatgccagtgacagcgaaattgaaacgagggaggaccaagcctttgccaacatcactgctcattcctccgacaatgcttcgcttactgagagttgtggcttcttttgccgaaacgtgcctttattcgtcggcttcatcttgaccctcgtctgcgtttctctgctcctcattctttccattgttttgtaccgttattttacgcggcgcacttacgccgacgagtgaaaagacagcgaatggacgcaaagaaacgatgattcttcttaaaatgtcatttcattttgttgagccatcaatcaatttgttgcttttcccttttgttggcctcctttttgaggcctt

SEQ ID NO: 95870 - DNA, 518 bp, Heterodera glycines
  SCN-specific regions: Sequence locations=1-81,108-222,252-492,515-518
ctacactagtggatcccccgggctgcagttaatcaggacgaggatttaaatttcaataatggaccaacttatcagtgggcttctcggaggtggcggcggaggaggagcaaattctggtgataatcagccgcagcagggcggcggaggcagtggcaatcagttggcagatatggccggggaattaatcggaggatttcttggcggtggcgggggaggaagcggcgccttgggaggaggcgcaggcggcggggacattctgtccacgctgttcaacgcggtcaaaggcggtgacattggcagtcttttgggcgctttggccggcggcgcagatgtgaacgccaaggacacatcgagcggcaacactctgctgcaaatggccataatgacggggatcaccgaaattgtgaagcttctgctgaaccgcggtgcgaatgttaacgcgacaaacgctgagggcaaagacgcggtgcgaattgcgcaagagcaggcggaacaagcgccggacgaggacagcaaag

SEQ ID NO: 95871 - DNA, 534 bp, Heterodera glycines
  SCN-specific regions: Sequence locations=1-534
gtccaattaagtgtttttttaaatttatatttctttgctctgcatataacaatcaacgagagaaatggggaattgtaagcccgcggatgccactgagtcggagaacgcgtcttctgtcgagacggttgaagttgaagtacctccggaccctctcgttaacccattctggaagatgcaaaaagccttcgagaagaaactgcgtaatctgttgaagcgtgagaagaagcttttgcaactgaaggaagaacgcgattccgacaagccgatcactaccgaccaacacgaggctctcagcaaattggacgaagttaaaaccctcattgggttcgttgatgagatgatgaagttgaaccagcagcagttcagccagtataagaaagccatcaaaaatcgtgaacgtcaactgaaaatgcagaaggcgcgttctcaaaccggacagcaatttccgagcagacaaagttatgtccattgttttaactgattgtttgatgagtaaaggaaagcgaatgatttgggatagaattttgtaatttg

SEQ ID NO: 95872 - DNA, 605 bp, Heterodera glycines
  misc_feature (591)..(591): n is a, c, g, or t
  misc_feature (595)..(595): n is a, c, g, or t
  SCN-specific regions: Sequence locations=1-244,266-605
cctttgagcctttcgatttgttccgtttcggtgcagtgaatctcgacccgctgactgagacgtacggattgcccttttatttgcattatttggtgaattggcccgattattttatggtcgctgaacatctctccggcgaccttatgggatacataatgggcaaatcggaggggcgcgaccaaaattggcacggccacgtcaccgcggtgagtgtggcgccggaataccgccgcatgggcctggcggccagattcatgcagaagttggagttggtctcagagaaggaggactgtttcttcgtcgatttattcgtgcggattagcaacgaaacggccattaatatgtacaaacggttgggttatacggtttacaggcaaattgtcgattattattctggcgatgacacccacgaggacgaagatgcattcgacatgcgaaaggccttgccccgagacgtggacaaaaagtcagtagtaccgctgaagcaccccgtgtcatgcaatgagatagactttgactgaatttccgtttttgtttcgtatttaaaatcaacaacgatgaaaaatatggataaaaattcattccttttcngganagaaaaaaaa

SEQ ID NO: 95873 - DNA, 191 bp, Heterodera glycines
  SCN-specific regions: Sequence locations=1-145,167-191
atggcattcgggtttgtgccactgaatgcttttgtggcgatcactcggagaaacggaattgttttggtgagaaacacaacgtcaaaatattaccatcccgccagaatacacatccttttggttgatcaaaacgccatttgatcaattgttgttgttgttaattttgtttttttttgcaaaatttgaattat

SEQ ID NO: 95874 - DNA, 400 bp, Heterodera glycines
  SCN-specific regions: Sequence locations=1-49,71-199,223-350,372-400
ctttacgacgatgggcagcgcgagactcggcgaggcgcaacgaaagcaacttttggagcctttgctgaaggagggcgggtggcaaatggagcagggaagggatgccatcaaaaagagcttcactttccgagactttaacgaagcgtttggcttcatgacgcgcgttgcactaaaggcggacaaaatggaccaccaccccgaatggttcaacgtgtacaacaatgtggacataacactgagcagccacgacgtgcagggcatttccgagagggacgtggcattggcatcttttgttgaggatgtgttcaaagcgatgaacttatgatgatgacgataatgaagtgttatttatacaaattattttcatctcaaacccgaatgcgaatataaattcatttca

SEQ ID NO: 95875 - DNA, 644 bp, Heterodera glycines
  SCN-specific regions: Sequence locations=42-213,235-644
ctagactagtggacccccgggctgcagattcggcacgaggctcatgaaactcaattgattttggacgaggcccggctttttctttcaatggacgacagcttcctttggggactgaacattctgagcatcttcttgccaacttccctcagtccggcgcaacacgatgaatttggcgctaaactgagtgaataaattgtggttttgttgtgcagcccaggcatggaactgaaagctttcgtgcgtgcttttccatactcggtgctcgactttttgccagacgtgttgatggcttgtttattgcatttcaaagaaaaaataaaaatgatcatttataattaattaatggtttgtttgtcctccttccaattgtaccaccatttcctcatccttccgttccaataaagcttcatatgctcgccatgaaacacaacaccaacaaaagtgaacaaacaaaggccgagaccaagttgagggccaaaccgataaaaattcatgtattggtctctgaataaaacagaatttggacgtgatttgttaatctattcgtttacgcatccaatcaacgaccatactcagtttcttaggtcaaacattttccttacttgatcaaggcctacattcttggcatcaataaaagcttaggt

SEQ ID NO: 95876 - DNA, 690 bp, Heterodera glycines
  SCN-specific regions: Sequence locations=1-49,72-98,157-162,216 -216,281-299,357-357,446-446,522-522,612-690
attcattccaccttcttccacttccatcatcatacatatcttctgcgaatcctccctccccttcttcctccgctgatggccaaccccaactccgaccactctctccccctttccccctctccctctccttcccattcttcccactccttctccctccgttctgtttttgcccaccacttttgctttttctgctcaaattctgtgctcatcgccctagtcgtgttcactttgtcactgctaatggcatttttgctggggaaacggcgctcttcgcaaaacgcattggcaaaacggcgcagagacaaatcgccagaaggcattgaattggaggagaatcccgaggtgttcaaaagttcgttgctgaaggactccaaagaacacatcatcagtacgtactttcctgatgtgcgcacacttttcgatgctttccaacgcggtctcaaagttgccgaacattcggcctgccttggctttcgtccggcaaaaggttcgccttaccaatttctcacttacgctgaggtagccgttcggtcgcagtcctttggccatgctttgatctccaaattgggccttcagcccggcaacgaaacatttgtggccatttatgcgcagaactgtcccgagtggatgatcacggcgatcggctgtacccgccactccatggtcattgtgccgttgtacgacactttg

SEQ ID NO: 95877 - DNA, 448 bp, Heterodera glycines
  SCN-specific regions: Sequence locations=1-77,99-378,402-448
ggtccttgaaataatgcaaggatcatcggcacgttcatttttaaactttaagaaaaaattgcaacgaaaagaagacttggagaaggaatttgtggagagtggtgagaaagaccgggtccaagaggttgtggaacgacgacttcacgagtcggggtgggcgaaacgagtggagagcatgtgcgaggagtacatcgcgaagaagggctatgaacgcgttgaactgcaagcgatggttgacgagctgaaggatgcctcgcgtcgaattgtgccggatgaagtgaagagagaactcatgcagctgattcaggaatttgtgaacagccgaacatcgacgggcgaagggtggtgataaaagacggaaactcattaattttttaattgttttgaaagacagacttgctttcgatttcttattacgaatcgtttaaatcaaaacatttaaaaaaaa

SEQ ID NO: 95878 - DNA, 450 bp, Heterodera glycines
  SCN-specific regions: Sequence locations=1-87,109-450
tcatcgtttccttgtgcctcttaatttcggtcaaaattttacgtctgacaaatctcgacattttgtttcgtattcgggacgggcttagaagtgggaagccatttattacggcactttttcgggttgacattgaatctcagaggcatggcggtgaacttgtggccgaagttttgaaggcccatggagttcgcgagcttttcaccctgtgtggtggtcacatttcgccaattttggtcgcctgtgaacaaattggcattcgtgtgttggacacgcgccacgaggccactgccgtgtttgccgcagacgcggccgctcgcctgcgccaggacattggggtggccgcggtcaccgccgggccgggcatcaccaacacagtgaccgcgttgaaaaatgcccaaatggccgagtcgccggtgcttttgttgggcggcgcgtcgccttcccttttga

SEQ ID NO: 95879 - DNA, 613 bp, Heterodera glycines
  SCN-specific regions: Sequence locations=1-613
tattagttaacgacgccatcacaatgtgatgatgacccattaggaccacatcgaaagtttcattcatttcgttcgttcgatttccatggaatgccctccgggttcttcgttcgacccttccccgtctccgtctgtcgcttctcagccgttttccgaggaatgccattccccggacaaccaaatttctcttgataattctgtgcctgaggaaagtccgaatggaaatgccaacgtttgcatgggcgaggcaaagccccgctgggggccgacccatgccggggccaaacagttggcatcgatgtacggcaaagggaaacgactccaagaagtcacttgcatttgcgttgcgtcagccctttttctgtcggtcggctgctccctcctttaccactttcggcttgtccccgtcggtcagctcattttggcatccctcgtcggtgtgctgatggccgatttcaactcgggcgtcgtccattggggcgcggatacgtggggaaccgtggacactttcgtcggaaggaattacaatcgttcgtttcgtgaacaccacgttgactcgacagcgatcactcggcatgatttagtggaagtgaatggagacaattttatgctg

SEQ ID NO: 95880 - DNA, 648 bp, Heterodera glycines
  SCN-specific regions: Sequence locations=1-623,645-648
gtccaattaagatttgatctgcgtcaaatggctaatgattctcgcagttcttcgagcgcttcctcccgttctcgctcgcgtagtcgcagtcgttcgccacgccgtcgcgagcagcgtcggcgccgctcgcgttccaccttttcacgttctccatcacctggccaaaaacgactgcacatcggcaatttggacgagtcggtccgtcgtcgggacattgaagacgtttttggaaagtatggacggatcagcgactgttggatggccagttaccctcccttctacgctttcgtcgtgttcgaaaacaacaaagatgcgtccgcctgcatgaaagacttgggcaacacggcgtacatcaaagggtgtcgtgcgcgtgttacggtggctcttccaagaaaaggatcttcacttgatgccaattcaatgaatggtgcgacttatcgtcgcggaccgccgcctcctccgcgacgttattacgacgaggaggacagtcaccgacgccgtcgtcgttcgcgtactcgctcgccccgtcgtaggcgctcgcccagtcgctcgcgcagtcgcacaccgccgcgccgcagtcgttcgcctcgtcgttcggcgcgtcggcagcgctcgccgtcgccgaagagagaacccagaaacagggga

SEQ ID NO: 95881 - DNA, 548 bp, Heterodera glycines
  SCN-specific regions: Sequence locations=1-548
aaagctggagctccccgcggtggcggccgtttctcgaactagtggatcccccgggctgcaggaattcggcacgagggtttgagaaaaacgttcaaatgtttcgcttttcgctgcttctgctgcttgtccctctcgtccgctgtgtccccaacccaaagcctttgttcggaattggcatcggtcgcaagcaaagcgcgggagcggaggggaagctgacctgcgctggagagccgttggcggatgtgaaggtgaaactgtatgatgacgaccgcggggtggacacggatgatctgatgggtgagacgagaacggactcagagggacgcttcagattggaggggtacacgcacgaaatcaccaccatcgaccccaaaattaacatttaccacgactgcaacgacgggctgaagccatgccagcgcaaaatctcaattatgatcccggacaaatacatcgcctcgggcgaacatcccaatacatattacgacgcgggcacaatcgaattggagggcaaattcagtggcgagacaagggactgtctgcactaa

SEQ ID NO: 95882 - DNA, 474 bp, Heterodera glycines
  SCN-specific regions: Sequence locations=1-391,413-474
taagaaatcagcaaattcaatttaatttttctacctaattctttaaaattcttttcttttttccaccaaaaaatggtgtttttcatttgcgaccaatgcggcgagaccatgaagaagaagcaggtgctgcagcacatccaccggtgccgaaacgcgcactattcgtgcatggactgccaagtggtgttcgacaaaaacagttaccaagggcacaccaaatgcatcacggaggaccaaaagtacggaggcgcgagacatgtgccaaaagtgaacaagggtgaacaaaagcaggacgcctgggtgtcgcaagtgcgtgccgccatccgtcaggtggacgagccgcggctgaagaatttgttgcgctccgtccaatgccacaccaacataccgcgcaaggaggccaaatttgtcaactttttgcaaaattcgttgcgcattcgggaccgcgcgttgtgtgtggacgcgtggaatgca

SEQ ID NO: 95883 - DNA, 590 bp, Heterodera glycines
  SCN-specific regions: Sequence locations=1-91,114-120,142-245,269 -485,507-590
agattttcgtcctcaaacgtcggttgtttttccgccgttaaaatgaccgcagcggcaaaactcagccgtttcttccgccgtttggtgcacgtccgacagatggactttgaattcgctgcttggcaaatgctttacctgctggtcaatccgcaaaaggtgtacaggaatttcatgtacagaaaaagtttgttgtccctctcaattaattcattaatttctaatttcgttcagaagccaaagatcaatgggcccgcgatgaccccgcctttctcctccttttggcactttctctgctcggctcgagtgttctgtttgcattagcgctcaatttgtccttttcttcgttctgcgcctttttcctttgggttgtgttcatcgattgcatcggaattggcattgccattgcaaccgcactttggttcatttcaaatcgctttttgcgtcggacgagggattgcgacgtggtcgagtgggcctattgcttcgatgtccatttgaatgcttttttcccgttgctcattcttctccacgtcattttacctttgcttttctacggattggttgattaccaaaattttctcgcccgcttt

SEQ ID NO: 95884 - DNA, 471 bp, Heterodera glycines
  SCN-specific regions: Sequence locations=1-471
gcggccattccgcttccatgccccgagtcgttgttgatgaagaaactgactgtgcaccccgacattatggacattgtgagggagttggacgacaaatgccttcgatctattgaagattcttattttgacagaatgggtcaaggcccaacctatcacactgacgaaaatgcccaacgtcctgaacttctcgacgagaatggccatcgttacgtcggcctcttcaaccaagcgatgacttgctatctcaattcgctgattcaaacattgtacatgacccctgagtttagaaataaagtttacagttggaaattcgtcgacacgccgacgaatgaggacaataaaaacattccttaccaattgcaaagactgttcttgttgctgcagaccagtgagaaagcgtcgctggagaccaaggagttgaccaccagttttggatgggtgtcaaacgaagcgtttgaacagcacgacgta

SEQ ID NO: 95885 - DNA, 566 bp, Heterodera glycines
  SCN-specific regions: Sequence locations=1-199,221-427,449-566
gtttgagttattccagcgttatgaaattctctcatgtactcgcgaagggcaaggttaatttgaacgcgcacacttggttccgacgcgtctgggagaagggctattctggaccgccactgccaaaaattaaacgtactggaaaacctcccgtgccggtgacaaatgaggcggtcaacgaagtgcggacggcactgatgcgggaatggaatgtcatgcagtggctggccaacccgtacctcaacgcggaaaaggaggcgccatatttggagcgtttcggggacatcaatgacgaatggacacagcgaacggtcgaggcgaaacatcgcaaaatgcccaacaaaccgaaaatccggcaaattgcatctggcgaagtggagaagagacgtgccaatgttggcaatttgttacacgctcatcggacggtggaggacgaactgaagaatttggagcgcagaaaccgatgggactgaacaatcgatcacttcaatttccttgtcatttcaacaaatcattgttttagttctacttatatttgctggccacataaaatggggttgttcgaaaaa

SEQ ID NO: 95886 - DNA, 829 bp, Heterodera glycines
  SCN-specific regions: Sequence locations=1-328,352-829
gtttgaggtggttataatcttttaattaaaacaattacgcaaaatggtcacccaaaacgaccatttgatggcaaatttgtccgaccaactcacaaatctgcaaaaggaattggacacactgaaaaaggacatgacggcgaacaacgacgcatttttcaattgtgccatggcactgatcatttttctgatgcaatgcgggttcgcctttctcgaagctggagcagtgagaagcaaaaactgcacgaatattatcatcaaaaatgtgcttgattcgcttctcggcataattgcttatgcggcggttgggtgggcactcgccttcggctctaaccctttgcccgtgttggagccctatttcggcttttcccaatttggaatggtcggcaccacggaattctcaaagttcttcttccaatttgtgttctgtgccactgcctccaccatcatttcgggtgccgtggcagagcgtgccgagttcgcctgtttcatcacttattccttggccatcaccgccttcgtttaccccgtgcttacccactggggatggacgaaacagggttggatggcagccagcggatttgtagtcgacgacgctcaccaaatcacttacgtggactttgccggctccggaatggtccatgtgtgcggcggcactatctctttgatcgccgccgcactgatggggccaccgatcggacgcttcccggagaggacagtcagcgtgccggtggggggaccgaggcggaagcagaacgagcccaaaagtgtggagatcaaacgacattcagtgccgctcgcctctatgtggggcttcattctgatagccgga

SEQ ID NO: 95887 - DNA, 449 bp, Heterodera glycines
  SCN-specific regions: Sequence locations=1-57,80-158,180-449
caagtttgagatttttaaacacttaccaaaaaatgttgggccacttttccaaacttagtgttcgttgctacgcttctgccactagctttcgtccgttcttcgaccgggtgctcatcgagcgttttctgcccgaacaaaagacgaagggcgggattatgattcccgagaaggctcaggggaaggttctcgagggtactgttgtcgccattgggcccggttatcgcaatgacgaggggaagacaattccgatgcaacttcaaattggtgaccgtgtcttgttgccggagtatggcggtgctaagatcgtcatggaggacaaggagtaccacgttttccgcgaatcggacatcatcgggaaattcgaatgagtttgtgaggcggtctctgattttatttgtttttgtttgaatcattttttactattgataaattgttgtcactttcaaata

SEQ ID NO: 95888 - DNA, 571 bp, Heterodera glycines
  SCN-specific regions: Sequence locations=1-108,130-571
gtttgagacatctctttcgcgcctcattaaatgcatattcaaacggtcccgtaattgcagaaaacattataaattcgttgaaaagaaatcgagaaatggggaaggagcaacagaaacaacaaaacaaagaaaaaaaggttgccgcacaacagcagcaaaacaccggagatgaagcggggactaagaaacagacaaggcttgggttggatgtgacaaagacggagaactattccgaatggtattcccaggttatcgtcaaggcagaactaattgagtattacgacgtgtccggctgctacgtcatccgtccctgggcgtattccgtgtgggaacacatccaagcattcttcgacgctgaaatcaaaaagctgggcgtcaagaactgttactttcccatgttcgtctccgctgctgcgctcgaacgcgaaaaaacgcacgtggccgactttgccccggaggttgcttgggtgaccaaggccggaaacaacgacttggccgttccaattgccattcggccgaccagtgaaacggtgatgtacccaacctttgccaaatggtgcaaatcacacag

SEQ ID NO: 95889 - DNA, 474 bp, Heterodera glycines
  SCN-specific regions: Sequence locations=1-18,49-474
gtccaattaagttggcggtttaataataaatttatttaaacaattaatggcagcggcaacaacaacaatgccgtcattttattttcacaaacatttttttcaacgaatttttcctggcaaaccttttttcgtgcaagtattttcggcaggcgttctcgcagcaaccggcgacattttgtgccaaaaattcattgaaaagcgcgacaaatgggacccatttcgcacgtcgcgctttgctctgacgacagccattgtcattgcacccatccaatttcattggtttcgcttcatggaccgacgtattggcaaccccaaaagggagggcccggctggcaaagtgacccttcagacggggctcaagcgggtgctggtggatcagagtctgatcgcgcccgctttgaccgccgcctttttgttttccgtcaactttttggattcattttccacacaaaatgcgattcagcggacaaaacg

SEQ ID NO: 95890 - DNA, 242 bp, Heterodera glycines
  SCN-specific regions: Sequence locations=1-242
tcgacgagcccctttttctcttcagctctttttggcactgaaatatgcgagcgaagtggcgtaagaagcgaatgcgtcggctaaagcgcaagcggagacaggcgaagaaatgagcggacggacggagagaaaactcagccgaacgcggaaacggaggcgcaaaatgttgttgctgtttttttgttattgttgtcaaccgcccctttactcagataaaatttgttgcaataatgatggaaaat

SEQ ID NO: 95891 - DNA, 230 bp, Heterodera glycines
  misc_feature (168)..(168): n is a, c, g, or t
  misc_feature (210)..(210): n is a, c, g, or t
  misc_feature (212)..(212): n is a, c, g, or t
  misc_feature (219)..(219): n is a, c, g, or t
  SCN-specific regions: Sequence locations=1-112,136-230
gttcggttaaattacgtgctgggaagaggtggaaagagcgttggacgaattgattgagcaacgccgccagcggggcgtactgcccgaggtaaccgaatgggtaccgcccgctggcggaggaaggaggagagggaggtagctgcaggggaacctcgttcttcccgaaancagtctggttttggttgacagacgattccctttttccgcatnanagctaanacgacgaagaa

SEQ ID NO: 95892 - DNA, 466 bp, Heterodera glycines
  SCN-specific regions: Sequence locations=1-466
cgagcagtgtccgacagacggaactgtctttggagcgacacgagtggcaaacggtgatgtgttccaatggagtgatcgcgtgttggcacccgcccaaacaattcccatttgagcactcgcgcacctttaacatggaaaaggcaatgtcagaaaaagagaaatttcttaatcgtaaacccgatcaaactctttttacaacggcgcccgatgataatgcgctttgcgaaattttccacaccgaaaagcaggaatggaggccgatatatcgagagaagcggctttacaatgcgaaagttgaagatcaattgaagccgattctttccaatccgctggaaactccgactgcccctgtcatcacaaaaaatgtcgaaaacgaagcccatcgaattgaacagggagtcaatgaagggaacaacccaaatattttgtcggaatgatatctcattctacggttaaatttcttcga

SEQ ID NO: 95893 - DNA, 705 bp, Heterodera glycines
  SCN-specific regions: Sequence locations=1-399,421-484,506-564,586 -669,691-705
ccaagtttgagacctttattgaaattgagtacgctgtgccaattgtgcggcgctaaatgcgacaaaattggcgcaatctttggcaaattcctggcaaatttttcaatgtgagattttggcggaaaaagccttttcaaagtgctcgccgacagtgcctttgagaagccttcgttggtcgacatctttttctcgtctaaattattccaagcttctctgaatgacgcatgtgaagcattgatcagaacgcaatcgcaacaatttaagctgcttaagaagcgcaacttcgacgtgatcatttccgagcagctcaacttttgcggcgcgggcattggccatttgctggacatttccgtgaacattgtgctcagcagctgttccctccaagagcaccttgcttcgctgattggccttccgtttccctccagtttcgtgccttcattgatggattcaaattggtccgacaaaatgtcgcttttacaacggttccaaaatttgctacacaaattcgccggctacaattatctcagttttggcatcgacccattgacacaaattttccgaaaacattttggaaatgcttttcccgaccttcgttcaattgtcagcaaatcgccgctcattttcgttgcttctgatgaatttgtggactttcctcgtccccttttttccaatgtcatttatatcggtggtcttggaatggagaaa

SEQ ID NO: 95894 - DNA, 393 bp, Heterodera glycines
  SCN-specific regions: Sequence locations=1-146,168-249,271-348,370-393
taaggtaatttggatcccaaaaagaatttggggtgaatcgttggcatttgctggaattttaattgggctgcactttgtttactactcaatgcaaaacaacccaaatttaataccattgaatgatcgtcgggaactgatttatgtgaaatggatcaaagaaaaattcccgtcattgggttgggttggcattgacgacagcgaagcaatgaaaagaagggaacggatcatgggacagaaagagcaatagacagaagaagaacagaaaaagaatggccaatcggagggaccgatttattatatttatttgtgtttccgttccattatatgtaattgaaagctgtttacatgtagaaagtagaaacaaatgaaatagaaacagcaaactgttaaaaa

SEQ ID NO: 95895 - DNA, 273 bp, Heterodera glycines
  SCN-specific regions: Sequence locations=1-19,41-89,115-248,271-273
gacagtcagagtgatttcaatttcaatgctttcttgggcaagccggacgagttcagcaaggaagtgacggaaggcgctcttttcgatttcaacttttgagctttttctgttttcatttggctttggttgtgctgtaactgttaattctattttaatctgcttatcattatatttggccattttttctttgtttagcattgttttgttctggtcatttcatttgtgtaagtaactctgtatttctgttatttttcccaataaaatcattttttc

SEQ ID NO: 95896 - DNA, 278 bp, Heterodera glycines
  SCN-specific regions: Sequence locations=1-69,143-278
aaccatcgcccgacttttgcaattgggatttcggcaaagagccaagaaaatgcgttttttgcattgcgaaagaagaggaagaagagtgggaagaagaagaggaagaggacaaagaatgagtggaagagagagaatgagaagacggggggagccgcgaaacaaaaagcaaaacttccagaaaatgttaacaatgtgtcaaatatgtatactgacaattctaatttagagcacatcgaacatctattattaattcttaatatcaaatacacgaaaaaacc

SEQ ID NO: 95897 - DNA, 478 bp, Heterodera glycines
  SCN-specific regions: Sequence locations=1-280,342-478
tgctctccgttaataatttggcacaatggtttgtgtttctaaacgccgcgttctctccccaaaaaacgacggcaatcgactgagcaaaacaccgacactcctccaaatgaccatcccgaagtaaaaaaggccaaaatcgaggatctgctaaaaaagttctccaatggagggttcgatcagttttggaatgaaggactccaaccggaagaggaactatcgcccgacttttgcaattgggatttcggcaaagagccaagaaaatgcgttttttgcattgcgaaagaagaggaagaagaagaggaagaggacaaagaatgagtggaagagagagaatgagaagacggggggagccgcgaaacaaaaagcaaaacttccagaaaatgttcaatgtgtcaaatatgtatactgacaattctaatttagagcacatcgaacatctattattaattcttaatatcaaatacacgaaaaaacaaaa

SEQ ID NO: 95898 - DNA, 460 bp, Heterodera glycines
  SCN-specific regions: Sequence locations=1-460
tgaagtttatacgggaaaaataatgttcccgggcaagtcaaataaccaaatgctcaagttcatgatggatttgcgcgggaagttcccgaacaaggtgattcgaaaggcggtcttcaaggaccaacacttcgactacaactgcaattttttgtaccatgagacggacaaagtcaccggcaaagacaaagttacagtgctcaccaacatcaaattgttgcgcaatcttccggctgaactctccggtgatcaggaacttgacagagatgggtttgccaaggttgaccatttccggtctttgctcgaacagatgacagctttggacccctccaaacgaatttcgtgttcggatgctttgaaacaccctttcattgtagaaaagtgatgtgaactttaagcgcagaacatatttgaacttaattccacttcctttataatttgttttcattaaacaatcgaaaag

SEQ ID NO: 95899 - DNA, 595 bp, Heterodera glycines
  SCN-specific regions: Sequence locations=1-56,78-108,130-595
tccatgatatggttagccatgccaaaaatggacatgaccttccccttccataccagtgagttcattctcctcaaagaatggcttcctcagagtattttcgcttatctcttttctttgcttgctgtgctcgccctttcggtggcttatgaattgctgcgtgtgttcagagccatccttttccaaatcgctgaaagacgtcagagtgaagagtgttgttcgccggtggcgagtgctgccccatcctccggtgccattaccgcctcctcctcatccgtcgccgcctgcaactgcttgtctccccaactcttttacaatgtcccccaatggtccttctcctcccaattggtctcccatttccatctcttccaatctctgctccatttcattcagttttttttgggtttctctctgatgcttgttgccatgacttacaatgtgcccatctttgtcgccctcctcttgggccattcgctcggttactttctcaccgcccctctctatcgccatggattggctgaagaaaatcggactggcggagattgctgctgttcataaacttcactttttgtttgcataaattcattagcaattaaaa

SEQ ID NO: 95900 - DNA, 488 bp, Heterodera glycines
  SCN-specific regions: Sequence locations=1-73,95-249,271-488
ggagaaaagcacagatccaattccgctgacaaatgtcagatttcttcctcgacaattccgacatggacgacaacgagctggagctgaagctgaacaatttgcaaatgttgaaaaatcggcgtgccaacaaatctctgaaaatgccacccactgacattggcactaccaaattgccagtgaacggcaaaggcattggctaccgaccgctgccagaaaatgcacaattgaagcgggacattgaaacaaaaatgggcaccactgacagcgaagagaaggaaaaggagccgaaggaggagaacagagtgccaccaaacgaaaatggcaatggcaatcgaccgctgtcagacaatgccaaggaaaaaaatgcccaattgaagcgcgaaatcaaagaaatattgggcataattgacagcgaagagaaggaaactgagccaaaggagacaaaattctgcgaaatgttttcatgggttcagctgttctttggcttg

SEQ ID NO: 95901 - DNA, 874 bp, Heterodera glycines
  SCN-specific regions: Sequence locations=1-116,138-874
ctgatctcttgacaaaacaactaacagcggtcgaagaatgtaaatctgtcactgcgacttacaagccaattcgtgtttccgacatgcccattcaattatgcgaacatggccgtgtcatgcccggcccgtttattcggggtgaaataaaggcggtgaacacttcggctgcccgacgcctgatcagggaatttaatgtgaacacgactttgtacacgggagctaacatctgtgtcaactgctgctcaagacttcgtgatcaccaagaaactaggcgaaggggacggacagaggcgattttatactaccccgaaggcgctactttgtttatcaaattgaatggggatgagaatgatgggaacacaacaaagggcaagaaaaccaccactggaccatccgcggcagtgacgcgtcgagcagcgtcaaaagggctaataaaaattcgaatttgttcggatgagacgatcaatgccctgaagttgcgcatttacgagaagatcgaccagtctccagtcgaccagttgctttacatgggcggacaagtgttggatgggaatttgacgcttgagagggcgagggttcctgcaaacaatttcgacaacccgcttattctgatcgtccagcagagaaggaaaagtggtgacgacgatgacagcgaccagaaagcgggctccagtggtggtggaggatttcatgacaccgccttgtcttgataataatgttcactgagtacaaaactcacacgggcgtcgacacactcatccactttgtttattaatggcttatgccctagttcttgttcacgtccattaagtacgagtactgtttgttttgtcaggtgccgattataattaatactcgataaatacttttatta

SEQ ID NO: 95902 - DNA, 475 bp, Heterodera glycines
  SCN-specific regions: Sequence locations=1-475
gtgagttccgctgctcattttttgtttatgctcgagtcggctgttctgttccttttgaatttgttctacgcttttgctaatttctgcttggatttgttgcccaattcgtcccccatgggctccaagtcgacccctgcaaccgccgacgtcgcttatgccaattatcggctgtttgacgaactgaacaggaaagtgcgggaaagtctgagaaaggccatcgaagctgacgagacgaggattgccaaatcgcgagtgatcggactgtacgagaatgtgttgaagcaaataaacaaagcattggagatacggcacacttcgtgcccttcacacaagcagacggaaatgcaggaacagcagaaaaaattaaaagcctttgttggacagacgaaggatcggctggaaaagttggcatccattgagccgatggcgcttagagcgacgcctcttccactggcaacggtcgaaaccggcaaca

SEQ ID NO: 95903 - DNA, 200 bp, Heterodera glycines
  SCN-specific regions: Sequence locations=1-155,177-200
acactatttactgttggtcctctgctggggtcatcaaagtgggaacatgctcgggaacagccgagtggactcgtccaaattgacttgggcctcaacatttgcggacgctctgtacctggcaacttggtcatatgctttgctgtacaacgaggcaccgttgaatattttggtgaccaacagcataaaccatgcaaaaactt

SEQ ID NO: 95904 - DNA, 554 bp, Heterodera glycines
  SCN-specific regions: Sequence locations=1-164,188-414,438-554
caaaacgaaggatcactaaagagaattctatttttaatcattctcgaaaatgccaccgacttgggccttagtgccgcttttgcttctgttctttgtccatttcattgatgtcggattcgctcgtcgctacaaagcgtcaacaaaatacaatccgccggcggaagaaacgacgacagaaacgacagaattgacaaccccaacggaatgccctgcgccggtgtgcccatgcgaatgtcccaccgaagaaacgtctgaaacgcctccttcgacgggcgggggagggggcactgacgacgacatcgtgacctcgccggaaggagaggagacgaccacgcccgtctccggatgtgttccgggcccgtgaaaaatttatcacctctaatccggatttgattgaatcgctgcgcaagcaaaagttcgacgtggtcatcgaggagcaactgaacttttgcggtgccgggctcggccatttgctggccattcccatccacattctcatcaacagctgtcctctccaagagcacgtcgcttatcttttcggccttccttttcct

SEQ ID NO: 95905 - DNA, 475 bp, Heterodera glycines
  SCN-specific regions: Sequence locations=1-26,48-228,250-475
ggtaaatttaaatggcaacgcaaagtaactttggaaaatttcaacagcgttcaagtcgacaatccagtcggatcatttctcaacaacccacgaaatgctttgatgaagcggctaaacgacggcgcattcagcaacaattggagtcacttgagaaagataatttccaagaggatccccacgcgaatatcacttggcacaaagcggcaccaaaatttgacgatgaaatggtttttggagacaaagaaaagaaaaggcgaaaacggaaaatcgcgtcaccctcaaaagtcagcggagcggagcaagcaacgaaaaagggaaagaaaattgtggccgctttgacaaagacgcgatttaggaagacatttgctcaacttttggaagaagcgcagcgaaagcgcgaggaagaaactcaacagaggcggaaagaggccagcccagaactccttttgcccacctattacgaagtcgcttcatc

SEQ ID NO: 95906 - DNA, 599 bp, Heterodera glycines
  SCN-specific regions: Sequence locations=1-186,216-599
tctgctacattttctgcttccgcatttgggttgctactgcttcgacagcttcctaccgtacggcgggaccgaaaacgaaagtgccagacaaaaacgaatggatgaagcgatgtgcggcggaatacgagcgaaagtactgcgttgagacggacaccaaactgaaacagcagacgacgaagaacaaggagaagaagcagcagcaacagcaagacgaatcgccggaggagtattacccgaccaattacgagcccgccttcaattatgacaaattgcatgtgtccgatataacccttccactgacaattcatcaaaaggatcaatatcaagcccaaaatggaccgactaaatacgaaccgaaggcggaaggacagcacgtgacgagttcagtaacaaccgcagaagcaggaaagtactcgagttcaagcggacacgcgagttcgtctgaaagtgaggaagaagaccgctgggaggagccaagaaagcggtcgcgaaaccgggaaagagatgagcgaaacggacgccacggggaaggtgaagacaaagcagcgaaacggtggtacaaaagcgacgagtcgaaggaagagaaaagagatggaaaa

SEQ ID NO: 95907 - DNA, 331 bp, Heterodera glycines
  SCN-specific regions: Sequence locations=40-92,139-263,285-331
gaggagcaaaagcctgctggtaagaaggagaagcgcgccgcagagaaagaggaaaagaagtcagaaagcaaggaagcagagaaaaaggagaatgaggagcaaaagcctgctggtaagaaggagaagcgcgccgcagagcagaacagtaagaaaggtgattaaaagtgagggaatgagaaacgcacgaaaagaagagacgcttttgaagatggtcccaagtcaaggactccataattaggagcaaagagggggcggttaagtgtaagaaacctcactcgccacaacacctgcggatgtgagcagaaatgatgctagtttttgctcaaataag

SEQ ID NO: 95908 - DNA, 676 bp, Heterodera glycines
  SCN-specific regions: Sequence locations=1-676
gtttactttttctcaaaaacccgagaaacgcccaaaaaaggatgacagaaatgagaacaatgacacatttgagcacaatacgcaatcgaactcattcgttggggctgcaatttccgctctccaattatcagctaaagacgtggacacgacctttcagggcatcgttgagcagacggtgttcagagggtcagccgatggcaacccatttgcaattcgcgaatgcacgggctctctgcttgtactgcttggccacgctgccaccatcacaattgacaagtgcagcaattgtgtgatcatttgcggcccgtgcagaggcagcatttttatgcgcaactgtgccaattgccttcttctcgctgcttgccaccaatttcgtctgcaaaattcgcgcgacattgaggcgcacttacactgcagcacaaacccaacaattgaagactcggatttgattgtggccccgttgctgatgagatacgacggcttcaaagaggacatggaatccgccagactggacaacgcgccgaatttgtgggacaaagtgcagaatttcaccgcggaaacgggccaattccaacggatgaatttcgacccctttgccaacggtgccattagcagcgaagtggtcagtgatgaactgctggagaagctgagcacggtcatggaggagcccgaggcg

SEQ ID NO: 95909 - DNA, 622 bp, Heterodera glycines
  SCN-specific regions: Sequence locations=1-141,163-622
ggaaaacaaggacggctcattcttgaacaaaagggacattagcgacccgtactgcgaaatccaagtcggctcgcaagtgttccacacccgagtgatcaacaacaatttgaaccccgttttcaatgagtgcttcgaggcggtggtggaccaggccagtgggcagaagttgcgcatcgaactgttcgacaaggacaccgccggggcggacgaagagttgggacggctgagcattccgttggaaagtgttcggcaggcgggcgaaatggagcggtggcatcatctcgagggctgtaagcatggcgagttgcggctcaaagtgtgttggatggacttgagcacggaatccacgggcgtgggtcgtgacgagtgggagcaggagtggttgggcgcggacaaacccatgcaccccgcccttctgatggtgttcatcgactctgtcgccaatctgccgtatccaaagtccaatttggagccgtctccgtttgtggaggtttcgctgggccgaatcactcagcggacgccggtgaagccgaagactgtcaacccgttgttccagagcaaattcaacttcttcgtcaaacagcccgaggggcaggaactgaaaatccgagcggtggacgaa

SEQ ID NO: 95910 - DNA, 957 bp, Heterodera glycines
  SCN-specific regions: Sequence locations=1-565,587-708,730-957
caagtttgaggtaatgtattaaccaaagcttaaaaatgaaaagcaattctaaaactgctgacattggtgatttttacgagatattgggcgttcctcgtaatgcaagtgagcaggaaatcaaaaacgcttaccgaaaattggcactaacttatcatccagacagaaaccctgggaatgagcaagcgcaagaacagttcaaaaaagttagcatagcctattctgttctctccgacccaaataaaaggcggcaatacgatgtgtccggaccatcgatggcaatgaatgattttgaaggactcgacatatccgaacttggcggagttggtcgcttttttggcgcaatgtttaccaaattgggaataccaattcctacccaaattggaccgaaagtgcttgctcaagctcgtgatctctctcgtggcaatgtcacaaacggcctctcgagccaggtctggtgctgtccgaaacagtgaacaatcaggaggcaaatttctacgcgtttcagatgactcccgaattccaacaacacggagtgatcattcgatgcaaatcattggcaatgagcaaattcaaattggtccttttcgatcaggaaggcgcagtccgtcacattcgcgagagtcagaagaaaaagaaatacacttccgctgaacttttctttgtgccgttccaacgaataaacatttccgaattcattccaattcgtttttacatggaggacaaagacactccgctgccatttcactttctggacactttagaaacccatggtgctaatgtgatggagcttcagccaggaaagcacatcctttgtgtatacggcgacaatttcttgagaatggtcagttacgaaatcactttcctcccgctgaatcattacgccagcgcagcaattaacaaaatcaacgcattggagcccgtgttggcatcgaagaaatcggaaatgcaagaattcca

SEQ ID NO: 95911 - DNA, 456 bp, Heterodera glycines
  SCN-specific regions: Sequence locations=1-8,31-313,335-430,452-456
tgagattataaaacgatggcaaaacgaaaatcgaagcgaaaagcgccgaccaaagcgaagtcaattgtggcattggagacgcagttcaattgtccgttttgcaaccacgagaatgtgtgcgaggtgaaaatggaccgtgaaaggaatgtcgggttcattcaatgccgcgtttgcatggaagacttccagtccaacatcaccgctttgtccgagccaattgacgtgtactctgattggattgacgcgtgcgaggcggccaatcagtgaaaaacaaaagtggacaaatcaccaacagagaacggacattgtgtgcacagaccagggatcaccttattattcactgatcatattggcattattttccaacgcatttttttttttgatttcctttttccattaaaagtcgtctcgtaattcgattttccccatttatgtgtatataaattttgaatgatt

SEQ ID NO: 95912 - DNA, 547 bp, Heterodera glycines
  misc_feature (426)..(427): n is a, c, g, or t
  SCN-specific regions: Sequence locations=1-262,284-427,459-547
aaagctggagctccccgcggtggcggccgctttcgaactagtggatcccccgggctgctttactcaaaacgaggattatgacccggacatttggcactctaaggagcagcagcggcaactgatgcataatgccaaacagtcgcgcattttgaaggaattgggatgccctgctatgggtgacggttgttgttcgattgcccttttagaggcgtcagttaaagcgcgtgtgcgcgacgtagcgcggtaccaactcagacgcgcgttggcctccaacaaattgttcaaatcacgcggccgaaatgatcagcagtgatcagaagcagatcaatgcttgaccaagaaaacattctattctattttgttgatatattaggagaattaattatttacacatttcccaaaatattggagaaaaaaatgtaatcnnaaaaaaaaaaaaaaaaaaaaaaaaaaaaaaactcgagggggggcccggtacccaattcgccctatagtgagtcgtattacaattcactggccgtcgttttacaacgtcgtgactgggaaa

SEQ ID NO: 95913 - DNA, 407 bp, Heterodera glycines
  SCN-specific regions: Sequence locations=1-25,48-407
ttttgattttttgataatttttggctatgggcaaggacacgaaaggagattatgacccggacatttgccactctaaggagcagcagcgccaactgatgcataatgccaaacagtcgcgcattttgaaggaattgggatgccctgctgtgggtggcggttgttgttcggatgcccttttagaggcatcagttaaagcgcgtgtgcgcgacgtagcgcggtaccaactcagacgcgcgttggcctccaacttattgttcaaatcacgcggccgcaatgatcagctgtgatcagaagcagataaatgcttgaccaagaaaacattctattctattttgttgatgtattaggagaattaattatttacacatttcccaaaatattggagaaaaaaatgtaatcaaaacgaa

SEQ ID NO: 95914 - DNA, 427 bp, Heterodera glycines
  SCN-specific regions: Sequence locations=1-98,121-172,194-365,410-427
aatgactgcctttctcggctgctgatttcttcgattgacatctgcaacttggttcaattgaaatggattgttttgacaatgatgatgcgtttggcgagctggtttatgaggaagaggaatttgaacaggaattggaggacaaacggaagcagggccaaaaatgcacgagcactcagcgggaagaagaggaagaacttcgtgagacagaaaatgagattctgccggaattgaggtcggaaagagtgttcattaatattcctgcgatcaaattttccttagttgtccaattaagaggatttacttggtctaaagtaaagcttcgtccaactgttacataaaatttgttcacaataacgagggtcttcaaaaaaaaaaataaaaaaaaaaaaaaaaaaaaaaaaaaaaaaaactcaagggggggcccggt

SEQ ID NO: 95915 - DNA, 543 bp, Heterodera glycines
  SCN-specific regions: Sequence locations=1-232,256-283,323-323,356-543
aaagctggagctccccgcggtggcggccgctctccaactagtggatccccccgggctgcaggaattcggcacgagggcagcgggtagtgccatgcaaattggcgatcaattagtggaaattgacggcgaaagttgcattgggatgagtcacgagcgagccattggcatgatcaaggagaggcaatgcgtgaggctcacattgagccgacaaaagctgtaacatttgccggacaaagaaagaaaggatggatgaatcgacgaatcatcaatcacgcgaacactcaattttaataataatttatataaataaatcattaattttcaaaaaaaaaaaaaaaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagt

SEQ ID NO: 95916 - DNA, 706 bp, Heterodera glycines
  SCN-specific regions: Sequence locations=1-217,241-706
aataaattcactagtaattttttgaactcctcccatggccacccttctcgaatatccggcttctgttgtggagcaaatttcggtgaagctgtcagcgccaaacttgaacaccatcgcaatggcatacccaaaagttgaagtgccaaaatattcgcgtgccactctttcggctggcattgtccattttggggttggcaatttccatcggagccatcaggccgttttcctcagcgaactgttcaacatgggccaagacttggactgggccatcattggcgcgggtgtgatgccaacggacgagcgcattcggagttgcttaagcggacaagactttctgactacggtggtcggtcaggacgagtacagtaatacggtccagatcactggcgcaatgattgacttcctgccgattggcaatgccgaagcgattgtggcccaactttctgatccggcaatacgaattgtgtcgatgaccgtgacggagggcggctatttcatcaactcggccactggcgaatttgacccaacccatccggcaattgttgcggactcaaaagatccggccaatcctcgcactgtgttcggactgattgtcaccgcgctgagccgtcggcgagcaaatggaaccgatccattcactgtgctgtcatgtgacaacataaccaaaaatggtgaaatggcacgaaatgcgtgtgttggcatggca

SEQ ID NO: 95917 - DNA, 660 bp, Heterodera glycines
  SCN-specific regions: Sequence locations=1-131,154-660
gtttgagcgatggtagatgctcattttgctgggtgtgcacatatcaagtcggagtacgtcgtattacgaagtgaaacgcaacagcaagaaggaggcaacaaaccaccaaatgaatccaatccattggaagggaattcgcacgagggaattctgccaagaaatgtgagggcacgcggaatggaccgccaaagagagcaaaaaatggccaaggcccgagcggaaaaccgtcaaaaaatcgtaagaatttgtccgtcggttctttttgagagcgaaggaaggaagtgcaaatatggagagaaatgcgacgcggagcactcgctgacaaaatattgggcgaagaaaccgccggacattggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcgttctgaacgtgctctgcatgaatcaccatcgggttgtatggaacgcgaagcaccgaagtgggacatgcgcactctccgcggcaaaaaatacttggcccctcctgacgac

SEQ ID NO: 95918 - DNA, 267 bp, Heterodera glycines
  SCN-specific regions: Sequence locations=1-267
tcattaaattgttttccaattgctgtttatccaaagaagatctgtccgcttcgtcctcctcctccgccccttcgttggagagtaaagactagtgggtgaaaaagtgcctggacctagccgcaacgaagaatgcctccggggctggtgtttacgagatggaaatgcgtgaaggccgagttggaggggtatagcttgttgatctgggttttttgaattgttgtgcacctttttcttattcagaataaaaatatagaaaaacgaaaaaat

SEQ ID NO: 95919 - DNA, 904 bp, Heterodera glycines
  SCN-specific regions: Sequence locations=1-60,82-144,184-269,291-904
ctttgttcaccaaaattgaaccggcgaaggtggccgagtggaaagaactctttggcagtgggaaacagcagcaaaatcagccgaagaacaacggaccaacggcgatgagcagtagcagcagcaaaaaggcaccaaactcgacggagaagcagcagcagaaacagaagaagaaaaaggaaaacatggcggaagagcggggcgaagtgggccaaatttacgcggaagtgatggccaaattcgaaaaagcgaaagcacttttcgtcacaaatgaatctgaaaaattagacaccgaaattgccgcattgaaagaacaaataacggagcagaaggcgcgcctgggcttcaccggcgcattgttctcaccgccgatgccaaaagcaacgccggcaatcgttgtgccaccagcagtttcttccccgcaaacaccgcccaaattgacagcagcgtcaaatgcgagcaaagaacaaacgcaacagaaacagcagccgaaacagaagaagccgcagcaacagcaagcgactgccccggccgatgacaccgtcgacgtcggttgcctcgacctccgtgtcggtcgtatcattgaggcacagaaacacccggacgcggacgcactgtacgtggaacagattgacctcggggaggagaagccgcggacggtggtgtccggcctggtccgatttgtcccacttgagcagctcaaaaaccgtcttgttgtctgtctgtgcaatttgaagccggccaaaatgcgtggcgttgagtcccaggcgatggtaatgtgtgcgtcgacgcctgaaaaggtggaagtgttggaagtgagcccggaaagtgtgcccggtgatctcgtcgtctgtgaaccgttcgtacgccgtccgcctcagcaattaaatccgaagaagaaaatttg

SEQ ID NO: 95920 - DNA, 591 bp, Heterodera glycines
  SCN-specific regions: Sequence locations=1-260,282-591
tgttcggcttaatgttggtactcacagaatattcacgtgatatccaaaacttcctttcttctatgtcgcgatcctaaggcatcaccaatggactccactgtggtgactttatatttctttcggatttagacgtctctatgaattgtgttttactacacgccggcgtgggggaatcggacttgacactgccgatgaacctggaacccgaatttcaaatttcactgttgcgagtggttggccaaccaggattgcctacccgggcgcggttcaagttgcccatgcattgtgtgcaacaccaacagcaaatgaccatcgaatttgtgccggatggcttcaaccagaccgagttggaagctgacaatacttggtatctgacgctccaattcaaccgcaccggcacaaaggaacagggcacgtttttgctggccaattacacactcgatgtccgtttcttcaacgtgcaaaatgcttcatcccattacaatggcacttatttgtacgcgaaggcgcccagctttaagccggaatggagcgcaacagtgcaaaacggacagccaaatatctttacctgctcaaagaatgggcttcatt

SEQ ID NO: 95921 - DNA, 340 bp, Heterodera glycines
  SCN-specific regions: Sequence locations=1-318
ggcgcaacagacactgaccttcgaacgttccgcgactttttattccaatataacgcagtcaccgagcagtgtttcgacgcgtgcatccgcgatttcaccagcagagacataagcgagaaggaggaacggtgctcaaaaaattgcatggacaagtttttgaaggccggccaacgcctgtccatgcgttttcaagaacatcagttactaaatatggaagcacaaggagcaccggtcatggcaacgaatacaaaagtgcagattggaaagtgatacggcggaaacaccattttttgttgtattgtttgaatattttgagtttaatacattttgaaagataaaa

SEQ ID NO: 95922 - DNA, 723 bp, Heterodera glycines
  SCN-specific regions: Sequence locations=1-723
gtccatttaagtaaaatgggcgaattcttcttcaaccttgatcacggctatctcgaagctttaatccgaggatttaaatcgggccttttgacaagcacagactattcaaacctcgttcagtgcgaaacgttggaagatctcaaattgcatatacaatcaacagactatgggaactttcttgccaatgagcctgggaatatcactgtgcaggtcattgatgaacggctaaaagagaagctcgtaacggagttcactcacttgcgcaacaattctctggagcctcttgcgacttttcttgactatataacttattcatacatgatcgacaacatcattttgctgatcactggcactctccatcaacggccaatcaacgagctgatctccaagtgccatcccctcggctcatttgagcaaatggaggccattcacattgcatcaaacccggctgaactgtacaacgctgtgctcgtcgacactcccctcgccccatatttcgtggattgcataagtgagcaagaccttgacgaactcaatgtggagattatccggaacacactgtacaaggcgtacattgaggacttttataatttatgcaaaaagatgggcgggaaaactgctgaggtgatgtgcgaaattttagctttcgaggctgatcgacgagcatttatcatcacaatcaacagttttgacacggagttaaataaagaggaccgcgctaat

SEQ ID NO: 95923 - DNA, 379 bp, Heterodera glycines
  SCN-specific regions: Sequence locations=1-305,330-379
agatgactttcctagcccattttatcgtttcgcttttgctgattgttccgtcattcattccaaatgtttttggagaggactgctgcaccaaatgttacaattccatgacgggctgtcttcagaagtgcatcattgagcacaagggggacccggcctgtcgcaagacttgcaagcccaatgtgtacaaatgcgctgccaaatgcgggccccactgtccgctaaattggacgacgacgacgccgaagagcggctaatgtggcgagggacgatcaaagaaaaagccattcattcattagcgagttaattaatgagttgattaaccattatttgtgcaaagctgttgttgatccgaaaaagtcatgaaataaaatgcttgttt

SEQ ID NO: 95924 - DNA, 629 bp, Heterodera glycines
  SCN-specific regions: Sequence locations=1-590,612-629
attcgctaacaatgcactcaccactgttcggctcaatgttggacaacaaggaatattcacgtcatatcgaaaacttccgttcttctatttctccacccaaaggcatcaccaacggactccactgtcatgacttcagatctccttcggatttcgacgttttagtgaagttggcaaaagaccccgccggggtgggcaaccgcgaattgcagcaacggatggaccaggaccaacaattccgacagcaagttttgtgtgcaattgtcaacggtggaaaagaacgttttctgcaattgtgcatcgattgcaacggatgtttcgtcattcagaagttagttgagaacggttcaaaagaaaccaatcaaatgttgctcaatttggtccgtccgctcgcctttaaaatggtgctcaatcgttttgcttgtcgcattgtccagaagctcgtcgttaatttgtccgggtcccaagtccgccaattgttctgccaacagttcaaaggacacgagaacactttggtcaccgaccaaaacgggaaccattttgtgcaatgcgtagttgaccattttgcgcccgacgtgtacggaccttttatcctcgccttggccaactgtcccacccgactgagcgccgtt

SEQ ID NO: 95925 - DNA, 417 bp, Heterodera glycines
  SCN-specific regions: Sequence locations=1-52,90-417
tccggaattgatcaatagagttttccaattcgtccaaatcccgtgctgtgccttaaaattgtttttaaattcaaaaaataaataaaaaacacttgtaaaagtttgtatttttgccaaatgccccaaggtttgacaaatgatttgtggccattcagctgagtaaagcctctccaattggtccgcatgaatcagaacttttcttattgagttccccgtcatgtcctttttctgaacgcttccctcctgccctgatgctccggaaaaattcgttcgcaatttccgcgttttccgtcgatgcttcgagctctttgataagagcatttccaatgccctggaagacgtgaaaaggcgccagaattattcgttcaaactcaattgattgtaaaagtggctcatcgacagttcccatggtgagcg

SEQ ID NO: 95926 - DNA, 505 bp, Heterodera glycines
  SCN-specific regions: Sequence locations=1-137,163-183,205-458,481-505
ccatttattgtctgttacttttagcccagaatttagttaagcaaaaccaagttttcacttgataccataataaactgagattgtcattgtttgaacgcgtgaactcgaacattgtttaaaatgatcatttctctggaatttttcagttatatattttttgtttattaaagtctcgtaaaattgccaaaacaattcttttcatgtttaagtccattcttcgcaaccgaaacgaacggtcgccaattaacaacgaagaattgcagaaaatgtgcaaaagagatattgtggagtttcttcctactccgaaggagattttgggtgatttcgttttcgagaggagcgccgggaacaacagagagaaaaggaagccgaggaaagggaggccaatgtcagcgtggaaaagtaggaaaatggacttgtcgagcagtgacgaggagagaatttaattcgcgaaatatttattgtatttgtttttgttatcacccattttgcaattatttttttc

SEQ ID NO: 95927 - DNA, 339 bp, Heterodera glycines
  SCN-specific regions: Sequence locations=1-65,88-339
gtttgagcttaagttcttttttaatcttttcacagttcaaatggcagcttatagacccatttacaccaaggaaaaagaatgggtcaacacgggcacagcggacggagagataatggtttttcgaccgacgatggaggagttttcgaatttcagcaaatacatcgaaactatcgagcgcagcagagcgcatttatcttctggcgtttgtaaggtcattcctccgcccggttggcacccgcgtccgtccaaaaatccgtccgattactccgatctgaacgacttcgtcattcattgcccagtgtgagcactgcacattctgcaaaaaataatagtcatctg

SEQ ID NO: 95928 - DNA, 445 bp, Heterodera glycines
  SCN-specific regions: Sequence locations=1-445
cgacgtcgccggcggtgcgctcctcggcgtagcggtgggagcgtttttcctccgaaatgtcctccacaactttcggcccaatcgctactccgtcttggacacgcaaatgctcagttcggcggatggttggcaagacattgagggaatgccgaacggatcggaagcattgatcagcgaaaaactaacagtgccgaaaacaatcgtaacgaaagagcaacaaaaaagaccaatcggagggcaaagggcgaacgattacggaagcgtaagggaaatgagtggcggaaggagcgacggcaggacggagacggcacaaatcggctgacaacgatgactttcatccctcccttacaccacaagaaaaaacataatttttgtcccatttttctttttgctattgtccattttgaaagcgcaaattattatagttcatgtttagaaacggaat

SEQ ID NO: 95929 - DNA, 496 bp, Heterodera glycines
  SCN-specific regions: Sequence locations=1-119,141-496
cagtcctcgcgccaaagaaactcacctaaatacgagtcgaatatttcttttttaattggcgtgtggcttcaaaacagaaaagtgccaaattattttcgaatttgagaaatgaattccaattcgttgctcttctctctgttcactttactgttgagcatcgccgccaatggccatttttgcttcggaaaagccatgggccagcagcgctcgcgacgagtggcggctgtggacaatggcaattttatcgtcgtggacggatccgtcagtgttgtcaatggagtgatctccgggaatggctggtatttacatgacggaaaagggcggattttggaaaacgcggaagctgacgggccaaaacgggccaaattgaaaaattcctccaccaaatggacgaaaataaccgaaaatttccgcaaggaaattccaagggatttacaaggaattttttccgataggaccccacccggggagccccctcccagaattttattttaac

SEQ ID NO: 95930 - DNA, 591 bp, Heterodera glycines
  SCN-specific regions: Sequence locations=1-98,120-132,154-509,531-591
tcttctacgtcactttgccttctgttgttcgctgtgttttatttgattgatgcgcgaactcaatccgtcgcggtgaaaggacgtctgctgtgtggtacggcaccggcacgaaatgttcgggttaaactgtacgatgaagacgctggtgtcgacccggatgaccaacttgatgccggatattctgacccaaatggcaactttcaactttctggccatacctcagagctgacgaacatcgacgttgtttttaaggtctaccacgactgtgacgatgggattaagcccggctcgcgcaagttgaagttcaaaattccgaattcatatgtcacggacagtgcgacgccaaagaaaacgtttgacatcggtgtgctcaacttggagactgtgttcaaggacgaggaacgcgagctgatcgtgaccatgaagaagaagcggagaagccaccgttaccaagactttttggacattttgccatgaaaaagtttcgagaaaatgacaaattgccaagaaaattattttcaatttaaaaatggaagcgggatttaaaatggaaatattgattattaaagttaaaataaattgtaaccattt

SEQ ID NO: 95931 - DNA, 532 bp, Heterodera glycines
  misc_feature (336)..(336): n is a, c, g, or t
  SCN-specific regions: Sequence locations=1-376,398-532
ggccctaacagtgccattttatggacagtgcagcgcaattcgaccaccatcagtcgtttggtggcggcacggcgccgacgagggcatcgacgggcggcggcattggcactgtttcacttggcaccgtcacgtacatttgcggcgattgccacaaggaaaacgaaatccggcccaaagacccgatccgttgccgggagtgtggttaccgtattctgtacaagaagcgcagccgcaaaatgatggtgtacgatgctcgataaagaaattcccagattggccattgttatttggtttgtgtcactgaatattgtttaagaaacaggaactgccatttanaaattgaaaatggaatgacaatccggttgagatatttgccaacattgctgcgtttcacttgcaattcgacgaacttcccaccgatccaaatgtgaaaaagtggagtgtgcatgtgttgaaattgtcctgtacgaaaaggcatttggaccgggcggagctgcacaaattttgggaaatgctcgacaggcacatttcc

SEQ ID NO: 95932 - DNA, 540 bp, Heterodera glycines
  SCN-specific regions: Sequence locations=1-384,420-461,490-540
cttaagaccggctcaaaaattgttgaaaaactaattcgaatgtcaaccatcccaatgccaccaccaccaacacaagacgaaaaggaccaacaaaagaaatcccaatggaaaccgctggagataggaaatcggatgcgcacgacctcagaagattcggccgagtcttttgacgcctatggaccggattcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttattttatttaacacttcttctgatttttcaataatgaaataaagacaaacccaccaaaaaaa

SEQ ID NO: 95933 - DNA, 724 bp, Heterodera glycines
  SCN-specific regions: Sequence locations=1-115,163-379,401-437,463 -589,613-684,708-724
catttaccgatatctgccaccgaatgctcaggttgtgcttttgagtgcgactttgcctcacgatgttcttgagatgaccagcaaatttatgacagatcccattcgtgtgcttgtcaaacgtgatgaattgacattggagggcatcaaacaattttttgttgcggttgaacgcgaagaatggaaatttgacacactctgcgacctttatgacacattgacaattactcaggcggtcattttttgcaacactcgtcgaaaggttgactggttggcggacaaaatgcgagaggcaaatttcactgtttcttcgatgcattcggacatggaacaaaaggatcgcgacgctattatgaaatcattccgtgcaggggaaagtcgtgtattgattggtaccgacgtgtgggcccgtgggttggatgtgccgcaggtttcgcttgtcattaactacgacttgcccaacaatcgtgagttgtacatccatcgcattggccgttcgggtcgttatggacgcaagggagtggcgatcaacttcgtaaagaacgacgacattcgaattttacgcgacattgaacagtactactccacccaaattgatgaaatgccaatgaatgtcagcgaattgatctgagagttggtatgaaaccacacaaggaattggatcctaaacgtatttgtgttttacttttctcacgtttattgtttttgataaatggatactttggtg

SEQ ID NO: 95934 - DNA, 480 bp, Heterodera glycines
  SCN-specific regions: Sequence locations=1-192,214-397,423-480
aattaagaaaaaataatttgctgttaatttattttccgccgctacacaaattctccagtattaccgaaaaaacgacctcaaaatgagaactgtgcaaaccgcacgcaaaagcaccgggggaatgccgccaagaaagcaaactgcgcgcaagtcagcaggagggtcagggcagcgactgcaaactgcacgcttgccagcagcaggaggaggggaaccgattctgggcactgcgcgcaggtcagccggagggtcaggacagcgactgcaaactgcgcgcaggtcagcaggaggtgcagcaccgcgaccgcaaacggcgcgcaggtcagccggagggtcaggacagcgactgcaaactgcacgcaaagcagcagcgggaccctccctacggaatgatgtggctgatgaggatgatgacgatgaatcggtgtcagaagaaatggaggagtcgtctgaggacaatgagccgccccaacttgttca

SEQ ID NO: 95935 - DNA, 624 bp, Heterodera glycines
  SCN-specific regions: Sequence locations=1-15,37-476,501-624
gtccatttaagcataaaaaatttgctttttattttcatgaacgcccattttaatggtgccttcggttttaattttgggtttatgcacggggctctctcatgcgcccgtacaatttctgcttgtcttggctcccatgtccatttgattctgccgccaattctgtccgtattggacgaccgcaaaacggaggagaaagtgcgtacgtcggcactggacactttgcttgagttggcccgtcgacattccatcgaggattacgctttgcccgtcatgcaaacatggcttcgttgcattggcatcaagtctcaacagccgcgactgatggagttactcggcatcatcgtcagaaaatggactcagttttctgtgtacaaagagaatgtaaatgccgccttggtgcggtgtcgtgtcgaaccaatgctgtgccatgagtaccaggaacagttggcacttctccaggcgccttcatacgcacgccaacagcagcagcaacaacagaatgccgttggcagtggtggaggcgtttaccaacaacaacagggcacattcagtgccagcacttcatcaccattattcgcgcgtcaagtgtcttttttaccgccgacgcaaaacggcggggcgaca

SEQ ID NO: 95936 - DNA, 508 bp, Heterodera glycines
  SCN-specific regions: Sequence locations=1-67,89-508
gactcgtgtttaagccaaacgcacaaatgggccgaccatttttaccattggcattttctttggttttgctgctgctggcggtggtgatcagcaccaattgcgcaaatgcttctccgatcgttggagaggaacagcccatggcaccggaacaaaaagcgacaaaaggcaccaacgacggacaaatgggcgacgacaatcggaccaatcggcgcaataacatggctgctgctcagcatcaacagcagaaccgcaacgccacatccttggtggcacttggctggttgggcttgcgtagcggcgcgagcagcgtcaacgcggtcaacgtggcgtcatgttacgacagccgactgtccagcttcataaacgacggcctccgctattattcgcataacatgggccaactgtctaaatacatcattgaccagattaagcgtgtccgatactcgggctattggtttgtgcatgcggcaatgatcggcggacaaacacagggactccaatggcagtc

SEQ ID NO: 95937 - DNA, 161 bp, Heterodera glycines
  SCN-specific regions: Sequence locations=140-140
gccaaacatattctgttgcctttcaaacgtaactaccattgcaatcacatgatttactttcacagcctctgcgcaactctttcatacaaatcacgaggccaattcctccttaaattgtttgcaatgaaacttgcaatctgaaaaaaaaaaaaaaaaaaaaa

SEQ ID NO: 95938 - DNA, 172 bp, Heterodera glycines
  SCN-specific regions: Sequence locations=1-172
atgacgatgacctctacagctaaagtgtgaacattgattattcggaagtgatatcatcagatgatgagtaaaatatgtcattgtttaattgtattggctgcatttttgcgccttgtcggttattatgtgtattgtttttcatttatggaaaagtggaataaaaactcgactc

SEQ ID NO: 95939 - DNA, 251 bp, Heterodera glycines
  misc_feature (251)..(251): n is a, c, g, or t
  SCN-specific regions: Sequence locations=1-251
aaacccatgaggacgagcgcataccgccacactgcacttgccggtctggctgccgtcgcgctgatcaccgcgggctgcaccgatgacaaggacgtcgatgcgtcaatgtctccccaggtcggattgatctccacctcaacggttcaaaccccgccgcatcccgcggaagtaaagctcatcggggagagggacgtcgaggtgacgctgaccggcccgatcgctgctaagtacaaaataaaatatcgaataan

SEQ ID NO: 95940 - DNA, 803 bp, Heterodera glycines
  SCN-specific regions: Sequence locations=1-14,37-803
gtccaattaagtcgcagctacaaaatgtttctcttaccggggaaatgtcgcaagaattggcgttggaattgttcgaaaacggcgatcttcaaggacttccctaagggttgtgagttcggcatggattatcgctcgtggattgtcggcccaaatttcctcgggatgaaaatgatacctcctggcattcatttcatttactttagtgtaccgggtgcgcctcgcattgctttctttcacaattttcggcaaaaggaagtgattttgaggaggtgggacacgaaaaaggaagacttggtgactgacgaaaagtcggacgaagttgaattggatcgacttcgcgagaatctcagaaacattgatcgctttttgggagtttatccattcgcagactatcgcaattggctttccctttcgtcgtacattacgccaaactccgtccgtcgtctttccccctcaaattcactcggacgcatttcgtcccaaaatgaaatggtcacgcaggaggcgaaattggagaagaaattgggtgatccctttggtctttcgattgtggacagagaacaccgcgggcgcattcgcttcacggacgaaggcggacttccgctgatgagcgaaggggaggaagcgaagctgaacttcactcggatatcgcagatcacattggctgacacaaatttaaggagggcgggcattgacagttccgacagacttttccaatgtttcgaagcaatgggcggtgattatcgcgaagtccttgcagaattccaatttgcttttgtcgtttttctcgtggggcaggttta

SEQ ID NO: 95941 - DNA, 827 bp, Heterodera glycines
  SCN-specific regions: Sequence locations=22-827
gaaaaatgatgcccaaaaatttttgcggcaaaacatcaaaattttcttcgtgccttctccctgctcttctgctgatcatagtattgtcaatactaaattctgtgagctcttctcgtcgccaccattctcctgcttctggtcataatcggcggctgtcatcaatttcatcgcccgccgttgcaaatggtggtagcctctttgaacatcgaacaaagcatcaaagtgttgccgcggctgatgagtcggccgggggttgtgccgttgttccaccatcgctttggtgcggctgtgacaagctgcagacacagtgtggcaccggacgattgtgcggccgatacaccggcgccatgcgaaatgagccgcttcacatcacactgctctatgaaagcctgtgccccgactgtcaaagtttcatcaccgaaactctgttcgatgtgtaccaaaaattcaagacgcacttgcgaattgaatttgtcccatttggcaatgcgaaagtgttggagaatggcacaatcaaatgccaacatgggcctgaagagtgtcggatcaacaaatttcattcgtgtgccattcacttcatgcacgacccaatgccattcatttactgccttgaaaagctgatcagttcaggcattccgctggagaaagcatccaaaaaatgctatgtcaaattgcatccaatcccgcacatttacgaccagattactcactgtttcaatgggccgaccggcgatcgacttcaaagggaagccggtcgtctgacggcacagatttggcctgatcagcatgaatatgtgccatggattttggagaacaatgccagtctg

SEQ ID NO: 95942 - DNA, 656 bp, Heterodera glycines
  SCN-specific regions: Sequence locations=1-553,575-656
gagtaaacctaagtaataaatagtcaaactaaatcttcttgctcgtcctcgttgctcaatgcatacaacggcagcaccgccacctcatcagccttctgttgtcatgtcggcaattgatgacaacaattcggttcgctttccgatcattcaagtggaagtgaagattcgagtgcctgaccatcttgtcggtcgactgatcggcaaaagtggcatttgtgtgaagaaaataatggaggacacccagtcacacatttccatcagcgaatcacgaagtcaacaggaggtgaatcagtaccaaactccggaactgctcgaccgaatcatcaccattcggggcactgcttttggctctgtgatggcggccgagaagcaggtgcagcagaagttgcgctacattcaggaacaggacatgaacatcagcgggggaggcggtggagtgagcgcggcaagcggacggcagttctgccccacgcctgtgtctgctccgcccggtggcattttgcagtctatggacggcggtggaggcgctgccattggttcgtacattgctccgtcggcggtcactgtgacgggtgcgccaatgctttcccgtggtccgccggacaatgccttccatcaccatcctcccacagccgccgccatgtacagtgcgcaat

SEQ ID NO: 95943 - DNA, 462 bp, Heterodera glycines
  SCN-specific regions: Sequence locations=1-121,144-462
gatgaattttaacaacgtaaatattagaaaatacgacaataaaaatgagagaaatggtgctgggtttggagcaaattctgacactgcggcgtttgagagctgggcttgcgagtctttcaacctttttgagtttttgggagaagacacatcgccacttgacgaagttgttcccgagaaaatggacgaagatgagatcgaaaaacaaaaggaggatgccatgtattcgcagtttcaatacagtgacatgcttattggggggcaacacccgacaaactctcaccatgattttggcgtaaacgatttcgcaaatgtgccctctgacggccgttccgattttgacgttcccactgctttccatgaaggagttcccttcccaatgccgcccgctacacaccaaatctattcacagaatttggatgcaattcctcacgtgccaagcacttcgaaatcatcgatgccgtt

SEQ ID NO: 95944 - DNA, 397 bp, Heterodera glycines
  SCN-specific regions: Sequence locations=1-376
gtgacaattcgatggcaactttggacgctgttgaggaaccgcttgacctgatccgactcagccttaacgagcgtgtttatgtaaagctgcgccaggaacgcgaactccgcggccgactgcatgccttcgaccaacatttgaacatgattttggccgatgtcgaagaaacggtaacaatcactgaaacggacgaagaaacattcgaggaaattcacaaaccaagcaaaagaacaattccaatgctgtttgtgcgtggagatggcgtcattctcgtctcgccacccacaaaatatgtcccatgatcagacaaaactgcttttgttctccatatttttcattgttaaagttctttcaatttggttgagctaaatgaccattaaaattttgtattttaaaa

SEQ ID NO: 95945 - DNA, 460 bp, Heterodera glycines
  SCN-specific regions: Sequence locations=1-397,421-460
gtcttcctcattctgattgttacttgttctgaagcaacaattcttttagcttacttccatctttgcgccgaggattaccattggtggttccgttcctttatgacttccggatttactgctgtctatttgttcatctactgcattcactacttcaactcaaaactcaccatcactggtgtcgtatctaccatcctctacttcagctatacttcgatttttgtctttttgttcttcttaatgaccgggaccatgggatttttcgcaacttattggttcatctacaaaatctacagttcagtgaaagtcgattaaagatgtaaatttgatttgtgattagaatacatgttaatttttttttggtcattggtttttgagcaatgatgggcttctttcaatgtttaatatatttttgtttcccttgtcttaatgtttttttttataaatgtgattagaagtcgaa

SEQ ID NO: 95946 - DNA, 476 bp, Heterodera glycines
  SCN-specific regions: Sequence locations=1-476
acgccatgaattgatgctgttacggatgagcgatgtaatttcgaatggattgggaaatcaccgtcccgataatgcatttgtcttcccaacgattgcacaacatcccaacgaaatcaaacccacaaatgcgatgagaagttcaaacccattggttggtctcgcttcgtcacgttcatctactactgcatgttcatcattgtccgggaaagatgacgacgaacaacagctacagaagtgttcgattgatgcagcaacactttgtcgtaatctgatcagattcgcctaccaattgtcagctgctaaacgacgaacactcgaagacccggagctgtatcggatgcgcactcactcaaaaacggaggagagactgagacggaaggttgtcagagacatgattatggagtgagttactcgaaaagagggcctgacccacttctgaccgcgaacttatttattcctttcttaagaatgcccgg

SEQ ID NO: 95947 - DNA, 476 bp, Heterodera glycines
  SCN-specific regions: Sequence locations=1-20,42-283,305-346,373 -442,464-476
agctaatttatttgcccgcacttaaacataaaataattaataagcgctttttttattattgttattgaaaatgacgtccgaaactgtgtcaagtgacgcgtcggcagcgggaggggcggacaaagagaacacaaaaacggacacaaccaccgacccgagttccagcgaaaattcggcgtccatcgaggcggaccacaacaacagcaaattgcgctacgccgacgagaccaccatcatcccgcacgacctcgtggagcggcattttctgcaaaacacttgggctctctggtacttgaagggcgatcgcaacaagaattggaccgattgtctgaagaaagtgtccacctttgacaccgtcgaagatttctgggcgttgtacaaccacatccagccggcgtccgggctgagctggaacagcgactattacctgttcaaggaaggcatcaaaccgatgtgggaggacaaaggcaatttgg

SEQ ID NO: 95948 - DNA, 673 bp, Heterodera glycines
  SCN-specific regions: Sequence locations=1-78,106-124,166-673
gtcaagtggccagcccggcggtggtggccctgttgtggtccacggtggcaatgcggtcaactttgctgctgccgctgctcatcagcagcagcaacagcaggctgctggtgacccatcgcaacatgttgcggctgttcatcatcaccaccagcagcaacagcagttgcctccgcaacaaaacaaaacgcttttcacaccggcagcaaacccagcgatggtaagcgcaacgccggccatgcaacaacatttgcaacagcaagctcagacaatcttccaccagacctcagccactgcagtgcctcagttccccagctacaacatgccgtacatgtattcgccggtggccaccgcgcaaacgttgcaaggaccaaatgcggagattgaccgtttcctcatccaacagtatgggacgccgtattcgcagctggacttgcagatgggcgcaatgtcaattggaccaccgacgtctttggcaccaaaccatcatcgtgccacattggaatcgtacatggagaacaaatttgggcagcagcaacaaaacgtcaatcaagcggccaacaatggacactatcaacaaacgcagcaaagtcagcaacaacagcgcggacttgcccaatcggagcaggcaactttgctggggggaccgccaagccatgtgggaccgcctcccggc

SEQ ID NO: 95949 - DNA, 740 bp, Heterodera glycines
  SCN-specific regions: Sequence locations=1-20,44-202,224-308,334 -529,551-740
tcaagtcactttccaagtacagcctgaaaatttattctttgacaatggcacaacaccaggaatcgttgatccgtcagaattttgcagctgaaactgaagccggcatcaacaaacagatcaatattgagctgtacgccagctacgtctacttgagcatgtccttttacttcgaccgtgaggacgttgctctccacaacattgcgaaatggttcaaaaaacagtccgacgaagagcgtggacacggcaccactttcatgaaataccaaaactctcgtggtggtcgtattgtgcttcagaacgttcagaagccggagaaggatgagtggggcagtgccttggaagcattccaagccgctttggctctcgagaagttcaacaatcagtcgctgttggagctgcacaacctcgcttcccaacaaggcgactctcagatgtgtgactttcttgaggacaaatacctccgtgagcaggtcgaatcaattgaggaaattggcaaaatcatcaccaatctcaagcgtgttggaaagggtttgggcgagtttctttttgacaaggaatttgccgagaccgactgaatgaatgtgcattttggacacattcaatgggttgccactggctgaatccaaaataactttgcagattgtcagatcatttacgaattttattaatctctccaatggcgttcattctcctttttctctccgacatttataaacacgtggataaattaatgaatgcgc

SEQ ID NO: 95950 - DNA, 331 bp, Heterodera glycines
  SCN-specific regions: Sequence locations=1-249,271-331
caattaagcccatagttagaataaagcgaaacgcttttttaattcgaaaatgtttgctacaccggaatttatggatgccgaagacagtttgatggagatgaaatcgaatcagttcaaaatggacaaaaatgagttcattgccgcggagaaattgatcgacaaggactactacagggactttggcgatatctttgacccggatgtgaagtaaatgcggctactttttgtgcggaaataagcaaaatgtagtgttgttgtttttgatttttgcgacataaaattgtgtatgaggtatatgaaatggaaacaatgaaagcgtagaaattccaag

SEQ ID NO: 95951 - DNA, 438 bp, Heterodera glycines
  misc_feature (437)..(438): n is a, c, g, or t
  SCN-specific regions: Sequence locations=1-196,218-255,281-391,414-438
attgcccgccaactttgtgctccgcccgatggcccgtctgaaggtgtgggcccgtaaccagggcggcctgcacgccccgccggatcagctgatcttcgatggcgaagaatcgttcggcgtcggctcaaacgtgcaaaccattctctataatgcgcaaggagaagaacgtgccacgcacatccaacgttcaagccagacagctgcctgaagaggaagagagagataatgctgataagagtgatcactgggggacggaattttaaattttttaattatttttcgaaaaatcgaaaaatgcacccccccccccccctcctaagaattgattttcttttttaattttcaaaaaattccccttatataaaattgattttttcaatgaccaaccgacatttaaccattaaattttaacaaattggataaagtgacaaataatnn

SEQ ID NO: 95952 - DNA, 465 bp, Heterodera glycines
  misc_feature (465)..(465): n is a, c, g, or t
  SCN-specific regions: Sequence locations=1-465
aattaagtcgtttattatggaaaaggacttctcaattaattgttacatcgccttttccaatcccatcttttgtcatcagaaaatgctgatgcggaagggcgagttcagcttcaattcacaagagcgttctttcacagcaaaaattcacaacaaaacgaggctccgcctttttccatgtgaattatgtgcggttggcaagaaaagatgtcctaacggccgatgtttgatcattcgctacaaaacgggtttttaatgatgacattaaggaattggtattgaaagaactcgaagagggagacaaactgaagattcattccgttttgctgggcattgccggatgaaattgacgttgaaatatcactttttcagggcttctgagtgtttttttttccaaaaatacagcaaatttggcaatgataaagttttgttgtttcttcaaaaaataaatttgagatcacgaaaaan

SEQ ID NO: 95953 - DNA, 964 bp, Heterodera glycines
  SCN-specific regions: Sequence locations=1-138,168-964
ccattcaattcaaacgctctccgcttggcttcttcaccatgcaaaaaaacacgcggattgcattttggactgttggcttaaggaagtgcgcaataattcggagaacgaacgactgatcagtctgattaatttggcaaacgatgtgatacaaaacagtcgaaagaaagtgccctcctttatggcagccttttttgaagtgttacagccggcatttgtccatgcctccgagtgtttggacgaatcgcaccggaaaatggtggcgcgaatcgttgcggtttggcgcgaacgtcaaatttactcagctaagaatttggatgatttgtcaaagtgtttaaccgcggacgaaccatcaactttttccgtctctccgaatttgaattccgaaacggaaagcccttcgaagagttcgccggtggacgggggacaatcgcccgttgcttcggaggaggacacaaagaaaatcaaggaggaattccacgcattctccacactcagttccaacatgatcgcccttctgcgcaagttggaggaccctgcttctacggacgttaaaatcaggcaactcatcgccgcttacccggaaagcattgccaatccgacgcttctcaaacaattcaaatcggcggacgaatttggcgaactgtcgaaaaaaatcgcagaagcgatgccagtggtcgacgtttactgtggccgactgcgcgaagagctaaaagatcgccagaattttcaatttttactcgaagattatatcaaagcattaaacgaagccaatgaacgaaacaaacaattggtggtgtccgtgaaaagacgcattggaagactggatgaggagaagcaagagttggccaggcatatcgaaagtttgcccgacctgacggaaatgttcgggtccgaacccgcaactacgaacctttcatcgctaggggaattgttcactccaacttcatgaatcgttgccaaagaa

SEQ ID NO: 95954 - DNA, 529 bp, Heterodera glycines
  SCN-specific regions: Sequence locations=1-269,303-376,398-529
aagctggagctccccgcggtggcggccgctttttcaaaagtggatcccccgggctgcaggttctcggcacgaggcatacaaaaaatggcggatgaacaagaagaaacgcaagtcgctccgcctcagccagttttacacacagaaaacgtctcttccttcttggatttgcaaaccgagttcatcaaacgtcgcgatgccgccattgcggggaagtcgcagtcattcgccacggagccgatgcaccggcgcactccacgaaataacattttggccataagcaaagaggaaaagaaagcaaaaagcgaagtttcaacgctaagagtttatctaattcgtcaaaatgaggaagcaatcagaaaagaggagcaacagagggccaagcagcagcaaatccttcagcaaaaggcggcaatttatgaacgaatggcaaagggcgaacgattggtttacgacgacggaaaagaggccgaatttttggtcgattttcacgcgaaaaaaaaggaattggaggaagaagcgaggaacaaac

SEQ ID NO: 95955 - DNA, 489 bp, Heterodera glycines
  SCN-specific regions: Sequence locations=1-371,393-489
ctttcaacgaagtcggctcccgagacgcgctttttttactgtccgttcttcagcttcatctgaccatttcagtgaacattgctacgatcataacaccaaaatttatgatttcttccgactcgcaccgacgcgcgttgggagacatcgccggaatgggcgtcagcggaagagcgcacccatcgctggccaaaatgcgcgagaatttgatcaatggaaccatcgactttcaggaagtgccgatcatcgacatgaaccccgaggacattcgggctgagctgaagagagtctacacgcagttgaggatgtacaagctgaagaacgcataccaggacaacccgcacatcagcaaacggaaaggcggcggtgccgtaaagaaaagcgccgcgggcgatgcgactgtaagcggaagactgtcaagcggcgcgggccttagcggtgcgggactaccgaagggcgtccgcggaacggagggctattgtgccgtaaaac

SEQ ID NO: 95956 - DNA, 510 bp, Heterodera glycines
  misc_feature (143)..(143): n is a, c, g, or t
  misc_feature (474)..(474): n is a, c, g, or t
  SCN-specific regions: Sequence locations=1-510
tcgactgaaaatggcgcacaaatgttggagagtgacacatcgggtgagcaactccaattgttgcgcaccattgtcgattcgcatctgacaaatggacagacatttttcgtgccgtggtccgataagcgggctttgcagtctanatttttgccattcaaagagctggccaatcagggcgttgctttggaatttatcatcgacgcttgttcaaaaagtgtcgccctttttatggcgttgacaaaaaatgggcgagaaacgaccaaaaagttgggtgtatttgtcgactgtatggaaatgacttatgaagacgccatgcgattttatgcgaaatgggcgagcggactcgaagaagtgtcggcagattgtgttcagcaacggctgagcattttccttggccgcggcgttcgggcgggtgcccaaatgcgaagtgttgtgatgcgatgtccggagatacttttcatgggggttcctcancaaatggacatgttttgggagaatattttggatttc

SEQ ID NO: 95957 - DNA, 477 bp, Heterodera glycines
  SCN-specific regions: Sequence locations=1-477
aagcatttcatcgttaaattaacagtaattttactttggaatttgaacgtaacaatttctcgtcaaaatgtttggtggcggaggagaccccttcagaaacccatttgatcaaatgcaccaacaaatgagacagatggacaacatgatgaattcgatgttgggcgatgcgtgggacatgctgaacggcttcggaatgatgggccccccgttccccaaccatcctatgctcaccgatggtctgaatcgtcaaaaccaagctcttcgtcgtcagcagcctccacagcatcactttggtcctgatacgatgatgagtccgtttggaggatttggccttttcggcggaatgatgcagcaaatgcaaaatatgcataaccatgcaattagtgatccgaattctgttgttttctccgaatcaacaatggtttcttacgatggaaatggacaaccgaaggtcgtccaacattcgacccgtaaagc

SEQ ID NO: 95958 - DNA, 804 bp, Heterodera glycines
  SCN-specific regions: Sequence locations=1-620,643-804
ttatactggctggtgaagagaagcgtattacttgggttccgcttgagtcaaaccctgaagcatttaataagtacatcgaaaaaatgggcgtgaaaggagttgagtgccacgaacttttcggttttgagcctgacttggtcagcttcgtgccgggacctcacttggcgctaattttctgctacccttaccaagacaaagcaaatgactatcagaagggaatttacggacaattgacggcttcagacaaaggaggcgtgccggaatgggccttcttcatgaagcagaaaatacacaacgcttgcggcacttttgctctttttcatgctctgacgaataacaccgaccgaattgacattggaaacggcgtcttctatgattggtttaaggcggcaaaacaactcaatgttgaacaacgctcggaccttttggcaaacgattcggagttggctcatttgcatgaacactgtgctttgagggaatcggagacagatgtcccaaggaatgttgctcaccacttcatctcatactttacacatggaggacgtcttttcgaatttgactcgggacaggaatttccgcgcgactgtggaccttccagcgaggagactcttttaactgatgctgggaagatttgcaaagagctaatgggccaattggaggacatttcatgcaatgcaattgcactctgtgcccaaaacaatttaattgatgaaatgacaaagaaaatattacgatattcccgtgttttctgagttcaataaatttgacaagctttggtcataattttattaaataaaccaattg

SEQ ID NO: 95959 - DNA, 453 bp, Heterodera glycines
  SCN-specific regions: Sequence locations=27-79,135-135,162-163,203 -399,421-453
caaatcttcgtcaagaccctgaccggtaagacgattacactcgaagtcgagtcctcggacacgattgactcggtcaagaccaagattcaagacaaggagggcattcccccggaccagcagcggttgatttttgccggtaagcagctcgaggacggccgcacgttgtcggattacaacattcagaaggagtcgaccttgcacttggtgttgcggttgcgcggcggtcagtaaaagtgctcgtgtttgcgcgtgcggtccgccctcattgctctcgctcgcccctcgcccttatgatgacgctttgttgtccttgtgttttgtaagagtgtgagtttgtacatttattaaccccctcacgccatccagcaatcttcccccgtcgagttcgttttactgttgtttttcacaatttgaaaacttgtttatatacattccaactcgtctctcgaaaaa

SEQ ID NO: 95960 - DNA, 347 bp, Heterodera glycines
  misc_feature (347)..(347): n is a, c, g, or t
  SCN-specific regions: Sequence locations=1-99,121-185,210-243,278 -289,312-347
gtcgtttttcctctggatgaacgaaaacaggcacagattctatcagccggggatgactcaggcggacgtggcaaaggccgcaggcgaggaatggcgtcgcatgtccagttccgagaaggccaagtggggagagaagtcggtggaggacaaagaacgctacgtccacgaaatgaacgaacagcgcgagaaagaagaaggggaggaagagggcgaatgagaaagagcgaagggacagaagatgagagagaggatatacaaacagaaagaatctttttggattccaaacttaattaatattaattggccatttcttttgccttttgtttctcaaataaatcattttgttn

SEQ ID NO: 95961 - DNA, 650 bp, Heterodera glycines
  SCN-specific regions: Sequence locations=1-377,417-650
tgagaatgcaatcagccgaagagacaatggcccttgttgcagttacaaaatttcgcgattatctgcgtattaacaccgaacaacccaaccccgactatcataaatgccgtgatttcctcttcacatatgcaactgaattgggattcatgccctgggaatacgaatgtgtgcctggaaagccaatggtcgggatgacttacgctgggtcggaccaaacattgccatcccttctcctttacagccataccgatgtggtgccgacttttccggaacattggacttacccgccttatgaagcgtttaaagacatcgatgggaatatttttgggcgaggagcacaagacatgaaatgtgttggcatccaatacatggaggcgttgagagaaattttatttgaaaatggccaaaaaccatttttaaggacggttcacattctctggggtccagatgaagaaattggcagccacgacggaatggaaaagtttgttcatacggacaaatttcgttctctgaacatcggttttgcgcttgacgaaaggttggccagcgaaacggacacttactcagttttttatggggaacgatgcgcgtggtggctgcaaatcacttgtcctggcgcccctgggcatggttcgcgattcgttgaaaac

SEQ ID NO: 95962 - DNA, 620 bp, Heterodera glycines
  SCN-specific regions: Sequence locations=1-620
gttttgacctatctgaccaacataaagccatccaggatggagctcttaaattcgcgaaggaagtggttgcgcctaaagccgcggaatatgacaaaacaatggcatttccttgggacattatcaaacaggcgcatcaattgggattgatgaatccgacaattcccgaaaaatatggtgggcctggttgttccaatttggagactgctctgatcgttgaggcgttatcttatggctgttcggctattcaattggccattatgggcccatcgcttgcgttagctccgcttcttttggccggaaacgaaactcaaaaacagaagtacgccggcatgttggcagcggaaccactgattgccgcgtattgtgtgaccgagccgggggcaggctcggacgtgagcggagtgaaaacaaccgccgttctgaaaggagataaatgggtgctcaacgggagcaaggcctggattaccggtggcggatacgcaaaatggttttttgtcttggcgagatcggattcggaccccaagacacccgctggcaaggcattcactgcctttgttgttgacggagacacgcctggaataacccgcgggaaaaaggaaatcaacatgggccagcgttgc

SEQ ID NO: 95963 - DNA, 484 bp, Heterodera glycines
  SCN-specific regions: Sequence locations=1-214,236-484
atttatttaagattttaaagtaaaaaagtgctttgtttgcttcatgcctgtctttgcgcttcaaatgagtgccaatttggtcggtgtcactgaccttcgtccgtcggattacgacgaccatcggtggtaccttaagctcaaatgttccgcgtgtggcgagtcgtatccctccgagcaatacgccaacactcgggaaacgcacactttgaccaaagggaaaggcatttgtcacatttccgccaaatgttccttttgcggcagaatcaattcactcgagattctcattgattcctatgcgagttattctgctgacaaaaatcggcttttccaaacattggtaaaattcgaatgccgcggaattgagccgacttcgttcgacccccggattggttggatttgcgttggcacagaatcgggctcaattttcgatgaaattgacctcaacgaattggaatgggccgattacgatgagaagaattcttcc

SEQ ID NO: 95964 - DNA, 347 bp, Heterodera glycines
  SCN-specific regions: Sequence locations=1-257,279-347
caagattataataattataatgttcaagaacattttcttcttctttttaattgttgcgccatttattgctgcttataaaccaagttgcaaatgtcccgaaaatgaacagccaggccaattgagttgtaacggatgtgagccgagttgtgacaatcggaaaccggaggtgtgcaccaaaatggcatgtgaatgctcatgcgactgtgtgccgggattgctgcgagacaaaaagacgaaaaaatgcgtgccgaaagagaaatgcccttattaaagaggacaattgagtgataaaaaatgataattaatgcatttggagataattagtgaggaataaattaatgttgaat

SEQ ID NO: 95965 - DNA, 550 bp, Heterodera glycines
  SCN-specific regions: Sequence locations=1-53,92-188,284-550
tccggccaagagtgcaccaccggacagtgttgtcgtcgttgtcgctgctgttgaacatcaacaacaacaacagcagcagcagccgccgctgtcgtcgtcgtcgcactgtcctcctccgccttctgttccttgtacgagtgcctccccttccatcgctacgtcttccattgttcttacgtcaacatcttcagcagttccaccagcagcagttgaacaacagcaacaacaaccaccgccaccagcgcagcagaataataacagtaacaatcagccccagcagcaggaatcagccgctgagaagcttgtcacttcattcatgcgatacattggtcaacgtcccggtcaagatgggcatgccttggtgcaagagtttgtccaacagtctgctattcctgtccaattccgttcattggttgctgaacagcttaatcatattgtggcagctgcgcgcgcgaatgtgtaaatttggagagagagagacacagagaaagagtgcctcgctgatctttttttgcgttattttattcattgattatcatttgaattaaat

SEQ ID NO: 95966 - DNA, 1138 bp, Heterodera glycines
  SCN-specific regions: Sequence locations=1-119,141-173,201-354,379 -1138
ctgaaggtgtccgttgtcggtttggaacgcgcgttggagcagtacacaagtgctgctcattttgatgctccatttgacctgaagcaagtgcctttgtccactgagccgttgaccgcttcaaccgatgaggtgaaaaagaaagcggcgatggtggacgatgcatcggctgccatgaaaaagcagaaggaggagaagaaaagcggtacttcccgacaggagcaatttgcacttcaattcgcgtccatgccggaatttgccgcctgcggtgccctgttcaagtcgtgtgccgcggttgagctcaccgaaaccatcactgaatacaatgtgtcatgtgtgaagcacattttcaacgacgactttgttcttctgcagtttgactgtcgcaacactttgaatgaccaactgttggaggaagtttttgtcgaaattgagccgcaggatgagggcgaagattgcccttggcatgtgcaaagtgttcacccgttggcccagttgcccttcggccagccttgcaccacttatgtgctgctcaaaatgccggaggacggacgcattgccggcacattcggcgccaaactgaagttcaaaatttgcgacgtcgacccggcaaccggcgagccggaaagcaacgatttgtacgacgaagtgtacacgttggagcccatcgatgttggcctcgccgactttctgttggccatcgcgccgaagggcgcctcatttaccaccgcgtgggacgcgctcaaggaggaggggcacgagacggaggagtcgtacgcgctgtccaatgtgcacacattggaagatgccgtctccaaactgctcaaatgcaccgcccttttcccttgtgagcattcgaatcgggtgccggagggcaagtcgtcccaccagctgttgctgtgcggcattttccgtggcggcatcgatgtgctgtgccgtgtccgcctggtcatggacccatccgaccagacggtgtccatgaacatggttgtcagatcaatggacgaaacagtcagtcaaatgatcgcaaacattgtcagctgaggaacggcaaaaaacattcattcatctgttgttacatcaatgataatatttctaaatttacactatttgattgatggctggattttatttatttact

SEQ ID NO: 95967 - DNA, 644 bp, Heterodera glycines
  SCN-specific regions: Sequence locations=1-310,333-644
gaacaaatttcaatttttatcgcatgggaccaaacgaagaagcacataaacataattcgtcttcgacaccgaatagaattgactctgttgaaagtgatgatgatgaaatcgcgggatggagggcggaggggtggcgaattgggttcgacgtggaaatgcgcgtcggtgtcgcgggcgtcgaccgtccgcacgaatcagcggaaagtgaaagcgatgcaacggaagatggccacaacactgcgttcgatgctgagaatggtccgtcgctgaactgcggctacgtcctcctgccctcctccgccgtcgacgacgcgccgccctccccgcccgcctcaacgcccaccgccacaagtccaacgcattgtcagagcaattggctgttgcccgctcccccacccgcagcggatttggactcaattcagcacaaacccaacgatttcaatttggacagagtgaaaacggaggaaataaaacaaataatggcacaaatgtcggtgtcgagccgaaagccagaatgggctcaacagatcgacgatggaaaactggccgaactagttgagcgactgaagaaaaggaaagtgacggaagggaaataaacgataatttgtgctttatgcttggacataactaattatgtcactaat

SEQ ID NO: 95968 - DNA, 782 bp, Heterodera glycines
  misc_feature (753)..(753): n is a, c, g, or t
  SCN-specific regions: Sequence locations=33-688,745-782
cctcgttccgaattcggcacgagggtttgagttccatcacaaaatgtcatcggcagagcgtaaaattgacgtgaatcggactaattattcagtggttgactccgaatttgattctatgcgtgaacgctttgagaaggaaatgcgccgagtggacgaggaaatgcagcgtcttcgccacgagttcgaggggtaccgccccgccgcttcgcgttcttcgccttatacaacggcgggcactcagcccatttatggtggaggaagttcactgagcaatggcgcgggcggcggggcgatggcgcgccattcgccgacttacgacccgtacttggaaaacctaaagagcccactgatcaaagacgaaagtgacgggaaaacgttgaggctcagattcgacgtcgcccaatacagacctgaggaagtgacggtgaaaacggtggacaaccgtttgttggtccatgccaaacacgaggagaaaacgccaagccgcacggtctatcgggagtacaatcaggaatttatgctcccccgcggcaccaaccctgaacagatcagctcaactttgagtactgacggcgttctcaccgtcgaggcaccggcttccccaattggccatccaaaaccattaaagaaaacggagaaaacaatgaggagagaacagagcgtaattttttttgaaaattacttaccgtccccacatttgtcatcttcaaaagaacaaatttatttttcaattgccttttaaaattacatggnctaatgtgagaataaacaattttttgggc

SEQ ID NO: 95969 - DNA, 511 bp, Heterodera glycines
  SCN-specific regions: Sequence locations=1-467,490-511
cgcggcttgagactcatcgcgtgttgacttcctttgtcggcaatctttgtgcgcccaaccattttttccgaccagaccacaacagcggccgtttctgtgtggtgtctatcaacacgcatgaagctaacagagagatggtccgcactttctttcacgacaacgaggctgggttcaccaaaaaatattatttctgcgaactgcaattttttcctatgaatgaattgccttgggacgttgccgtgttgaagttgtacgcagaaaccatgggacatatttgggaccccctttttacgtacctggacgaagtcatcacttcactggagaatggtgacatgccgccgtacatttccgaatcatcgccaaataattcggccaattcactcgagaatctcccgtcggttgaggcaccgcaatcggatgattagttggagtgaagacttttctggcatttctgttccttcaccaaaaatgcctttgttgttgttgttggcataataaacaatgaattctc

SEQ ID NO: 95970 - DNA, 428 bp, Heterodera glycines
  SCN-specific regions: Sequence locations=1-428
tgccatttgccgtttcgccctctttcaactttttgcgtcgtccgttccctttgttggtctttcgtcgttccctttttaaaccgccattggactcaccgttctgtggcatttacaggacaaaaatggctactaaaaatgggagaattccttatgaattgcttttcgaactcatttccgctcttccgtttcacattcgatgggccgtcacccgtgtttccaaggcttttgatggttttgtgtggcagaagcaattttcatgggttagagctgagctgatccgcaaggaagcacaaaggcaaaaagaaggcggcgcattcctccaaatggttgattctctttcgacggctgtcaattcgctttcggaggcttctcactcgctttcgcaagcttctcactcgctttcaaactcggcggcgcaggaaatgcac

SEQ ID NO: 95971 - DNA, 550 bp, Heterodera glycines
  SCN-specific regions: Sequence locations=1-550
aagctggagctccccgcggtggcggccgctctagaactagtggatcccccgggctgcaggaattcggcacgagggttaagaagaccacttaaattttaacgaatattcgtgatggaaaatgcgagattggagtcttttgctacaaagaaacgtgataagatcatacaaataacgaaggagcagtttctggcgcccatcaaggacgaatatgtacggcgactgtcacaaacgcccattgaacagattgtcgatgacggatataacccaggcccacaaaaaccggacggtacggtgaattttgagtgccattgcgttgcccatctggtggccagcccgtgcgggcacgacttccgcaaagcgatcagttgccaaaaagcggccaccgacgcggagttggagaagggcaaatgcacggaggagttcttctcgttcatgaaatgcgcgatgaaaactcagtgcttccgatcaagagatgaagaaacactcaacgacccattgcagcctcaggacgcggagggcgatcactgatgagaaggcgggaagaaccact

SEQ ID NO: 95972 - DNA, 463 bp, Heterodera glycines
  SCN-specific regions: Sequence locations=1-97,121-131,153-463
cttctaaaaacgttcgatccattgcaaattagcgcaaaaatgttgcacagttttcgcggtgttcgcctttcttcccataccaacaacacatttgagttctcctcctccttctcgtcgtccacttcaacaacaacaaaacgtacaaaaagcagcaacagcaacgaggatggcagaacgccaacaaacggcaaaaatttgtcaccaaaaaaacgcaaccattcacaacagcgtcagcaacagaacgacagcaaaaaaagcgcattgtccacagatttgggcctcaaatcagtggtggtacagagaaagctgaacatccagacgaattattcactgcgtgcagtgcgcaagaaaatcacggcctccaacgaattggtggtggagcaggacgaaggggtcgcaaaggccaaaccgccgaacgaacaccgctacaaaagagccgccaaagacgaaaatgaaaatgacg

SEQ ID NO: 95973 - DNA, 1012 bp, Heterodera glycines
  SCN-specific regions: Sequence locations=1-1,23-403,426-652,675-1012
gtttgagataaatgattttcaaccatttctacacccaattttacattctgcttaacgtgttagcttcaactggctttgttttctgtacaacagaatggttcggagacctcagagcccatatgaatcctccgaaatttcctccgttttatgacatcgtatacgacgaaccagattgtccatttgggcttgaaagtgtggccatccccgagtttgtgtactttggggaaatgattgcaactaaatttgttcaagagcattcacaatgtctgcagttttgcttggaaacctcaaagtgcaaagctgtgaatttctttgaatcgatcgaaggaaaaaatcccgaagtcggtttctgtgaactgttggtcgaaggccagtatgacaacccacgactgatgcgacctttcaaaaaagcaacttaccatgaaaaaattcactgccgagctgaaaacgaagaggaaaaacagccattcatttttgatgagaaggatggcaagcaattgctaattggaaacgaaagtaacgaacgcaaaaacacgtcgtcgacagcgaaacaaaccgaaaaagggacaaatgaaaacggacaaaagacaaccgcggaaaatcggcaaagtgaaggaagaatgaacgagcaacggagccaaaaaacaacggaaaaacagccgagaagagaagaacaaagtgaaggtcgaggatttttttgtcgaaaaacggagacaaaggaagaaacggcacaaaaatcggaaacgcaggaaaaggcaacggaaccaccgacagcacaattaaattcactgattctcaaaagacttgcggaaagaattcaagaactcaaaaagcggttcagaaattgacaaatgaggaaccaaattgatttgatgaggaaatactagtatttattaatgatactaatcatgctgccaattcatttgtattattttttggccagtagttttgacccattttagagataatttcgcaaaaaccttatttgtgtcatttgaattagttttactta

SEQ ID NO: 95974 - DNA, 468 bp, Heterodera glycines
  SCN-specific regions: Sequence locations=1-136,158-333,356-362,384 -431,459-468
tcctcccaataaaaagcaccaaattctcattaacaaaaagccttcaaaaaaaaaatgcattttttgttgaacttcaagctttttgcatccatctttcttgtactttgtgtggtttcgtttgtcgtctgccaggacaagccagctgaagcatgccttcatcccaaagacgagggaactggcggcttggcactcacacgatggtggtgggacggtagtgattgcgaggaatttacctacaaagggcagggcggcaacacaaacaatttcccatcaaaggagctttgtgatgacgtgtgcaagccatgaatgagccgtggaaagaagatgcaatatgaagagacaagcaaagaagaaaatcaaagaaataaaattcataaaacaaaatgtagcactaatgcctaatgattttgcggaataaacaaaacattgccaaaaaaaaaaaaaaaaaaaaaaaaaaacctcgagggg

SEQ ID NO: 95975 - DNA, 859 bp, Heterodera glycines
  SCN-specific regions: Sequence locations=1-84,107-859
aaagctggagctccccgcggtggcggccgcttttcaatagtggatcccccgggctgcaggtactcggcacgaggcttaccattttttgccttctctctctgttgcgctatcacaacacaattccgattcgtctacagcttcttcttccctcatcgacgagatgacttcttcaagatcgcgaactcgtcgtacgaccaccaatgctgcttcaaccgctgctgctggccgtagtcggagccgttcaacacatacgggtcgtcgttccgcgagcagaagagcaatcggcaacagggcaacgggtcgttcatcgtccgtcatgaacgcgtctcgccgagtgtcgcgccgtgtgtcgtccgccaggaaatcatctcgccgacgtcgccggattgtggcgcgcagagcaacgccaaagaagcggtccaagtcggccaagaagcgtgggcgtggacgtccgagaaagccgcagcgtggacggagtgcgcgtgcgcagcggagaattaccatcacgcaaggagtgttggatgtgcccggtcatggccaaatgacggaagccgagctgagagaaatcttcatggcgggcacgacggcgaatgaaccgacgaacagaccgttgggcggcgcggaagtgattacgacgacgaatgccaacaacagaacgaccggtgggaatgcgaccagcagcagctcctcaagcccctcactcagcgacagtgtctgaacgacgtgacgcgtggtacaacaacaataacaacggcatggagaaaagaggcgatcggaatggatgagaatttttgcagaggatactaattaaatcacggataattgtgcccatcatagagagtgtggctcccctttatgt

SEQ ID NO: 95976 - DNA, 475 bp, Heterodera glycines
  SCN-specific regions: Sequence locations=1-414,446-475
ttttcctcctacaccaaaaaaaagaaatgtttccatttgtccatttttgtgacactttgtcttctcattagctgcttaatccccttctcgtttgactatgatgacgacctgttcgaaattggcactgctcagtccgtagcagtcaccggaattttgacgtgcaatggacgaccaagtggcggcacaaaagtgaaactgtacgacgtggacacttttgacccgacgatttgatggccgaaggctttacggacgaaaaggaacactttctgctggagggattcgaaacggaaataagcgacatcgactcgaagtgaacatttaccataattgtaacgacgaacatatccctgtctgcagaagttctccattgagatccccgacaattacataaccgaagaaaaacgatcaccacaaaagattttttacattgggaaattgaatttggaaggcaaattctcgggccaacatcgagatt

SEQ ID NO: 95977 - DNA, 548 bp, Heterodera glycines
  SCN-specific regions: Sequence locations=1-505,527-548
ttgacctgattacgccaagctctaatactccaagactatagggaagctggtacgcctgccgaaccggtccggaattcccgggtcgacatcatcatcatcatggccgctaatacgacccaatatagggggcactttgtctactcattagctaaattaaccccctcctcgtttggctatgatgatgatgatctgttcgacattggcactgctcagtccgttgcagtcaccggcattttgacgtgcaacggacggccaagtggcggcacaaaagtgaaactgtacgacgtggacacttttgacccggacgatttgatggccgaaggctttacggacgaaaagggacactttctgctggagggattcgaaatggaaataagcgacatcgacccaaagctgaacatttaccataattgtaacgacgaacactttccatgtctgcagaagttctccattgaggtccccgacaattacataaccgaaggaaaacgaccacaaaagatttttgacattgggaaattgaatttggaaggcaaattctcgggccaaca

SEQ ID NO: 95978 - DNA, 698 bp, Heterodera glycines
  SCN-specific regions: Sequence locations=1-479,501-698
gttgctacaattaaggtttcttcttcttccgctcatcagttgcacaacaacgcatcaataattaacattgacactgtccgtttcacttcgcactcaaaagagaatgacaccgaaaatagcaatggaagtgatttcactgtgaataatgggggcacttttgtgaggcgaaaggacccagtagaacggaaagtccaaccgaatgtgaacccgtcttcaaacccttcgtcctcttttacttcccatgaccactacccaccggtcgttagtgacggtgatgaaactgccgacgatggcaccggaactattcgaatcatttctccctcaaaagcggtccctccaataccacctcatcattttcatcgacaacaacaacaacaacttcagcacaaccaggtcaacaatgtgccatctacttttgttgccgatgtttcggttggcattgctccgccaccgcctacaatccgtggcgttcgctgtagctcactagagaacacactgcttcctgcactggataagttgactcgaactcggcacggtgccgcccatttggacacaattgctgtcgcactgaaacgcgctgaacaggcaagccccgggctgtgcgatcacttagtcaccgaattgatcaccaccatggcacatccccaatgcacgaacgcggagctgcgcaaggctatcgaccgattgaccacgcgaag

SEQ ID NO: 95979 - DNA, 487 bp, Heterodera glycines
  SCN-specific regions: Sequence locations=1-404,427-487
atttcaattttgccttcgctttaaaaataaaaacaaaaaaaaaccttttctcttttggctttacattaaatttctccgcgtttttggcccctgatcatttctggggcatttctcaaccgcttcatcgagcgtttcttccacccctctgctcattatcacacaaagggcagcggaccaagttgaaaatccattgcttaaataatcgtgacttttttttgacgaattgggatgagattttcttgctttctttgtgtgtcctggttgatactttgctcggaaatttaacggcctttaaattttgaacaaatttactcaggccatcagatttgaaaattctttttgaaagagacagtgccttaccaaacattaaaaaaagaaaccaaaaagtttctatttcataacccatttcatttttattttcattttagctccgtcgcatcgccgccccgggtgagcatttgcgcatttgtgtcgactcgggcggctg

SEQ ID NO: 95980 - DNA, 513 bp, Heterodera glycines
  SCN-specific regions: Sequence locations=1-513
ggataaaatgccaatttaaaaaaaaaatagattatggatgattctcatcaggataatggacgaaagcagcaaaacacttttttgactccaaaattctccattttgctgccgacgtacaacgaagctgaaaaccttcccatttgtctctggctgataatcaaatatttaaaggggctgagttatgaagtgattatcatcgatgacaacagtccagacggaacacaggaagtcgcaaaaagtttgcagaaagaatttggagcgggaagaattaaattgttgacgagggagtgcaaactcggattgggaagtgcctatgtttttgggcttaaacaagcacagggcgaatttgtcattttgatggacgccgatttgtcccaccatccgaggcatattccggagatggtcactcttcaggagaagcatggctatgacattgtcacgggaacgcgttatgcgatgggcggcggagtgtccgggtgggactttagacggaaaatgatcagccgaggagcc

SEQ ID NO: 95981 - DNA, 504 bp, Heterodera glycines
  SCN-specific regions: Sequence locations=1-318,340-504
ccgcgcctcaggcttctcctcatgtggcgttcgattatggggcgacaaagcttgctgcagccgcaccgtccagctacggctcggcctccgaggcccagcctgccccagcaggcgacgaaaatggcactaaagaggtgtcgcaacgaaaaaatgcaacacccgcgcaaacggcacagcacaataatgcaccaccacaacaaccggcacggcaaaccactgcagcacaaaatgtgctggagcaacggcgtgcaaaacggcgttgtcccagggaagccgggtttgtgcaagctgatgcagctagcggaggaggcatgcatagcccagcagcagcagcacgcatttcgcacagggttattggtcatactgcaccaagcactgaatatgcgtccggtccacggccagcgggaactgatgcaccacgagtgtatgcagcgcaaccctacgctgcaccgacgcgatcaatttcatctgtcagcaaatcgaggggctcaattggtcccgaat

SEQ ID NO: 95982 - DNA, 764 bp, Heterodera glycines
  SCN-specific regions: Sequence locations=1-764
gtttgagaaaaatttgtcaaaaaatggcacgaatgcacaaaattccgctggaccctgactcggcaaatgtgccaatgtttgttgctaaatgcgagcaatggttggccaatttgccaacacactttgaacaggtcgaaatgcagcaaaacttcgatcaaaattttaatggctcttctttgtctgagcagttaactgagctaattaaagcattggaaacttctgaatcaccgttggtggtgtttgcgcacaacgatttgctgctctttaacatcctttttgacgaggaaggcactggcgatgtccatttcattgactacgaatatgcgggccaaaactaccaactgttcgacattgcaaatcacttttgcgagtacgcaggtgttgatgagtgtcccgattatggaatgaattcggccagtgaagacgaacgtcggcactttttgcgccgttatttcgtctattttggccaaccaattgaggaagagtgtgaaatggacaaaatgttgtgcaaaattcggcactttgaagcggcagcccatttttctggactctgtgggccatccatcaggcagcaaaatccgcgattcaatttgattacatgcgttacgcgatcacccgccatcgttactgcacccggcttatgacctcatcaggcattgctaaaaataattagccacaaaagcacaacattattgatttttggttttcgttatctgtactttatcaactctcttaataaaaggtgacgatcaacgcgaaaaaaa

SEQ ID NO: 95983 - DNA, 199 bp, Heterodera glycines
  SCN-specific regions: Sequence locations=1-199
aatataataatttccatataaataaatgggcactaaaaatgggcgaattccttatgaattgcttttcgaactcatttccgctcttccgtttgacattcgttgggccgtcacccgtgtttccaaggcttttgatggttttgtttggcagaagcaattttcatgggttagagctgaactgacccgcaaggaagcagcaagg

SEQ ID NO: 95984 - DNA, 745 bp, Heterodera glycines
  SCN-specific regions: Sequence locations=1-33,62-242,265-403,427 -523,545-745
gtttgagataataggaatcctttctatcattattcaaaatgtctcaccgtaaattttctgcacctcgccacgaggtccatgggacttcacgcccaagaagcgagcgaagcgtcatcgcggaaaggtcaaggctttcccgaaggatgacccaaagaaacccatccatctgacggcgttcatcgcctacaaggctggcatgtcacatattgtgcgcgacgtggacaaacttggctcgaaggtgcacaaaaaggaagtggtggaggcggtcacaattctcgagacgcctcccatggtcattgtcggtgtggtcggttacatcgaaacgccgcgcgggccgcgtccgctcaaaaccgtttttgctgagcatttgagcgaggactgcaaaagacgtttctacaagaattggtacaagtgcaagaagaaggcattcacgaagtatgccaagaaatggcaagacgaggcgggacagaaatccatcgaggccgacctgaataaaatcaagaagtactgttcttatgtgcgcgtcattgctcacacccagatgaaactgatgaagcaccgcaacaagaaggcacacataatggagatccaaatcaatgggggtaccgttgccgaaaaagtggactgggctcgtgagcactttgagaagcagggtccccgtggagcagtgtgtgagctcgctacaccatcgactgcatcggtgtcacaaaggaaagggttgaaaggagtgaccagcggatggcac

SEQ ID NO: 95985 - DNA, 412 bp, Heterodera glycines
  misc_feature (412)..(412): n is a, c, g, or t
  SCN-specific regions: Sequence locations=25-270,349-412
ctttttcttcttttcccttcctttaaccaggccaacaatgccgatgagtccaccgccgcctgttgccacaaatgctacgtcgcgttcagagattgtttccgcgagtgtttggacaatcagtcggagaatttggtgtgcgtgccgaactgcaaaattgccttgggaaattgctcgaccgacaaatgcggattgatctgtccccgacccaaaaatccccaattcagcccaccggaaaagtacgacagattctattgaaatcgccaaaagagcagaaagagagagaaaaaggaaggagagagcgagagagagaggacgaaagaatgagagagaaaagaagagacagacagacaaagggaaaagacattatgccacaaaaaatataatttgaatgataaatgggatatgtggttan

SEQ ID NO: 95986 - DNA, 477 bp, Heterodera glycines
  SCN-specific regions: Sequence locations=1-477
tagacgggaaagttgaaagagacgcggatgggaaggaagttcgataccccgttattctaagtgctaaagagaagacaattgcgcgaagagttgtgttggcatttgggcaaagtgtctgcggattcgatttgctaagagccaacggctgttcgtatgtgtgcgatgttaatggattttcgtttgtaaaaacgtcgaccaaatattacgaagataccgctaaaatactcggcaataccattttgaggcgtttagcctcttcgctgagcattccttggcacattcctttccaagatgacgacccgccattagtgtcgacgcccagtggcaaaataatggaacttcgctgtgtgttggctgttattcggcatggagacagaacccccaaacagaaaatgaaagttgcggtgaaggatgagcggttttggaacatgttcaaaaagtatgatggaccgagaaagcgcgaattgaagctaaaaa

SEQ ID NO: 95987 - DNA, 352 bp, Heterodera glycines
  misc_feature (348)..(348): n is a, c, g, or t
  misc_feature (352)..(352): n is a, c, g, or t
  SCN-specific regions: Sequence locations=1-352
aattattgcacggatcattaagaagaatcttttaatttcctccctaagaatttttccaaaatgtttccgttccgttttctcttcgttttcgctttcgctttgctcactttgtgcggcttttctcacatgacattggcacagcccggaagcaatgggccaattggcgaacctaacaaaatgttgcgcatccgccgggaaaatgaacgcaaggaaaattgacgttttccatggaacgaaccaaagaggatgaaaatgaccgaagaacaaaaaacactattagcaattaaattccgttttcattgttactttttagggtggtgttttggtataaaatcaaaaggttgatcnctan

SEQ ID NO: 95988 - DNA, 476 bp, Heterodera glycines
  SCN-specific regions: Sequence locations=1-31,53-187,228-476
acggtttatcactcaaaatgagcgaatctgccagtgatgatgaaaatgcccatctaatcgaaatcaaattcaaaacgatacaggaaacttacaatgtgaaggtcaatgaaaactcaaccataaagcagcttaaaaagacaatggcgaagaaactcaatcagcctgaagagaaaatttgcctcattttttctgggaaaatactgaaagaccatgagaatctctcacaacatcatattggtgatgggatggtccttcacatggtcatccgaaatcagccctcaacttcgacggcttccgccgcaacaacttcctcagtttcgactgcgccgacgggtggcgctgcgccgaacttagctggaactccgccgtcgttaggcggaattggcgatcttttcaacaaccctgaacttgttcaaggcattctgaattcacctttcatggagagtatgctggccaacccggacataattcgaacg

SEQ ID NO: 95989 - DNA, 476 bp, Heterodera glycines
  SCN-specific regions: Sequence locations=1-304,326-476
gttccatccccaagtccgcgtttcgtttcggcactttcgaatttctgaagggtcacgcggtggatgaacgcggcaatctctccccgttcatgcgattggcttgtggccttggtgcgggaatttccgaggcgatttttgctgttactcctatggaaactgtcaaagtcaaattcatccatgaccaaacgctggaaaagccgcgtttccgtggttttatgcacggaatgggcgtcattatgaaggcggacggtccgcggggtttctatcaagggcttaccgcgacaatggcaaaacaagggagcaaccaggcaatccgtttcttcgtcatggaaacactgaaggattggtaccgggacggtgacccgaatgttccggtcagcaaacccgtggtcggattgttcggagcaattgctggggcggcgagtgtgtacgttgcatttgctattgtcacaattctttttttttacttccgtccc

SEQ ID NO: 95990 - DNA, 476 bp, Heterodera glycines
  SCN-specific regions: Sequence locations=1-238,260-476
acgacgaccgttgcaaattgttggtgaacacgttgcaggacacactgaaaggcattgaggcgcagtcttacaatggtggcggtgccggtctgtcccgtaaacaccgcgttcgcgaccgttctcgctcgccaattcgctcaagcaagcgtcaccgccggtcgcgttcgcgcagtcgttcgcgcgactattcgccgatgcgttactcgtcggccgtgtcgtcgcgacgcttttgagtggcaaaaggggaatgagtagaatatgttgacggattatgggatggttgaacagataaaagctgggccgataatttatgtaagcgcattaccttggcttgtcctctgacttcgcgtgaattgtcacaccatttgtaactttctttgactcataaatcagctgttatctaaagtgtttcctggcacaataaaattcgtttgtggtgggtccttcccatttttcattcgttgtcgtttgtttta

SEQ ID NO: 95991 - DNA, 664 bp, Heterodera glycines
  SCN-specific regions: Sequence locations=1-11,33-63,87-664
gtttgagacaggcaaacacaaagtaaataaatgacggccacaaccattgcccaggatccgactccctcccctcggcgtgtttttctccgtgacctttgttccctcttttgttgcccgccgctcccttcggctattgttgccaaattggcttttatgccaccggaaccgagttaccgaattttgaccaacgactcgggacggacgacgttggagctgatcgacggcaggacagagtggccacatgggcaagatgagctgaacaatgtcgaggtgttcttcacccgtactcaacgtcgcaataaaatcgcctgtatgttcgtccgacccttcgaactttcgcatttcacccttttgttttctcacggaaatgcggtggatattggccaaatgtgtaacttttaccttgggctcggctgtcgactgcggtgcaatgtgttcagctacgattactcgggttatggtcagtctacaggtcgtccttcggaaaaaaatctctacgcggatatcggctgcggcacttaaatctctcgaaagccgttatcaaattccaccggagcaggtcattttgtacggtcagagcattggaactgtgccttccatcgacttggccagttgtaatccgcgcatcgctggcctcgtcctccattctccacttctttccggc

SEQ ID NO: 95992 - DNA, 743 bp, Heterodera glycines
  SCN-specific regions: Sequence locations=1-743
attttgttcagtttagttggagatgaagcgagttacggctgatcaaaataaacaatcaaaatggcagtgatcagcgtaaatttgaattagcgcgaatttcatttttttcatacgtattatatatatgttatataggttttgagtttcgtttcaaaaaacaaaatctcccggccgaagtgaaaatgacaaatgtactcaattctccgatgctcgaagggattaaggacagcggacgacattttgtatcggggggaattgcaggtatggccgaggtttgtttcgcacatcctttcgactgtatgaaaacgcgattgcaaatcggccaattccatggcattctcgattgtgcgcgccgtacgctgcttaatgaaggcccatcaggtttttacaaaggccttttgccaccgcttgtcatcgaaacgccaaaacgtgcccttaaattcatggcttttgaccgctattggcgtgttctccgttcggatgcgcttcccacttggctggtgattgaatcattattccatgtccggactgttcaccggtctcactgaagctgtgctcgtttgtcccttcgaagtggtcaaagtgcgactccaatcggagctgaacacgcccttctttcaacaaaaaagttcagctaccgtcgcccgtgaaattgttcattcgaatggttggggcactgagggcctttaccgtggcattggtgctaacctttggaggcacggcgtgtggaactcgtgttactt

SEQ ID NO: 95993 - DNA, 619 bp, Heterodera glycines
  SCN-specific regions: Sequence locations=1-234,258-284,307-439,461 -483,505-566,599-619
cagcaccgaatgtcgaacagccagcaacgccggaaatcattgagaatatggaggtggaggttgaagcagttgcggaagctgaagccgaggaggagttggacccgaagggtcgggtgcagcaactgctggaaatgggcaagtctctggaatgggagatggccgtccaatcggacgatgagcaaatcctcgacctggatgatgatcttgagatgtttccaaggctgattttcctgcagctggccaagttcctgaagaatgcacctgatgggttgaacgaacagcaaaagaaggaactgaaaaaagtgttggtcaattggatggaagagcaaaagcagccatttacggtggatgaggaaatggcacaagtggacgaaactgtgcaaagtttgagcaccttctgtgaccaaattggcaaaagtttcaagggaactcctgccattttggacattttccttgatttccacaaaaatgaaactcttgaaactgagaaattggaattcatgtggaaaatggtgaaccgaaaggtaacgcactatgttaaaagcgttggccaattttacggcggcattaaaattgccaaggaaaatctgaagcaagtcaaaaaaattggcaaatgggc

SEQ ID NO: 95994 - DNA, 739 bp, Heterodera glycines
  SCN-specific regions: Sequence locations=1-278,300-467,489-739
aaatatttttttaaaacctatttctattttatactcacgctatctcaccaatgagtactaaccgaggacgaggacgtgtgtctttaccgaaagaccattctcaaacttctgaatatggaggtcgtggacgtgggatgtattctttccaccaaccggacgtgaaagaaagttcgcaaatcgctggccgtggacgtggaactactctccaacagaagacggaacacggaggcggctacagcatgggtatgcaacaacagcaagaaatttcaccaatgcgtgggccccgagggggccgaggacacgacgtctcgggacatggcttagaccgtcaccctgttgctcctaccatgccctctccagttccctttggtggcgtttccgccgtccaaccaacttctgggcgcggacagcttccatcgatgagccgttacggagcgtatgctgcattcaccaaacaacgtgaccaattggaccagcagaaagctgtgcttgaagaagtcgcgactcgcttggaagaacacaaaggggaggagacgagcgttggaagtcaggctgaggaagttacgagtacgacgttgcagcgtggtctgcttcagcacgaagtgggaggaatggaggcacagcaaatggttgtgggtgagcaggcgcaatgcccatctgctgagggtgttccgcatgccttcctttgcgccgggtgtcagttccgcgcggattgtgccaacttgcttcgtgccatcgg

SEQ ID NO: 95995 - DNA, 888 bp, Heterodera glycines
  SCN-specific regions: Sequence locations=1-279,301-888
agaaaatatttttttaaaacctatttctattttatactcacgatattctcatcaatgagtactaaccgaggacgaggacgtgtgtctttaccgagtggagaccattctcaaacttctgaatatgggggtcgtggacgtgggatgtattctttccaccaacaggacgtgaaagaaagttccgctggccgtggacgtggaactactctccaacagaagacggaacacggaggcggctacagtatgggtatgcaacaacagcaagaaatttcaccaatgcgtgggccccgagggggccgaggacacggcgtctcgggacatggcttagaccgtcaccctgttgctcctaccatgccctctccagttccctttggtggctttcccgccgtccaaccaacttctgggcgcggacagcttccgtcgatgagccgttacggagcgtatgctgcattcaccaaacaacgtgaccaaatggaccagcagaaagctgtgctcgaagaagtcgcgactcgattggaagaacacaaaggggatgagacgagcgttgaaagtcaggctgaggaagttacgagtacgacgttgcagcgtggtctgcttcagcacgaagtgggaggaatggaggaacagcaaatggttgtgggtgagcaggcgcaatgcccatctgctgagggtgttccgcatgccttcctttgcgccgggtgtcagttccgcgcggattgtgccaacttgcttcgtgccatcggtgctcttttgaaagacttcggcagtgctgcatctgttgacggaggacgcaacaacgggactacctaaaagacataacgaatcgtcataaatatctccaccgtattttaacactgaatttgagttctagatttccatttaattttctta

SEQ ID NO: 95996 - DNA, 651 bp, Heterodera glycines
  SCN-specific regions: Sequence locations=1-13,35-56,133-134,193 -369,393-456,478-560,583-586,621-651
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgaccgccgtcgaagccccgtgataaccccttcaactccatcttccgtgccaaacgtcaactgcccggacactggccagtgcgcctggcctccaacagccaagctgtccccctggtccgccccggccgtcccggacggcctggacagcccggacagcctggaggcgcaagacagccccgacagcctggaaagcctgggcaacccgcctcctccttgcccggccccgaacatcccctggcgcaccctgccctggttgggccccccccgcggcccccgaaggaaaaggaaccgcccgggccaccaagggagcccccggaaaacctggtaacccccccctccagggggggggaacctggaaaaccttgggggcccccggaccccaaggaaagacctggggaaacccgggaaaccccccgaaagccctgtgcaacccccggaaaacctgggaga

SEQ ID NO: 95997 - DNA, 341 bp, Heterodera glycines
  SCN-specific regions: Sequence locations=1-182,209-341
cagcgctcagttagcggcggagatgcggcgcagtcgcggatggacaaatgggtaccgaatcggacagtgacaaaaggccaaaacgaaacgaaaaaaaagacacttcggcaacgccataaaaaaaacaaaggcgcatcgaacagttgaaaagccaggcaattagcggaaagcaaacaattaattaatggctaattttgttttttgtaaatacccatccaaaacaacccccggggcattcgttcttcactcatttatttgtttaacggcgcattgaatctcagtgattttaaacacataatttatttctcacgaattgaaatgataaagtcggtttgataccc

SEQ ID NO: 95998 - DNA, 886 bp, Heterodera glycines
  SCN-specific regions: Sequence locations=1-47,70-439,462-513,535 -733,755-886
gtcattttctttccatccattcaaagagtcattctcccatcacccagataaataattaattaattaattgactgctcgttgattctcttaattgaccacaatgtttctgctaattgctctactgctcgtcgcttttcctctcttttgcggtgccatccccgcgctgcccaactcagccgcggcactaactcaacagcagcagcgcatgatgcaaattgatgctttttctgcggcggatgacgcacagcgaaaggacagcgacgccgcgggcggtgcggcgcccttcgctttcgaaccctccgagcaaaaggcattcgtactgaaagggttgcgtcgcgtgaagaatccgtcgccgccggcggtcgttccgaaactgacggcagatgccaaaatcatttcattgaacgcggacgacgacgagtggcgagaaatgggacaacaacagaaacaacagcagcaacacggcatgggccgacttttgccaccgacggattctttggcgcggagaatgagcggcgccgcggccgcggtggggacacaacgcgcgcaacggccgacggcgacggaagtctttggagacgccgcaaatggcgacgcactgataaatccggcagcgtttttcatgggcggcgccgacctggacagaattgctgcgccctcgtgccatttggtgggctgcgtcggccctttggccaacgacggggacatcgccatggagggacggacggggccgggcgcgggcggcacgcgccagtgccaccaaacatttgtgccgttgaacggctgctgggagaggggggcggtacgcgactcgtaccccgtgggaatggtgtgcacaatttgctgtgagtgcagcgctcagttagcggcagagatgcggcgcagt

SEQ ID NO: 95999 - DNA, 120 bp, Heterodera glycines
  SCN-specific regions: Sequence locations=1-120
gagaacggcggtccgggagttgccggcgaaattggaaatatgggcacatgcgaccactgcccaacgccacgcaccgccccgggctattaaacggaagaaaacagaacgaacaaaggaaat

SEQ ID NO: 96000 - DNA, 525 bp, Heterodera glycines
  SCN-specific regions: Sequence locations=1-199,221-234,260-286,308 -359,389-525
actagtggatcccccgggctgcaggaattcggcacgaggtgcttctgctgattgggataaaaaggtggccggttgggacgacaagaaagtgaacaaaggctgggaggaagccgaagcaccgctcaacatccgtgcccgtcgcggcggatgggatgagcgcattttgggcattcgtgaacaatgaatggagagaatgagtgaagaagaagaagaagaagaattcgggatggatgccaaaaaagtaaacattcattttcaatttaattccccctttccgcccccatttgagcccctttttccaaatttcaattatcaaatgcataaacctgttctttccctccaataaatgatccgattttaaaaaaaaaaaaaaaaaaaaaataaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcg

SEQ ID NO: 96001 - DNA, 360 bp, Heterodera glycines
  SCN-specific regions: Sequence locations=1-325,350-360
caacaaaattaggcttcttcaccgagacaaactgaagccatgcatgtggctcaacaaacacattcagtcgcactatcgtccgcttgaattgccctggacactttgcatcgttcaattttccaatggaacaatgaaacagtgaatgtttggagccacctgctcggcttcgtctggttcgtctacctccaatggtgggccctcaatgaatcgcttccgtcggtgaacgcgccgattgcggactattgggtgatgggcacggcaatgctgtgcagtcagctctgtatgcttctctcctctgcttaccatattttcgggtgccattcgcctcagcgccgcaaacaatggcttcgggccgacctt

SEQ ID NO: 96002 - DNA, 1008 bp, Heterodera glycines
  SCN-specific regions: Sequence locations=1-128,171-1008
ctaaacttaacctcacaatgaagcggttcaattcatgggcctcccaattggagaacgaactcgagggatggaaggacggatgtccctgcgactttcttccgaatatgtcgccaatttcggatgcaaatgactcctcttccctctcctcttcttcctcctggtcttcgccactccttcacaaatatcgcttgctaattgagcccggtaattctccgtttgaatacgtcgcccccggtgttagagctgttcgtcgtctttggaattttttgattttgcaagagaatttagctccaatatttgtgcgctattctttcgcaaaagcgaaggataaaatcgcttcttcggtcacaaaaggagcagatttgaacagtattttgaatgtaatcaaattagtccaccgcgagcacgacccaatcgtcgcatttgcagcgaattcgattaggcccggtgtgatggtcgtctccactgggcgtgagcttcaggaactgagcatcgaccgtgtgttggatgagcatgagcgggtcgtctcccgtctgcagcactatccgtcgaccagctcttttcttcttgcgcagaattgggccgagttggacatttcaatgcagcaaatccgtcgtgacccgctcagggacaacgatgactaccaattgctgatcccgggaagcgatggtcagccgggcaagaacatccccacgcaaacatcagcccatttgcggaaacgacttttttctggcgttcgccgtttggaggcccattcatcgctgccctactatgccagtggctcttccgatggttctgttttcctatgggaatggggcgttgaacagcctgtgttcgtcgcccgtgttgctggccaattcgcaaaagtggctaaattggcattcgctcagaacggcgcccgttttgcggctgtcgatggggatgggctgctgtccatttggcaggcacaacctggtgttccggcaaagaagccttatttcatccaaaagtgtcacaccaaatttgcat

SEQ ID NO: 96003 - DNA, 472 bp, Heterodera glycines
  SCN-specific regions: Sequence locations=1-128,153-161,183-284,306-472
tgatttgaatgggaaatgaaagcacataaaaggagcgaatgaatcagtgaaattattcaactttaatttgactgtgcttccgaattgtcaaaatcattaattaatttatcgcgcaaataatggccaacaaatttttaattgttgcttttattttgacaattgccatttttgtcaatggacaaagtgaggcgccaaacaattcgtcggaaatggcatcggaggagagcaattcggaagagtcgggcagtgaggagcagcagttcaacccattcaaatttcgacaatttgctggccacggcttttttggtccctcgtcgtccaacagttcggcaccgccgcccttcggcttttggcccccttttggacgaatgccgtcgccatttaaccgccccgccaaccgaccgccgtctgacaattgatcactttttgagtgatttttgtccgtcgatcagtgcgaaatgaaaccgttgat

SEQ ID NO: 96004 - DNA, 378 bp, Heterodera glycines
  misc_feature (145)..(145): n is a, c, g, or t
  misc_feature (161)..(161): n is a, c, g, or t
  SCN-specific regions: Sequence locations=1-378
tgactgtgcttccgaattgtcaaaatcattaataatttatcgcaaaaatggccaacaaatttttaattgctgcttttattttgacaatggccatttttgtcaatgggcaaagtgaggcgccgaacaattcgtcggaaatggcatncggaggagagcaattncggaagagtcgggcagtgaggagcagcagttcaacccattcaaatttcggccattttttggtccttcgtcgtccaacagttcggcaccgccgcccttcggcttttggcccttttttttgggcaaatgccattgccatttaaccgccccgccaaccgaccgccgtctgacaattgatcactttatgagtgatttttgtccgtcgatcagtgcgaaatg

SEQ ID NO: 96005 - DNA, 573 bp, Heterodera glycines
  SCN-specific regions: Sequence locations=1-418,440-573
ccaagtttgagcattaagattttttgattcaatgttggtcttacgcccacccgatggcgaacagtcagtgcgtcaacttatgttgctcaacatctcctgtcttccaatcaattatgggaccaatccgcgctcgactcattacaaaagggtgacacgaaatcgactagcggaaaaaggccctgacaatggggacgaatgcgacacgagcttttggaccatgatggcctatcgtcaccatttcaatgatcaaaatggcactgattgtgaggaagacgcccccatgcttgtgggtgccatcaccgtgtccaaccgaaacagcaactgttcctgttgcagttccaataaaaccgatggggtcgtccagccacaaaaacaaatgttttctgtccaaattcagacattggcgtgcgattataacgatttttcatttttatgaactgttatttgccccttttgcagtgttttgcccacttttcgtcgtcatggcgttgccactcgtctgttgaattcgctgataaaccaatgtgaaaaatgggctaacgtcgaaaatatctttttgcactgtcagacgac

SEQ ID NO: 96006 - DNA, 527 bp, Heterodera glycines
  SCN-specific regions: Sequence locations=1-25,67-67,89-411,441-527
caattaagcaaaacattcactttccatcctcccaaatttcccaaaaatttctcaaattctaaatttgaccctttctttctttttctttgaatcggccgaatgtcgtcgcttgagcaattggcttcacctcacaacgatttttacgagagtctcttcagacagctgaatccctccggaagtgccgaagtcgatgccgcgtctatcgctgcttttttgaaaacggcacacggcgttagcgtcgcacaactctctcagatttgggaaattgcgagcgaattgagcggatacaaaaatcgaagcgcactgaacaaaattggcgtgtatatatgtttaaagttggtcgcgggcattcagcatggcttccctctcgcgccctccgttctcgacgtgccgttgtccgccgtgccccaatttgagtttctgtccttccccacgccgcctcctctgccccccgtgccgcctccgccctccgcggactcaaaaagtccgtcagtctctgccgaattggccagcggaggaggcggtga

SEQ ID NO: 96007 - DNA, 473 bp, Heterodera glycines
  SCN-specific regions: Sequence locations=1-8,30-51,128-129,188 -298,322-425,447-473
atgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctgga

SEQ ID NO: 96008 - DNA, 357 bp, Heterodera glycines
  misc_feature (354)..(354): n is a, c, g, or t
  SCN-specific regions: Sequence locations=1-357
aattgatcaatctcaccacgaagatgaatgtttcgatagcgaattgttcttcatttcgtccaataaatggtcgccctttcgctaattgctaattcccccgttaattaccccccccccccaaatgcgtcgctatttaaaattttattttaccctccaatgcaaagtgtgcctttgcttgctcagctgctcgccactcactttccccttcaaataccgtccctttcgttttcctcgtgccatttccatttgcttttcatcccatttttaccttttctatgctttttccctcttttctgctactttttctgcccaccgtttttgctcccggcccaagtcgagaaaataaattgttcntcg

SEQ ID NO: 96009 - DNA, 459 bp, Heterodera glycines
  SCN-specific regions: Sequence locations=1-31,53-214,236-265,295 -299,322-459
tttgccaagacgtattaccaaggaaacgcaacgtctgctgcaggatcctgtccccggtatttcagcagttcctgatgaggccaatgcacggtactttcatgtgataatcgcgggtccggacgagtcgccatttgccgggggcgtgtttaagttggaattgtttctgccggaggagtatccaatggctgcaccgaaagttcgttttatgacaaagatttatcatccaaacattgacaaacttgggcgaatttgtcttgacatactcaaagataaatggtcaccagctttgcaaattcgcaccgttcttctctccattcaggcgcttctgtctgctccgaacccggacgacccgttggcaactgatgtggcagaacagtggaaaaacagcgaaacagaagcgattcaaactgcaaaacagtggacccgattgtatgcgcatgcctgattactgtgtgagtt

SEQ ID NO: 96010 - DNA, 474 bp, Heterodera glycines
  SCN-specific regions: Sequence locations=1-474
ggaaaatgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttttgcgcttcgttttggtgttttatgccattgccttttccttccgtacgattggtcggctgacaaatgttgactacgtccgttttatcaaattgctcggaaccgtgcgcaaatctccgcagaatgtcactttgctcgacacactcaaagactacgattttcaagtgtacgctgcgcccgctgattttaaagcatcgccaggccgaacggccaaatggcaccctccgcgtgaacgccttccggacttgaatcctccgcttaattttctgcgtcaggctatcg

SEQ ID NO: 96011 - DNA, 476 bp, Heterodera glycines
  SCN-specific regions: Sequence locations=1-51,73-124,146-333,355 -376,398-476
ccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccgcctccatgcaccccgtgccctggcggtcagcccggtaacaatggcccacctggacccccgggagcgccaggagcaccctgccagcccggcaccggaggaggacagccgcaacccggagagcccggcccacctggacccaatggccagcccggacaacccggacagcccggagcccctggacagcccggcgcggccggacagcccggcccgaagggacctcccggaggcccaggacagccaggcaatggcggagccccaggccagcccggccaacccggacagcctggaaaccccggagagcgcggaatc

SEQ ID NO: 96012 - DNA, 253 bp, Heterodera glycines; identical to SEQ ID NO: 78715
  SCN-specific regions: Sequence locations=1-253

SEQ ID NO: 96013 - DNA, 636 bp, Heterodera glycines
  SCN-specific regions: Sequence locations=1-25,53-104,127-364,386 -477,508-636
ggagtgtttcttcgctttcgtgtcttcaaatattttttgttaaaaatgatgaacattcggtccaacggcaaaattcggtttgctgtcagttgctcgtcaaacatgaaccgcagcatggaggcacactttttcttgcaaaaacgtggcttcaacgtgcaaagctttggctccggcaattacgtgaaattgcccggcccaagtgtggacaagccgaacatttacgagttcgactccaccacatatgagcacattttgcaggacctgaagcagaaagacagcaaactctatacccaaaacggtctgctgaacatgttggacaggaatcgacggataaaaaaatgtccacaaaaattccaaaattacaaggagaaattttgtgtcatcatttgtctggaggaacgggtgtatgaccagattgtcgactttttgcagacgcgcgagtcgaccaccggcgaaagtgtgcacgtgatcaacttcgacatccaggacaaccacgaggaggccaccatcggcgcgctgcacgtggtggaactgtgcaaaaagttggaagactgcgaagatttggacaacgaaattgacgaggcgctgtccgagttcgaggcgaataatccggagcgcaatttgctgcacacaatt

SEQ ID NO: 96014 - DNA, 229 bp, Heterodera glycines
  SCN-specific regions: Sequence locations=1-229
ccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacat

SEQ ID NO: 96015 - DNA, 1057 bp, Heterodera glycines
  misc_feature (1025)..(1025): n is a, c, g, or t
  SCN-specific regions: Sequence locations=1-69,91-1057
tgttccggcgcctgacatgggaacgggagaacgagaaatggcttgtattgctgatacgtatgctccaactgtgggacacactgacaaggaagcatcggcttgtgtcacgggaaagcctattgttgctggcggtattcatggacgtgtttcgacaacaggacgaggactctggaagggcttggctgttttcatcaatgatgaaaagttcatgactaaacttggccttaccactggcttcaagggaaatacattcatcgtccaacgattcagtaacgtcggcttgcactcccaccgttatttgcacagagatggtgcaatttgcatcggagtacaggaatatgactgcgcaatttacaatccgaatggaatccatcccaaagagcttgaggattggaaaatcgcaaatggttcaattcgcggctttcctggagccaaggctttcgagccattcaccgacttgattttcgagaagtgcgacatccttgtcccggccgcttgcgagaaagctattcacttggggaatgcacatcgtattcaagcaaaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatgagcgtgactccaactaccatcttttggcgtcggtgcagaagtcactcgagcgcaccttcgaccgtgccgttccggtggatcccagcgaggagttccaattgcgcattgccggtgccagcgagaaggacattgtccattctggccttgagtacacgatgaaccgttcggccaagcaaatcattgccaccacgaacaaatacaacttgggcttagacttgcgtactgctgcctatgccaacgccatcgaaaagatttaccaaacctatgagacgtctggctttaccttcgcttaatcgattnttcgacgcattcgtaatgtagttaattctcgg

SEQ ID NO: 96016 - DNA, 550 bp, Heterodera glycines
  SCN-specific regions: Sequence locations=1-550
ggagctccccgcggtggcggccgctctccaatagtggatcccccgggctgcaggtatccggcacgaggcccactttgggtacaagccaagtgaaaagcgtgcgaaaagaactgaaaatgcacctcctaagaatgctcaaacatcccggcactttcactttgcacaacctccacccgaggatgaagcaattgctcatcgaattgggcgcttctcagtccgaaattcaacgagcgatgcccgccatcaacgaaattgatgaggcactgaaaaagcgtttggccgctgcgacggcggtggccgctggcacggcacggcaaacgacgacggaaccgaaacggcacaggaaagagccgcaacagcacgaacaggaggatttggacttgagggacatcaagcggattaagttggatgaggacgaatacgacgatggcatcatcgacctttacaaacagttggacaaccccgactccgccaacgctgccactcagaaggcaattgacatcaccaccaattttgtattggaacggctctctattcacgtggtcactaa

SEQ ID NO: 96017 - DNA, 289 bp, Heterodera glycines
  SCN-specific regions: Sequence locations=1-75,97-207,229-289
ctgtgtgtccttttttcattggtcggttcgcgtcctcagctgctcaattcggtcagtacctcgggccttttgatcggaaaaggaagcgaagtcaaatcggcttcggtcccccttctgtcggagccaatgattgaaatccattcgcattcggcgccagtgtcgccttcggagttgaacttcagcagaagacgaaggaagcgcataagcaacaacaaatccaattgaacaagaaaatttataatacgtatcgcaaacttaaaaatcaaagaagtaaatcgtcaatgaattc

SEQ ID NO: 96018 - DNA, 511 bp, Heterodera glycines
  SCN-specific regions: Sequence locations=1-511
cacgggtacactgccggactgctcactttgccacttcctgcgcttgtctttctttgggggacgttggccagcccgcgcccctccaaattgttttggattgtcatgataatttacaccgaattcgaaatcgtggccaaattcgcttttcaattcggattttggccttggaatggggacacagtcggcaataacaaagtgtacaagacggagtatgtgttcggagttcagcgcattcagggctttgccggcaaggacgtcgccctgctcatcgcactctttttccaccgttatatgttgaggaaatttggactttggagagacgcaagttccgacagattgattaacgaaatgcccaaaaaacggatggacaatgggtcatcttcatcatcatctgctgaaaaaagtccacagaaatcgactcaatcgacggttgttccatcgtcgagtggagaaaactttgaatcggtggccaaggcacaacgggaacagaactccgacgacatcgaaaagg

SEQ ID NO: 96019 - DNA, 672 bp, Heterodera glycines
  misc_feature (669)..(669): n is a, c, g, or t
  SCN-specific regions: Sequence locations=1-93,115-643,667-672
tggaccccgacattttctctgtgcctcctaattccctttgtccattgagcaaacaattgcccatcctttgcgtgtttctgctgctcatttgcaacccacaaaggacaaaatgatgacacgaagggcattccgatgttccgagtgtgccacgatgctttacagggaccaattgtcgcccaatgatgtgaagccactacttcaaagctttgcgcttgaccatttccccgaaattcacatttcgaggcccgtaaaactcggccctggacaaaactctgccatttttctaactcttacaaataattcgtctggccctattgacatttcactgacggggaaaaggctcgaagaggaagaaaactgcgtaaataattctgatttctccctgcaacttgtcctctctaatcgcggctcgaccgacgaacagccaaaaatggcccatcagcaaagcgacagccgcatcattaacatcagtcagcacagagtgggcatttgcgcagaatgcgtcccttccgcggactcaattgaccactacgctctgttcagcctctcattcagccacacttcgtctgaccttccggagaagaagttgaaatccgacgtcatagtttcgttgaaacagtcataattctaccgtttattgtgctattaataatttatataaaatatcgnttg

SEQ ID NO: 96020 - DNA, 421 bp, Heterodera glycines
  SCN-specific regions: Sequence locations=1-421
cacaaaccgacgagggttagcgtcaaagtgatggacgaacgatatttggcgcagaacataaaaattgcacaccaacgactcgctgccattttgttgaagcaaaaggttgacgaggcgacacgccggcacgagtcccatcgaaaattgcgggttggcacgatggaacgggcggagaaaattcggacatacaattaccgggacaatcgcataacggaccatcggctcaaagtgacagtacacggggttggacaattcttggacggtggccaaatgcttgaacaaatggtggacgcactgatcgaaatgtacgaacaggaaagtgtggagcaaacgggggaacagccgaagaatgaggaggaagaaacgggcaaaaaagtttaatgttaaattttttttttgtccaataaagcatcatattttt

SEQ ID NO: 96021 - DNA, 367 bp, Heterodera glycines
  SCN-specific regions: Sequence locations=1-189,211-367
ggaatttgtgttggtcttgctatcaacaaatctctctgtgctgggatcgttttcaatccaatcactgatgagctatacaccgcaattgaagggaaaggcgccttgaaaaatggctttccaatttcagtttcatccgcgaaagcacttgatcaatctgttatttgtcaaacttttggtcagcataacatcaaagaaaagggagaaaaatggttggacaatgcattcggcaatttgcgctccgcagttctttcgggcacccacgggtacgttagttcatttttgagtcatcaatttcacgatcactgaagttgtgcatgtttagggggtctgcgattacttacgcttaatgtgtacatttcgttgttgc

SEQ ID NO: 96022 - DNA, 476 bp, Heterodera glycines
  SCN-specific regions: Sequence locations=1-9,55-128,154-371,394-476
cggcacgaggctcaatttatttgtttgtttgtgtttttattttctaaaaattacttagcaaattctcaccaacttccttcgtttcctggacaacaagaaccgttacagggacatcatcagcaacacgcacaacaacagcagcaacaacaacaagtaaatgctggagcggaacatcagcagcagcacgctcagtttggtggcgaacaagtcaaagacgaaggacacataaaggaacatctcgaggggaaagtcgaccctacggcacacatgacgccagaacaattgcaattccactatttcaatgcatgacttggacaaaaatggaaaattggatgggatcgaactaattaaggcgatcacccactttcaccaagaaaatgcaagtcctgggcatcaaggtgccagcattccgccgcctttacccaatgaaaatgaactggagaatatgatcgactcgattttgcgcgaagatgact

SEQ ID NO: 96023 - DNA, 573 bp, Heterodera glycines
  SCN-specific regions: Sequence locations=1-436,474-503,525-573
ggtgatgcgctccgaagttccggcaccgcacgcgctcggccgttcgcgctcgcttgccgatgtgttccgctccaactcgcgctatgccgagtcccaattttctcccaccgttgtgcccatcggaatgccgtcgaagccgatcagtgtccatcgaccgtatttgacttactccgcctattggccctatcgataccatcgaaatttcaacacttacgacaatcaaatcaccgattccttctattggcattaccctttccgcctttggacatcctacaaacacaattggtaccaatacgacagcccctattactatcgccgttaccatgacaattacaacattttctacaacactgaactgatgtcatacggaaatcggtcaaaactgatggagaatttgtaccaaggaacgccgatcacacaatgaaacgattggaacagagaagaagagacagaagagagagagagagagagagcggaaaaggaaattataagacaaagaaacaaaatgccaacatttttaaaaagattcaattgaaaaatatagcagaatattgaggatgaaaagaaaaaaag

SEQ ID NO: 96024 - DNA, 462 bp, Heterodera glycines
  SCN-specific regions: Sequence locations=1-462
gaaattgaagacatggaggaattttggaaacaagcgcaacaaatacaaacggacaatcacgaattgtccgaaagagtgtcttctttaactcgagagcacaacactcttcgcaccgaacatgaacgaattcttgtcgatcacaacactcttcgcaccgaacatgaacgaattcttgtcgatcacaacactcttcgcaccgagtatgaacgaattcttcagcgacagcttgacgatttccactattggattctttgtttcgccttctttatcccgccgctgtcaatattagccaccgcgcgtaacaatgggctctcatttccggtaactgttctgtccgcactcgccgcgacaaatttctgtgcctttctgtggatccccggcattctcttcgccttggcattttattttggtttgaggaagaacgcgaagaaagagtgatctgtacgaattggaattcccagt

SEQ ID NO: 96025 - DNA, 470 bp, Heterodera glycines
  SCN-specific regions: Sequence locations=1-7,32-437,459-470
ggaattttggaaacaaacgcaacaaatacaaacggacaatcacgaattgtccgaaagagtgtcttctttaactcgagagaacaacactcttcgcgtcgatcacaacactcttcgcgtcgatcacaacactcttcgcaccgaacatgaacgaattcttgtcgatcacaacactcttcgcaccgagtatgaacgaattcttcagcgacagcttgacgatttccactattggattctttgtttcgccttctttatcccgccgctgtcaatattagccaccgcgcgtaacaatgggctctcatttccggtaactgttctgtccgcactcgccgcgacaattttctgtgcctttctgtggatccccggcattctcttcgccttggcattttattttggtttgaggaataacgcgaagaaagagtgatctgtacgaattggaattcccagtctttcagtctgagtgtattttaaaa

SEQ ID NO: 96026 - DNA, 481 bp, Heterodera glycines
  SCN-specific regions: Sequence locations=1-481
cattaattaattatgagtgatcagcaacagtccaaaattgtgggtacggtaggcgctgtgtgcgcgctgggtacggtagcggtccttttgctgctgcttgtacagcggaagaagaagcaaagacaatgcaacacagaagaatatgtacgagctggacatgttgaacagctttacatctacccaatgaagtcatgtcgagggaacaaagttgactggcttgattgtggcgagcgaggttgtgcccatggataacagcgcgatcggcactttttggtggtcgattcggcacggcaaaatcaaatgctgaccggccgcatttacccaaaaatgttgctgatcagtgtccatgtcgagcagggcgtactccgtgttgatttcccgaaccgaagcagccctgtggaggtaaatctgaaggaagtggaagagcgaaacgttgtcctacgagcaaaactgttttctgacctccaaacggatgggttgg

SEQ ID NO: 96027 - DNA, 556 bp, Heterodera glycines
  SCN-specific regions: Sequence locations=1-556
ggcaataattccgtgtttaatcgttctttgaaagtcacaaaatgtccttccaacaaattttctccacctccgccggtcttttcggcttagtttttattacgtcgacgctttcggccccagcaccaaaaccgcgaaaaccaacaacaacacccagcagaaaagcagccattcaatgcttatctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggctatggcttcaacggatttgagaagcgatcgttcgattctttcacggggcccggctttacgggaatggacagaaaatgaacataaaatggacggatggccaaattcaatcaaatcgttaaaatttgaaatttctatgtgaccccagctgttttctttgctgaattgcaccagttcgatattctcaatttatgcgccatta

SEQ ID NO: 96028 - DNA, 575 bp, Heterodera glycines
  SCN-specific regions: Sequence locations=1-245,267-575
ctctcctcgaaagtcgcccggccgaaattggccggccttggcgcgagggatgtgttgcgaactgaagcaggactttgtttattcggcaatgaaatcgatgagcggacgacaccagtggaagcggggattgcctttgtgatcgcaaagagacgacgacaaacactcggattccctggggcggaaagaataattcggcagttggaaaagaaagacttcgtcaagaaaagggttggattggcatcaaccaaagcggggagggcagcgagaaataaaatgccaattgccaacccaacagatggttcttccgttggctttgtcaccagcggatgtccttcgccaactttagggaaaaacattggaatgggttatgtggacaaggcgtatgctaaagttgggaacattttgacggtcgaagctgggcgagacagaatgattgaggtcgaagtggtcaaaatgccatttgtgaaaagcgcctattatctgaagccgacttctgtgaacgaagacaaaaagaaatgattaacattaattattgtatttgcattttacattaaattatatatttccatttttaa

SEQ ID NO: 96029 - DNA, 593 bp, Heterodera glycines
  SCN-specific regions: Sequence locations=1-233,255-593
tgtttctggatgataaggagaaggaaaacggaacgaaaaattgcgaagctgaagctaaaaaggtggaattagaagatgaaaggaagcaaaaagaagttgaacagaacaatgctgggaagagatcaatcgcagttccccaaaatcagctgtcagtcgaattcttagccaacattgaaggccaccggggaacaacaaatattgttcgattttcgccaaatggaacttatatcgcttctggggatgcggacggctttctttttgtatggaaattggaacaagaagttttggaatgcgaagtgcaaatgctggaagagccggcgactgtccgacaacgtgacgccgaccccgaaatggacattccgccgaacaaggagaattgggcaagggcgtttcgaagtccgatacgacatgacggtgatgtgaccggaatctcctggtcaccggactctcaaatgctggcgtcagtgtccatggacgattcgggggctgtacaccgagcggaaaatgggaagcgagtttgggccatccgtaactttcgtcattttgcaaatggaattgcttgggatccttgtggcaaatatataataacgatg

SEQ ID NO: 96030 - DNA, 610 bp, Heterodera glycines
  SCN-specific regions: Sequence locations=1-610
gagaattaaagcattttaattgttcaatggaagtcaaattgaagccctattccgatccgtcccgttgggtggccatttacccgctgtacatcgatgcctccaagtcgttggcacagggtcgccgaattgcgaaggcgaaagcagtcaacaacccgacatgccaagaaatattcgatgttctcaaccacgccggccttcgctgtgaattggaacagaaaaaaacgcaccctcgggcgcagtcgcgtggcgccgccaacccgaaacagcaacaacaggaggagggacgaatccgagtgcaactcaaaggggacgacggagaaaatgtgggcgaaggggcggcacagccaaagttcatgacccgacaacaaatgatggaatacgctgcggaaatggtgcccaaactgaagacacggcagcagcaaacccaagtcgaacagaacgacgcgacggggaagcagaagaagcggaagtgaacgaacggacggacattcaaccaatgacatcaaaatgtacaattaatacaattgttgtttgttatatagaaactctcgttttctttttgatgttgtatagaattttggttagaaattaataacaaattcagacattt

SEQ ID NO: 96031 - DNA, 488 bp, Heterodera glycines
  SCN-specific regions: Sequence locations=1-7,29-54,76-488
ttttcgtctcttcaaattttctccctgacattaccatctgaaatgagtcttctgttcgttgtgtcaatgtttgtcgatggttgcgccattctttggagttattgggatcgcttcaaaaaaccaaaaaagaaaattttcatttccgccgactgttggctttgtgtcttcgatttgcttgcgccttcacaacttggcctcggaatttcaatgatcagccaccgttttgattattacgtggacgaacacttcaagacgcgcaaatggacgttgaaatctattcgaattcgacgcaaaattggaaagaatggcacaaagcaaatggcaattgtcaattacgattggaaaccattgccaattccgaaaattcgaatgccacgcaaagtcatcggattcaaaagcatcagaatcttatttatcgaccgcaatgccatcgcttttctccgccatttttgtcaaattttcgccgtctgtccaattaatttgtccat

SEQ ID NO: 96032 - DNA, 699 bp, Heterodera glycines
  SCN-specific regions: Sequence locations=1-699
ttgagaacgatttatggagaattgtttgtcgaatggaaatgattcatgccgttctggttcctttctactcgagatgaagccgtccactgatttggcttcgcttttcgttagccttcctgggcccgtgtcaaacgagggaaaagcggtggatgaaccactgggcattatgagggtggacaaccaatcgttggaaattgcttttgatgttcaggacattgctgaacaaacaggatgtcaatccgccgatttctcctcgtcaatgttttttcaaaaattcggtgctaaatttgtggacattatgctcgaaccgaccaccctttgttctccctcttgggccgatgctcaacaacggctgattatgtgcaaagtgcgggcggaggcggactgtgtgacgtttgcaccgaaaacaatcggactattggaggaggaattggcccagcgctgtctcttgcgagaatacgtcgaacgcatcgaacacaaccgaactttccacgtgaactgtcgccgatgcggtcatttgattcactcgcacagcaaaggtgactttgtgtttggtgtgtttcccaacgacgattggctggagacggcaccccaaatggattatttctgtgccctttcttccgattgttgcggtgctcatttggaaatgtcgtcggtgcagcctcggaattctggcgagggtattttgggcttttcgcc

SEQ ID NO: 96033 - DNA, 750 bp, Heterodera glycines
  SCN-specific regions: Sequence locations=1-421,443-684,707-750
aaagctggagctccccgcggtggcggccgctctccaactagtggatcccccgggctgcaggaattcggcacgaggaaaaggagacttctactacactgggtgacagaaagcacaatagagatttccaatgtttctccatttgctgggactgccccatcgaaaaaattcatccaaggacatctcgccaacatatcttttcgaaaactgaaatttgcaggtcgtatcggttgtattacaatggattcggaataatgtgaggaccgcgccattcatcttttggataacgcaattttcaagaagaactgtttgagtgttacaaaagcgattgatttaccgaagtgcccaaaaacggtttcagttgcgcaaaccgatgaagctgaaaagagttgcaaaatgctcgttactccgctcttcgatattccctatgaagaacagctcaaaatcaaattcgaccattccaaaaaagtgttggaattacttcaaaagaaattgacgcaagcgcacgcaacgaattctttaattgcgaaggaatccctccctaaaaatgttcttccctctccattaattgaacaatatcgcaacaaatgcgaattttctgtcggttattcgtccggcgacaaccgttctgcggtagttggttttatgagtggcaaaatggcgaacagacagtccaatgttttggcgccggatgagtgttcgaatctcacccgaaacactcggtcaattgtccgccattttgaggcatttgta

SEQ ID NO: 96034 - DNA, 475 bp, Heterodera glycines
  SCN-specific regions: Sequence locations=1-475
caattgccaattgtcccttccttttcgaccgttttttctatttccgtcgcttttcctcccctcccaaaatgggcgaagttcgctttcactccgattacgtttcctccaaccgcggaatcaccaaaatcatccaaattgtgctcggttttgtcgtctgttcggtgctttgttcgaattggtatggcgggtacagctgtttcggggagggccgcctcggttatgtgagcggattgaactttgtctgtttgatgattaacatcatccttttcctgctcaatctgttcaacattcgtccactgaaacttgaacaattgtacaatgtcgccgccgcccttcttctgctcgtcggcatcgtccttctgttatggtacatgatacagtactcttactggaacatttggatgataatcgcagcggtctgtgtgctgatcatctttttgctctttcaatgggacttcaaagggaaccgcacaat

SEQ ID NO: 96035 - DNA, 550 bp, Heterodera glycines
  SCN-specific regions: Sequence locations=1-176,198-265,288-550
aaagctggagctccccgcggtggcggccgctcttcactagtggatcccccgggctgcaggaattcggcacgaggcagcaacaaaatcaccaatccctggcgtcattcgacggacttttgttcttccgtcttgtaaaggccataagcaacagcagcaggtgtccataggcgacgaaaaggacggaaagacaacgacacttttggtgccaatgtttagccaggagctcgcttcattgcttgcgcctgaacaatcgactgacttctccattcggcttcaatccaaatctaacaattgcatttcccttcgcgttcaagtttgttgtacccttccttcaaaatcagaaaatgaaggtcaaccgttggaagagcctgccgaattggtgcagcactttcccatccgttgcgttgatcctttcgaaccgaaaatcgcaattttttgtgaaaatggaggaaaggcacaatgtttggtctttgggcaaaagtttcgggtgcaattacaactcaaatgcaacggaagagtggcagtgcataatgtacattggaaattgaat

SEQ ID NO: 96036 - DNA, 547 bp, Heterodera glycines
  SCN-specific regions: Sequence locations=1-61,83-430,452-547
cgtttctccaaggttttatcttttatcagtgccatttgataacataattcgcgcacattatgcttcggccgccacatttcccattgcttttgactgcgattgttgtcgtcatttgtttactctccggcactgcaaatggcgacaaaaacctgttggacgagctgcgcgatttggacattttccagctaaagagcggcgtttcggcgtgtccattgctcgtcggcgagcgatgccccgagtcgagtccgctttactacttcaaatgttgcggtgatctctactcgagctgttgcgttcggttgcaggattgggctgtcggcgtcatcgctcttctgatcgtgctgattttggtcgctgccttcataaatctgatccgctgcatcttttgtgcctgatccgtttgagtacgtcggatgaaacaattgaggacaaagcagtgaaattgttgtaaattcaatttccaattgcaacaaattctgggatctttttttccatggcacttaattttgtttttctttgagtgattccatcaatacattttttcatt

SEQ ID NO: 96037 - DNA, 476 bp, Heterodera glycines
  SCN-specific regions: Sequence locations=1-476
cttgacagtgcggatgcggagaacctggccttgatcaatcgtcccgatttgggggtgaccttcaccaaattgcattgctggcgactcactcaatactcaaagtgtgtgttccttgacgccgacacttttgtggtcaaaaattgcgacgaactctttgaacgacccgaattctctgcggcaccagacgttggatggcccgacattttcaacacaggcgtctttgtctttgttccctcggagcaaacatatcgcaatttgcttgattttgcactcgtttatgggtccttcgacggcggtgaccagggacttctgaacgcatatttcagcacatggcgtgaatcagatgctacccaccgtctcccgttcacttacaatgtcacgaccgttgccatttatggctatgccgccgctttgaagcgtttcgcgccgaacatcaaaataatccattttcttggcaagcaaaagccttgggctct

SEQ ID NO: 96038 - DNA, 475 bp, Heterodera glycines
  SCN-specific regions: Sequence locations=1-475
aggcgcgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacctgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggtttaagaagttggaggccgaatcgggcggccttcgagacgaagaggaggagcaggcggagaaagacgtgctgaaagggag

SEQ ID NO: 96039 - DNA, 732 bp, Heterodera glycines
  SCN-specific regions: Sequence locations=1-732
aacagatccctataaaattcaattcttgatcaattcccctcattcatcgcggcggtcatcaaaaaagaggaagcaaaaaaaacaaaaatgattggcatgatgaacaacgccggcatggacggacccgcggagtttttcgcgggccgtcgcgatttgtgcgaattgcttgtgccggcctcgtcgttagcagcggtggacggccaagcgcagccccacgcgccaccgccgaaggtttttgagccgacgcagcagaaaaaactgagctacacgggcagtggccgacggttggtggacggaaagccagaagtgaacgaaacgccagaggaaatgtggcgaaaagcgatgctcagggcaacctgcacaagagcagtgaaagaaatgcttggtgagaaacgccgcaaaagctccaaactgagacaattgatcagcagccaaagcggatcaattcgaaacttttttggcacagccaaaaaccttcgccatcggaccaccggcgccaatcaaccgcagcaacaggttgaggccggtggcaaagtgatcagcagcagaacggaggggccgggaaagcccgatcggatgatcatctgatcagagtaaggagaggaggagaaagacagcgcaactgaaagccaatcagtgatcagtggagaaccaatcgccttcaccgaacaaccaaataacctcacatttctttcgcctttccctcaataataaactgaatacattctcaaa

SEQ ID NO: 96040 - DNA, 958 bp, Heterodera glycines
  SCN-specific regions: Sequence locations=1-240,272-359,381-958
ttgaggcgcactttcaaaagtttaaatgcttttccaacgacaaaaattgccaaaaatttgtgccactcttttcccaaaatgccaaattcggcgatcgtccaactttgtcgagttggcaggcttcaccgcctccactgactccaagcagtacgcggctaaaaaactgttgttgctcaaaaacggcagctcccgaagttacaacgacgtgaacgtggcagccggacgttttgcggcattgctcaacaaaaagtacggcattcagaagggtgacactgtgttatgtcgaacttcaaaaaatgttgacgcgttggcactttatttggctgtccttcggcttggtgccatttacgtgccgcttaatcccacttacacaaaacgggaaacagagcattttgtgaacgacgctaaacccaaagtgatggtttcgcttaacgcatcggaggacgcctcatttactcagtccggctttgatgttaagcatgtgctgtgtgagaagcgattggcagaggaggcactgaagcaagagcccagctgtgaggttgaacccgcagaaaaggacgacgtggcatgcattttgtacacaagcggaaccacgggaagaccaaaaggtgccatggtcactcacggcggtttggtggccaatgccgagacgtgcactgacatttggcacttcagcgaaaatgatattaatttgcacgttttgcccttctaccacatccacggcctgttcatcagcttcaactgcacgctaatgtccaagtcgagttgcattttcttgcccaaattcgacgtggacgaaacaattgcgtatttgcccaaatcgaccgcgatgatgggcgtgccgacattttacgctcggatggtcgaacacgcgggactgaatcgggccgcggggaaaaacatgcgcgtgttcatcagcggctccgcgcaactaacgccccaagtggttgagaaattc

SEQ ID NO: 96041 - DNA, 560 bp, Heterodera glycines
  SCN-specific regions: Sequence locations=1-286,325-560
aggcgcacttccatgggccaacgtgggggaaatgaaagcgataggcgaggcaaagatcaaacgccagaagaaacaaccggaagccgttcgacgccaggcaatcgccgacttgctctccggatgcccgaacgagttcggccaggtcctcaaatacatcgacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagcagaagaatcgccaagaagcgtcaccgtgctgaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaaataaaggacattttgt

SEQ ID NO: 96042 - DNA, 480 bp, Heterodera glycines
  SCN-specific regions: Sequence locations=1-27,49-284,306-399,421-480
aaaaccaatcgccacccctggcgatggccccctcacaaatggtcaaaagcagccaaagtcatacggatgggttctgccagttgctccaccatcagtcacgtcccccgtgcgcttcgtccagcagttcggcttcatcttcgggctacgcgtccatggttaatagcattgtcaatccatgcgcaaatcgtttggccggaattgacgaggaggaaacagcgattggagggggaggaagcagcagcagaaggcaatcgacgaccattggggagagtggggaaaatgagggcgaagagaaagaaacagcggtgcaagaagattggcaagcagttgctgaagaagagcagaagcaacaacagaagggggccatcggcgcatttgcgtcgcccgaggggacaaattgctgtagcagcaaaaacccattgatgcgagatgattttcgccaattgccttcctctaatggactcgtcgaggcactttccg

SEQ ID NO: 96043 - DNA, 537 bp, Heterodera glycines
  SCN-specific regions: Sequence locations=1-196,218-537
aaataaaacaaataacaattttttctcagactctttcaccggtaccgggtccgccatcattgagaccacgcgcacgagggactaccgagaggtccgcaagaggaggaggacggagcaggacaaccgacaagcaacattccatcgacctccaaacaacagaaggacaaagagacgagcggagattccaaaatcgcattgccacccccaaaattggccataatcgttgaggccaccgaatcagcaccccgcggagtgatttgcccgacacttcctcccatttgttgcgcaatgacactggactggcgtcagtgtgagcagcatcgaatcggtgaaggtggtgtttacgtgccattccccggcggtgaacaatcgacgtgttcagaccgccaaaatcagtccgtcttcaccaactgttttgggaaccggaggacgggaaaattttgaattgagagccgttctgcgacagtccttcagcacatggttgacgtgcgcaagaagctggagttggaggtcaaaattgaccctgccatttttgtc

SEQ ID NO: 96044 - DNA, 624 bp, Heterodera glycines
  SCN-specific regions: Sequence locations=1-90,112-525,547-624
caatcgtcttcgcgctcttttaggccctctgatgacacggattcgcggggaagctgttcgtcacttttgatctgcttttcctattgttcttcaatcatatgtttcccttgcgccatttgtctttccatccgggtcattcagcagtatgagcgcgctgtgattttccgtcttgggaaagtgatgcgcgaggcggcagggcccggtctgatcttcattttgccatgcattgatgatttccgttgcattgatatgcgcacgacttccttcgacgttccgccgcaagaagttctgtccaaagactccgtctccgtcactgtggacgcagtgatttatttccgcgtgttcgatgccaacaaagctgtcgtcaatgttgagaatgcgacgatgtcaacacagcttttgggacagacgacgcttcgcaacattttgggcaccaaaactttgtccgaattgcttagcaaaagggaccagatcaatttcgaaatgcagcaagtgttggacaaactcaccgacgcttggggcgtaaaagttgagcgcgtcgatgtgaaggacgttcgcctgccgaaagatatgcaacgttcgatggccgcgtaagcggaggcggcgcgcgaagcgagggcaaag

SEQ ID NO: 96045 - DNA, 469 bp, Heterodera glycines
  SCN-specific regions: Sequence locations=1-283,305-469
tgagtattacgctaccaggtagagaagataatgatatgctaatccataacttagcgattcatggcatagccgctgccgaggggagtgcttgtagtagtggtagtgcgattgcttcacccgttatagccgcattacagggggaacacaatcaggcaatacgcttttccttcagcaagtatacgacccatgaagagattgcaaagaccgttgaagtattgcggcaccttgccttgtaaaaaggtgctaaaaaaagaaaagacaaaacgacgagacccgagaaagcaaaagaaccaaaggaagaaagcagaactgaggggaaccacgaaaaaacactagaagttcaaggaggatagggaagcgacataaacaaaatggttagagtagaacacacaatcaataggagagagaaaatcaaagagaagaaacaggactagctaagatcacaagcaaaataatagatagccaaaat

SEQ ID NO: 96046 - DNA, 790 bp, Heterodera glycines
  misc_feature (770)..(770): n is a, c, g, or t
  SCN-specific regions: Sequence locations=1-558,580-790
tcgtagaggcgttgaccgctcatttgttttgtgttgtgctgccagcgccgaccattcgtctcagcccttcccatcatttcaaattccattattcccgtgattgtccaaaatgatcggcggaatcctggaagatatctggacgagatttatcgacttggtggaggacatctctgatcagtacgacgattctgagcaaccaacaatcatccaccacgaaccggcaacaccaacaacaatgtttgacaactatggtccgattgagaagattgttgtggtcggcaccggcctcatgggcagtggcattgcgcaaattgcggtcgagtcgggcgtcaaagtgtgcctggtgggccgtagtcaagagaagtgtgatcagacccggctgaagatcaacacgggagtgcaaaagtcgatcaagaagcgcatggcaaatgaaactgccgaggcacaacagcagttggtcgaggcgacaatggaaagccttgagctggtgaccaacttggatgaagcgggcttgtcagatgccgacattgtcattgaggcggtggttgaaaatctgaaggtgaagcagaagctgttcacggaattggaagctaaggtcagcgagaagtgtctattggtcaccaacacttcgtcctttctgctcgaagacgtatcgtgcaaaatgggcgccgccaagcgcgagcagttcggcgggttgcatttcttcaacccggtgccggcgatgaagctggtggaggtggtgcccggcaatggcaccagcgacgcggcgnacgaagtgctggccaacttt

SEQ ID NO: 96047 - DNA, 506 bp, Heterodera glycines
  SCN-specific regions: Sequence locations=1-191,215-506
aaaatgcaagagacgcaaataattgtcggagtggcctctctgtgctccattttggccatcctcgccaccgttgttgtggtgccatcgctgtactcggagatcaatgagatcgccaccaaagtgcacgacggtgttcaggctttccgcgtggacactgactcggcctggaccgacctgatggacttacaaatcacagtcacgccgccgtccaagccgcgtcagaacccgttcagctccatcttccgccagaagcgtcagttgcccggccactgccaatgcgcgggtgtgcaacagccgaactgcccgcccggcccaccgggaccggcagggtcgccgggacagcctggccagcctggacagcccggaggacctggacagcccggagtaccaggacaacaaggtccgccttgccctgtctatacgcccccgtgccaacactgtcccgcgggaccccccggacagcccggaagccaaggaccgcaaggccgccccggagcacctggtca

SEQ ID NO: 96048 - DNA, 476 bp, Heterodera glycines
  SCN-specific regions: Sequence locations=1-280,302-476
ggaagctgacgcgggtctgctcatggctgggttcagagctgaactatgatcccgcaaagatcatgctttataagaatgtgttacatggtgacaagcccggcatgtggataccgcaccaacaattgttggaactgcaggttagccagatgctcaacctgaacacaggcagttacgacccacgttttcaacgcatcttcaaatttttctatgccaaattgccacttccaatggtcgactttgataatcatgcacatgtattgctgcacttgatgaatgaaaaattccagctaacggaaatgagtatttttgtggataaaaacgcaagcgtgcaaacactcctggatgaggcgagaaaagagttcaggttctcgtcgatggggaccaaaactcttagacttgtgcaagcctcggccgacgggacttttagagtctatcaggtcctcaagaacgacattctttacaaggatatccaactc

SEQ ID NO: 96049 - DNA, 535 bp, Heterodera glycines
  SCN-specific regions: Sequence locations=1-535
ttccctatttgaatcccccgggctgcagtatcaggcacgaggtgacagactccttatcttgacaaattgcctcccctccgaattctttgcaaattactccttttctccccaaaatatggactttaacctgaaaagattggccggggaggcgtccgggatgttcagccgagccaaacaactaaccgaggaaaagctattgaacgcggagaagacggaacttgaccctcatttcgagcaattgctcgccaaggcggataaaacggaggaacagtcgaagaaactgttgtccgccatggaggcgtatctgcagccgaacccagccctccgaatgggcgacctgttctatgaaaagatggaaatcacttcgccagcccccaatcgctcaaacactttggaataccttagcgaggcgatgcaggaggctgcccaatcctttggcaccgaaacgccattcggaggtgctttgcaaaaaattgcgcagacggaagccaaattgggcgctgccgaaagggaaatggtccaaacgacggccggg

SEQ ID NO: 96050 - DNA, 656 bp, Heterodera glycines
  SCN-specific regions: Sequence locations=1-656
cacctaccaccacctccggcattgactggcctcctaacggtgaacaaaccgaaggtgttagaaaaattgttggagggacaagttcttgggcctgaatcggctgtcatcgaaaatggaaaacgcaaaacaattccaatttgtggacgtccgcttggcattcgtcgattcaattcacaacaattcattgttgctgacgccgtgcttggcttactgctcatcaattttgaagaagagacaaaagaagtgctgttgccaagtataactgttgtggacaagaaacgcttgggcttcccagacgatttggacattgtggacaatgacacaattttgttcaccgatttgtccgcaaaatatggctacagtgattgtgatttggcattttttgagcacatccgggacggacgtctgcttgaatacaaagtgtccactggtcaattgcgagttctgatggacggtttagcagttgcgaatggtgtccaattgcacccagacaaaaattctgttttggtatgcgaaacggccatggctcgtatacaccgctattattttgctggccccaaaaaagggatgcagcaaatttttgtggacaatttgcccggtttccctgacaacatccgaatttcgcgcagcgcagattcattttatgtggcgttacc

SEQ ID NO: 96051 - DNA, 404 bp, Heterodera glycines
  misc_feature (148)..(148): n is a, c, g, or t
  misc_feature (152)..(152): n is a, c, g, or t
  misc_feature (183)..(183): n is a, c, g, or t
  misc_feature (204)..(204): n is a, c, g, or t
  SCN-specific regions: Sequence locations=1-4,26-47,124-125,148 -152,183-404
aagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacanccgnactcggcctggactgacttgatggacgtgcnaagtggtcgtgacgccgccgntcgaagcccccggtgataaacccccttcaaacttcatctttcgtgcccaaaagcaactgcccggaacttgccagtgcctggcctcaacagcaaattttcccctggtcgcccggccttcggccccctggaacccgacagctggaacccagaaacccgaaaccgaaagcttgcaaaacctccccttgcggccaaaatcccct

SEQ ID NO: 96052 - DNA, 300 bp, Heterodera glycines
  SCN-specific regions: Sequence locations=1-74,96-264,286-300
ctttactcgacaggtcggtgatccgtttccacggattaatcccatcgaagcaaagaaatcccttctctgcagagagtgcgctgacttcatttgttcagcgctccgccagtgtctctaatcgtcagtccccaatccaaaagaaaagacgccccatcaaaagctgtgcaggagtgtcgtgcccacccacacagcccaatggaaccccaaaagcagccgataatggcatttgacgccaacttttagtcggaggagcaccgtcagctccgccgggtcgcctttttctcgattgtgatctccacc

SEQ ID NO: 96053 - DNA, 499 bp, Heterodera glycines
  SCN-specific regions: Sequence locations=1-499
gaacccactcgtccattatgagggaactgccgaagaaatcatttgggcatgcgatggcaaattggatgccatggtggtcggcgccggcaccggcggaacaatgactggaatagcgaacaagatgcgacaaaagcttccgaattgcaaaatcattgccattgatcccgagggttccattttggccaatccgacaaatcgccaaaagcacgcctacgaaattgagggcatcggataccactttgtgccgtacaccactgatcgcaatttggtggacgaatggatcaaaacgaatgatgcgaatgcctttcgcaccgcgcggcgactgatcagcgaggagggattgctgtgcgggggttcttccggcgccaatgtttgggcggcgatggaagtggcaaaaacgatgggcagagggaaacgcgtggtcacaattctgccggacggaattccaaattacatgagcaaattcatcgacgacgaatggatgatagttaagggattt

SEQ ID NO: 96054 - DNA, 476 bp, Heterodera glycines
  SCN-specific regions: Sequence locations=1-476
gtcttgtcctgctcgactgttgcttcattgcactcgcctccacctccccaccgctccaccaccatggccccgaccgctacctcgtcgcaagagtaccgtcaacagacgtacaacctgccgcgcgccatccgcatggtgatcatgggcccgcccggtgcgggcaagggaacgcaagcccccgccatccggtcgcttttcggagcgtgccatttggccacgggcgacatgctgcgtgcggccgtgtctgctggtacccccttgggcaaggaagccaagaaggtcatggacgccggcggcctcgtctccgacgaaatcgttgtcggcctgatccgcgaaaacctcgacaccaacccggattgccgcaacggcttcattctggacgggttcccgcgcaccgtgacgcaagccgagaagctcgacgacatgcttgccgccaagcaccaggcgctgtcgcacgccgtcgaactcaagattga

SEQ ID NO: 96055 - DNA, 864 bp, Heterodera glycines
  SCN-specific regions: Sequence locations=1-358,380-758,780-864
gtcacaaaccatgggaatcaattgaatgcccaattagttttgatacgccgtgctgctgagtctggagacggacaacaaagcttgttgcacgtgtctgtaaggaggtttctggacgagaaagtgttcccggcaaatttctgaagtcgctggaaacttttcaatatttgtgcaaccagtgtgcaaaaaggtggaggaacagtcggaagaaagcgcaactcacaaaaaagaaggacgacactgagaaggagggagccgaggaacatcagcaggcaacaacatcgaaacctcaagccgacacacacgcgaaggaggaaagtgacgaggcaacactggttcggaacatggtcgatgagctggcgccactttgggaggagctgagcaattgcctgtcacttctcgagaaggccgaagattcgcaacatgcggttttgtgtcttcaaaatgctgccgaggcgtttttcctctcttattcgttggtgataccgcaaactgctcaattggctccatctgcactccctgaaactgcaccaactggcggttcttcacctcagttggcctcctcttctgcgggcggcaactccggcgaggatgagctgggccgataccagaaggaaatgttcacttttgcggaaaaacatcgatcggtgctcaatcaaattttacgtgggaacacgcagaacctggagggaagtgcctttgctattctcacacacttccccaaattgttggactttgacgtcaagacgaaatacttccacaaagaactcaagaaaatggacgagaggagcagatatcgtcacgaagacgttgcaatccgtgtgcgccggtctcatctgttcggtgacagttttcgcgagctctatc

SEQ ID NO: 96056 - DNA, 445 bp, Heterodera glycines
  SCN-specific regions: Sequence locations=1-199,226-445
aatgcaccaaggcataccaaatgtgccaacagtgtcgaacaacggaacatcgtttgggcgagtggcacctccgggaatttcggatacgatttctacaactacccaatttactataacagcgacaaatttaccaataacttcttttgtcacgacacaagatcctaacgttagaagcgaattcgaaaaagcggatgctcccgaaattttgaaaatttttattccacctaaacctccagcggtgccacaagaagcaaaaaagatttttgaggatttatgtgccggagggaaatgtttggtgcaaaaacctgaatttatacagcaaaaagcggcggtagagaaagaatcagagcaaatcgaactgaaattaaaccctgggaaaagtgcggagcaagtgaaaagggaagtgaaagtgcgcatggccaaaacgcagcagctgaagaaggca

SEQ ID NO: 96057 - DNA, 632 bp, Heterodera glycines
  SCN-specific regions: Sequence locations=1-632
gaaaaaaacaattggtaggtatttattcagcattttgtgacatcaatcagttgtacaaagggcaaagtgtgctaattgcagcaaaaaatgaacagacgttggatttgtggtgacgtgtggatggacattctgccatcttttgaccgtcctcaactcggcctcaaaatggcattgctttccgaccgtttcgatgttttggtggacaaacatttcgacagaaaaagcgaattgacaatttggagacgtatcagaattgacaaggacaaaggaccaaaagcgaaactgtctgttctgatcgatgacaaatgcgtggcatttccattgccggaccattcgctgcccatcaaaattcgctttaaggagcttcagattgattacattggccattccgtgatcacatttttgagttccaaccagcaaatttgggacagaaaaggcaccaatttggatttgtttatattcgcgacagatcacaacaatattcagtcgatctgggatgttttggcccgagaaatttggcccatttttgcgacaaacattcgccatttggcctttcgcaatggcgatcatttggacaatttgcgcagttacacttcaccaacaattctcactgatcttgatcaattgaattc

SEQ ID NO: 96058 - DNA, 795 bp, Heterodera glycines
  SCN-specific regions: Sequence locations=1-48,70-366,389-716,738-795
agaacataattcacttcttcttctgctaaaccctccgcaacagaagtcaaatttcagaaaagaaaatgcacgaagcgaaaattatagtcggaattgcttccctttgttcgctggccgcgattttggccactctcgtggtgatcccgcaactgtacactcaaatcaacgaaatgaacaaccgcgtgatggacggtgttcaggctttccgcgtgaacacggattccgcgtggactgagctgatggaggtgcagatcagtgtcactccgccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtgtcgacgtgtcagaaatgcccagctgggccgtccggtcagccaggaagccaaggaccgcctgggccacccggaaacgatggacagcccgggcagcctggacagggcggcggacaaggcccgcctggcccaccgggtcctcagggacagcctggccaacccggacaaccaggaggacctggccagcccggtcaacccggacaaccaggaatcaaaagcacgacaattcccggcccacctggacctcccggaaacccaggagcaccgggccagcccggcagccccggacagcccggaaaccccggaggac

SEQ ID NO: 96059 - DNA, 1126 bp, Heterodera glycines
  SCN-specific regions: Sequence locations=1-380,402-1030,1052 -1053,1076-1126
gtctttagctgatcagtgatcactgtcatatagagatacagtgatattttcgtttgttatgagtccgattgaccctgacaaaatggcattgctaaagcgccttttccccgtcctcggcaaacaccttcgcaagggcgactgtggcaaaatcggagtgatcggcggttcgcccgactacaccggtgcgccttatttcgcttcgatcaccccaatgaaaatcggtgccgatttggcctttgtttacgcccattccgacgctgctccggtgatcaaaagttacagtccggaactgatcgtttaccccagcaccgatttcgccacgaatagacacagcattgagcggttggacgcgctggtgttcgggccggggcttggccgacagaaacacacacaaaatttgctggcggacgtcgtaaatttcgtcaggagcaaacaaaatctttgtttggtcattgacgcggacggtctgttcttcgtcaaagaatgttcgcaactgttcaaagggtgcacagacaaagtgatcattacgccaaaccacagagaatttgttcggctttatacccaaatgttccctaaccagcagaagggagaggacacggacgaattgaaaattcaatgcgaaatggcggaacaattggcaaagcatttggaagtgactgtgatgagaaagggagagattgacataatctccaacggttccgccgcccaaacgcgaattgtccaagcggaaacttcgatgcgccgttgcggtggccaaggcgacattctcagcggcgcgacggcacttttcgcattttgggcaaggaaagcctcagatgccgacatttattcctccgagcatttgctggacggggcggaagccgcttcgcttttggtgcgcaacgcatcgctacggacctttcagtctgtcggccgatcgatgaacgctgccgacgtcattgaccacattgtgcccgttgtccgcgacattgactcggaactttcagcaaaagctgcgacaattacaacacgttgatttgtgtacgaaatcttttcaaaatttatttactttcctttaataaattctttttattttgactattgtgacccgatttatgcaaaaataaaaaagtttgctgaaaaaaaa

SEQ ID NO: 96060 - DNA, 475 bp, Heterodera glycines
  SCN-specific regions: Sequence locations=1-475
ccttaagcctttgctaatggaggttgaccatcaatcacttgacagcatttgcgaaaatattttgtcaatttctcgtcatttggatcttccgctagctgataatctcgacaatgcccatttgtcactcttcaagactaagctgactgaatttgctaaagaaagcaaaaaacaaaaagccattccgagtttattgcttccgtcgaatttgtcgttgaatgacaacgaatgggccaaatttggacagtacgtcgacttaatgaatgccgattatgcggagagggcattattgctgaagagacgtgccgaagtgaccatcgattcttttctttggtcggatcgcgtcaaacaaattgaggacaaaattcgacaggttttggaagtcggcggattcacaaatgttcattttgaccctgtccatgccgacgatgttttggccgctaatttggaccttttatatgtgacgaaaacaagtgac

SEQ ID NO: 96061 - DNA, 476 bp, Heterodera glycines
  SCN-specific regions: Sequence locations=1-54,76-118,145-163,191 -198,388-394,428-436,466-476
gttgctcctcgtcctctgtccttttgctcgcgcgctctggcccccacactctcaaccacaccccccaccatccaccatgtcggacgaaatttctgcccttgtgattgacaacggttcgggtatgtgcaaggccggtttcgccggtgacgatgctccccgctcggtcttcccttccattgttggtcgcccccgccaccacaatgtcatggccggcatgggccaaaaggactcgtacgttggtgacgaggcccaatccaagcgtggtatcctcacgctcaagtaccccattgagcacggtatcgtcaacaactgggacgatatggagaagatctggcatcacactttctacaacgagctccgtgttgcgcccgaggagcaccccgtcctcttgaccgaggccccgctcaaccccaaggtgaaccgtgaaaagatgacgcaaatcatgttcgagacgttcaacacgcccgccttctacg

SEQ ID NO: 96062 - DNA, 642 bp, Heterodera glycines
  SCN-specific regions: Sequence locations=1-642
cctcgtgccgcgacattctgacgcgtgagactcgcttcgccgaactgttgtacgcacacgcggcacagcttgcgttggccgagccgcgtgcgctcgttgacgctttgttggcactacagcagcaacatgcgtcgttggacgtgttgcaattgttgcccgccttccaacaatgcctggacaaacgcctgccggaccggcaagcgttggcggatgcgattttcgtttttttggattatttccctctccaaaatgcgtctccaccatttgtcaacttcaccattcatttgtacgccgtttttcggccccaaaaactgctcgtccatctgcaaaagtgcgccggcgagtcttcttcccaaccaccgtccgctttgactgcgagacgcactcacaatcattgtcatttcgatgtcgcccaagcacttcgtatttgcacagaaaatggcagcattgcacgagtgttctgtgtttttgctttgcctcgagcgtctttacgaggaagcgacgcgtttggcgttgcgtcacgttggcctcgcgtgtgccaaagagtgcgcgcgacgtttggacgccgactcagccgcagcagacgcattcgccccaatcgggcatttggcgtcctttcatgggccggtggatgaggaggat

SEQ ID NO: 96063 - DNA, 277 bp, Heterodera glycines
  misc_feature (275)..(275): n is a, c, g, or t
  SCN-specific regions: Sequence locations=1-277
cggaggagtgttcttcgaggacggcacacgaagacgttgaaaaggcacgaacagtccaaatgcaacaggagaagaagcggaagaagaacagtcactcccccgccccgcccctctccccactttccggtgtccttattgttcttattttttgtagtttccccaattcatccaaatttcgtccccaaaaaactgccatttgttccctccttcgatgagaagcgatcagtgatcactatccgaaattgcaaaagatcagcaaataaaaaaggatagcncg

SEQ ID NO: 96064 - DNA, 479 bp, Heterodera glycines
  SCN-specific regions: Sequence locations=1-479
caacaccagtgcgcgccaagctcgtctacacatttcgtcgcgacaactcatcacttcatcatgagcgacatgagcgcctacatgggatccggccccgccgagcctgcaccgtcgtccggcgccgcggaagcctcttcatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccgccagcgccggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttcc

SEQ ID NO: 96065 - DNA, 476 bp, Heterodera glycines
  SCN-specific regions: Sequence locations=1-476
ccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcgcaggagaagtccccggatcagagcgcctacatgtgagaagatgcaacaacgaccggcggatggatggacgaaacctgaagagcgagcgacctgtcagaagatgcaaagctaaagaagatgtcccataatcgtgatctgtatttattgatgtattgtacatttgtatgcatatatca

SEQ ID NO: 96066 - DNA, 693 bp, Heterodera glycines
  SCN-specific regions: Sequence locations=1-4,26-551,573-639,677-693
agaaagattgtttcaatttgacaatgacatcacaaaacgaaggagccgtcccggctgaagagaccaaaaagctggtcaaggagaaggacgaagccacggatggcttttacttccaacaaacgatgtaccgtatcagagacccacgcgtgtccattcccttctactgtaacgtgctcggaatgcggctgctcaagcaattggacttccctgagggaaaattctcgctctttttcatgggctacaaagatttggacgaaatcccttcggacgatgcggcccaaaagaaattcgccctctcaacccattcgaccatcgaactcactcacaattgggaacatggtacggacttcaagggctatcacaacggaaactcggaaccgcgtggattcggtcacattggcattgctgtgcccgacgtggactcggcttgcgcgcggtttgagcaattgggcgtaaagtttgtcaaaaaaaccgaacgaggggcgcatgagaggcttggcattcatcacggacccggacggctattggattgagattttcaatccaaacaacatgtgaaaaacgaacccaaaagattgagaattggattttcccattggcgaagcaatcaatttcgaaaaatcacaatagagcctagacattatttatttttatttataatcgaataaatatttatgacttgaaaagaaaaaa

SEQ ID NO: 96067 - DNA, 853 bp, Heterodera glycines
  SCN-specific regions: Sequence locations=1-317,339-853
ccaagtttgagatttgtctgatttcaaattggattgaaacttgagagtgccgatcttaatcgaattttgaagataatttcagaattcccatatattctttcgtaaaatgccccaaattttggatggaataaagcttgactttcgtgatgttttgctaatgcccaaacgttcacagctcgccagtcgttcagaagttgacttgaacagagaatttgtttttaagaactcgaaagcgacgtacacgggaattccaataattgcatcgaacatggacacagttggcacttttgaaatggcggaaacactcagccaatccaatttgttcactactgtacacaaacattacagtgttgaggaatggaaggaatttgctaatcgcgtcagaaacaattcgaatgtgctcaacaatatcgctatttcgtccgggtcgcgttccgatgaccttaccaaaatgcgtgacatttgcgacgccgtgcccgaaataaaattcatttgtctcgacgtggcaaacggctattctgaaactttcgttgactttgtgcgcaaagttcgggaggaattccgcacctccacaatttttgctggcaacgttgttaccaaagaaatggtggaacagctgattctgtcgggtgccgatgtggtcaaagttggcattgggccgggcagtgtgtgcaccacgcgtaaacagactggcgtcggttatccccaattcagcgccgttttggaatgtgcggatgcagcgcatggactcaacgggcacattatcagtgacggtggcacaacatgtgccggcgatgttgcgaaggcatttggcggcggcgctgacttcgttatgattggcggacaattcgct

SEQ ID NO: 96068 - DNA, 485 bp, Heterodera glycines
  SCN-specific regions: Sequence locations=1-485
tggctaatgattctcgcagttcttcgagcgcttcctcccgttctcgctcgcgtagtcgcagtcgttcgccacgccgtcgcgagcagcgtcggcgccgctcgcgttccaccttttcacgttctccatcacctggccaaaaacgactgcacatcggcaatttggacgagtcggtccgtcgtcgggacattgaagacgtttttggaaagtatggacggatcagcgactgttggatggccagttaccctcccttctacgcttttgtcgtgttcgaaaacaacaaagatgcgtccgcctgcatgaaagacttgggcaacacggcgtacatcaaagggtgtcgtgcgcgtgttacggtggctcttccaaggaatggtgcgacttatcgtcgcggaccgccgcctcctccgcgacgttattacgacgaggaggacagtcaccgacgccgtcgtcgttcgcgtactcgctcgccccgtcgtaggcgctcgccc

SEQ ID NO: 96069 - DNA, 527 bp, Heterodera glycines
  SCN-specific regions: Sequence locations=1-527
gtcaatcggtgctgtacctggacggtgtaaaattttctgatatacaggcaacaatacaaggcatttttctcgccgcttgtttcctgtttatctccagatcaaagcccctaaaaacactcgcgaaacaacgaccgatgaccaacattttcaatgtgtacactctgtccaccatcacaatacaatttgccgtccattttgcctgtttgattcacattgtcagacttgctcatgccttagaggagagaccaggaaaaactgagttggaaaaggagttcaaaccgaacttgttgaataccgccgtttatttgatgtccgcttctctgcaaattgcaacttttgccgtcaattaccgtggcagacctttcatggagagtttagttgaaaacaagcccctcttctactcaatcatttgctcttttggtgcaatggtcgcctttgcttcaaatacctttccggatctcaacaataaatttgagcttgtccacatccccgtcgaattgcgtgatacattgatttgttgtattttg

SEQ ID NO: 96070 - DNA, 471 bp, Heterodera glycines
  SCN-specific regions: Sequence locations=1-471
acgggcgaacgaaaagacaccgccacttggccatggcaactgtggccgttcatgtcctgcttgactctcgagttcccgcgcaattccattccaaattcattcactcattcccctttaggtgcatttgtccactctttcggggtaatgtcgagggccatttgtgcattttgccgaacggaaagcccttaaaaagggcaattcgaaaggattttcggcagtttagccatgaagagatggctttgttcctggaagtgatgggccgttacaaatccagtggcctttacactcggctcggaatgattcaccgccgttccggcgttcactcgggcccctccttcttaacgtggcatcgcgagtttctgaagcgacttgagattatcttccgctctcttttcccccaaaataccgacccctccctcggccttccttattgggattcttcgctggacggtgaccttccatcccccgaag

SEQ ID NO: 96071 - DNA, 476 bp, Heterodera glycines
  SCN-specific regions: Sequence locations=1-476
gattgttgccccaacccttacccggacatttgctattacttctccatcaaacgaaacccttcctactacctgttcacgctgatcatgccgtcggcactgatcaccaccattacggtggtcggctttttcacgccccattcgaccactggagaaaatacggagaagtgatgatggtatcggacaaattgcccgccacttccaactcagtgcccgtcctcggccaatattacattggactgatttgcatccaattcacggccacttatgtcacaacttggactttgggtcttcaaatggaaactcgggacggacaattccccgccgtttgcgccgttggcttatgcgagtgaacgcacacggcaattttttcgtgcgccaccttttgggccgcgagttgcgctgcacgcagcagagcattcggaatcgaatgagcaaatttgatcagctgttggaccgggcggacgatcggccgagtt

SEQ ID NO: 96072 - DNA, 616 bp, Heterodera glycines
  SCN-specific regions: Sequence locations=1-616
ttgagagaataaaatctcgtttttggcatccgttggaaatgaaattttcgcttctgttggctttcgcattcgctgtgccattggccaatgccgcgctcactttcccctccattggttatgtccaatcggcggctgtcaatggcactttgacatgcaatggaaagccaacgcatgccaaagtgaaactgtacgacgaggatgacacggacatggacgacctaatggacgaaggagtgaccgacgaggagggatttttccatctgagcggaaaagagagcgaaatcactccgatagagccaaaagtgaacatttatcacaattgcaacgacgacgaaagtcttaacccgctgaagaaagtgtgctacaaaaaaatttccatcgaccttcccgccagttatatcactgatggacccgtggccgaaaaagtgtttccgctgggcacccttaatttggccgggtcgttcaaaggcgaaacgcgcgactgtctcaactgatctgccgaggcggttgatgtaaagagaatggcacaaagaaaggctgaaaggcatttttggccacacaattcttttttcaattttcactcagtcgaataattaatgattctgtcgttggtaaa

SEQ ID NO: 96073 - DNA, 620 bp, Heterodera glycines
  SCN-specific regions: Sequence locations=1-36,60-620
tgagtgtccaatgggacaaagttccctatttctatcccatccaaataatccaatttgggctgggacaatacaatttggacagaaaaggggcggaagtgattgtccgaccattggccaacagagcgacaaatgccatgggcacggaaaatgccaacggaacgatggcattgggcgacggcgcgacagtccgtgtcaaactattccgtcgactgccacttttgcttttttctttgaaaacgcatcgaatggacagcgaatttgtgttggaattggaaaaacgccggagggaaggcggaacgatggaaatggcactgttttttaagcattcggaagcaaagggatgcgtgtggagtgatgagagcattaaggccccacgtctctccgctgtgtttaatatcggcccaaaaccaacaatgcgttgggtggattttgttattgacaacgatatttatgtgacaaaggcgttgaaatgttatgtgcccgaaaaaacggactcaaaataaatgcggcgacacaaagggaattgtgccgaaatcaaacgaacgcgaccgacgaaggctttcttccgaaatcgctgctcttcaaaggcccttgtcagcttcggctgcactctctccgac

SEQ ID NO: 96074 - DNA, 854 bp, Heterodera glycines
  SCN-specific regions: Sequence locations=1-854
actctccggtgaactcagctgaaagactgcacatttcgctgttagaatatatcaacgaaaccttcaaaaatgaggatttctaccattttctttctgtccaatatcggtcaaatgaactaattcaaaaatggtccaacaaaatattctacgacaacaaattggtcacttatcagttgacgaaaaacattcacttgcgccaaataataaaccaacaaaatgctgatctctcctctggtcctttgtcctcaaaacaaaaatttctgatcgatggtccgcttgtgctcatcgatacggacaaaggcatttctgacagtaaatggcagaaagtctacagcttgttcaagttgtggtatcccctctctttccgcgagggtcagaatgagcacacgcactccttccacaacattggcgaggctttctgtgccgtccttcacctccacgcgttgaatttattcggcggtttggatttgtcgaaaatcggttgtattacgccgtactcggcacaggcggaaaagattcaaaagttaatggccatgggaagggacgagggaccacgcttcgaagtcagctctgtcgacgccttccaagggcagcagcgagaagccattgtgatgtcattggtgcgcaacaacaaaatgcgcgacatcggtttcctgagagaacaccgtcggacaaatgtggcaattactcgcgccaaacgccaattccttttgatcgcctcttcacgaatgttgaatgtggaccggcttcttagagaactgtacggtgtaatcagaacggatggcctggtggtggggcccgacgctttgctgccaattgctcatgaaatttggcagtgtcatttggaaaggaag

SEQ ID NO: 96075 - DNA, 559 bp, Heterodera glycines
  SCN-specific regions: Sequence locations=1-459,481-559
gccaaacacccattcagttgcatcaatgaacaactttatatggacatggccgatcggctggcagaggacggattccgcgaggtcggctaccaatttgtgcacatcgacgactgttgggcggaaaaggcgcgggactcacagggccgaattgtggcagatccgactcggttcccatccggaattcgcaatttgtccgactatatgcacaaccgtggactgaaattgggcatttacggggacattggcacggagacgtgcgaaaattacccgggcagttaccagcactatgacatcgacgcgcaaacttttgcggattggaaggtggactatttgaagctggacgggtgctacatgaattcgtcgatgatgccggacgaatacccaaaaatgggcgtcgcactgaaccgcacgggacggcaaattgtctattcgtgctcatggcctgattatttcgatcacaattttgaagaaaagatcaattacaccgccgttgcctattggtgcaatttgtggcgcaactttgacgatattgcgcgatcgtgggcaagcgtgataaaga

SEQ ID NO: 96076 - DNA, 480 bp, Heterodera glycines
  SCN-specific regions: Sequence locations=1-480
gtttcgctcgacaaacaaacgccgaaactcactgagcaaatgatccgaaaatgccaagttctgcccatcgatttgccgcgtggcattgagacacagcgcgacaaagggatgattcagaacaataacccattctttcgtgctcacggtgttcgtgttgagacgaacatgatgcaagcagaggcgcaacacctttaccctccggcactcggtttctcggcacaaaatgaacaaatcgaaccgaacaatcgtggcgtgttggacttccgtttggctgaccgtggacaaccgttgccccgtcgctatttgcttccgtgtgaatttccggaggtttggactgttgtcatcgtgcaaaattctattcgcatggaccaatgcagatacttttgtgagaatttgatgcgatgtgctcaagcacgcggtgttcagatgggaaagccaagaattgatcctatggaagacacttcgcttaattatgttcgt

SEQ ID NO: 96077 - DNA, 474 bp, Heterodera glycines
  SCN-specific regions: Sequence locations=1-474
attttccaatcacacgtcacagccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttgacgagcctacggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcgttttctctcgtcaagccctgggttcgcgacaacaaaagtcatctgcagaaggtcgctgatttgtttgccattcaat

SEQ ID NO: 96078 - DNA, 475 bp, Heterodera glycines
  SCN-specific regions: Sequence locations=1-45,70-212,237-334,356 -375,412-475
gcaagcaccaccatcacatcacacacagccgcagcatcgttctgcttcatcattcattcattcatcggttatcgtccgtcacgcgacgcatcatgaggaagttcgcctacttcaaactgtgccaggccgtgctcacttccgtttttctgtggcaaattctctcaacccaccaattctgtggcgaatttgacgagcctacggccttcttcaattccgctgtctcctcttcctctgctggcggccattgcgaccaacagttcacgctcatcggaatggactccaccactggcgaatacggtgccgtgccggacaagcagaagtggcacatgcaactgatggcgagcagcggcggcggacaaggccaaccaattgatgaacaacaacagcaacagaagaatcagatggaggaattttcgtcaaaattgccgactgttggacgtcactgcattccgattgcgttttctctcgtcaaccc

SEQ ID NO: 96079 - DNA, 608 bp, Heterodera glycines
  SCN-specific regions: Sequence locations=1-383,415-501,523-559,581-608
cgtttctccgctcctcgtcaagtgctcaaatatttctataaacggacaaacgcattttgggacaaatcgatgctccacaaggagcgagtcgcatatgcaaagctccggctgaagctgtacggcgcgttggtgctttccatgtggtatatgtatgaattcgccactcctccgcctgacgtgcgctttgacatacggtggttcttcagcagctcatttgccaattatgtgcagacaaagggtgccggtggcttggacattgcggatgagaccatgtacaaacagttctcattttcgaagggcagattgttggagaatgcgctcgaaacgccggagggacaagcgatgggattgtccgaaaggtttcactcatgagagggacaagcaacgaagaagaagaggaggaggaggaaaagcgacgatcacagaagaatggcactttaaaagcaaaccgagaacagtcacacattctataggccactttcatttcattttgtccaatcctatttattaaatgaaataatatttctatttttttgtttgattgccatttctctttcttcggattgtttttcatttgtttcgtctgctgatgaatgccttttttgcta

SEQ ID NO: 96080 - DNA, 386 bp, Heterodera glycines
  SCN-specific regions: Sequence locations=1-334,357-386
ttccgctcactttcaatttcaaaatgttctccgtccgtttcttcgctttccttctgctgctggccgtcctttgcttttccctcgtcgagtgcggtctcatcggcattggtgccactcccattgaagccgcttggtgcggcgtcatcggccaagagtccacccattgcccgggaggtgcccttcacggcggatttcccgccgtcggcggaacatacggatttggccgatagaaagcggcgcatttggatacggattcttttggactactgacaaatcgctgagagtgaaataaataagttgaaataattgaataaatttggatagaatatcaagcttttcactcaaaattgttcatttatttgtggtttcaattacttaatgatctt

SEQ ID NO: 96081 - DNA, 954 bp, Heterodera glycines
  SCN-specific regions: Sequence locations=1-289,311-954
gcatttttcggcgttgtaatgtcaacggttgccacggtgatttgcatactcagcgtgccgctggcctaccaaaacttccagcagattggcaccaaaatgcagaatgagctcgagttttgcaagcagcgttcagggaacatactccgtgagctaacgcgtacgcaaacgcttgcccaagtggtcggcatcattggaaacgcacgtggcaacggcgcagccaaggccagaacggcaaggcacctcgtttacggcgaagcgggcgtctcgggttccgccgcgcaagccggcctctgctgcggctgtggcgtgtccccgcccggattgcccggacctcccggcccggtcggacagcccggatttgacggagtgccgggagcacctggacaaacagggccaaatggccaagccggtgcgagtggtggcggatcctttggcgcgggctgtggtgaatgtcagcctgcccaacctggtctgcctggcccgcccggacttcccggtccttccggaaacccgggacttcctggcccgaacggaggccaagggccgctgggaccgcctggtccacctgggcctgatggtcaacctggtgagtctggccagtctggccaacccggagcccccggcagaatcacagggtacggcccgacagtcgtcggacccccgggaccacccggacccaacgggtacccaggtgctcctggccaaccaggactgcccggctcgtttggacagcccggggggccgggacagcccggcgacgcgggaaagcccggcacgcccggaaaccccggagggaacggcggtccgggagttgccggcgaaattggaaatatgggcacatgcgaccactgcccaacgccacgcaccgccccgggctattaaacggaagaaaacagaacggacaaaggaaattcgacgcagaaaacttctattttccgtaggaccagacgaaat

SEQ ID NO: 96082 - DNA, 473 bp, Heterodera glycines
  SCN-specific regions: Sequence locations=1-473
tggaatactatctgaacctggccaaacagcttgtgaatgcgaatgcgcacattctgtcgattaaagacatggccggtgtgctgaagcccgaagcggccaaacttctcatcactgcacttcgtgaccaacacccggatgttccgattcacgtgcacacacatgacacttctggtgcaggtgtggccagcatgatcgaatgtgcccgtgcgggtgcggacgcgatagacgcggctatcgactcgatgagcggaatgacttctcagccttcgatgggtgcaattgtggcttcgttgcagcggacaccgcactccaccggtttggaaatggactcgatttcgcgatacaacgcttattgggagacggcacgtcaattttaccaacccttcgaatgcacggtgacaatgaaaagtggcaactcggatgtgtacaaccacgccatccccgggggtcaatatacgaatctccaattccag

SEQ ID NO: 96083 - DNA, 635 bp, Heterodera glycines
  SCN-specific regions: Sequence locations=1-452,581-635
catgtctgaccatttttgggacgaaaatgtcttcgatctgatcgttgaactagagaaggaaggccgccatgtacggcttgattggctgtcgtcaaattcagcgttggtcgaccgctttcaaacggacattgcgcgattgtccgaggaggaatattcgctctatgccgcctccagcagcaaacttcagcggatagcagcagccgaatgcgcgtacaaatacaaccggacggaggagttggataaactgtttgagaaggaccgcgactcggaggcgttgagggaaacaaatgtgaggcactttctgattaatcgcattctcgacgagttccggccgaacatccgtcgcctttctgccctgccaattgagcggacaattgacgcgttttgtttgaatcagccaaaggacattgaacagcacgtgttggatgtgtacgattttctgatggattgcccagaggcaccagcagcggcggaagcagcggcaccgagttaccaaggaggacaggagagcagcggaaccgcagagcaaccgcaggaagcggcagcgccagaggcaccggctgcggcagaagcagcggcaccgagttaccaaggaggacaggagagcagcggaaccgcagagcaaccgcaggaag

SEQ ID NO: 96084 - DNA, 580 bp, Heterodera glycines
  SCN-specific regions: Sequence locations=1-143,168-580
taactcagttcaattctccaaccacacgcagtatcccaatgtgaagggccagcggctgaacgaacgcgacttggccgaattgttcgacggaattcggaacgccgatttgcctgccaaatattcgcacattcttaccggctattgcggcgacgcctctttcctccgtcaaattgcttcgatcgttcgcgagtgtcgtcagcacaacccaaaactgacttatgtttgtgacccggtgatgggcgacaatggcaaatatgtgagcagaattaggcatttttgaaaagcatttatgtcaaagtacaacggaattccgcgcgaactgtgctcaatttaccgtgacgaacttctgccattgtccgatgtgatcactccgaacgcattcgaactgaggacattgccatagccaacgaaagggactgtcttcgtgccatggaacatttccaccgagtcaaacggattcgcatcgttgtggtgacttcgggggtgcctgacgaaacgacaaaaaacaaatcgatgatgcattgctacgcatcggaagccattccatccgccgtcgacaccatccgagtgcgctattttc

SEQ ID NO: 96085 - DNA, 512 bp, Heterodera glycines
  SCN-specific regions: Sequence locations=1-14,36-478,500-512
cttttaataggtaaatacaatgaaatattctttgctccgaccgtttgtgaatcgaatttttacgcccggcaaagagcagcagcaattggtgcaacgaaaccaaaatgaatttggaatggtcaaaacaaacgccgggcaatcggccattttattgcgatttgtcagttggataagcggcagggaacaaattgagcagcacttcagccgattcgggaagataaaggagacgctaatgttttatgacagagtgacgggaatgcaccgcggcttcgctgtcgtccatttcatctcaccacaaagtgcagctcaggccattcaacacaaaccgcatataattgacaacaaattgttggcggtcacttaccacacgccgcccgaaatccgacggaagacgaattagtgggaccgaataaacgaaacatttaaattgaaaattaataacggattaccaagcgagaagcacatgtgctacagacgttgttttatttaaacgaataaagaacaaacggcgg

SEQ ID NO: 96086 - DNA, 638 bp, Heterodera glycines
  SCN-specific regions: Sequence locations=1-457,479-590,612-638
acgcacagcgacggcgaaccgccgaggattcgctgtcgttggcccatttgcgaaaacactccgcgcactctgtgtaatccatcggtgcttccctacaaagagtacgtctatcacattcggcaacagttcgagcgcagtagggaacggacatccgcgcagaatgcttactcagactttgccgcacaggaagcgatacgacggcacgcatttgccaatttgcgcaaagagattacggaagattcggagggtccggtgacgcgaagcattcgcctcacttcagcgctcattctgcgcaacatttgtcaccattccgtcgccggacgtcgcaaactccgcacgcatgagagtttcattagttggctgtcactctcacacatggaatcagctcgtacattggcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttcgtctattgttaattgcaagcgttccttctccgtcgcgaatttgagcaattcgaatttctaatct

SEQ ID NO: 96087 - DNA, 479 bp, Heterodera glycines
  SCN-specific regions: Sequence locations=1-479
gtccaattaagcacaccatccacaaattttatccgagactgttttattgttttcggcaataactccgacgacaccttctccaaatacgcgaatatttgacgagatggacagacgaattaacaaaacagcgcggaacagaacgtgcagcatggtaacagtgacaacaaatggcaggcagcaaccgagaaagatagactatctgatcaagaagtttgatgcacttggatctggacgaccgccgatgccaacaagcgaaagtccgtcgaccagcgtcgattcccaattccttccggtcaccaaatctgcttcaacaaccatcgcgtcggcacttggatctggacgatcgccgatgccaacaagcgaaagtccgtcgaccagcgtcgattcccaattccttccggtcaccaaatctgcttcaacaaccatcgcgtcggcacttggatctggacgatcgccgatgccaacaagcgaaagtccgt

SEQ ID NO: 96088 - DNA, 472 bp, Heterodera glycines
  SCN-specific regions: Sequence locations=1-78,100-149,171-265,287-472
gccaacggaacttcaatttttggacgaatcggttgccgatgaagaggcggttcttggcagtgaaattacgctacaccaacacaaaatggagaaggaagaggaaaccacttttgaagagcacgacgacatgacagctccgaaatcggtttttggttcttcttcatttggctgcaacaaaagggagcactgcaaaagtgatgacgaggattattgtcacagcgcttgtgaagaggggccgacagaggagacaaagaatcattccccgccagaagaaagcagcaaagagaaggagggtgaacaggcggaagacacgggaactgggatgaccgacattgttgaagcagaagcgcttactgaacctggcactccccttcggcagatggacgagacgactaattcccagagaaatgaggaagaaacgtgcccaattcgagaggaggaacagcagacaaagacagaagagaattcgacg

SEQ ID NO: 96089 - DNA, 647 bp, Heterodera glycines
  SCN-specific regions: Sequence locations=1-58,86-430,453-647
agacattttactcaaactaaattcaaataaggcagttgtccttcggcggcccattgtcagcaaaaaagaagaaggaaaggaaaaatgaggacgaaaatgcacgtggttgtccttggaccgaagaaagtggggaagacttcacttttgaaaagtctgatcaatcagcacgacccaaagccaagcacttcctcgtccgatggccaactttacgttcccaccgtcgaagacactttccatgtccaattcggcgactttcgttccgttgaccaaatgccgcagcgctcacttctcattcttttccatgacactgctggcataacggactttggcagcattgagttgagaaaaccgtaccttcaggttgccgatgcctttctgctcgtttattccgttttggaccctttggctttaagtcaaatggaagcgttgaaaaaatatttggagagggaaaagaacggcacgagcaaagaacggaaggaagtaccaattgccgtggtcggaacaaattgcgaaatgtcgggcaaaaaagtgaacacggaaagtgcacttctctgggcgagtcgtgaaaaagtcaaactgttcgaagtgtccgcgaatgaccgaaaatcagtcgccgaaattgcgcagcacctcagcgaaagactcat

SEQ ID NO: 96090 - DNA, 626 bp, Heterodera glycines
  SCN-specific regions: Sequence locations=1-75,98-110,138-245,268 -506,536-626
cgggtgtccacctcccatcagttgcccgtgggccaatctcgtccatgtcgacagtcgatttcttcgtcaaactcaaataaacgggcggaaaacaatactttcaggtgcattctttttaaataagggttttttcaccagtcgaattagactaatttcactaacaaattaaaaaatgatattggacagacccaaaccaattggcggagttgcgagtcgctgtcggagtgagccgtaagctcaaaaataattcggtttttgttttgttccgtcagtgttgtccatgtttacaattagctgttgcttattattcgactttgcatttaaattcgcaatttcagccgaagcgacggaggacgcttttccatgagagggactcacaatcagccgaccaaaggacaaccgaaggcgagcgcagcgaaagccgtcgttcagcagcaaagccctgaaatggtggcatggctcagacggaaagagtacgacccgcggaaggcggcggcagaccaaagccaaagggaagcgcagcagagacagcagcagaactctttcatggcttgtcggtttttctccacctcggccaatgccaaaacgcccttcgcccgatggcgtcaaaatcgcaagagtcagca

SEQ ID NO: 96091 - DNA, 686 bp, Heterodera glycines
  SCN-specific regions: Sequence locations=1-25,60-686
ctcgattttcctttactagctgtgattctgattttacagactttctttttctcgccatttcttcatggactccgaaaatgcgttgcaatcattcaaagaattcaccggctgcactgacgatgacagcgcacgtcggctgttgtccaaatgcgcatggaatttggagagagccattgactttttcttctcgggacgaagggaagagggggatggggaagtgatgtgggacgagcagcagccgatgacgagccaaggaacacgacgacgaatttcgcactttgctaacagtttatggacaacgccagcgattggagggaacgcggcgaatggaaaccgacggacggacgaaacttctcacaaccaattccgaaccgcccgaatggacgatgattcggtgcaaaccctcgacgacagtgacgtacaaatggtcgaagaatctgacagaaaagcggcgccaccaccaaaagcagtgaatgggtccgcttcttctgacggcgttcgcgcgccaattgcgcctgtccaaggcgttctaattgagcagtcattccgcgagacatatcaaaatcgagaacgcctttggaacccggtgttcgagcagtatcgccaagaccatcaacagccctcctcgtcatctgcggcggcttcattcttatcacgcagagcaaacggtgcaaataatcgcattg

SEQ ID NO: 96092 - DNA, 462 bp, Heterodera glycines
  SCN-specific regions: Sequence locations=1-67,89-149,171-434,456-462
ctacatcatcggtgattcagaattggaactcgcccgagcctttcgcactccgtgccctttgtgcctcatcacaatctcagttcctgcgagtttgtatgcagtgttcagagatgaggcaaaatcgaattcacgcaactttgtttcgcacacaactcccccagcccagctccgttcatgctcaattttcgacgacgcccaaatgtttgtgccgattcatttgaccgatggccgagtcatttcactgccaatcgactcgcaatcgaccccctttgaattgtgcgaaatgttgtgccaacaaatttgtctcaaagatgcgtttggcttcggcctttttcttgccgttggtcgccgttttatccgttctttgggcgttggctccgaatgcgtgattgacgcaattgcatcgcttgagacgaaaagcgaaaaaaattggcgaattttctttaagaaagaattgtttag

SEQ ID NO: 96093 - DNA, 890 bp, Heterodera glycines
  SCN-specific regions: Sequence locations=1-45,69-366,388-865,887-890
tttcattggctgaccgaccatttccacttccatttgctgtttcggcacttccttttcactcctttttgctgcaactcaccagtaatgagcagcagccatcgcgagaccggcagaagtccaagaagtgtgctgatgcgccagtacgaaatgctgctgcaaaactcgaacgacaacagcggattccgtgcctggttcgacaataacaatctcttcaaatggcgcattctaatcgacgggccgccgggaacgccttacgcgggatgcaaactcacggcactgctccatttcccggcttcgtactcaaatgatccaccgacaatgaccttcctcaccgacattcttcatccgaacattgaccagagtggcaaagtctgcatcagcattcttcatgcgccgggcattgatccgcttggccatgagcagccgtccgagcgttggaatcccaaccgttccgtggagtccattttggtgtcgatccaagtgctgctggcagagccgaatttcaacagtcctgccaatgtggatgctgccattttgttccgcaacgatccggcacaatacaggaaggaagtgcgacggcgcgtggagatggagatagcgaggacggcaccaatactaccgggagcgcaaccgccgccggaagagcaggggacgcaaccgccggaagaacaggggacgacgcaagcggcagaagaacagagggcgcaaccgccggaagaacaggggacgcaaccgccggaacagcaagggacgacgcaaccgctggaacagcaagtgacgacgcaagcggtggaagaacaggggacgcaacagccagcgacaccgccgcctgaagggccgcagcaacaaacggacgaatggtacatgtgatgtgatgtgatgccctctga

SEQ ID NO: 96094 - DNA, 633 bp, Heterodera glycines
  SCN-specific regions: Sequence locations=22-507,529-633
ctcaatcacaaacaaaattctcggcggcaataaaaaggctgacaacacttatcaccaccaacagcaaaacaaatcgtcgtcagcagcaccgtttggcggcggtctcttgggcaaaatctcttcgacaatcgcttccgctgtcaattcgacgaatcaacagcattatccttcaactcagccccaacaaatgtcttccggcggttacaacaatcaatcgaattatccgggaggcgcccatccgcaacagtacggcaccggaaacactggcaacgctggtggatatccgcccgctgctccgccgtccgcgggtgcgtaccctccgcaacagtacggcggcattgctccaccgtacggcaccgctggttatccaccgcaatatcagccgacaccgtatccaacttccacaggcggttatgctccttcgtcgggtgcttccatcggatttaacattgacgctccttcggcgggcggcggaggttacccgccgtatcagcccaatttgggtggcggaggggcaccggtaccttcgccctacccccaacaaacggcgccgtatcagcaaccgccgtaccataccaccggcggtggtgccggggcctatccaacacaaacttttgggagtcaaccgcaaca

SEQ ID NO: 96095 - DNA, 436 bp, Heterodera glycines
  SCN-specific regions: Sequence locations=1-80,102-436
ccaagtttgagttttctgagaaaatgttctatgaaagagcactcaccgaatggagagacaaaatattaaaggacagtggtaataaaaatcacgcttttgttcttcggaaagcattatgcaatctcaaattgttttcgctcgacgtcaatggcttttcagacctaagaaaaatccgaggaattggcgttgacattgcgacccgattgtcttcggcttggaaattcacatgcgctactcacttttgcacagaatcccctacaattggccaaataaagtctctgaaaagtggcgaggcttttgtgttaatcgagcaatcgtcaactgaaaacggtggacgagttcccttagtggcgggcgccaaacagcgaaaggcaattccaagtcaaattggccaacagcaaaagagtcaaacgaacggaaaacaaaaaggacacca

SEQ ID NO: 96096 - DNA, 646 bp, Heterodera glycines
  SCN-specific regions: Sequence locations=1-69,96-280,302-305,328 -496,518-582,611-646
agtttgagaggaaaaccgtctcaaaaaatggacttcgaagccaggatcaaagcttaccgcttcgtggcctactccacggtgtccttctccatcatttcgctgctgtccgtttgcttcactttgcctatgcttcaaaattacgtgtccaatgtcgctcagaatatggacagggaattgagtgcttgtcagggttctgcaaaggacatttggtcggaagtgaaccaactgaagagcatccccgtggtgggaggaaatcgtacggcgcgtcaagcggacggatacggaggaggaggcggcgcagtgtccggcggaggaggaggaggtggctcgtgcagtgaatgctgctcaggcggaggcccgggcccagcaggtcccccgggaccgcccggcaatcccggaaaccccggagcacccggatcaccaggacaacccgggaaatctgtttccgctccatgcgaacaagctaccccgcctccgtgcaaaccgtgccctggcggccaacccggccagcccggccctcccggaccgcccggccagcccggctcaccagggcagcccggaagtggtggcggaaaccccgagccaggacctcctggacctcccggaccacctggaaaccccggagggcccggccaacctggaggcc

SEQ ID NO: 96097 - DNA, 483 bp, Heterodera glycines
  SCN-specific regions: Sequence locations=1-18,46-242,264-483
aaatgtcaaatcaatcaacttcttctgctgctgctgctgccggatcgacggcgccgccatcgccttcgaacgaagcttcttctccttcggccgctcaagcgtcaagtcagtcatcgtctgctgctggtgattcgtcagcctctcccaatggaccgcgtcttaagccgcgtaaagtgcccgtcaaccgcttcagggatgttcgtccggcactgcagctgcgactcagtcagttgaagcatccgttaatcaggaaactggagcaggacaccggcattgaccgtgagaggctcttttacatggctatggcatatttcgtgttcctgctcctgttcactcagtgtaagcttctgctctccactctcatcggctcagtctatcccgcctatcagagcattgtgactgtccatactcaggccaaaagcgaagagattcagtggctcacttattggtgtttgttctctctgttttctctgtgtgacattt

SEQ ID NO: 96098 - DNA, 475 bp, Heterodera glycines
  SCN-specific regions: Sequence locations=1-51,77-475
tgaggtcaattcgctttcttttcctggatgattcctctttttcccctccggggtcctttctcttcttttccccgcactttccactcaaaatctccgcttcatcagacaaaaacttcgcttttggttggaccggctgttcgccttctgctcggtcattacgacatcaaaacgagcgtgctcagagcatcggggccaaagaaaaacattctcaaaagcgatgtgctgagtcacataaatgacaaaaaactgtctccgattaaagcattttcggctaagccaccatcaaaaatgtctcttgaaaacgaagtgatctccgcgtcatcacatccgatcattccgctaaaatcatcgggtcggtccgagccgactcatcgccatgtccatgtggacattcaattgtcggaaatgcgtcagaatcaaacaaaacaatttgtgcagtcaaggaattcaattccccatgcttatgcgtcggccc

SEQ ID NO: 96099 - DNA, 311 bp, Heterodera glycines
  SCN-specific regions: Sequence locations=1-311
aagtaacgctggagggcagaactcgactcccgcagagagtgcaggaactcgtgatcgacattggcaatgccatgacaagcattcaacaaacttcgggttctacagatttactgattacttcgattcgaaatttcacttcttctgatggaataatggcaaattctgaacaaaatctcgtcaaaattcaaaatcaaatggaccgaattgagactcaaacgaatggcgctgagcaaaaccttaaaaatgtttcatcagtgaacaattttcttgatgctttggagcaaagtgcgtattgtacaaattttgacgac

SEQ ID NO: 96100 - DNA, 687 bp, Heterodera glycines
  SCN-specific regions: Sequence locations=1-687
attaagaccacgtaattctgagtgggaattgttcgtcgcacatgcaacaaaatgaatgctttccgcttaatcgctgatctttcccacctttttgcaattcttattttgctgtggaagatatggaaaacgcgttcttgtgccggactcagcggaaagtctcaagtgctttttgctttggtgttcacctgccgttacttggacatccttcactttatctccatttacaacaccttaatgaaggttctgttcatcggttctctcttcgccacctgttatttcatgttcgtcaaattccgtgccacttacaataaagacgaggacactttccgcgtcgaacttctcgtcctcccgtgcattgtgctggcgctgtttgtcaacgccgatttcactgcgttggaagttttgtggaccttcagcatttacctcgaggctgtcgcgattttgccccaacttttcatgcttcaaaaacgcggcgaagcggagacaatcactgcccattatctgtttctgcttggcatttaccgcgctttatacattttcaattgggtctatcgctattacactgaggcgttctacgacccaattgtgatcgtttcgggcattgttcaaactgttctgtacgccgatttcttctatctttacgtcactcgagtagtcaaagatggagccaaattggaattgccgatc

SEQ ID NO: 96101 - DNA, 480 bp, Heterodera glycines
  SCN-specific regions: Sequence locations=1-5,44-92,115-126,148-480
aaaagataaaaaatattaattaaattaattttattttattaaagtggccaataaaatggcattggcaaaacttaaaacatcagtttttgccatttttgttgtgctttttgtttcaattgacaagtgccgatgtacaaacattctgttcacctttttccatgacacgggaagccatttccaatcggtgtttccattgatgcaaaagctggcgagtcggggcaataatgtgtccgttttggacacagtttatgagcaggaccatagccttgaaatccatcactttcgggcgcttttgcccaaacaccataacgatgaaacatctaaacgtcactttgccaatgacatttggtcacgccgtctttccgccactgatttggccctttattttgggacatgtgacaaggaactcggaattttgatgcaaaatcacagccaaaaaattgttcagctgttcgacaccaattgggatgtcattgtgct

SEQ ID NO: 96102 - DNA, 476 bp, Heterodera glycines
  SCN-specific regions: Sequence locations=1-1,24-359,383-476
cttgtctctttccaattcctcatttgacaaagtcaaagatcagatgggcaagatgaattcgaaattgataaaaatggaatcggaagttcgcaaatggaagaaccaagcggaggataacgcgagacgcgtgtcggcactgagcgatgaaaaagtcgaaatcgaacggaatctttcgttgaaggaccgtcagctcgtccaactgcaggaattatgccgagtgctgaaaagagagggagacaaaccgaaccgacagaacgaaaacggagaagtgacggaaagggacggggaattggaagcaggggcaattgactgatgaaggacagaaacggacgaatctttggaaatgttcggatggtgtcgttgattttggacggacaaatgggctaattcaaagtggcactaatcgacgctagctttaacttttttaaatttttctactctattgcttaattttgtgtatataaatgctttttagt

SEQ ID NO: 96103 - DNA, 685 bp, Heterodera glycines
  SCN-specific regions: Sequence locations=1-158,185-232,254-305,327 -460,485-540,562-685
agaaaactttgcaaaaaaaaatggccgacttcgaagggcgtgtcaaagcttaccgtttcgtggcttacacgacggtttctttctccatcatctcacttttgtcggtgtgcttgacactgccaatgctgaagagttacgtgtccaacgtgggcatgaaaatggactctgagctcagctcatgccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccggaaaccccggagcgcccggctcaccaggacagcccggacaaaccccgcagacgccttgcgagcaagtgcacccgcaagcccgccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccctcggatagcaacggaatgtgtcccttatactgtgcacgggaccgaggatggctctttgagg

SEQ ID NO: 96104 - DNA, 478 bp, Heterodera glycines
  SCN-specific regions: Sequence locations=1-250,272-478
taagttcgttttaatgccttccgctagagtttcttcggctgattcttctgccgtctctgtgtccaacaaaggcatttctcttggtctttcctcctctggcacttctccgagtaatgtcattgtttcctccgtgcctgtcaatagcggcacttttcgtggtctttcccccattggcaatgtttcttcgctcgttcgcgacgtcttcggccctttagcggccgttcgaaggcaaagtccgacggttcaagtcgccgcgggggcaggcggaggaataatcgcaggttacgtttttgggaagaccagcaaaatggttgccattctcctgggctcgaccgttctcttccttcagttcgcccaatgcaaaggctatctgcaaattcaaaacggaaaactccgagaggacttcgaggcggcacgcgacaaattgggcgaaatgatcgacggaatgggtgccattggcggcgaagcggtggtggga

SEQ ID NO: 96105 - DNA, 476 bp, Heterodera glycines
  SCN-specific regions: Sequence locations=1-63,86-311,333-476
gttcggtgtctcctccccctcctccgtcttcaaatgaatgccctcctccgcttgtgccatgtcagtatgaatatttggaccacacggccgacgttcagctccacgcgtggggccaatcgctgggcgaagcgttggagcaactgacaattgcgctttacgggtatatgaccatcgaaattgaccgagttgagcccatttacacgatggacttctccgcttccggccacgacctttccgcattggtttataatttgttggacaattgcctctacagtttttgtgctgagccttttttcattggacggttcgccaaatttctgaatttgaaaaaaccatcgggaaacactggcgaagaattgtcggtgcaaattcgaatttggggcgaatcgttcgacccgcaaaagcatccgcagggcactgaaataaaagctattacttattcgaatatgcaaataatacggaaagaggaggaggag

SEQ ID NO: 96106 - DNA, 632 bp, Heterodera glycines
  SCN-specific regions: Sequence locations=1-319,341-357,379-632
gctctaacaaatggatgtgctggttcggctttcacgtgacaaatggctctctcgtcgcggcgtggattttttctattggccggcatttttgccttttcaagtgtcctccaaatgcttgtttttcgtcacttttatattgaacacattttcaatttgatttcgcccattttgcttttgtgcggaagtgtgccgataattgttggagaaatgcgcgggcaaagaaccagcaaaatgtatcgaccatttctgatcactaccgccatttcttttgcaataacggcgtttcccgaacttgttggtaaagtgctacgttttatacgagccggctttgatactcattactttcttgatttgtggccttacactctggcccttatctcaatttggctttacccaattgtgtatcgggcgtacaaatttgttcaacaaaatgaggaacacaaaaacggtggaccgtatggacagaatgccaaagtgatcaatcaacagtatgccaaagtggtgccaatgccattgccaaatgccgaaatgattggataattgcattcttttatatggaatatggataaattagggcgatcacaagctgttttttatgcaactatggaacaaatcatggctcacaagttgtt

SEQ ID NO: 96107 - DNA, 475 bp, Heterodera glycines
  SCN-specific regions: Sequence locations=1-475
atttaattttggtgaaaatgtttaaatttgcaaaaccgatgaccaccaccgccgctcggatgattgcgcgcaagtcgcgtttggaggtgatgccgatggccaagaagtacaccgagtcaggctaccagcgtgagctcacttaccggcgttccgactattcatttcccgcattctgcgagtccgatgtcacccacttcaagcgtggcgaagtgcaccacaaattgatgcagggcggcgcgtcggagggcggcttcacattgactgcgtatgtgctggttgctttgctggagaaccacgtgcagaacaaagtgacggaattggcacgaagctatttggtgtcacacctcgccgacttcaaagaggacccgtacgcgttgacgttgtgcacttatgtgctgcatttggcgaacagtccggagaagggtgacgtgctgaagatgttggaaggccttcaaacaaccggcaccacagatgg

SEQ ID NO: 96108 - DNA, 444 bp, Heterodera glycines
  SCN-specific regions: Sequence locations=1-68,95-213,240-444
gtcagccctcctggcaatttcaatcaaagcttcttcctctccgcttgcttcttcattcatactcatcagctgtttctcttctctctctgctcttaaaaatgattggctcaactgctcggtgtgttgcgcttttgctgctcggcgccacaatggcacaagcattcctcacgacatttaacgttgcaccgaacgcctttcgaaaccgacgcggatgcggaggaggaggaggcggcggatgcggtggcgccccaccaagcgttggcggtccagtccaactcactctcggctgcggaggtgcgcctcagccgcagcaagcgccgccaccatctggtggatgcggtggtggaggatgcggtgggggaggatgcggtgctcctccaccaaatggtggcggtgcgatcaaactgacgctcggatgcgaaaggcctccgccccaagcacctg

SEQ ID NO: 96109 - DNA, 649 bp, Heterodera glycines
  SCN-specific regions: Sequence locations=1-649
aattcgtgttaacaaatgatataatgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcattgaattgtacgctcttttccacgggacaatgtccggattggtgctggaactgatggagggcggttctctgagtgaatgtgagtcaaattttggcatttcgaaacgcactgacaaatcactgtgccagcagtaattcaccagcgcaaaagcatcgtttatcaggtggcacaaaactatgcaaaaatgaccaattgttaacagaattgtcatgtgattaattggactttccaagtggccaaagcattggaatatttgcacaagcttagtttcatccatcgcgacgtcaaaccctccaagttttgttgtttcgaatttcgtctatggaagggtcacccattt

SEQ ID NO: 96110 - DNA, 541 bp, Heterodera glycines
  SCN-specific regions: Sequence locations=1-131,158-541
cgtaggggaccgcctgaattgggaatagtttggaggaccattaacatccgttggtactgccacggtgttttcaaggcacttctctcttttgagtttgccaattactcccgtctgaacgaatccgaagtcgaccctttgctgctttcctgggatggtctgatgcgtttttttggagatttggacgtcctttcccgggttcgcttttgcgatgccatcgatgtcaaaaccctttccaatgcgttggcccatttgtttaattctctctccgaccccccggggcataaagatgccatttgcgttgtttctaatgtcaacgaccttttcactggcccctttcactataaattggtggaccgtcctttctatcgtgaacattttacgaggaatctcttcttccggactttggccacaatccccgctttgtttcgcgaatggcacggcactctcagcaaaacggaagcgaacacagtcaatgaatactcccaaaaatatgtccgaatcctgtccaaagtgcgtgagatcaaatgcacttatcggctgg

SEQ ID NO: 96111 - DNA, 643 bp, Heterodera glycines
  SCN-specific regions: Sequence locations=1-100,122-643
tggaggagcagtcgcatcagttggcactgccacggcttttcaaggcacttctctcttttgagtttgccaattactcccgtctgaacgaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggggcataaagatgccatttgcgttgtttctaatgtcgacgagcttttcgctggcccttttcactataaattggtggaccgtcctttcgatcgtgaacattttacgagtaatctcttcttccggactttggccacgatccccgctttgtttcgcgaatggcacggcactctcagcaaaacggaagcgaacacagtcaatgaatacacccaaaaatatttgagtcatttgcttattcaacgtgaattgcgcagtttggaaaatatgaaacgtgggcggttagaggtccgaattctgtccaaagtgcgtgagatcgaatgcacttatcggctggaggagacgacaatgactttgacaatacttttgcctgaaaattatccgatcaaagcgccagaagtgga

SEQ ID NO: 96112 - DNA, 466 bp, Heterodera glycines
  SCN-specific regions: Sequence locations=1-466
ccattccccggatgctttccgtctggttagacttggcgcccaaatgtgccatcgccgaggcgatcgcctcgggcaccggcacaactgttggcggtactgctcgcacttcggctagcaaaaggggaggcaaagctgcagcagcagcggcggctcccgccggtgttgcaacacaaccacacgacccgaacagagaaatgcgtgacgcgttcaaacggctggacagggcgtatttcttctcctcctactcgcaaatgatttcgcgcatcactcactcggacgccgccacatatgccctgttgaaggaaatgttgtccgaattgatcgtccactttccccaccggtgtttgtggctttctcagtccatcgtccgttccacgcgggtcgccgtccgttcaaagcgttgcctggagatttttgaacttgccaagaaaaaagcgcggagcaacaatgacaacaacgctgctgt

SEQ ID NO: 96113 - DNA, 408 bp, Heterodera glycines
  SCN-specific regions: Sequence locations=1-153,175-408
caaatacggtgacaattctgaggaagcaccaagcgccccagcgtgtacttaagtcggacgcggctgttaatgcggcaaaaaagcgcggcgacgacgttgaaacgacgaagaaatatttcgcaggggtgaatcgtcagcacaaaacggacaaaaacaccgcggttttggacgcggagacggagcaattgcaccacgaaagggtttcgctcaaattgggcactgtgattcagcaggcgcggcaggccaaggaatggactcagaaggagttggcaacgcgtgccaatgagaaagtggaggtcattcgggagtacgaaaacggcaaagccgtgcccaaccaatcgatccttacgaagatggagcgttgccttggcgttaaactgcgcgggaaggaacttggccagccgcttg

SEQ ID NO: 96114 - DNA, 479 bp, Heterodera glycines
  SCN-specific regions: Sequence locations=1-324,346-479
gcttcgccttgtttcctcccatttgccaactttttgccgtccgattccgagtttggcgaagacacctctttcggaatgcgtccggttttgcccggctctggccaagaatttgcattggctttgggcggcaacagaccccgggagcaattcaccagttttaattggggactcctttcatttgcagttttattatctttgcctttttacagtaatcattctcgcctacaatcgagaacaagtgttgttggtcagtgatacgatcgatacacttattaacaatttattgactgtttagtcatggttgttcaaagcatgacatttccttgggtaaaatttgtttttcactcatctaactttgaaacaagctgttccccaatttctgattcgcgattgactatcccattttcactgaagtcgtgccttttcaattgttttattatgtcaattaggggttcttccaacaaatgtggcaaaatgcc

SEQ ID NO: 96115 - DNA, 656 bp, Heterodera glycines
  SCN-specific regions: Sequence locations=1-499,521-656
agaattcatttgaacacacacagtcatacgctagtaattacaaatggctgaagatgaggtagatgatcttcttgaagaagcattcaaaaatgttgacgaggcagagaaaaatgggacaaagatggatgatgttatcaagaaaaaggcgaaggaagttggaatcaaaatgaatgacagtgaaggcaaacgtaaacgtagcagaagcggaagcagggagagaaagcgcagacgaagtcgcagtcgcgagaagaagaagagggattcgtcgcgagagcgaaggcggcgttctccgtcagagaacagcaaaagaaaacgtcggtctagatcttgacgtctgatcatattctcctttgtttgttgatgaagacgaagaacggcgtggaacgtgcgttaaagcagaaactcattcctctcatattccacaacctttcttttctttcgttcataaattcgttcgcgccatgccttcattaccctcccataaatttattaatttgctttccaggcacacagacacattgatttaatttttaagttctcgtgatcgtcgccgctctcgttctaggtctcgcgatcggcgtcgttctccaatctcacgtcggcgctcccgttcccgatcacctcttgagaaacgtcgttcgcctgccccgcgtcgt

SEQ ID NO: 96116 - DNA, 1105 bp, Heterodera glycines
  SCN-specific regions: Sequence locations=1-38,60-171,193-336,358 -523,545-1046,1068-1105
caagtttgaggctaaagttttcatttgacttccccacataaatactgacaaaaacaaaacgcccccgcattctttgtctaaccgactcaacgttgagacatggcctctgttgatgagaatgagcagcttgtgcaggaaattgtcgggaatgttctgtcggaatcagcaaaagaccaccagcaagaggagggaacggaacaccaattgatggacgaagtcgtcaagatggacagcaccgatgccgaggtggaggaccatggagggattggacatgaagtggcaatttcggtcagtgacgtcaagcaggaagggtacgcagtggaaagtccggtgggagaggaagaggagaaagaaacggagggacaaaacgacggcgcaatgcgacagattgccgacaaagttgggggaactttcactggacgaagacaaaacagcgaacaccgacgccgtcgtggaaccgccgatggccacggaagagaaggcggcggacgttggcaacgacaaaccgtcgggagagaatttgaatgaggaaaacaacgaaagcaaaggctatcaatcgccagtgtcggaggaggagcaccccattcagcacgtcgacgcaaaacaaccgactgttgacgaaggacagacccatgctgctgctgctgactctctgccgccgtctgaaccgaccaccgattcttcagcggaaaacgatggcaacaacgaaattgtctctcccactgcgctcgagccacaattggtgcccacttctgatgaggaggagcagaagccaaagaatgccgtcgaagctggggacgatggtgccgccaaagacaacactttgagcagcggcggcgccacggcttccgacgaaacggccgctgtcgcggcgttcagtgccggcactcctccgccggttccggcggttggccagcagcctcaacagcaaacggagcaccaacttagccaacatcagcagcaggcggaactgtgcggagcgaagacggcggtggcggcggagtccaccgcccgcgacagtgccgaggacgaaacggatgcttcttcgtctgctcgtcaatctgtcccggccaaaggcggcactgacggaaaggcgcacggcggt

SEQ ID NO: 96117 - DNA, 428 bp, Heterodera glycines
  misc_feature (426)..(426): n is a, c, g, or t
  misc_feature (428)..(428): n is a, c, g, or t
  SCN-specific regions: Sequence locations=1-163,185-235,257-428
gcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatgcagaagacaaccgccgaagaggaaggaggaggaggatacattcaactgaccctattcccatatatgatcccaactgtacagattgtattattgtatctcactgtatgtacagtatttgtcgcccggttatcgtttaagcgaccataattgtctgttgttggttgatcaccattatcaatgtgttgtatctctgtgttatcatttcaaatgatttgtgattaattgttggcctaatgtgtgtaaataatgtgaagaatccaaagatttgtttgtgaaanan

SEQ ID NO: 96118 - DNA, 712 bp, Heterodera glycines
  SCN-specific regions: Sequence locations=1-28,53-79,101-712
ttctaagcatttgcgcaatttcccttttggctgtccttttgctgcgcgtcccttgaggcgatactcagcccatggactgcaggtgcacagggacaacgagcggaacaatccgaacacgcctttccaatttacggaagccaatttggccaaaattacggtgctgttgaacaatttcccggagggacataaaggagctgctctcattcccgtgttggacttggcccagcggcagcacgggtggctgcccatttccgcaatgcacgaagtggcacgtgttttggaaatgcctcgaatgcgcgtctacgaagtggccaccttttacacaatgttcaacagggaccccgtgggcaaatactttctccaggtgtgcggcactacgccgtgcatgttacgcggcgcagaagcaatcatcgaggcaattgagaagaaattgggcatcaaaaagggagggacaacggcggacggactcttttcgctgcaggaggtcgaatgtctcggggcttgtgttaacgctccgatggtgcagatcaatgacgattactacgaagacctgacccctcgggacattgaagagataatcgacgagttcaaggcgggcaagcgacctttgcccgggccaaggagcggccgtttagccgccgaacccctcgccaaacaaacgacgctgacggagacaccgccggggcccggctttgggcttcagcagggattg

SEQ ID NO: 96119 - DNA, 475 bp, Heterodera glycines
  SCN-specific regions: Sequence locations=1-475
gctatgactaacaatttggacgagacaaatcctttggttgaacaggcattgaacgtgatcaaaatattacacgaactttctcgctcaattagcaacttcgaccaaattattggtgttgaagtcacttttccgactcttcctgaagaatcatttcatagtacaaaattgtcgcaaaaactttgccaagaactgactgatccattagtggtttctgcaaaggcgttgcctaattggtgcaactatttggtacacaatttcccatgtcttttttcgatggacatacgaacaagttttatgaacacgacagcttttgggacctcacgggcaattgcgtatttacaaagtcgacgcgatcacttacttgaccaaaatcgttctgctacttcttcagccgcttccaacatggcaggccttcgaagagaggaccattaccctgagtacagaataggacgagttaaacatgaacggataaaag

SEQ ID NO: 96120 - DNA, 476 bp, Heterodera glycines
  SCN-specific regions: Sequence locations=1-71,93-239,262-338,360-476
ctttttttcgatccattaatttttctttattaaatgttggcacggatgaagaaattgttgagctcgggcgaccatgccgatgtcaattttttgatcgggaatgaagacagcaaagagattttgttggcgcacaaagcaattctgtcggtggcgtccgatgtgttcgcggcaatgtttcgtttttgacgccacaaatgcgacgagggccaccgttggaaaaccttttttgcggcctgtcgagatcaccgacgtggagcccagcgcgttcaaagtgttgctgaacttcatttattgggacgacctaagcgaacgtaatggcgacaacgcaattgctttactttacgcagccaaaaaatacaaaatccccgagttggtcaaagcgtgtgttgaattccccgtttctgagctgcgtgacattttctctgcactcgtacgaacccgtattcttgaagaggaggaatttgctgctcgatgtt

SEQ ID NO: 96121 - DNA, 420 bp, Heterodera glycines
  SCN-specific regions: Sequence locations=1-420
gtgacacgctcagggacaacgatgactaccaattgctgatcccgggaagcgatggtcagccgggcaagaacatccccacgcaaacatcagcccatttgcggaaacgacttttttctggcgttcgccgtttggaggcccattcatcgctgccctactatgccagtggctcttccgatggttctgttttcctatgggaatggggcgttgaacagcctgtgttcgtcgcccgtgttgctggccaattcgcaaaagtggctaaattggcattcgctcagaacggcgcccgttttgcggctgtcgatggggatgggctgctgtccatttggcaggcacaacctggtgttccggcaaagaagccttatttcattcaaaagtgtcacaccaaatttgcatcggacgtcaaattcctcggacaaacca

SEQ ID NO: 96122 - DNA, 1140 bp, Heterodera glycines
  SCN-specific regions: Sequence locations=1-122,145-1087,1117-1140
gttttaatttggtctaaatgccggacggaaaggcgcctcatttcccccaacagcccgtggccaggcaaaatgacgacggctcgcttgagcttgaatgttttctggaggccaacccggtcccggaaatcaaatggttttatgaaaacaatgaactgaaaccaactaaacgattttcattccgactggacaacagagggtccgaggccttttcggccattctgcaaataaaagatttggcggacagtgacaccggtgcctatcgctgtgccattgtgaatccgttcggcaagggcaatgccaacttcaatttgaaacttactgggttcagttcgccaacattcattgaaaaaccgcagatttcttcacgtgacgacggccgggtgatgatcatggagttcaaggctaaatccattctgaaaccgacttttgtgtggcaaaaaggggacgaaattgtggccgagtcggaccgttacaaaatcattctgaaggagacggggaaccacgagtattacgcggcattggaaattgtggagccaaaaaaggaaaaggacgcgggacaatttgtgtgtacggctaaaaatgagtcgggaaaactgacagcaacattctcagtgaaatttgaagtcccacaaggtgctcccactttcacacgcaagccgcagattttgcaaaaaacatcagactctggcgacccggccattgtgttcgacatcggatttcaggctgaccaaaacccggaagtgatttggctgaacccgaagggcaagaaaatgaaggagtccagcagaatcaagttcgggctgacgccggacggcggcgccaacacttacaccgctcaattggagttgaagaattataaggcaaaggacagcgggacgtacacgtgcaacatcaaaaatgacgcaggagaggcgaatgtggagctgacactgaacatcgaggacgacgaggtcaagcaataagccagaacagaggagcgcaaactctaagcagtgtttaaaatgggccattggacgatgctggcgacgacgaaagtcaagcctaaggagtaaatgggaaaatggagaattttgttgaacgatgccgagaaaaaatttcttgaaaaaatctgtttttatcatgaatccaacctaaggcatt

SEQ ID NO: 96123 - DNA, 656 bp, Heterodera glycines
  SCN-specific regions: Sequence locations=1-120,142-656
cgcattttaatttcctaaaataacaaatttctcctgctaattcctataataaatcatggattctccgccaacatccacctcaaaattaatgcaaatcccattgctttcggccaaacggcgaaaagaagtgctcaattttcaatggcctttcccgaaacatcccggcttgctttaccgacttggttcaaatgccgtaattttagctgtgttcagtttggcaaagcttgttttttgctttaataaaattctcgttcaacctgaacaaaagaagctcgttttggacttgctcaatgatcggaatcgtccgttggtcaccatcagcaatcataggtgcgtcgtcgatgaccccctcatttggtcaatgttcacatttcgcgagtttttgtccaatatttcccgatttcgttatattctcactgcccacgacatttgtttcaccaaaaaatctcacattttttttttctcacttggccggtgtgtccccgttgttcgtggtgctggcgttttccaggagggagttgatcactgtgtggatatgctcaactccaatggttgggttcacgtctttccggagggacgagtgacaacgggaaagtgtgcggattaagtggggcattggacccattaatttccgaaatcgaacaaacccgccaatt

SEQ ID NO: 96124 - DNA, 464 bp, Heterodera glycines
  SCN-specific regions: Sequence locations=1-464
gttttttaattcttaccaatggctcctccaaaattctcagacctcggaaagtctgcaaaggatttgttcagcaaaggctatgcccatgggttcatgaaattagatgtcacttctgacgttgctcccaccgtccaatttaagacttccgcagcgcatgatctcaattcccaaaagttggatgggaaccttgaagtcaaatacaaaattcttgaacatggtttgaccatcaccgagaaatggaagacggacaaccaactgacgaacgtgctcgaattgaaggacaaggttctgcgaggactcaaactgacggtggagacggcattcaagccgcacgtggaaggaagtcgccatgccattgccaaggcggactgggcaaatgatgcgttccatgtcaacggggatttgactttgtttggtggcccactgttcaccggatcgtttggtgctaaaatgagcaacgattg

SEQ ID NO: 96125 - DNA, 467 bp, Heterodera glycines
  SCN-specific regions: Sequence locations=1-350,391-467
caaacttctcatcactgcacttcgtgaccaacacccggatgttccgattcacgtgcacacacatgacacttctggtgcaggtgtggccagcatgatcgaatgtgcccgtgcgggtgccgacccgatagacgcggctatcgactcgatgaacggaatgacttctcagccttcgatgggtgcaatttggggtttcgttggaacgggaaccggactttcaccgggttgggaaaatgaccccgttttccccaatacaacgctttattggggaaccggcccctacatttttcccaacccctccaaatgcccccggaacaataaaaaaggggggaactccgaatgtgaaaaaaacaccaaacccccgcggggggaaatttaaaaaatttcattttccgggtttttttctcggggggggggaaaaaaattttcaaggggggaaaaaaattatccccgcggggaatttttctttg

SEQ ID NO: 96126 - DNA, 477 bp, Heterodera glycines
  SCN-specific regions: Sequence locations=1-452,476-477
ctttgatctcgggagaacagagtccaagatggacacgagaagatttgttacggtattcggaaccaaaacttgggtgagaactgaccacagtcacacgattccaataataacccattcttcaacagttacactcgcgactcagtcggttttctgaacttcgtcgaagtgctcatgggtttcaattcggcggagcgtaaggccttccttcagtttacgaccgggtctttttctctttccttttttcgcatttttgggtgtttttaggtgctcttctttgcctcccggtggcctcgccaacctccaccctcggtcggtcttttcacttccctttgtaaatgcggaaatctgtttttcagtctaactgtcgtacgcaaagtcggttctggagatgggtcttatccggtacgatttttcgctctcatagtcagtgtaaatttcacattcagtccgtcaacacgtgtgtgcattacttgaaac

SEQ ID NO: 96127 - DNA, 650 bp, Heterodera glycines
  SCN-specific regions: Sequence locations=1-385,408-503,534-650
gttccctttaaaatccaaatctttcaaccaaatctcttttcgtcacaatgctttctccattcacctacgatccgttcaatcgccgttcgttgtggcctatgaccactattgttggcaacgtcctttctccattccgccaattggagcgcgaactcgaccacttcttcgacgggatgcagcccatgcttcgtgaccatgttgctcagttgaacgtctcgaacaagggcgacttcacttacaaggtcgatgtcagcggcttccgccccgaggagatcaacgtggaggtggttggcaatgagtttattgtcaatggggagcaccgcgagcagaacgacagcgagttcgtccaccgtcagttcttgcgccgtgtgctcattccggagggcatccaaaaggagagcatcaagtgcgagctggacggcggtcgtttgctcatcagcggaaccaaaacggctggcaaaggcggacgtaccattccaattgaaatgaagaaggcggccgtggaacagcagaaagaggaggagaagaagcagtaggaaaaaggacggcggaagtggagacggaccgatcggtcgaatgatccattgacatcgaactgatcttttatacacttatgcaaagttatctataaattatttctcctccaaaaa

SEQ ID NO: 96128 - DNA, 669 bp, Heterodera glycines
  SCN-specific regions: Sequence locations=1-27,67-393,416-516,545 -615,638-669
caagtttgagcatttaaattccaatcttccaaccaattattctcttttcgtcaaaatgctttctcccttctcctacgacccgttctatcgccgttcgttgtggcctatggccactcatgttggcaacgtcctttcgcccttccgccagttggagcgcgaactcgaccacttcttcgaggggatgcagcccatgcttcgtgaccatgtcgctcagctgaacgtcacggacaagggcgacctcacttacaaagtcgatgtcagcggcttccgccccgaggaaatcaacgtggaggtgattggtaatgagatcatcgtcaacggggaacaccgcgagcagaacgacagcgaatcggtccaccgtcagttctcgcgccgtgtgctcatcccggagggcatccaaaaggagagcatcaagtgcgagctggacggcggccgtttgttcatcagcggaatgaaaacggctgacaaaggcggacgaaccattcccattgaaatgaagaagaaggcggccgtggaccagcagaaggaggaggagaagcagcagtagaaaaggacggcggaagtgaagacggactgactgtcggtcgaccgaatgatccattgacattgatctttttattttgatacttttgcaaagtgatctataaattatttttccttcaaaaaaaa

SEQ ID NO: 96129 - DNA, 652 bp, Heterodera glycines
  SCN-specific regions: Sequence locations=1-575,597-652
cttcccactagtcttttaattacgggttctccaaaatggtaaaaacattgtggattgtcagacacgccgaaagagaagacaacataaactcgaattggcaaaaaaatgcgaaccctcaaaaattgaaatcggataacagtccattatcgtcgagaggcataaaacaggccacagaattggcagaaaggttttcgaatgtccaaatcgatcatatttttgcgtctccttttgagcggactgtgcaaacagcgacttttcttatctcacagaggaaaattccgatcaaagttgagcccggacttgcagaggctctttacctttgcgaaagtccgcctggctttgaggaatcggctgaactccgtaggcggtttcctctcgtcgactccgaatatcgctcaatttacgaaaaaccaatgcccagggaaggctttggagatgagtcatgcatttaacgaatacgccaaactcttgaagagattctgaggagatacaacgaagcaacctccatcgtttttgtctcgcatggctcgcccattggtcggttttccttcaaaaaatccttttttaaaccagttaaaaatcctcaaatttttaaatttttctcgtggtcctgtcttaccgacgccacaatatttcagatttttaaaatttc

SEQ ID NO: 96130 - DNA, 715 bp, Heterodera glycines
  SCN-specific regions: Sequence locations=1-282,304-620,644-715
gggagacggactcctccgcatcgtctatgtccagtcacaccgaaacgatgaaaagcagcagcaacggctccgattggcctttctgctccgatcggatgaaaatgatgcagaagccggccaaactgaacctgaacgaggcgggccccgcccctccgagcccgtgctcagtgaagacaccgcttgagggcgtatcgacggaggacactttgcaaagactgaggccgaaggaggaccaagcggaacaaagccccacggggacactcgcgacacggacaccgaaggactttttcttcataaaagtgctcggcgaggggtcattttcgacggtgtattttgcgaaagaagtgaccacgggggacgaatatgcgataaaagtgctgctgaaaagcgaaatccgacgggaggcaaaagtgcgctatgttctccgcgagaaggacattatggccgcgctcacttacgtccacgggggtcacccttttgtcattcgcctttattgcacctttcaagacaacgaccgactttactttgccttggcatatgccaaacatggcgagctgttggattggctgcgccggctcggctcattcgacgaagctggcacccttttctacgcttccgaaaccttttgtgctttggaatttctgcaccggtgcaaagggatccatcgcgatttgaagccggaagacattttggtgggcgccgattggcacattat

SEQ ID NO: 96131 - DNA, 720 bp, Heterodera glycines
  SCN-specific regions: Sequence locations=1-568,593-624,646-720
cttaaaatgcttcacggatggcgagtttttgcctcatgtagcaaatcggttttgaaatcgccttccttacaatcgggtggctatggtttgtcgcgaagactcaagagcgatgaagttcgtggtccagttatcggaattgacctgggtacaacgaattcgtgtgttgctgttatggaggggaaacaggctaaggttatcgaaaatgcagagggctctcgtaccactccatcaattgttgcgtttaccaaagataatgaacgactcgttggtgcaccagcgcgaagacaggcagttacaaacagtgagaacactttgtacgcgacgaaacgactcattggccgccgctttgatgaccctgaagtgcagaaggacataaaagttgtgccgtacaaaattgtgaaggcgtctaatggcgatgcttggcttgaagctcaaggaaagttgtattcgccttctcagatcggcgcttttgttttgatgaagatgaaggagacggctgaaagttttttgggcacttccgttgcgaattctgtcgtcacagtcccggcgtatttcaatgactcacaaagacaggcaacgaaagatgctggaaaaattgctggactgcatgttcttcgcgtgataaatgaaccgactgcagctgccttggcttatggtcttgataagggggaagacaaagtcattgtcgtttatgacctccgaggcgggacgttcgatatt

SEQ ID NO: 96132 - DNA, 808 bp, Heterodera glycines
  SCN-specific regions: Sequence locations=1-324,346-403,426-557,579-808
tttcctttctatccttaattttgaaaatttgaattgattgaaaataatcgtgtccattcattcccgcttttcccattaaaatgtcccaatttggcccggcattcgctgtcaatgccaacaatccgtacgctcacttcaaatgctgctgtgcaacatttaatatcaaagaccatgcccagttttgcggtgtgctcagtttcgcgctgttcctctgcctcgtgctcatttccatgatgcttttcgggtcgctttctctgttttacattttcgttggtgtcgtcgtttacattcttttgatgaaaactctctttggcgtcgtcaacaaattgtcccttctcttttacatctttttcgaggccattcaaattggcttttacttggctttgatgctttacataattgtaccgttgctttttcttgaaattccccgtcgcaactgtcggaatgttgagatcaacagtgaaatttgcgacgaacccagaaatcgctccgaagattacgtggaattgcttttgtttgtctctctcttggcctcaatcaaactgcactttgccagagtgtttgcccatttctacagatatttgacttggaatgagcagtgttcggtgcatcgagctcaatacataaacggacgaggcattcacatcaccatggatcagccccaattcgctgcttcgttttccccttattacggatgggacactcacaccgtaaagggatgcgacagaaggggacgacagaatgagacaaacaatcctaatcaattgcccataacggaactgccgccgacatacgcacaggtgatcgg

SEQ ID NO: 96133 - DNA, 582 bp, Heterodera glycines
  SCN-specific regions: Sequence locations=1-582
gaaaaagccattaaattaaaaatccttccctaatttagtgttttctgtattaatttaatggttttcttactcttactgttgtacatctttccactttatttcttggtgccttttggtgctgctcattgtcatgacactctctcctattacgaagattttgatccgagaatgtcagatttttgctggcttccgcctggacatgatgattgtgtcgaagcgagctgcttatttgaaactgcgggaaaaagttggacaaaagtgtcaaagggttgcactttcaacggcactagggaatgcgctgagcttgaacagaaatgcttaaccgatggtggcaaacttttggtagactgctcagtttgcaattccacctcgtattgtaacgacaaaattccaaacgaaattgttgtgtgtttgaatggaactatgaatgatggcgagaaaaaggacgaagcattcaccgaaattaggtgtgaagatgcgcaatgcttctcagtgcgttgcattgggacggacaattcgacgcttttccacacaaaaggatgtgttaacatggacaaattgtgggatgttaaactgccactt

SEQ ID NO: 96134 - DNA, 608 bp, Heterodera glycines
  SCN-specific regions: Sequence locations=1-491,515-537,559-608
cgcattttgtccattttgcaggaggcccaaaccgattgcactgacacagagtgttccacgagcactggcggcgaccccacgggcactgccgggtccaacgttctgctgattgccatggcctggggactgtttgccatgcttatgtttttcatgcggcctgcttcgatgcgttccggcggaaacgatcgcgaaaatggccaaatcgcgggcaaaccgtcgtcagcagcgaacggacacaacaacgatgatggcaatggcccaccgcccggcgacgttttctgaatacagcgaaaggaacggaggagacgaagacgcaaacatggaattttttgaccagcgaatgccttttccgtcgacgatcactccgtccgtccttcgatttgtcctccatcactttccctccctttttctgtcgctttgcctttcctttcgtttcgctgtctcccaaaaaggctgatgaatggcatttttcaactttgagctccgtctcaaaattggattgtttgtctttttgccggtgcttctcccccccccccctttctcccacatttctttctccgaatttcgtgcaaatgttttattccaaaaagaaaaatgattcttcgatt

SEQ ID NO: 96135 - DNA, 482 bp, Heterodera glycines
  SCN-specific regions: Sequence locations=1-97,121-482
gttatatttaaacaaagaaacggttaagctaccagcagtaataatacctactaagtcagttgttttctgtcaccaatgctggttagtgcgcctctcatccaacaacagcaacagcagcaagtgttccaacaacaacgcccttccacttccgcttcttccgccgatgctgttttgcttccgcatgccacggaagcttctgcaccaactccctatcagcagcaacaaacggaggatcagctcgaattgccgacctccgtaccctccgctgccgactcccagcgccaacaccgcgccacccaacaaccgcagagattcttcaaatccggattgggtatcagaataatcgacaatgatttgccggagggaccgggcagaaggcttcgcaaaaatgtggccaatgttcggaaacacatagactacatcgcaaacgcactcaatcacatggaggcacgcctttggcagtctccgcaccgtcgccaatt

SEQ ID NO: 96136 - DNA, 474 bp, Heterodera glycines
  SCN-specific regions: Sequence locations=1-186,209-474
gactttttgggcgggtgattttagggcgatcgaatcgatggtaagacagtcgaatgggtgacggagaagaaatttggcgggacggttaaatttgatgccgagattgaggcgggcattttcaggtttgaccagtgtgaagaccatcattgtggggttggcacgcaacaaaagcggaatctaacggacaaatggacaaaatgcacaatttgtcatccatcgcaaaagcacctgtgcccctggcattatcctttgggaacagccattttcacgaagacgcaaatccacggccgaagtccatccagcaatcctaacaaacaaagttttgaaaatggtaaatttaagaaaaaaagacggggaacaatgtaatgataaattaatggatatatgaaaagtaattatgattcagcaatgcaaaatgagtagagtcacaaatgcgattgaattaataaagttcactaaaaccgaactaatctt

SEQ ID NO: 96137 - DNA, 485 bp, Heterodera glycines
  SCN-specific regions: Sequence locations=1-485
caaaagaaagaattattttaacacaacaaaaccactaacaattttgtgctgcttcttctcgcccttttctcagtgcccaacttaaacttcttccatccgcaaatggcaccgctttgtttccaagtgaacgaatattacgcgcagatttcggagttggtgcccggcctgtacatttgcggggtgaccggactgacgccggccaacatgaaggccttccgcatcgagttgatcgtgaatgccaccagggaggtgccgaacctgaagagtcttggccatatccagcggatgaagctgtgggtggaggacacgacggatgaggaccttttcccgcactttgacatcgtggcagatcagatccatgccgtcatccaagaccgtggtgccgttctggtgcactgcgtcgccggcgtttcccgatccgccgccatctgcttggcctatctgctcaagtatcggactcggtctctgagagccgcctaccattt

SEQ ID NO: 96138 - DNA, 475 bp, Heterodera glycines
  SCN-specific regions: Sequence locations=1-111,133-287,309-327,349-475
cgggaaaagggggcgaagtgtttctgagcagagagagacacgtccactgcttggaaagagcagtgactcatttggaggagtcggaatctgcgcttgccctgtggaatgacccggcgatggccgccctctccttgcgtctctgtttgagtgcggtcggagagattgcgggccgagtggtgcatgagcaagtgctggacagtatcttcagtcagttttgcattgggaagtgagccaactcaaaacggaccaccgatcgctgcctttttttatttgttacgacgcgccgcaatcattcgcttttcctttcctcgcattgttttctcattgtcagctcatttttccccaaattgtccccggttaaacttttgcttcgacaatcgacggacgctttcttctcacaatcagataagacgttgccattttcttccgactcatccattttaaaggcctacggtcatttccagcggaggaataa

SEQ ID NO: 96139 - DNA, 391 bp, Heterodera glycines
  SCN-specific regions: Sequence locations=1-391
agcaaaaatgaacccacttggacgagtccagatggactcagcagcgcggaagcgcttgatcgccgacgatgaagaggcgcgatcacgtcaagcctgcgaacgaacatgggcgcctgggcgtttgtgcagccgcgcttcctctccttcctgaagcatgaggaccggcgcttccttatcttcctgaagcgtaagccccggggcctcacttacgcgggccgtgcgccgagcgcgtcgaccgccgccggcaacgaacacacgctcgagtgcgaaaatatgaagatgatggaggccattctgaagaagccgatcaacaatgaggacgaataattgctgggtgattatgaatgtgattattggatggtttcctgattataatggtcctttaggattt

SEQ ID NO: 96140 - DNA, 474 bp, Heterodera glycines
  SCN-specific regions: Sequence locations=1-21,43-427,449-474
gcaatgatggcagcagctgccgcagcaggggcgggcgggcggatgccggcgacgtccacagccgcctcaattggtgcgattccgacaccaccggcgggcattgtgccaccgcctccgctccccgccggaataccgtcgcctgcgtcgggaggtgccattccgatgccaccgcaagcggcattcgccgcttaccaggataaaagcatctccggtggaaagtatggcaccagggacgagccctctacttctgccgcgtcgtcgtcaacaatggtcaaaacattgggtgccaagacgcgcattgtgtgccaagatgaacagacatcgctggaagagatgatggcccaacgcattgtgccgacctacacacgtgggctgatgccatttgtgcgttagcggagccgaagggtcgcaacaacgaaggcggaaaatgtctgtctgtctgtcactgagtgtttccccacgggggcttttcgt

SEQ ID NO: 96141 - DNA, 717 bp, Heterodera glycines
  SCN-specific regions: Sequence locations=1-289,312-717
gcggtggagaaagcggccgagcggggcggcgtttaccccgaggttttgtttcgagttgcccaccattggtacgatgacctgtacttggcccatttggagaacacccagcagcagcaggcgacaacgacggcgcttccgcccccggcccatccccagccgacccaacgcattgccccgcagcagtgcgtcgtccgtctgatgatgccctccccgctgcaccactcccaccagtcgcagcagcacttcttccccgtccattctgccgccgcttcgacttctgctgccgttgttttttccccttccgttcccccgccgccgacgcccccgcagcaatttgttgggcccaacgttgtcatccatcctcagcagcacaacctcagcaccggcaacaacttcatacagtacagccaccatctgcagcttacgcccacagccgtcccgctgttccacggccaaacggctgccgtctcaatggcaccaatgttttaaacggtcaggcgccatcggtttcatcctgttgttttctctcgcttccccctcctcaactacaagcagtacagccaccaacagttgtggatcataaacaaacatctcagcctcacctgcagcagtctgttgcccaatttggttcgaccattggctaccctcaccatcatcatgtcactgctcaccagccaccgctttccacgccacctcccccactgatgctgatggcat

SEQ ID NO: 96142 - DNA, 474 bp, Heterodera glycines
  SCN-specific regions: Sequence locations=1-474
accagcggcttctgccctcccccgcggcggcatttgtcccctctccgaatggcactgtctctgtgccatctttgccctcctctccaacaacaagaacaacaacaacagcgatgatcagtgtgccggccatcgcaacagtcactgcaacttctttggcttcttcaagggtcccctcttcaagcagtccttcgcccgtggcaattcatccgacaatttccaccaaagcggcgacttcgtccgccccaatcattttgctacccaacaaaaggagcaaagaggggcaccaatcgcagaagcaaacaatggccaaagaaatggcgacagattttgccgctgaaagcaaaggggggagagaaagcgaaattcgaagggcacccgcgagacaaaacgcagaggacgaatggacgaaggccaacgagttggacgagaagggcattccgccgacacagcgaacggcgccgaaattgagcacga

SEQ ID NO: 96143 - DNA, 340 bp, Heterodera glycines
  SCN-specific regions: Sequence locations=1-37,66-340
gtttcgattgttccaattaatttgacaatgtctccccatttgcttcatctttttctcattgttttgctcattttggccctttcgtttgtccttttcggcggaacggacgcaaaagaattgtttaagcgaaaaatgcctcaaatgagtcaaatggggccgatgggaccaatgggcggcggcggtggttatggatacggaaaatgaataaaagaaaggacaaacggacggaatgcgcatttgagaaaggaacgaaaagagaaaaagcattcattcattaaccatgttaatgtgaactaaatataatcggattggaccttattaaatctaaattggtataaaa

SEQ ID NO: 96144 - DNA, 476 bp, Heterodera glycines
  SCN-specific regions: Sequence locations=1-248,271-476
tgagaatgaaagggccgccatgctaacatccaacgaaaggctgtcggtgccgctgccccaaaagagagactccgtcgaggcggtccaaatgccactcgtcacccaaggggtcgaaatcgaacggtcggtgcattcggagggccaacgaacggacactccgacggaatgccccgttcagttttgacaaacagtcatttgctcacaaacggcgtaacaccttctcaaatcgtccattcctctcaacgctcgaactgttggccagcagacagaccattgacaaaccctcgtgcacttccaactccaatttggcgttggaagtgagcaaagcgggcattgccgacctgaacaggccactttcccggatggacatcttttattccggttccactgtcactttgacaagccgcatccggcgaagagaagcgacgatcacctcgacaaatgccgaggcaggcggagagctcaccgcttcagcc

SEQ ID NO: 96145 - DNA, 481 bp, Heterodera glycines
  SCN-specific regions: Sequence locations=1-144,166-322,344-481
aaaaaaagcatggccaaattcctttctggcattatgttttgcgcattgttggcactgctggacaccaccagtgcatggaagcgcgagtttttgcgcatgccgaaaagcaatgaaatcggcacggcggacgacagcagcgaaagtggcaaaaatttgaaaagccaatcggaactgatcgcttcaatgctgccaaaaagaaaaactttgcaatgctactacggcgttgacatgttccgcaccaacaacggcactgaaggtggtgcctttgaggaggtcaaatgcgatgacgaagactatgaccgctgtttaattggcaaatgcaagggacaaaattttgtcgaggtccgcaaattctgtgccaccaaagatggatgtgccgcgtttggatgtgccgttgaggaggaacttgaatgcaaaacgtgctttggcgaactgtgcaacttgtaaaaatggatcgagaaattattttcggattttcaaa

SEQ ID NO: 96146 - DNA, 418 bp, Heterodera glycines
  SCN-specific regions: Sequence locations=1-176,198-360,382-418
ttggttatctgaaccagctctgggacactgtttacatggacttgccaacccgggaattccgcgtggaagaagcctgcgaatttatgttcaatctcctacaggtgatcagaaaatcagaagagaaagtggtccgtaatattgtttctgacttggaaatccgccgagaagcagtgaccaatctttggaattttttggggttgccttctttcgacgagtcgcttttcccgcccaagtcgatcgcattgctgaaagtgcttgattcggaaaaaaaccgattggaagcgaaaagggaggaaattgtggggagccaagcgaggctgacgggaaaatacaaagcattgtgcgatagggtgggaacaacggcgcgacaaatcgaaggagtgcacgacagaattatgtccgaagatgagttggacaa

SEQ ID NO: 96147 - DNA, 406 bp, Heterodera glycines
  SCN-specific regions: Sequence locations=1-15,39-98,202-240,267-406
caacagcaacaccgtcaccagcagcaacaccaacaacatcatctgaaagcagcggcatcggcaccgcatttggtggtgacggagacgacgagcagtgccagcaacacaaccacagtaccatcaattacagtaacatcaacaaccgcagaaacaataacaataccgccgccattatcagcatcatcaccaccaccaacaccacaattatctgttattaatagccatgatagtaccaaggatggaggaggaggaggaggaggagaaggtggtgggaatggcgatgcggacgatgaccaccgtattccaataccgtaacgcatgatggacgaatggctaccaccatatgccatttgtgtgtctattgtcgtcgttactactgttgttgattaaactgtaaaattggtat

SEQ ID NO: 96148 - DNA, 454 bp, Heterodera glycines
  SCN-specific regions: Sequence locations=1-303,326-454
caagtttgagccgtaagcaatgagttcttttccgaaagcggtaaacatcaagattgagcacaacaattctttttcggaccacgattactgttacaaagaatctgcagttgaagaaatggacgaagaaaatcgttccttttttgtcgacgtggagaacgatgacgaatatgacgatgagtataatgcccgtggtcggaaacggaggagcgtcaaacagccggatttttttatgatcaacaacaaagccaacaattcgaataagaaaacgtcaaaggcgaggccgaggaaaagcgaaagcaaaagaggaaagagtggggagaaaaaagtcaaatacgaagtggaatacatatggggcaaacgcacggacaaattgcgtcctgataaggtggaatatcgcgtttattggaaggggtatccgattgagaagagcacttgggagcccgaagataatttg

SEQ ID NO: 96149 - DNA, 454 bp, Heterodera glycines
  SCN-specific regions: Sequence locations=1-21,49-393,416-454
gtccttcggcggcccattgtcagcaaaaaagaagaaggaaaggaaaaatgaggacgaaaatgcacgtggttgtccttggaccgaagaaagtggggaagacttcacttttgaaaagtctgatcaatcagcacgacccaaagccaagcacttcctcgtccgatggccaactttacgttcccaccgtcgaagacactttccatgtccaattcggcgactttcgttccgttgaccaaatgccgcagcgctcacttctcattcttttccatgacactgctggcataacggactttggcagcattgagttgagaaaaccgtaccttcaggttgccgatgcctttctgctcgtttattccgttttggaccctttggctttaagtcaaatggaagcgttgaaaaaatatttggagagggaaaagaacggcacgagcaaagaacggaaggaagttgccctttc

SEQ ID NO: 96150 - DNA, 474 bp, Heterodera glycines
  SCN-specific regions: Sequence locations=1-266,293-414,452-474
cggtgtttcaaacggtgctcgaggcattggaataccctcagataaaagtgattgccatcatcgccgaaggagttcctgaaaatcagacgcgaaaactgataaaagtggctcgacaaaagggggttactgtcattgggccagcaactgtcggggggataaaacccggatgtttcaaaattggcaacactggcggaatgatggataatattctcgcgtcgaaactctacagatcaggaagcgtcgcttatgtctcgcgttccggaggaatgtccaacgagctgaacaacatcatttcccacaacaccgacggagtgtttgagggtgttgccatcggtggggatcgctaccccggctccacttacactgaccacattcttcgttatcaagatgatccgagagtcaaaatgatggttcttcttggcgaagtgggaggcgaagaagagtacaaaatcgtccaggcgttaaaagaaaaac

SEQ ID NO: 96151 - DNA, 320 bp, Heterodera glycines
  misc_feature (320)..(320): n is a, c, g, or t
  SCN-specific regions: Sequence locations=1-111,146-244,266-286,308-320
attcattcattcactcacggacaccaccaaactttgcccccccccccccctctctattgatttatataaataatgctgtgcgattcgttcattcatcgtccgtccattcttctccccctccaccacccacccgtccccattttggactggctttgcttgctttgttgagtgggttttgtcttggcaacacttttttttgttacaccctaattaccttcattaggatgaaaacacccccccccccttctgaatttcttttctttgtaatcgccgctatgccaaattgcaaaacatcagcaacaaataaagaatgaatttcn

SEQ ID NO: 96152 - DNA, 475 bp, Heterodera glycines
  SCN-specific regions: Sequence locations=1-475
gtgcaattaagttttgttatattttattcgagaagactttaattaccattctccgatttgttttgactttttgcaattggacaatgtcttcggaacaagcattaaaagcaaaacaacttggcaacgaggcgtacaaacggaaggaatttgccactgctcacaaatattatgacgaagccatcaaatatgaaccaacgaacatcgtattttacagcaacaaagccgcagtttttttcgaggaaggaaaatacgacgaatgcatcgaaatgtgtggaaaagcggtggaagttggacgagagaatcgggcggactatgcgctggtggcaaaggcttacgctcgaatggcaaacagttacaaaatgaaggacgaccccaagaaggcactgcacttctacgaaaaggcattgtcggaacatcgcgacccggacattgtgaagaagcacaaggaattagcgaaggaagtcaaagagatgga

SEQ ID NO: 96153 - DNA, 180 bp, Heterodera glycines
  SCN-specific regions: Sequence locations=1-66,113-180
ccccgcggtggcggccgcactacaactagtggatcccccgggctgcagtgaactcggcacgagggtgaggtcacccgcacccaggcctactccaaggtgtcgcacgacagccgtcacaagcgtcaggcaggcggttgctgtggctgcggagtgtcgcccccgggcccgcccggaccccct

SEQ ID NO: 96154 - DNA, 476 bp, Heterodera glycines
  SCN-specific regions: Sequence locations=1-406,428-434,468-476
acggctataaaagccagctacagcaccaccacctgcaaaacagtttcctccgtcgccgtctccaccaccagcacagacgcgtccgacggagcggccagcaaagcgcgacggccgccttttcactggacaacggtgcgacggcacccgcggcgagcccattgcgatttgacgacaaagcaccgcccgcgcgcattaaccaagctgttttccggcagcaaagtctgctgaacgccgcttccgccgagctcagtccgtgcgtgcagccgcttcgccgcggcaattgtcaggaagcgagtctgcgctatttctacgacttggccctggaccagtgcagactgttctacttttcgggctgcgacggcaacgaaaacaacttcgccacgttggccgagtgcgaagtgcggtgcaaaattgggtttactcccaactcggtaccagcccaacaacaacagcagcaacaacaaaaaggcagcatt

SEQ ID NO: 96155 - DNA, 649 bp, Heterodera glycines
  SCN-specific regions: Sequence locations=1-187,209-381,403-649
gtatctttcaaggccggaaaaggaaaaaagccacgaggagggggagaatgattttattcgttttgctgcgacatccatgcaaggatggcgaacccatcaggaggatgcgcataattgtatcctcagttttggagatgagtgctctttttttgcagtttatgatgggcacggcggttctgacgttagctcctacctgaagaaaaacttccccgacttcttgaaagagcacaatttgttgctccacaccattgacgaaggtctcagcgcggcattgcacaaattatttgtgaaatttgacgagactctgcgccacgacgatacggtcaaagcaatggtagagctgaagacagcactttcaacaacatcggaccaacaacagcaggcagaagagcaaaaggcaaacgaaggctgtgacccgggggagaaggagcgcaaggaacgtgagagtttgatcgatgcaaaaaaatagacgccgatttgcggcgagtagctgtggtacagctactattattgagccttttggctcaattttcggtgaattgggctcgacgatagccgagccaagaaaatcgccaggaacagccggacaaaaggggaggatgaaactcatcacaaacgtttgtcgttcggaccggaagttttgcgtttc

SEQ ID NO: 96156 - DNA, 767 bp, Heterodera glycines
  SCN-specific regions: Sequence locations=1-65,87-203,225-767
aaacaaatttaaaaaacggtcgcgaagcgcccgcccaagcccaacaaaatttgaaaaaaaggcgtgaagcgcccgtctggccccaactaaatttaaaaaactggcgcgaagcgcccgtcctgaggccgcgaagcggccgaatgttcttaataaaattaaaaacgggcgcgaagcgaccgtcttgaggccgcgaagcggccgaatgttcttaacaaaattaaaaactggcgcgaagcgcccatttatgagtccgcgaaacggccgaatgttcttaataaaattaaaaacgggcgcgaagcgcccgttatgaggccacgaagcggccgaatgttcttaaaaaacgggcgcaaagcgcccgtcatgaggccgcgaagcggccgaatgtccccaaaaaaattaaaaaacgggcgcgaagcgcccgtcctgaggccgcgaagcggccgaatgtcccccaaaaaattaaaaaacgggcgcgaagcgcccgtcctgaggccgcgaagcggccgaacgtcccccaaaaaattaaaaaacgggcgcgaagcgcccgtactgaggccgcgaagcggccgaatatcccccaaaaaattaaaaacgggcgcgaagcgcccgtcctgaggccgcgaagcggccgaatatcccccaaaaaattaaaaacgggcgcgaagcgcccgtcctgaggctgcgatgaattgctaaattacatcaatttctagcgacgcggcgaagccgcgtccctgagcgcgaagcgctttccccacagcaacaga

SEQ ID NO: 96157 - DNA, 950 bp, Heterodera glycines
  SCN-specific regions: Sequence locations=1-95,117-212,235-278,315 -493,515-525,590-777,816-950
gcgataagaaagatttattttgatcggcaatggcggcgacatcaaagctgcaaaaaagtggacgaaagcggttgagatacgattcagaggagtcatctgatgatgatggcattggaggagatggggccactgttgcaatcattccgacgccgagcatcgatttggtcctgcaaaatttggcaacaaatgcactcgcttttacagcggcgcccgaaatggaggagaatgaagagcagggcgatgccattcaattgttttgcagtggttccagtgcagcggaagaggaacaccaccaccaccaacaacaaccaaatgggcaaaccgttagcagcggctgctcctccagcagtcgtccgtccactgataaggagggggaacaaaagttgcggagaatgcaagcgcaagcgcgtcgtcagcgtgtgagcaagtggaaaatcagtgagacggcgcaaaggaagaagcaaatgcagaaaagcaaaggcaacaaaggagtagggggaggaggagcacttgtatactctgtccgcagcagcagcactacagccaacaacaatagcatcagcaaaaaacccccgaacaaaaagaagcaaaatgtcgctgatcgaactgctcgcaaaaacaacatcggcggcgcgggcggtgaagaagcgccagcggttacaaaaacggccaaaaccttggctgaactgcttcaatactcaaacgtcgttgcagcaaatctggaaaataaactcacttcaccgacgacttccaagaatgatggtcctccgacggcggatggtttcacatttacagcagcagctcaggaagaatgtccgtcctcgtcatcgtccaaatcaattgccacgctcatcaccgaccggttcaggccaaacagaggcactttttaccgttatacaccagcgccagtggttacaccggcggtcgtgcacaaactcttactcaacgct

SEQ ID NO: 96158 - DNA, 361 bp, Heterodera glycines
  SCN-specific regions: Sequence locations=1-361
ctggcggacagcgcgggaacaatgggccacctggacccccgggagcgccaggagcacccgggcagcccggcaccggaggaggacagccggaacccggagagcccggcgcacctggacccaatggccagcctggacaagccggagagcccggagcgcctggacggcccggacaacgcgaaaacccacggccaacggagacagcccctgcaggcccacacgggagaggctggtgcaccgggacagcccgggtcaggatgggagcccagggaaagataggcggggccgggtaggcagggcagaaaaggactgccgggaagcagcggacaggccaggaattggcgaaagcccagggccacccggg

SEQ ID NO: 96159 - DNA, 795 bp, Heterodera glycines
  SCN-specific regions: Sequence locations=1-567,589-656,678-795
aagtcgttttcgggccgtatctaaaaaagttgggaaggcattgtttctcgttgccggtggcccactgattgagcatcacatttcgcagctttgcgaagagttggaaaacctccacgaaatttttattgttggattgtacccggccgaagaatttgggaagtttatgtctgatggggagaaaaagtatcgacgcgtgccaatccgatacattcaagagaactgtccgttgggcactgccggtggccttttgcagtacaaagacattctaatcgacagaaaacctccggatgcactctttgttctgaatgcggatgcttgcggagaatttcctttccttgaaatggtgcaggagttgaaccaaaagacggaggcgaaatgcttgattttgaccactgaggcgacacgggagcagtcggtcaactacggatcggtggtcattgattccgtcggtttggagtgttcgcgtggccgtgttcttcattatgtcgataaacccgcgactttcgtctccactcacatttcctgtggcgtttatttgctccgcggcaattcgttcgatgtcattttggaacaagcggaaaaaacagcctccgagcgtggcctaaacaccgactctccgacgatgcaattgtttcattcaaatcaactttggtttgaaaaggacatcttcccccaaatgacctccgatggcactctttttgcatggcatacaaaccgttggtggtcgcagacaaaaacagctggtgccgtcctttacgccaaccgccattatttgggcctttaccgcgcgcgatg

SEQ ID NO: 96160 - DNA, 656 bp, Heterodera glycines
  SCN-specific regions: Sequence locations=1-1,27-411,433-449,471-656
gagatttcattttaaaaaatgtgttgtgatagcagctctaacaaatggatgtgctggttcggctttcacgtgacaaatggctctctcgtcgcggcgtggatttttttattggccggcatttttgccttttcaagtgtcctccaaatgcttgtttttcgtcacttttatattgaacacattttcaatttgatttcgcccattttgcttttgtgtggaagtgtgccgataattgttggagaaatgcgcgggcaaagaaccagcaaaatgtatcgaccatttctgatcactaccgtatgtttttggcaataaattctgatcactaccgtatgtttttggcaataatcattaccgccatttcttttgcaataacggcgtttcccgaacttgttggtaaagtgctacgttttatacgagccggctttgatactcattactttcttgatttgtggccttacactctggcccttatctcaatttggctttacccaattgtgtatcgggcgtacaaatttgttcaacaaaatgaggaacacaaaaacggtggaccgtatggacagaatgccaaagtgatcaatcaacagtatgccaaagtggtgccaatgccattgccaaatgccgaaatgattggataattgcattcttttatatggaatatg

SEQ ID NO: 96161 - DNA, 344 bp, Heterodera glycines
  SCN-specific regions: Sequence locations=1-23,45-269,294-344
gaacaaatgcaaagcgtttcttccgctgctgctgctgatggccgttcattgagtacgaaagcgggcgcaagcggcgccaatggggaggaaatgggagaaacgccgaaggggcggagacggaaggggacaaaatgaagcgaaaggcaaacaatgaaaggcgaagaaacacatctaattaatgaacacggcgtccggaaactgagctgctgtaccataaaagatttgtgtgtggcgaagtggtctgtgagaaggtcaccaaagggggggtgggtcccaggttcgattcccagtgcatgctattgatgtatttcgatgattttaatgaataaataaaaggaaaagtg

SEQ ID NO: 96162 - DNA, 462 bp, Heterodera glycines
  SCN-specific regions: Sequence locations=1-298,320-330,352-462
ccgtcctttcttctgtcgtaattggtgaaattcagcagcagcaatcgccggattcatttgtgccaacatcttttgggaggcgacggcattgttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaggttcaaaggaccaaaagcgaaactgtctgaatggatcgatgacaaatgggtggcatttcctttgccggaccgtccgctgcccaacaaaattcgttttaggaaccttcggattgagaaccccgaccattctgtgctcgcatttctccgtgccaatcagcaaatttttgaaaaagccaccaatttatgtttgtctgtttcttcatgcttcc

SEQ ID NO: 96163 - DNA, 525 bp, Heterodera glycines
  SCN-specific regions: Sequence locations=42-62,84-368,390-400,422-525
gtggatccccgggctgcggattcggcacgagattttcctgcatcgcccgtcgaaaaaagaaacgaattttccggcgcccttatgtcttctacaattagtgaaaatcagcagcaatcgtggggttcttttgtaaaaacatcttttggaacacgacggcattgttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaggttcaaaggaccaaaagcgaaactgtctgaatggatcgatgacaaatgggtggcatttcctttgccggaccgtccgctgcccaacaaaattcgttttaggaaccttcggattgagaaccccgaccattctgtgctcgcatttctccgtgccaatcagcaaatttttgaaaaagccaccaatttatgtttgtctgtttcttca

SEQ ID NO: 96164 - DNA, 1316 bp, Heterodera glycines
  SCN-specific regions: Sequence locations=1-1316
atttattcaaatcgcttgggaagagtctgcacagagttaacggatacatttcaaacaagagcggttttgtggacgcgtggaaattggcgaaggaaaccttggaattatggactgaaatccaatcgtcgacacttcgaaatttaaatgatcttctgaaagaagtcgctcgttatcaagaagaattggctcggatgcgaaaacgtgccaaagacgcggacactttggaaacgatcaatttgatgctaacaacgaccacctgtctgcaaaaagcaagggacacgttcaaccagcgaagcactgaggtggtcagtctgaaacagagcaacaaagaatggacggctgccagcacaaaagaataccttcgagcacgcaacaaattgaacaaggctcacgaggagtacaagcagtacatggacaagtacagccaaatacgcgacactttcgaagaacgcgtcaaccaagccgcacgctctttccaagaacatgaccgactccatttgctacaaatgaaaagtttttttacgcaaatggcgaaatgtttggaaaatgcccacggcgcaaatgcacaagtgagcgcaactcttcgccagagagtcgagcagaacattaacgtggagcagatgatgttccgatttatcgaggagaagggcaccggcactgaaccgccacaaaaactccaatggacaaatgcggacgaacttccccccgaattggacgttgtctcgtgcgtccaatcccagtcttcctcctcaaattcgtctgccatcgtccctaacttttccggcaaccaattgcagtcgaatgcgaatcatttgctcggcctgaatgactcgtggctaaccgtcggcggagggaaaagtatcgccgcgggtggcggcgaatcggcaaacagtggcggaagctttgacggaggattcggggaaagtatgtgcagtttgggagtcaaaaggggcagtatcaacggatgttcggagcaaaataagtcggccggagagagcgattccgagaggcatttggagttgcctttctctgccaacccttcctcttctgttctgtccaatttctctgctcaaaatccatcgtcctcttatgttccccagcaaatctcttcttggcttggccgtcagaagttcagcggtcgtctgaagaaacatttctcaacttctcagtccaatttggccggtccaatggcaattgaaccattcgcagtcggagaaagtgatcagcagacaaaggacgaactcatcggatcagcttcgaatttttccaaaagttgcaatgatccatccatcaaaacgaattcttccgctggtctt

SEQ ID NO: 96165 - DNA, 645 bp, Heterodera glycines
  SCN-specific regions: Sequence locations=1-17,39-490,512-645
agcaaagtgtcactctgaaatgactttggcattttattcgactaattaaatgatttctccccctccccccccccccaatttgcctgaaggcgaagcatttgaacgctcagtcgccgatagcccgggaaatcctccgcccacaatctctgctgcacttcaattgctccatttgaatgttcattagcaaaaagtgtcaaaatgaagcgtcccggtcttaaattgcttcgcaatcatccgaacagcccaatccccggcaaaaaactgcctgaagcagtcgagcacccgcagggtttgttcatagagacagccccggcgatggtttgtctcgaagctggcgtagcaaaactcgggctcgggagttacgtgaatggtcacgtattcgtcaccagccgggaccccattcataccttgaggcaattaccacggaaaaatttagtgtggccccggtatagcaattattaatgttaaccagtggctttttaaattggcaaattaatgaaaaatgtaagaaacaattgttcgttgttttgcgaatgtactgactgtatccgaccggctcgaacagttcgtcttggacgatggtcccccgaggtaacagtgacagaatgccggatcgctgataatgggagacggagaaagtgatga

SEQ ID NO: 96166 - DNA, 640 bp, Heterodera glycines
  SCN-specific regions: Sequence locations=1-14,44-432,457-459,496-640
gtttgagctatacacccgcccccgccgcctccggcgcggcgccaccggtgcctggggatgatgatgaagtggaagaggaatgagcccgcatttgagcggccgctcgaagaatggcgggagcgccgcaaccaacacgcgcaaaacacaattcacccgcctccggcgccaccgcaggaggaggaggaggagcactgggcccaggcatggcctgaggaggaggaggtggcaaagattagcaacgaggaaatggacgatgaagagggaaaattggcgcctgaatctgaattggactatgacgaactaaaccgaggggatttctacctaatcggaggtgtccatgacccgatcaatcttcgttttgaggctgcgatttgcgcgagatgatgcggaacgtgtggcgccgcattgacccttcgaaacgtgccatgttcggcggtggccgctcggccggggtgccttcgcacggcggaggagcgcgtggcgggcgcggcggtggaaacttggccgaaaaatgaccaacgggaaaggacggtttaatttatctgatacatggcatttatattgagcctgcaattgtttcgttgctttatcctttttgaattgattgtctgtttttgatttttaaaaactcagatttttt

SEQ ID NO: 96167 - DNA, 484 bp, Heterodera glycines
  SCN-specific regions: Sequence locations=1-47,69-484
gccacatataatccgaccccttattactgtatttacctaaatctgtattaatgtttaactttttattacctatcctactttaataagtttgttaacggacaatgcaatgtgcctacaggttcaatgtggcaacgttaaattgctggcttttaccacacccttggccaatcggaagcaaacacaaacaattccgtttgcaaaaattaatcgacgaactgaaaaattcgcgttttgacgtcattgctttgcaagaagtatggagcgaaaagatttttcttcaaatcgcccatgaactcaatggattttttccccattcacattatttccacagcggatttacgggtagcggcacatgtgttatcagcaagcatcccatagtttcaactttactccataggtattccctgaatggctttcctcatcacgtccaccggggtgactggtttggcggaaaaattgttggaatggttgaaataatggtgga

SEQ ID NO: 96168 - DNA, 1058 bp, Heterodera glycines
  SCN-specific regions: Sequence locations=1-365,387-1058
attacgaggaagacgatgaactgcttacaccgacaaagcgacttcgcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaagaatttggccaattctcgcaaaaaatctcccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcactttccacgttcaccccgtccatttcgggctgtgatgatcaattgatggatgcggaggacgacgccgagggggacgacgaccaaagaatggccccccaaaacgcaacggtcttcgacttctctcctgaccagctgcgtgcccacaaggaatggaatcaggtcgaattggacgtggcacggacattggcacggtttccaccgaacattgacgaggacgaaagggcatgtctgcagaacgagttgaccccacttattgtgaggatattgtgcgaaaatgaagacttccgttactatcaaggctttcacgacgtgtgtctgacttttctgttggttctcggcgctgattcggccctccaagttatgcgggacatttgtgcccgaggcgccttccacaattatttgtgctgttcgctcgaagagagtgcaatgcgcgagttgcaggacctgtacgtgttgctgttcctgcatgaccaagaagtggagaagcggctgagaagcgccgagttgggcactctgtttgcgctcagttggcccctcacttggttttcacatgcactccaaaattactcccaggtggtcctgttcttccaccttttcctctcttctcatccgctgatgccaatttacgggagtggccgcgtt

SEQ ID NO: 96169 - DNA, 454 bp, Heterodera glycines
  SCN-specific regions: Sequence locations=1-454
atcagtacatttcccaagtgtacgctcaagcccaggccgcttcgcaggcggcggttgccaattcgatgccgtcgctctccgactccccgccaaacatcgatcctgaaaagggctttcaattatccgcaggcgtgggccactcaaaacattcctcaacccccaatggaagagttcgggacgtcgatgaattggccgaggaggtgcccggtgaatccgatgtgagtgacgaggaggacgcagaatcgcctcttccttctgtccatgctcaaatgggcttattctgtcacacaaatccggaagtggcgcccgcttcgatgtggacctcgaagaatgtgcaggaatttaaagacaacatcaagaaagagggcaccgagggagttctgaaaattggtcatggcgaaactgtcacagttcgtgtcccgacgcacccagagggcaattctttagtctggga

SEQ ID NO: 96170 - DNA, 487 bp, Heterodera glycines
  SCN-specific regions: Sequence locations=1-407,429-487
gtccaacggctcacccattcacaataaaaatgccgttttgtccgttggtccccatggtccgatgctaatgcaagacgtcgtttatttggacgaaattgcgcacttcgatcgcgagcgcattccggaacgcgttgttcatgccaaaggcgccggagcacacggctacttcgaggtgacaagcaaagacatggccgagcactgcaaggccgccatgttcagcgagatcggaaaacggacgccgcttttcttccgtttttcgcgtgtccgtcggtggagataaaggtggagaatcggggagcgcggacaccgcgcgcgacccacgcggttttgccatcaaattttacacggaggagggcaattgggaatttggttgcaaacaacacaccgattttcttcatccgcgacccttttctctttccaaatttcattcattcgcaaaagcggaaccccgccacccatctcaaagacccggaaatgatgtgggact

SEQ ID NO: 96171 - DNA, 476 bp, Heterodera glycines
  SCN-specific regions: Sequence locations=1-169,192-204,226-476
gttcagcgagatcggaaaacggacgccgcttttcatccgtttttcgcgtgtccgtcggtggagataaaggtggagaatcggggagcgcggacaccgcgcgcgacccacgcggttttgccatcaaattttacacggaggagggcaattgggaatttggttgcaaacaacacaccggcaagtcaaaattttcttcatccgcgacccttttctctttccaaatttcattcattcgcaaaagcggaaccccgccacccatctcaaagacccggaaatgatgtgggacttttggactcttcgacccgaatcactacaccaagtgatgtttctgttttcggatcgtggaattccggacggatttcgctttatgaatgggtacggtagtcacacatttaaacttgtaaacaaaaccggcgaagcagtctattgcaaatttcacattaaaacgcggcagggcattaagaatttgtcccctcaaa

SEQ ID NO: 96172 - DNA, 853 bp, Heterodera glycines
  SCN-specific regions: Sequence locations=1-10,32-32,55-399,421-853
cgcagttcagtctttttcctcctctccttctgctcatttctcctaattcttctcaaacgtcaaaatgctttctgaaattccgcttccccaccaaaaaggcatcgtcgaccctcgtcttccctgcaaaattcaaattgtcggccgtgccaatgacgtcgcgaaacgtttcgaagtgaatcttttgtcacaaacaggcgaacaccttctccatttcaacccgcgcttcgatgaacattgcgtggtgcgaagcagcacaaaagacggccaatggcaagcggaagaaaggggagggaccaatcccttcgtggccgggcagcctttctcgctcgatctgctggttgagcaaggcctaattgagtgttctgtgaatggcttccaattctgtgaatttgccgcgcgggatgacttctcccaattggggcgctgtttccgttggcggtgacattcagctgaactctttggaagtgtccaccgccgagggtcccgcgattgcccatgaaggcggcgataaggggccgcgcgaagctgacgaggaaaatgcgcaagaacagccgcccattgtgatgccggcccatcccgaaccgcaaccggtgccagccgaaccgactccccagcagccgcagcctccaccggcccaggggccgctgtcggtgccttaccaagctccgctccatgcgttgcttcagactaaccgaatgcgcgtcgtcggtgtcccccgcccgggggcacagcgcttcacagtgaatttcaaaacgcacgacggagagacacttttccatttcaatgctcgctttgatcaaaactgtgtggtgcgcaacgccagcgtgaacagacaatacgcgccggaggggga

SEQ ID NO: 96173 - DNA, 944 bp, Heterodera glycines
  SCN-specific regions: Sequence locations=39-850,872-944
aaaagaagaaaaggggggaggaggagaaaaagcggacaatggacgctgaaaagagcgcattaaacgaaacagtcccaaccgaaagtaccgccaatttgactacaatggaacaaacggtccctaaagtaaaggaagtgaaaccgaggaggtcgctgttggcccaggcatcccaacaacggcctccgttgccacgcgcatctgcgcaaagttcggccagtgcccctacgcaggttgctctcccacggagccattctcgctcccgaatcactccgtctgctcgtccggtgctcagttctcgcgaaaacacttccattgcactgaaaggaaccgcaccaatgtctgggatgacccgtcgttcaatgaccacgaaaagtcagtcggttgaacacgtcgcagtcgcacaaaaacatttgtccggcattggccgaaacatcgcaaacggaaggacgaaagagtcgaaaagtgcgaatgcatccgacagacagcgaaaggaagtcgaagacgaactgaacaggacgaagcaaatgctgaaacagaccacaaaaacattggatgtgttcgctgtggtggcatcacattttgacagaaaattggacaatgccaacaccgaatcggctgttctgatggctcaaaagggcgacgaggcggcgcaacaccaaagggccatcgccgagctggactgcaactggaaaaagcgacttcagcgggcgaaggaggaccatcgagtggaattcgatgaattacgcgcaaaaatttcttctgaacaagcggaaaacatcacgaagatccaactacagcatcaaaaaaccgtgaacgaattggaaaaacatgtacagaaactcggcaaaaaactggcggaacaagaagaaaaacaccgaagggaattgggcgagtcggcgagtcaatcgacaaatagacttcacaaagaattggagagtcggaat

SEQ ID NO: 96174 - DNA, 670 bp, Heterodera glycines
  SCN-specific regions: Sequence locations=1-249,272-425,462-514,548 -560,582-670
tgataatcccccctcactttcacttaaatttattggcgaaatgtccactgccactgacgttcagcacaagagcatctacgactttaaggccaacgacatcgacggtcacgagatcagttttgacaaataccggggcaaagttctgctggtggtcaatgtggcgtccaattgcggcaccaccgagttcaactacagccaactgaagcagctgtacgacaagtataagggcaaaggcttcgcggttgccgccttcccgtgcaatcagttcggaggacaggaaccgggcaatgccaacgaaatcaaagactttgtgcacaaaaagtacaactttgagccggaccttttcgagaaaatcgacgtcaatggatccaacgagcatccgttgtacggctttctgaagaaagagcagcacggcacactcatcgacgccatcaaatggaacttcaccaagtttttggtcgaccgaaatggcaatgttgtgcagcgttactcgcccaacacagagccaagggacatcgaagcggacattgagaagttggtggctgccgcagcctaatcgcaaaaaccatttgaaagaaaacgaaatacgacgatcgacgagaccaaaaattaaatgatgttcatttaagcaaatttctaaatttactttggaataaaaaaattatgattt

SEQ ID NO: 96175 - DNA, 462 bp, Heterodera glycines
  misc_feature (217)..(217): n is a, c, g, or t
  SCN-specific regions: Sequence locations=1-297,321-340,363-462
caaagtaggacaaccacaacatctacaacggacaaaacagcagcaggaatttgtcaccttccgttacacttggccagtgcgaataacggaacgactgatcggtgccggtgaatctgccattttgaatgtcagcccggcattttgcactgccttcaatggtgtccaattcacttggcttttgcgcatttgcgaggaggaaatattgcctgcggactanatcgactaaagtgagggcgacatttcgatggactcgtcgtatttcgcatcgggcggcgatgacgacgaattggagatggtgcagcaacaacagcagcaaaggaaagtgaacatcaccctctactacaaggaggggccggcacgcgacgttaagctgagcgggggaaacatttccattctaaactcggagggcattctcttcgacaatatgccattgcgcaacttggagtacacaaagggcggcgg

SEQ ID NO: 96176 - DNA, 319 bp, Heterodera glycines
  SCN-specific regions: Sequence locations=1-268,300-319
taatcgatgaatttcctaaaaaatgccctgttataaattgccaaaattttcaacaacaaaaaaaatggcatccaatttgaatactgtaatttaatcaacgcgggttaccgtaccaatgcgcggggcgcatgggtcggaactctttcgagcagcacacggtggctgggttactgtatcgtcgtcattatggttgttgaaggtgttcagttgggcaccaattcgtgaacaaatgccatctatttgcatcaattatatataatacaaagatatttttaattttgaacattttttgaataagtttgagaggtgaaaatttgtg

SEQ ID NO: 96177 - DNA, 540 bp, Heterodera glycines
  SCN-specific regions: Sequence locations=1-317,340-540
ggagctccccgcggtggcggccgcaatcgaacaagtggatcccccgggctgagtaactcaacacgagggccttatacaaacatcaaattcttaaaaaatgtcaacaatcggagtacatgaaatattcaaactgtcgcaaaaagaccatcagcctcccgaaaaaaggagcaaactcagcgatggatcgacacaaattgtgccgtcggttgcgacagcaaaaaatggaggcgacattttggaagcattagaaaagtcggaagacacttcagaactcaacgaaattgacgaagcgtcggtgaagcggatttgttttctgttggagcgaaaacaggggaaaaatgcggaattgcgcataaaatacgcggaagagcctccgaaatttatggagtcggaaattgaattgaacaacgcaattcaggaaatgcacgtaattgcagcggagccccaattttacgatgtgctcgtggaacaggggtcggtccaactccttctgcaactgttgtcccacgaaaacaccgacataatagctgcagtttgcaa

SEQ ID NO: 96178 - DNA, 476 bp, Heterodera glycines
  SCN-specific regions: Sequence locations=1-125,147-476
gttttaggtgtttggagtgccaattttacattttaccgatcagtctatgcccaatttgtcacttttggacaaacttatttttacttcatcctgtttttccaacctcatttgtgcaccaaattgacaacatttgagcaatgaatgttcagcaacagcagccggtcacctcggcataccctcagcagggcaattttgcggaggagaagcagctgcatcccaatcacaatgtgtataggaaaatggaactactgatcagtctgatgctgaatgttgatgatggcgtgccgatcaagacggtcaaatcgtttctttcaaaattgccaaggattccgtcggtgttcacgggccaagacttggtcggttggctgctccaaaatgtggacattgccgaccttggcgacgcgttgcatttggcccatttgctcgcctcccatggctatgtgtttcagattgacgaccacgtgttgacggtgaaa

SEQ ID NO: 96179 - DNA, 475 bp, Heterodera glycines
  SCN-specific regions: Sequence locations=1-116,138-475
gtttggagtgccaattttacattttaccgatcagtctatgcccaatttgtcacttttggacaaacttatttttacttcatcctgtttttccaacctcatttgtgcaccaaattgacaacatttgagcaatgaatgttcagcaacagcagccggtcacctcggcataccctcagcagggcaattttgcggaggagaagcagctgcatcccaatcacaatgtgtataggaaaatggaacgactgatcagtctgatgctgaatgttgatgatggcgtgccgatcaagacggtcaaatcgtttctttcaaagattccgtcggtgttcacgggccaagacttggtcggttggctgctccaaaatgtggacattgccgaccttggcgacgcgttgcatttggcccatttgctcgcctcccatggctatgtgtttcagattgacgaccacgtgttgacggtgaaaaatgacaacacttacta

SEQ ID NO: 96180 - DNA, 1530 bp, Heterodera glycines
  SCN-specific regions: Sequence locations=1-34,56-380,402-496,521 -669,697-1316,1345-1368,1403-1467,1491-1530
gcggacaatccgaaccttcgcatcaacgaacccgacccaatgctggtgcttatttatttgcccaacccaccaacgaatacattctctaaattaaacatttttcaggtgacttgtgcgcatcgtaagtttttactgtcacaaattcaataaaatgcaaaaatgaacttcaaaagtccaccaaattgtgtcccctccccatactgaagtgtccgaactcagctgtcctcgggcatgcccacccgtccctctccttataagtaatacatttgtacaatttcccttcccccaggcaacaatcgtttttatttgtttaccaatgtcgaaccgtacgcggaagaagcggatggtgtgttttgttatgcaaaaacagtcattaaaaatcgtttttgtctttttaagggtccactcatagcagagacgtgtacaacgaaaagccgctaaaggaggacatgatcaccgcaatagaagtgagttagggagacgagccaattgtgggaaataatttaatttatttttattactgcaggaagaagcaccccaatcgaagctgtgcaacaagtaattcctaattaaagtgccaaaagcgttcgctcttttagggcaattgtttacacaacatatggcgacattcacattgagtgggttttgtgcttccccatccattcatttctccatttttattttcaaattttatgtatttaagactattcccggacaaaacgccaaggacggtggaaaatttctgtacacacggtaattctcgacaggcatttctctgatagatttattaatgtaattgtttacttttggtattgtttcagcacgacggggttattataacggacacgcctttcacagagtgatcaagtcgttcatgatccaagtcagtgagacgcgagacagagcatttctgactgaattcgctttagacgggcgatccgacgggccgtggcaccggcggacagtccatttggggcggtgattttgaggacgaatttcacccggcactacgacatgacaaagcattcagtcagtctccgcactttttctgtctgtgcttttacaccttcgtttcctgtcttttcaggagtttcgatggcaaatgccgggccaaacactaacggttcccaatttttcatcacaatttgcccggccgaatggctcgacggaaagaacacaatttttggccaagttgtggaggtgattttgtgaatttggatgagtgcgtttcacttttatttgctgcagggattcaacgtggtacaaaagatcaaccaagtgcccgtctataaaaaggtatttcctaattgtaagcgaattttaatttaaaatttaaaatttttagagtgggagaccccgagaagagatttcaatcatttccatttctctgaagagtgtttagcttatataaattcattgctttacaataatgaacgaatgaatgctctcattttgttgggccaatccgaaattatgtttttacttttaaattccaccaaaaataaataaaagtgccacagaatggatgtg

SEQ ID NO: 96181 - DNA, 560 bp, Heterodera glycines
  SCN-specific regions: Sequence locations=1-63,85-166,189-469,491 -535,557-560
tggagctccccgcggtggcggccgcttctacaactagtggatcccccgggctgcaggaattcggcacgagggtgcaaggggtgaacggacgaatccgtcaacaaagaatgtccgatacaatcaacagcttaggcgctatctgcaaatgagaagggagctgacagatagaccaaccaaagtggagttgaccaagggattgagtgttttgttgaagcgagatgggggtgctgatgaggacgacgaagtcgtcaacactcagccacggcctcccgctccaccaccacctccaccaccacctcatcactcatctcaactttttttaccgtcgccctcccagccttcccgatcagcaatcttcctcatctgacgatagtcatccgcctcgtccaccacgtcctcagagaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgacgatgaacaa

SEQ ID NO: 96182 - DNA, 486 bp, Heterodera glycines
  SCN-specific regions: Sequence locations=1-50,76-486
tgagggtttagatttattgttaatattgttgtaaatattccctttttgggaattaataaaaataaataaataattcaaaatgtccgctagcaacagtcgaaaagcattcgtgcccttttcaaatgcactccgacgacgaaagctgctctttggctttggggttggcactgtcatcggcgccggcttttactacatggacaaaaacaacgaaaggcgcttcaaacgggacaaagacgtttatttcgtgtccaatgcgcatgcggccaccgttgacaccaaagcggcgctgaacaaacgcccgtccggctcacttccgacccgcgcggagctgttgaaaggaatgcgtgacgaggaattcgacatccttgtgattggtggcggagcgacgggcgcgggggtggcattggacgcgcaaacgcgaggtctgaaaaccgcgctggtcgagttggacgacttctcttcgggcacaagttcgcgctccaccaa

SEQ ID NO: 96183 - DNA, 718 bp, Heterodera glycines
  SCN-specific regions: Sequence locations=1-718
ttcagtaatttttccaaaatattaatttaattctcatctattggacaatgagaggcgaggctaaggacccaaaaggcgaagcaacggcagaagcggtttcagtggagaagcaacaggaaatccttcttatgaacaaattggcttctactggcaaactgccgccaaaatctgctagcaattttctccagaaaaagcttcaacaaagaaaatttttcgattccggtgactacaacatgaacaagaacaagcctattccaccgccgataggccagaatttgactgctgccaacactcccaaactggccgttccgattgaaactgaacccgagaaaaaaatggaagaatcagctccgattattgtatcgcaattgctcccaatgatgcgtcccttggccggctcaatttcgggttgttcgatggatggcggcgaatctgacgatgagggcggacagcttcagattcctcgacctgacacagtgccgcagcgcaaatcgtccattttacatccgtcagcacatagcaaattgagtcctcaaccgcacattcaccacgaacacactgacgagtcgttgaccttcccccagtcgtaaggagtgaaccgaaggcgaaaggagcgcaaatcgaaatggtgatcttccaacagcaattatagctgagatcggctttttgtttgatgtaaaatttacttggacttttgaggaatgacttttttgggcaa

SEQ ID NO: 96184 - DNA, 233 bp, Heterodera glycines
  SCN-specific regions: Sequence locations=1-2,57-233
cgataataaaataaattaaaatttaaatatctaaaaattaaaaaaaaactaaataagaaatttcgttttgcaagcgataataaaaaatagagaatttactaatgcacaaattccattaaatattagcaaaagaatgtaatttaaaatttggtttttacgtcaattttgtattttctacagttttttacaggtgaaaaagaaaatcatcgccttcaaaaaggtgaggaggcgtt

SEQ ID NO: 96185 - DNA, 652 bp, Heterodera glycines
  SCN-specific regions: Sequence locations=1-347,373-652
cagagacatcatcgaattctgcaacttcctgctttaagccaaacaggaaccagtcagcggatatttccaatttgccaaattatctacaacaactccaactcggtcctggcggtagttcgaccacgagaagaaccgggcgtttcgtggaggaaaggcggcttcgtcatgttaagcaacagcccagctatagctttgaggtttccggcacttggggtcagcgcttctcgagttgccaatttctggacgtgtcggaggatggacgaactttgattggatgctggacttcagagcaaaacaatcttttcgaggggcactgttctcgtgtgctatccttcggcgtcactgttgacccaaacacagccaaaaaagacactcagcgaatggcactcgccgaagatgttggggacatggcatcactgttggactccaatgggaaataccgctgcaacacctatggattgtgctttgagccaatagacaatgagatttgcttgggctcttccaaccgaattctcattgacatggtgcttgccccggctgaccgtgacgtcacttgccttctctttgccactgctcgttctttttaccaggaacaacaacattccgtcggatcttgtccaaaaattgtaaccaaatgcacggttaacttgcg

SEQ ID NO: 96186 - DNA, 550 bp, Heterodera glycines
  SCN-specific regions: Sequence locations=1-550
ggagctccccgcggtggcggccgctttccaatagtggatcccccgggctgcattcccttgttgcgagcgaacaacgcaaatgtgcgaccgcaactgcaaggagtggacaacgccaaagactgtttgacaccgtcgacaacaggcaataatcaaccgacacgagaacagccaaaactgatggacattgacgaaaggattgggatggacgacgaagacaacgacgacggggacagattcggagaagcagcagaggtattgggtggaggagacaacgctaaccgagttggtggtgagagagtcgtgggtaacagactgcggaaacggcgctccgtttcctgtgagccgacagcgaacagtccggccaaaatggcaccgcatcagccagccgatgaccaatccgctggttgtctgctgcagcgcacccaaagtgtcaatgccttcgctgttccctctgctcatcaacaaaatgccgtcgtcccaattgcctcttcctcgcgtatttcgtcgagaatgccctcctccgtctccatttgctcatatgccaattctg

SEQ ID NO: 96187 - DNA, 482 bp, Heterodera glycines
  SCN-specific regions: Sequence locations=1-32,54-191,278-482
acttccttctgcctcttccttctcccataatcattttccttcttcctcttcctcaacttccatgccaaaatttcctgttccatttcttgccaattctctcaaaatttcttcacccgtttgtgctgatgtgactccaaccgaaaagaaagcaacgacaatcagagaagttcggacacaaaagcagcaaatcaaaaaggaagaaaaaagcgaagcacaaatagcgcaggaaaaggaaagagaaagggtcaaaagagagaaggagagggagaagaggaggacaaagctgtccgacgcattttctgctctccgttcatccattccgactttggactacaaaacgcccttttccgataaaatggactgtgtaaaacggcttcttccttttggactttattccgagactgaactgtccgatgatttcctacaaaaatttgatggtgaattgcaaaggcattccgaatttttgtgcgaacggatggatt

SEQ ID NO: 96188 - DNA, 508 bp, Heterodera glycines
  SCN-specific regions: Sequence locations=1-118,140-373,406-508
aaacaacgttccgattcattgctgttgcccaacgatccgaattcttatttagccgtccttaaccaagtcacttggagcgattttattgaacgcattgtgcctactggaactgtgtcaaatgttcatttgaaagtttctcgtgggcctgaaagaagaatttccaaaaaagcactggtcacagttatgccgggtgcgcggtggccggatggaaaaatgttgccaaggatgttttttgtaaatgtgcccgacattggtcgagtggaacaagaaatcaggaaagcggaagtggatgctgggcttgcccctgaacattggagcaacatccaatggatgcaaccggggccaatgtcattgattataccttctctggtcatttttgctttatttgtccttccattggttttccttggtcgaatgatgactggctcaaaaatgggcaacttctccgaatcgatctcttccatgatggggcatcgtcttcgaatttatgacccggcattaaaggatg

SEQ ID NO: 96189 - DNA, 568 bp, Heterodera glycines
  SCN-specific regions: Sequence locations=1-13,40-568
atcttgagagcgttgtttgaaaccaaatattaaatatgtcatctctttccgaggaggtcaagaaagttaagcaggccgctaacattcctcctccggcagtttgtaacagatttgtcgaagggttttcaagcgtttatgtgttcgaaactcgaccatcttcacatggcggtgcttttgcattccgttacgatgttgaaatggtgcagctcactagaaacaaaagtttgacttcgggcggtggcgacgatgggaaaaatggattgctccgcggcgtttgttttgaattgatcaagttcgtgcacgactcgacgcagggatttggacaagcggcacaatttgtttacgacaaccgtaaaatcttattcacgaacaagcgaatcgaacaatttgtattggaaattgacacggaaaaagtccaaggaatcgttcgcgatttcctgcgtgggtcttcggtcaaaattgagatcaaaccctgtcagactgataaacatgagctggatctcaacgacgtcttttcttccatctcgcgccgtcctgatgagcagtctgacagatctttgcgcacttt

SEQ ID NO: 96190 - DNA, 481 bp, Heterodera glycines
  SCN-specific regions: Sequence locations=1-57,79-99,121-481
gaagtaagaagcacttctctgtacagcttgcactcctgcaaaatgatgttcatctgcaggtccgactcaatgttccctttttggcgcagctcatagcaaagtgaaaatatccttcaaaatgttaatcatcggttttgttagcataaataatgattgaccgaccaattaattggcatccaatattttgggaattcgcttttcacattttccattaggtccaattctggtagcttaattaatttgcattcgaatcggatgattccattttgatcaatgtttgtcgttcgactgacttggatcagttcggagtcaaccagtgactccatgtttggaaaacgctttcgcacttggatggaaatgtcgcggaggacgagcacttgggtcaaacacaaataccttttaaattgcaaggagtttaaaaatatattattgttagctttattgcccctggctcacccattcatttgctgcctaattacct

SEQ ID NO: 96191 - DNA, 1107 bp, Heterodera glycines
  SCN-specific regions: Sequence locations=1-20,42-1107
gtttgagatatctttcacacttacaaataataaccataagatctaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggctggacaacctcatcaagtcagatggaaatcgctttcctaaaatcacggaaatggcttatatgtcggtgccgcgggtgttgttccttgagggaacggagcaaatgtccgcgcgccatttatcatcgatgtcgcaagacggcgaagaaggcattgagccggtgcaggtcgttacgaatgtacacgtgcgacagctgaatccgcagcttaatgacaaggagcggttcaattacgaggaattgcaacggaaagtgccaagaatggcccggagtcgtccacctgcttcagactgttccaaaaccagcctgtctggttgcgcacaatggtctcaactttgacttccgaattctgtgccacgagttgcgcaagagcgacctgttccgtacccatccgatcccagaacaggtttatttcctcgacacgctttcctgcttttacgaactcgagaaggagtacaaccgcgagatagaattaacgatggaaaatgttgattggactctcgttttgtcccaattccaaccgaacagcgaaactgtcgttgcaactgccgagatagaggaaactgtacaacaaaatggcactgcttctgagggaacacaaaattccaatggtcacaaaagcaccaccgttcttcatcgattgttcgatcagaaatgttctcttacatcaaatgccaacggattgccaaattctcataagaaaataaatccaatcctacgtcattggagcttggctttgccgctgatcatgttcatgcgcaaaacgcattggtcgccggccaaacgccgctgcattgacgccaaattttttgagagcaacaatcgcggtgaatggaatttcaatggtaaccatgccaggcggttgttgtgcggacgtggcaatttcaaactggagaacatgttcaagaggt

SEQ ID NO: 96192 - DNA, 659 bp, Heterodera glycines
  SCN-specific regions: Sequence locations=1-216,238-659
gtttgagcaacaaattgaaagcctaagtagctcatattccaaaattatggaagcgaatagagccggtcaaattgcgccaaatacaaaggctgaaaatcatgggaacgcacggactgaaattcgacagcctgcgaatacgacattcagaaaaggtcacagaagagcccattcgatgccatccaacgcacagaaagcggacaaaacaatggcaaacggaaaacaacaaacgatcggtgaaaagcaacccgaacacaaacttgcgtgtgatgcgacatcggcacattcgcctcaaaccgaatattcttaactcttcggctgcagcgaacgcttccaagaaaagacacccgcagccaaacttcgacacaatcgaagtgctcgaggaggagcacgagttcgaggtccaatgtcaagcttggtaaggcgaggctgacgaagtcatcacaaataaaggttccaatcaacgaggaggaaatgatgcgctttcccgggatggaggaaggctcacaaaagtcggataaaatcagcgtccacaggaggttttggcagctgaattgcaagggcgtccacttctccggccttcccacttggctacaagacaatgaattcctccacttcggacatcgacccccacttccgagttttggttcttgctttaatag

SEQ ID NO: 96193 - DNA, 1171 bp, Heterodera glycines
  SCN-specific regions: Sequence locations=1-1171
atttcgttgggtgtgcacatatcaagtcggagtacgtcgtattaccaattgaaacgcaacagcaagaaggaggcaacaaaccaccaaatgaatccaatccattggaagggaactcgcacgagggaattctgccaagaaatgtgagggcacgcggaatggaccgccaaagagagcaaaaaatggccaaggcccgagcggaaaaccgtcaaaaaatcgtaagaatttgtccatctgttctttttgagagcgaaggaaggaagtgcaaatatggagagaaatgcgacgcggagcactcgctgacaaaatattgggcgaagaaaccgccggacattggcgagttctggcacccaacgccaaacaccatctttctttggaaggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcgttctgaacgtgctctgcatgaatcaccatcgggttgtatggaacgcgaagcaccgaagtgggacatgcgcactctccgcggcaaaaaatacttggcccctctgacgacggtgggcaacttgcccttccgccgtttgtgcgttgaattgggcgcggaagtcacttgtggtgaaatggcaattgccacgcatttgttgcagggtcttccttcagaactttctctgatgaaaagacatccgtcggaaaaaatctttggcgttcaattggcaggaggctaccccgattcacttggtaaagcagtccaactgatcaccgacaatttcaatgttgatttcatcgatttaaatttgggttgtccgctggacagtgtcaatgaaaagggtgcaggctgttcgttggcgaataaatccaacaaattggtttccgttttgcagtgcatgcaaaagagtgccacgggagtgcctgtgtccgtcaaaatgcgttacggagtgaaggaaggagaacggactgcgcattacaccatggggacaattgccgaacggagtccccctcagctgctgaccctccaccctcggtcacggggacagcgctacacaagg

SEQ ID NO: 96194 - DNA, 507 bp, Heterodera glycines
  SCN-specific regions: Sequence locations=1-179,218-279,304-304,333-507
aaaccttaaagcactagccgattgaaataaatggacaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagccaaaacacaaaaccttaaagcactagccgattgaaataaatgg

SEQ ID NO: 96195 - DNA, 475 bp, Heterodera glycines
  SCN-specific regions: Sequence locations=1-475
gagatttgttacacgttaaattgctgtctgtgatagcaattcaattttttccatatttgcaaatcaacaccaacatcacgacgagcgggacactgaacgaagggagtggcggtggtaccggcactgctgcccctggtcaaaataatacgaatggtgacatcaccggaggttcttctgctgccgctgctgttgccgggaacgtccatcggtgtcaatcgcccattatggaagcagaagttgccgaagacacgtccaacaaaatgttcccttctcatgagcaatcgcaacaactacagcagcaaccacaaggagtcaagaaggaaagtgttggttcttccaattcgacgacttcttccacacgggtcgcttccgttgtacatccaatagaaaccacgaaagattcgaaacccaagccatcggtcaaagacaacacaacgatcagtccacaggcgcttaattcaatgctaagcggctc

SEQ ID NO: 96196 - DNA, 382 bp, Heterodera glycines
  SCN-specific regions: Sequence locations=1-382
aaagggcttaactgctaaaactaggcaattctagggaatttaaaatcgaacaaaaaaagttttggtgcattaatttgtcaacttttatggtcgtcttttttatggtcgtgtaaactgaaatagatcaaccctggaaagttactttatcaaaattaaaaccccccattatttagggttggcacatactttcaatttaggaatacaaatttttaagcgaggattcggtagttttttaacttaaggttgctgaggcaagatctctggattccgtttgcgtttctctaaaaaatcttgcacaaaatgcggaagatgaaagcgaggttggtatcaataattttgtactatttgtgctacagttttgatttcctattttatcccattc

SEQ ID NO: 96197 - DNA, 650 bp, Heterodera glycines
  SCN-specific regions: Sequence locations=1-31,173-198,243-254,401 -404,426-426,458-482,543-543,629-650
attgaattcaataccccttcaatttggctatcatgcaaatcttcgtcaaaactctcaccgggaagaccatcacccttgaggtcgaggcgagcgacaccatcgagaacgtgaaagcgaagatccaggacaaggagggcatcccgccggaccagcagcgccttatcttcgctgggaaacagctcgaggacggacggaccttggccgactacaacattcagaaggagtcgacgcttcatctcgtcttgcgccttcgtggagggatgcagatcttcgtcaagacgctcaccgggaagaccatcacccttgaggtcgaggcgagcgacaccatcgagaacgtgaaagcgaagatccaggacaaggagggcattccgccagaccagcagcgccttatcttcgctgggaaacagctcgaggacggacgcaccttggccgactacaacatccagaaggaatcgacacttcatctcgtcctgcgccttcgtggagggatgcagatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgc

SEQ ID NO: 96198 - DNA, 1832 bp, Heterodera glycines
  SCN-specific regions: Sequence locations=1-492,516-624,646-920,942 -1156,1212-1254,1278-1832
ctcgttccagtgacatgaccttccccgaaattaaactaggccttgactccattcgacaatttacaacgaagggctgggaaaattgttgggtcatagataccacccagggtgttttggagtcgctctacactgattcgcttggggaaggtttgaacaccgacaatgttgaccacgcgcagctggtggatgcacagtgtgatgctctgggtgtgttggatgcgccgaaaaacgcgtgccgccattttatttacactgcttgggtggggcactccggtgaggaccacacgcgccgattggaagaccagcgcagccacagttttgcccattgttgtacggatgcgcatgatgatagcgtgaaagcgcctggggttatactccgtgtttgagccacgctgcgcaattgccaaaaattgctttcgagttaagggttcaacatttattttaaaaacaacagtacaatttgaaattgaacacatctacaaaacaatggacaaaatttcaagagggaaaaaagttttatgatctccgcctccaaattcaacgacgcacggcaagttggggtggcgcaagcggatgccatgctttatgtaatagtgcatgcggacctttaattttttgttaccgacaaacaaaacaaataaaaataccgttatgccgaggtagcctcggtacgcgggggccgagtgggtgtccaggatggacaggtcattacagcggaccggaaaattgcgcacggacgggcgcaggtgggcggtgcgcagttggacggagcgcaaatgctccacaatgtcccgccgtttctctaagcttttgaaaagcacatgcagctcgtgagcgttgcatttgaaccgcttgcagagatggtccacgagcggaacggggcgacggcgttcggcacatgcacatttttttggagtgcctaaatttaaatttaaatatacgtttaaaacaaaagcaacttgttgctggcgtctcctcaccaattggagcgagcggctcgcgcttcatctcctcgtcaatcaggctgatccaactgggatcatccgcctcctcctcttgctttttcgttggctctttgttggcgtcctgtaaatccatttcgggataagcgttgtttatccaatcggtggcaagaattaaatccatttaaaatctgtgaaaataaaaaaaaaactataaataaaaagaaaattacataaaaaaaagtaaaatggacgccttccaacaatttaaaagggaggatggacaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttgccaatgtgccagtcactgtacacagcggcgtcccacgcgcggaacaagtgcgggagtgtgccaaaaaagaaaaaaccttgctggtgctggatgatttggtggtgggtatgagtcaacaatatttagacgcactcttcacccgtggctcacacaattggggcgtcagcgtaattttggtgactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagatatccgccttc

SEQ ID NO: 96199 - DNA, 413 bp, Heterodera glycines
  SCN-specific regions: Sequence locations=1-22,46-60,82-136,158 -198,220-413
ttgccatgccaaacgcattctgcaccgcgacctgaagccacagaatttgctcatttcgaagaatggggagctgaagttggccgacttcggcttggcacgggcgcagtcagttccgaccaaaagttacacggccgaagtggtcactctgtggtacagaccaccggatgttctgcttggttccacagactacagtacccacattgacatgtggggcgtgggttgcattctctttgaaatgttggcccggaagccaatgttcccgggaaacaaagtcgaggatcagctcgacctgatttacagaaaactcggcacccccacgccacaattgcacccgcggctttgcgctttgcccgccttcaattgccacccgcgccatttgcggcggcactcgcccagggcattggtttgcctgg

SEQ ID NO: 96200 - DNA, 71 bp, Heterodera glycines
  SCN-specific regions: Sequence locations=1-71
gtttcaaatatcgtaagattgtttgatagggccagacaagagaaggcaactgttggtaccaattttgcggt

SEQ ID NO: 96201 - DNA, 132 bp, Heterodera glycines
  SCN-specific regions: Sequence locations=1-105,131-132
aattttattccaaatttaaaaatcaataaaacgcttttttgaggcgcgctttttccaaaaaaaaactttttgtgaagagggggcaggcggcgccgccaggaaaatttttgaaaatactttaaacttaatatt

SEQ ID NO: 96202 - DNA, 280 bp, Heterodera glycines
  SCN-specific regions: Sequence locations=1-192,214-280
aaagagaaaaacattcacaaaaatggtaataataaagcagcagtctgacccgttattattcggctgtaaatatgacatcatgtgcggcgtcgcgtcattcacaattaatatgtaaaagaacaattaatgcactagagagtgtgtgtcgtttgtgaatcgaaagagatggagagagaaagcgaaaagtgtccatttggtggtcaaaatgaaacaccaaagggtgaaggagtggcggagattgatcagttaagtacacacaataacaacggttatataatat

SEQ ID NO: 96203 - DNA, 481 bp, Heterodera glycines
  SCN-specific regions: Sequence locations=1-284,310-481
ctctatagccttttttgggtccaagaattcgaatatcttttcggcaccttatcccgaccctgatcccaacccttttttccttgcatccatagcattttttggacccggaattcagtatttcgaaaattgacatcccgaccgtggtccaccaatctcccttttccccaacaaacattcttaacgcaacaaaatttggggctggctctccattgttcaactctcatcaaaaccaatgaattttgcttgggcctgacttgtcccgtcccaactgagtacacaagagagccaaaaaataaaacatttttcgtttgcccattttggcggattgaaaatgttcagtctccccgttctccgttcacaaacacagctccccccccccaatctcaaatttcgcgcatcaaccaatttcactctcggttagtttcacaaataaacaattctttgccaaccccgcgcctccggggacggcggacggggcggg

SEQ ID NO: 96204 - DNA, 462 bp, Heterodera glycines
  SCN-specific regions: Sequence locations=1-246,277-462
catgtggattaaccctaattaagccaatgtctggccattcaaaaaacgacactttttaaaattccgcattttagggggcaatcaaaaattccacattcttttacatgacaatccaagaatccgttgaaggaaaattcaactggtcaaatggcgccgaatgctcaatttattagtaaattatacaccgaactaagtcaaaccagccaaaagattgtcgaacttaataccacataaattgactttcactgaaagcattttaaatgttaaaaaatatatcaagttcatccaattcgacaatccatggcatgagaattgggacaagaatgattgccaaatgatgaggaacaacaaaaagcatcattttcaaatttcatgcatattaagcggtgcgatagtggtcaggtgattgattttattcattcacattttgtagggatgacaagtgtttattcccgtgtttgt

SEQ ID NO: 96205 - DNA, 682 bp, Heterodera glycines
  SCN-specific regions: Sequence locations=1-682
atttctttaaaaaaatacgacagttggttccatcgtattacaatttttttagaatggctgaggccagaaatattgctgccttaagcttcaccgtaacacacgatggcatttccgtctcttatgaccaggaagttctgcgggacatttggcacgcgttttcacgcagttataaaaaacgcatcgcaaaattcgagaatgatttcttcgctgggattttcccagccaatatccgttcgttggccattgtcattttccttgtggccgcattgaatgtttcattcggaaatgacaaaactccgttcaatcttgccgataagctcaattactacgtcttttccaatatcaccacgctcgacgttttgtcccgcactctctcaattgcctttgcgggttgcattttatggtttttgctcgtccaattctttcgtcttttgctcaaatggtttctcatgtacaaaggttggatgtacgaagcgcctcattctggccaaatttcacaaacgaccaaactttggttttacgttcttcacaaaattgccgcttatgagccgatgacgcactctttccaaggcgctttgcctcatctcccactgccgtcgttggcctccacgatggaaaggcacctccgttcgatgcggccaatcctttcggacagagactacgacgaactcgtagaactgag

SEQ ID NO: 96206 - DNA, 360 bp, Heterodera glycines
  SCN-specific regions: Sequence locations=1-101,127-360
cagatagatccatgccaaactctctacatattgtgccaacaatatttcggcatggcttggcgtggtgatgccgtaccgtttttccggggcttcctcgtccgttttttgtttggccgtttttgtccacgggctcggcggttgtttccaactcggacggacagatgcgttccgttcggttctcgttgcagccgctttccgggcaaacttggcacttgtgaatagttaagggtggtgggcaaaatttttccaattctttaaagcattttttttcttccgtggcacatgcgttgagcacaaagttatcatcgcccttctctgatgagagataagaagcattaaaaatgccgccggcggatgttt

SEQ ID NO: 96207 - DNA, 789 bp, Heterodera glycines
  SCN-specific regions: Sequence locations=1-79,133-134,156-249,302 -328,369-415,463-789
gagagagaggcagtcacagcacaatacccctccggggacgaccaaaagcgttgagaacgcaatgaatagagaaaataatgagtgagatggagagaagagagagagagaaagggagaggagagagcgacagagcaaaaggaaaaggcagacaacacgacaaaggagaggagaaaaacggccatttgctgttgttacactgccgggggacgagccaaaccaagttcaaagtgccggtgcgcagcggtttgttttcgttcaatgctaatcagctaattgctcactaattaccccaaataacaaactgtcccctgatgccgacattcgccaacaaatgccttccgctcgaacttctgtacgaaattgtgcctttcatccctgccgaaaatgccgcccctaatgcgctctcgtcctgttcgctgctgcacaaacttttgctgccacgtgtcatcaaatggaaagagaaagcgatggacgaaagaataatcgagctatttgaccaatttaaagaagagatggagcagaaattaatgaacaaattggacgaaattaaagaagttttaagccttgaatttaaccaaaaattcgacgctttggagcaaaaattcgagcaaaaattcgacgctttggaggtgcgcgttggccgcctggagcgaggcactgccacaaacacaaatcaaggaaaaaaatcgctgaacgtccatgaaagattggacctcatctttgaaaaattggggataattcgtgtaaacaaatcgcgttcgcctgaaccttcctgcagcaacactttgc

SEQ ID NO: 96208 - DNA, 493 bp, Heterodera glycines
  SCN-specific regions: Sequence locations=1-290,313-337,359-381,422-493
gaggaagtgaaaagcagttctttttgccatttcaagaacacatggtcaaagtcgaaaaacaaatttcctccgggacttcggatgacccattgagtttggttgattcgatcataaaggaccattttctcaacgatttgaagcacaaacagctcacccccgttcaggcatgtactctccgccacatgttggccaacttcgattgcgtcgtgcagtcgcccaccggcacaggcaaaactttagcttttatgcttccaacgctgcaaattttggtgcaaaagaaactgaccggcgcaggagagggaaaagaacagccgacgtctgtctccgattcgtgtcgcattttggcacttgtggtggcgccgggccgtgatttgattgtccaacttttccatcttttttcaccattgtgcaaaaagcttggccttagcactttgaaattgcacggggctggcggaaaacaaaagaaaaagagcccaaagaagcacatgaaggg

SEQ ID NO: 96209 - DNA, 479 bp, Heterodera glycines
  SCN-specific regions: Sequence locations=1-124,155-178,201-479
aaaacctcacctcatttgaaaacgcctcatttttctccatgtttaaaattgttttattgtatcatatttattctgcttttatttattgtaaaccattgaagaataattgtgacggaatacatcattacaattttttgttgttgttgtttgctgtattaggatatattccttacaattcgttaattaatgcattttttaaattttgggttttaatttgtcaaatattcgattatttgttgtgcattttattcctatgggctgaaatgagttggctgcccaatgagaatcttttggatgtgttcgcttttttgtccgatgttcgcctcctccgttcggtttccttcgtttgccaccgcttttggcgtttgtctgagttggcacttttcaaatttcacccaatggtggccaaaagtgttcgcatcggttgggacccaaagaatgcttcgcactatttctttgttcaaagtgtaaaatgtgcc

SEQ ID NO: 96210 - DNA, 287 bp, Heterodera glycines
  SCN-specific regions: Sequence locations=1-287
atttgcttctctcttcgtccatttctctgctctttcatccccatggtcctccgtacccccaatccgaactgctccaactccatttgcgcttgcaacggacgcaccgccgcgcgatgcgttgggcgcggcttaacactttcgaggcgggcgccggcttcaaatcgctgaaagattggggggggggggcacaattagggcgaggaaaaggtaatcaattaattagtctactaattaataacgggaaatggtaagacttctgctaacaaaatgagtgactgactcttggg

SEQ ID NO: 96211 - DNA, 377 bp, Heterodera glycines
  SCN-specific regions: Sequence locations=1-146,168-341,365-377
aagctggagctccccgcggtggcggccgccctacaacagtggatcccccgggctgcaggtatcaaacacgaggcttgatgtccctgagaactccctcaaaagtcgcaccttcgaaatggccaacgaatgtggtcatatttctcttgaggaaaaagcaggttaagaaatgaaaatgaacactgtatagatatcatcgggatatacccgtatgaggtcagagaaaacacagggtccgcttcacgtattctttggacccccccccctccagtgctagccaacaccggaaggggctcggattagcgcaacccgtgcagcacctatggactttcgcgacctgtaggccaactcctaccaggctccccggaggttccgagtat

SEQ ID NO: 96212 - DNA, 633 bp, Heterodera glycines
  SCN-specific regions: Sequence locations=1-3,82-135,163-172,196-633
tccaaaaaaaatttgaaaaaaataaatttcagataaaaatatatatttccgaaagattaataaattaaattttaaaaaaatgcaaaacctaggctttttaataataacgtacgttctatagaaacctaacagatattctcattttttaaaatacaagaatttagtggataacaaattattatatattattattttctttggttgctgtcgatggtcacagaaatggataaaattgctcattgcttgctggtctgctgtttattaataatttttttttcgattgtacggactatggagaaaatgaaaaatgtataaattaacatttgttgcattaatcatccatcaatagggatgcgatttttaggcaaatgcctaaaatttttgcgcacttaatacttacagttaagcacgaaaaacgcattttccgcttgatttggcgtgtctacgatgacttttataatgcctaactttgcctattttggattttttgtgcttaatgcctatttcgccatttttgacgaatttttcaggatttccggaaaattcgttaacaaaaatgcaataaaaatgaaaaatacaccccctaagaatcgacttgaaaattttttagaaaatacaaccccctaagaattg

SEQ ID NO: 96213 - DNA, 457 bp, Heterodera glycines
  SCN-specific regions: Sequence locations=1-368,391-457
tcagctgattccttccaaatgccttctgagtacggcattgaaaccgactcagtgactcttcagcgttttgtgctaaacgaacagaagaaattcccggatgcaaccggcgacctgaccactcttctgaccagtctgttgaccgctgtcaaagcgatctcttcggctgtccgcaaggcgggattggcacaattgtacggagttgcgggaaatgtaaatgtgcaaggggaagacgtgaagaaattggatgtgctgagcaacgaagtgagtttcgaagggggggggcattcattcgtttgaaaagtcaaagagtggtaaattggcattactcattgtcagcttatgattaacatgttgaagtcgtcatacaccgtttccactttggtttctgaagagaacgaacaggtcattgaggtggaagtgagcggcacccaaggtcagaagaggagggaaatgcgag

SEQ ID NO: 96214 - DNA, 552 bp, Heterodera glycines
  SCN-specific regions: Sequence locations=1-552
catcgctctccgatcggtcccgaccccctacattcccccgaacggctactctgcgcgcctcgcccatttcatccccttcccgtccccttcaccccgcagagttcgacgcaaatttcttgtcgccacgacattttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaag

SEQ ID NO: 96215 - DNA, 481 bp, Heterodera glycines
  SCN-specific regions: Sequence locations=1-481
agcgaccgacggacagagagaaatgccctcccccgccacctttttgaactgttccgtggaaccgtcaatggcaaatgtcaatttgtggagaatgtttccgttcgaagttgccgtgctgatccgtccatatcgccgactgttcgccatttcgcgaagccattccatcgccgttttggccctttgcattacaaccgccgctttggaaccctcggggatcagcaactcgcgcgacaaaagggtcgaacccggcggaatgggggcgccgagcgcgagacagttcagctcatcgatcactaggggggagagtgggagatgatgggacaggcaatggcatccctttttcgttagataatcccgttccattccatcgcttcttaccaatggtcgggactaaaacagtgaattggtcggattggacgagccgctgaatatggcccaaatggtcgatgaaagtgtttgtgtcgggaactgagaaaagggg

SEQ ID NO: 96216 - DNA, 420 bp, Heterodera glycines
  SCN-specific regions: Sequence locations=1-420
gtcaagcgatgcattgtgctgcaggaattaaaaaagtccaccgaagcaatggagcagaacaatgaacagatgccatcgcaaatacaactcgatttccatgtcttcacacttccctatgtcctaccacattacgcctgtttatcgttattcgacggagaaattcatcacggcgcaattgcaacctcaaaacaaagggcgaagatcagttgtgcagcagtgttatgtgaagtgttggtgaagatgggctgggcggatgtgaaaagggccaaaaagagaaaaaactccgacggagagaaggcattgaaaaagaaaaaacggaagggagaaaacggacagacggaagacgttgaggagggaaatgtccgtttgtctcatcagttccttttgacattgcatccaaatgaatcgcttgacccaaca

SEQ ID NO: 96217 - DNA, 173 bp, Heterodera glycines
  SCN-specific regions: Sequence locations=1-173
atgacctttataatgcctatttttgcttctttcggggatttttatgcttaatgattaggcgcctattttgtgccaatttcgtcatttttggaacctattttcaggattttcggaagattttttttcttggtaaaaatttttggttaatcaattatctcaattatccttatacg

SEQ ID NO: 96218 - DNA, 377 bp, Heterodera glycines
  misc_feature (377)..(377): n is a, c, g, or t
  SCN-specific regions: Sequence locations=1-377
gcttaaaagcattgtacagcatacttaaaagctaatataattttcgtatatttttcacaatttatttcaaaaagccaaaaaaaatgattcaattttgaaacgaaatagtgcacaaaagggagggatggttagacgaaaagaggaattttcagaaaagagcgcaccccatctgatattcccatttttccgttccacaactggccaaaggcgactatgctcattgacacgtagttgttcaataaggtacttggactttccacagtaaaatgtggtacaaaattttggaactgtcccgcctcacggcggggcttaaaagcattgtacagcataattaaaaccgaaaataattttcgtatatttttcacaatttatttcan

SEQ ID NO: 96219 - DNA, 637 bp, Heterodera glycines
  SCN-specific regions: Sequence locations=1-101,177-637
gatatttgttcactgataatgcgagaacgaatgtgtgggaaatgtgcggccatatcgctaagcaaagtggtaaaactgaatgcgaactgctcatggatggttatttctaaaagaaaacaaggaaaaaaaaaattaaaatatacttttagaaaaaataaataaaatatacttttaaaggaatgcatttaaatcaaaaaacacactgttcgatttgtcaatcgctccatcatcgtactaacgcaaatttgtcaacgacctaaacgatattcagaagcaattcatggaagcacaaatgaccttaatgcatcggcaaggaaattgccaaacgtttcggcatacttaacaaggataattaacaagaagtcggccattgtcctaccttcccatgtgagtacagcacataaatgccagtgcaaagcaaagctgaacgaacgttgtgattgaaaggatggccgctgattcctgcagtcaatcccccgaggagctcattttgaagacgcgaaagcgaaagatcattttgattagcaaggcacagagcaacacaataacgattcgagaaggcaaagtcattacacattggagccatcaaaaataaatgattaattaaggaaaagcaagcaaataatatataatttgg

SEQ ID NO: 96220 - DNA, 654 bp, Heterodera glycines
  SCN-specific regions: Sequence locations=1-469,507-654
atttgtttgcggaaattcacttgtctgtgaaacgcctgaccacgctcgtcagcttgcttatggaaccgatggtcgttcagagcgatttcgagcagttgctttagacgggactcaatttcagccaaatggcgttataagcggcggaggtgccgacttaaaggcaaaagcgaaaaaatgggatgaaaatgcaatcagaaagttgaaagaccgtcgaacggcgttgcaggaagagttgcaaaaactgcaccgaaccgggaaaagggagttggatgttgagatgaaacgggaacagatcacttccctggaggcacgtctacgcttcacacagcaagaattgaagaagagcgaaaacgaaacgctgcggcggttggagcaggacgcggaggtcgaaagtgcggagccggagacaatcgaagtaattaaagccgaacttacaatttagacgaaaaagcaacaacaataaacattcatttattataaaaatttaaacatttatttaaaattttgcacgaattgaaagccgtcgaattgaaattgaggagcgcaaaatcgaaatcgaacgcttggaacaaaacaagaatgcaattgctgacgaaatctttacagaattctgtgcaaaaataggcatcaaccacattcgtgagtatgaacagc

SEQ ID NO: 96221 - DNA, 588 bp, Heterodera glycines
  SCN-specific regions: Sequence locations=24-276,298-493,524-588
cttctcttcctcctcctccgtctgcgttcctttctcacttggacacaaattgtttctgtttcttttgccaattttgttcgccgtccaacaattcgggatgacagaagccagcccattaatccaacaaaaagatgattccatccccatgccattggtgttcgaccggccatggcaaccaccgatttcgttggtgccaaaccctcccccagcctatttcgtgatccctgcaaatgtgccattggagcggcccatttacgatcaaaatgatagtgccattgaggacgaattggcggaggaagcgaaggcgaagcgagcgcaaacgttcgtccgattcggcaaaagggcacaaacatttgtgcggttcggaaagcgggcacaaacattcgttcgcttcggaagggatgcgcaaaggcagcaagaaatggcaaatgagcaggcgcagaaaaaggagtgaaagggacggcggcgaagtgggagaagcaaaagaataatcattttaagaaagaaaggatgtaaagtgacatgacccttttgatcagagaatgttgcacctttacccaaccgaattgataaaatgtaaatgaaaaa

SEQ ID NO: 96222 - DNA, 1729 bp, Heterodera glycines
  SCN-specific regions: Sequence locations=1-104,126-141,196-315,338 -1729
cattcatcaagcgaatatggaacgagtgagagaggacgaatatgaaaaaattggtctgatggacattaaacgggaaataaaagccgaactcaatgaagcgattggtcgccaaacggaagatggcgaaacggagccaaaggcggagagagagcgcgagaggaaaagcgacagagagagggagcgcaagaagaagagcaagcggacttcgcgagaccgaagccggtcgaagtcgcgggaacgcaaacgatcacgcgaacgccgacgaagtcgctcgcggtcgaaggaacgccaccgcgagagagagcgaagccgagaaaaggaaaggggcgaaaagaggtcgaaagtgaagagcaacaaatattgggatgtgccacccgctggctacgaacacatgagcccgaaggagtacaaagaactccaagtagtggtcgtccattagaattgcgcaagggtgctgaatcgatggattttttagcatttaggtcttctgtacggtgctttccgaagcattttggcggaattttaacttttagcactcaatttggtcgtctcgtcgtttttcagatttaagatactccgccaaatgttaatcgatatgaaagtcttttaggttttaggggaaaacggtgtcctgctgcatttttggattcatcccaacccaatagcttatagggtgaccgagcacaatcacctcgcaacaaacgcagaatagcattcccactttcttgaattcaccacttttattttagctaccggcgccatccctcgggccaccctccaatcgtctgttccggtggtgggcccttcggtcacttgtcaggcgcgacggctttacgtcgggaacattccattcggttcaaatgaagacgcaatgctggacttttttaaccaacagatgcatttgtgtggtttggcacaggctccaggaaatccggtcattgcgtgtcagataaatttggacaaaaacttcgcgttcattgaattccgttctattgacgagacaacagctgggatggcatttgacggtataaattttatgggtcagcaattgaaaatacgacgacctcgcgactatgtggctccaaccactaattacgaactgcttggcagaatgccagtctctaacattgttgtggacagtcctttcaaattatacattgggggactccctaaccatttgaactcggaacaagtcaaagagctgctgagtgcgtttggacagctgaaggccttcaatttggtgatggacacaaccaccggaatgtcaaagggttacgccttttgcgaatatttggaccagtcgctcactgaccaagcagttgttggtctgaatggaatgcaactcggcgacagtcgtctattggttcagttagccgctgctggagcacgtcaatcggtcacccatccgagcactgcggttcaaatcgcggggattgacttgtccagaggagccggacccccaacggaagtgctttgtctgatgaatatggtaactgaggaggaattgcaacaggacgaagtttacgaagacataacggaagacattcgcgttgaatgcaacaaattcggaaatgttgtgagcatggaaatcccgaggcctgggtacgacgagcgtggtgttggaaaagtattcgttgaattccaatctaaagaagaatgccagaaagctcaggccgcattgactggacgcaaatttgatagccgagtagtggtcacgagttacttcgac

SEQ ID NO: 96223 - DNA, 636 bp, Heterodera glycines
  SCN-specific regions: Sequence locations=1-82,112-636
gcggaagcagactgcccagcaatggcccgacttctccaaacgttgtcgtgcgctgataaagcaatggcagaaggtggcagagtacaggcccagctcctcctgcgaaggctcttccaatggcggcactcctcagcttgtctcgccggctttgaagcgcgggctgacaccacgggcgggggccgtgacgacgcccggcaaacgcacaacaccacatcaaccgcaacaacaactacgggtcacttccacagggctttgccctccagattctcgccaacatacgggtcgttcgtcttcaactttggcctcctccgtttcgccggtggagaatggcgtgccgacagcgagcggaagttacgcgccgctgccgtcgactgtcaaaaaagagtcgcctcgacagatcacagcaactgttcagcaacaacattccatacacaagtccgcctcagttggtgcctccctgagctgtctcggcggctcatcggctgcaaagcgaacagggccaatgcttaatggcattgccgaagatgggggaacagtcagcggaggagcgcacttggcctccagctctttctacgccgacgtgacgaaggatttgagagctgtacaaccgtcgctgacggcgccttccgcgccatt

SEQ ID NO: 96224 - DNA, 612 bp, Heterodera glycines
  SCN-specific regions: Sequence locations=1-612
catacgggtcgttcgtcttcaactttggcctcctccgtttcgccggtggagaatggcgtgccgacagcgagcggaagttacgcgccgctgccgtcgactgtcaaaaaagagtcgcctcgacagatcacagcaactgttcagcaacaacattccatacacaagtccgcctcagttggtgcctccctgagctgtctcggcggctcatcggctgcaaagcgaacagggccaatgcttaatggcattgccgaagatgggggaacagtcagcggaggagcgcacttggcctccagctctttctacggtacccggccgtttctttagatggctctaacccccgcctcgttgtgttgtggtacagccgacgtgacgaaggatttgagagctgtacaaccgtcgctgacggcgccttccgcgccattggcctctaatccgccattgacgctgaagttgaagcgttctgccagtggagtgcaacgactgacctcctcgctgtcgccaccgtcggacaatggcattggtgcagcttcgacttcgtcgtcagcgccgcttgttgctcaacaacctcttcagcaactatcggtgcttgctgcgcgacaacaaaatgtgcaatcg

SEQ ID NO: 96225 - DNA, 460 bp, Heterodera glycines
  SCN-specific regions: Sequence locations=1-436,458-460
aataagcaatttgatatctcagaaaaaagttatgagagtttcaaatttttatcaggttgtaactcaactccaaaactgctgttttctaccaaaatgcgaaaaactaatcattttttattgattctaaatgtccaaagagattttgtgtccttataaccaaaactattcgaatttgcaagttccatctttttcatgtgttagagacacgaaaatagtacgccaaaacgagagggagttgacccatagtgcgggcattgcgctgtgtcaatgtgtatataagcaagcgctgtaagcaaaagaaatcacttggcttcactttcttttttcctctttttttcttttttttaactgttctttgtctaaactcgcgttttataaagtcctgttttagcgtattcagaagtgccgcaaagaagtctttacgagcccaatttgccgaatcagaagtttggaaatggaa

SEQ ID NO: 96226 - DNA, 483 bp, Heterodera glycines
  SCN-specific regions: Sequence locations=1-308,398-483
caaagccttgcctaggacttgagttataacgtgatgaacatttgaaactctcacaacttttttctgagatgtcaaattgcttagcattcacttagaaaaagattccccttttcaaaatctttttttagataccaaatttgttcagtttaattgggaatgaagcgagttatggcagatcaaaataaaaaatacaaaaaggcattttccagtgtaaattttgaattaacgcgcaaaaatttacgccaaatgcgctatttggcgttatgagcaattttgtctgacactggcgcgtacccatagtgctgtcgctctatctctcgccttctctctcgctctctccactttatcactgtcactcaatctctctttttctctctcactctctcccctttctctcacactgttcactttatcactcactatctctcgatctcttcattttatcactgtctctctatctttatccattctttctcatagaaa

SEQ ID NO: 96227 - DNA, 631 bp, Heterodera glycines
  SCN-specific regions: Sequence locations=1-233,255-631
gtttgagaaattgccgatgaagaggaaggcatttgcactgacacagtgcagcaaaatcctctcgattgtctgcgatgcttttcccctatcaaatgccccgtccgtttgccttgtcagcactatttttgtcgtttgtgcatcgccgatgagaagtgttgtgtgatttgtggtcatccgattggctgttccgagttagtagaggacaaagtgctgaattacgtgttggaaagttcgagtgaggtcactgagacatgtgcaaattgcgaccagatttcgcaaccgatgttcttctgcgacacgtgccatcagcccctttgcagcgggtgtcgcgagacgacccacaaagccaaaatattctcgactcatcacatttttgagttggaggagcgcgggaggttgagaagtcgccccatctgtccacagcacaatgagccgttcattttattctgtctcgactcgaaatcgctgatgtgcatcgaatgcttcaattcgtcttcgttggaacgacgcggacatttcgtcaacatcgaactggcgcacaaaatttgctgaggaacttcgtgagcaaattgagttgaggaaacgattgacggacgaactttcgaagaacagcgagaatttgagagaggaa

SEQ ID NO: 96228 - DNA, 474 bp, Heterodera glycines
  SCN-specific regions: Sequence locations=1-254,276-474
cgcacttttgacgaattccaaatggcctctcaaaagcaattacgtgagaaaaagtgttccgaagtcgaggacaaaacaaacgacggcacagaacgggaaatgacaaattccaccagcaatttttacaaattgaccaaaaccgattcgcaaagctctgtagaacagaatgttgcgaatttggagcgtaatttgtcatcgaatttggtggtcccttcgacgagtggccgatgtgccaatcggagagacgaggaggaaacttccaaccctaaaaatgcccaactttcggagcaaacaaagtgtacaccggaacagcacgaggaaaagacggacgaatgcccgccgaaagagtccaacgttcgactgaccaataaaatctgcaaaaggcgcatgaacaaagttgagaatgttgcccatttgaatggccgtgggggcattggggcgctcggttggcaggcgacgcttccgtcggcccgg

SEQ ID NO: 96229 - DNA, 695 bp, Heterodera glycines
  SCN-specific regions: Sequence locations=1-424,477-695
tgtttgcggtacgggcctggttatccatgccaaactgaacaggtagatggatgccaaaaaaaaaaaacaatttgtgtaaaaaaaaaatattaagctaccaaatggtggaagtagtgctcgaaagtgcgctgattgccagttcgtcttcccaaacgatggctgctacaacttctttttggccaacaatcctccagctccaatggatgggcgtggacagcgtcaacgtcagccaatctgtcaatggcgccgggtgtgtcgtgcgtgtggacgtatcgcctacgtggccacacatcagtgcccacgtgaccaaccagccgacgatggaatctgtcggcgctgcaatgggccccacaccgtcgatgagccttgctacatccagcccattgacgacggctcagttcgacaacgtgcatcgattgctgttgacaacgacgacaactcagatgacaacggtgacgatgacggcgaagacgacgtattgccgcttcgactttgcttcttcgatgcagagacgtcgcaggacagcccgctccagcttaacaaccgattggtgcagaagcacgtcccgctgttgatcattgcagaagtcatctgtgaacgttgtcttcaggttggcatcagcgtcaacgatgggcttggaagaagagctcctggctgcgtctgcatgacaggaatggtgaggggtcaactgtttc

SEQ ID NO: 96230 - DNA, 805 bp, Heterodera glycines
  SCN-specific regions: Sequence locations=1-549,571-805
gtttgaggaaagtgcttaattcgcaaagggataccaactgcttaggagatgccatcgtccagcgggtcggaaaagggtaatggacgcaatggcgttcgtggcgaggaagaagtgaagggaggaaaagaaattgctagcaagacacttaatattcaatcgaagcgtttttatttggacgtcaagcaaaatgatcgtggacgtttcgtcaaattggctgaggttgctatgaatggtcgaaagaatcgtttgttcatgtcaatgcgaatttgcaagaatattaaggaattgttggggaagtttgaggggcacgtgccagcgtcggaggaagtgaatgggaaagcggagaatgtgaccattcaatctgaatctatcgtgaccgagagacgtcgatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttccccattctcagatgattcgtactgatgggaaaagctttttttttgatcctggccacaattctcgcggggactttctgaaaatcaccgagttgaagtcattcatgggagtgcgcaattccgtcgtcctttcaatcagagcaattccgcaattcactcaagtcctctccaagctctacgatgactttcaggagctcagagccgtagaggaagtgaacgtgaacaatgtgctta

SEQ ID NO: 96231 - DNA, 871 bp, Heterodera glycines
  misc_feature (828)..(828): n is a, c, g, or t
  SCN-specific regions: Sequence locations=1-23,45-871
ataaaaatgaaaaatttgaatacttttttcctgtgctaagcaacagacaatgagctatgatccttacctatctggaacaagttccaatgctcgtcgattgttgggcgcacccccatctctgtcacgtgatgttataacgaagtcattcgtaaaaatggactgcagtcatgaagcgtcacttggcacggaatgcagcggcgaagaaagcgaagcagcaaaaacagcggatgaaactgaaggagaattgaagccgtcacaacgcgacgaagaagaggaaaatgggacaacggggaaaaggcagcaaaagagacgaaagcgacgaattcgactcacagatattggaccgaaggcaaagaaaaaggccgaacgaagggaaaaaccaatggcggagaagaagaatgaagtgcaagatgagaccaatccaaccgaaactcattgtcagtcatctaaaatgtcgcctcctttacttgaaatcgaaaatgaactcggacaaaacccaccaaataaagtgaagccttctcctcactttttcacgccatttcaattactttgtgacaatttgatacggaaattcatggccaaagatcccgagaaatattttgcgcagccagtgacagagttggaagcgcctggatatcattcaatcgttgattatccgatgtcattttcaacaatcaatgacaaaatagataataatatgtacttgaatttggatcaattcaaatctgacatttgtctggtttctgacaacgcaatgctttacaataacacaggaagtgtttattttttggcagcgcaaaaattgaaagttttggcaaaatattattntttccgagaagtatcttttgttcctcgtctattcgttgccctt

SEQ ID NO: 96232 - DNA, 644 bp, Heterodera glycines
  SCN-specific regions: Sequence locations=1-191,213-644
tttttgttagcgcttttttgaatgaattctcagcaattggatgatcttaattcttgccttaatcagctattacgaacaattaaggaggacacgagtgaattccctccgtctgaccttcttgatgagattaaacaatgcttggattttctcgccaactcgccaaaaatactcgcaaaacaacgagccgaatacatttccctttcctggcctgctgaccttcgcgtcgtgcttaacagactcttgcgcactttcaatatcccggaggaatatgtcaaattatgcttcgaactgagcaattgtgcggcacaaagtttgggcgccgattggctaaaatcgtcggataagcaattcctgcgtctgttggccagtctctccagttgtcgtcttcgcattttgttggataaacctgaggagattgacatggctcagctcatcgcctgtcatcagctccaggaatatttttgcggctgtgttgaggatgaacagagttggatgagcgacgatgatgccactttcgtttccaaatgctgtcaagaagcagcagccctttgtctgttcttacacagccgcttgtgcccatcaattgtccgacatcacttcgcgaatggatcttttctttgtcctttatcgtttcatttgtgctt

SEQ ID NO: 96233 - DNA, 540 bp, Heterodera glycines
  SCN-specific regions: Sequence locations=1-540
tggagctccccgcggtggcggccgctctacaactagtggatcccccgggctgcaggtttaccttgccgttaatcggacaacccgaacaattgaattgaacgcgttaaaactgcgttttgatccgaataatttgatggcgtacgaattgaaaaggacggacaatttggcaactggggacgaggtggacagaacgccgaaagtgatcggaattcgggtggatgaagcgcgagaaaaggtgttcttcgacttggacggcgatttaaccctgggaaatcattacgccctgcggattccttattcgggcccaatcgcctccaaattgtccggcctttacctgaccacgtacacaacgctttccggagagcacaaatgtgcggcagtcactcaaatggagccgacggatgcacgcagaatggtgccctccttcgatgagcccgaattcaaagcgatctttcggctgagtgtcactcatccgaaagggtcgcgggcggtgagcaacgcgaaggaattgcgggagcagcagcaaacggaagagacgga

SEQ ID NO: 96234 - DNA, 312 bp, Heterodera glycines
  SCN-specific regions: Sequence locations=1-64,89-145,167-312
agcaaaataagcaggttaattgaatttactatgatttaaattaggtgattgcaattacagacaattaaaactatttttatattttaaatccttaatttggtgcccaaacttcctcctcacattcatttataattttgcttacaataattcattaaataaatgtttagataatttatagttctttctgtacttattacatatgcttcttcattctttcacaaattctttctttctttatccactaatttccgtccattctcttttcacatggcgaagcagaagttgaagagaaaggctaaaacaatgtaatat

SEQ ID NO: 96235 - DNA, 661 bp, Heterodera glycines
  SCN-specific regions: Sequence locations=1-196,218-661
caatgaattttgtcaagagaattgatttttattatgatgttacgacaatatcttcttggataatgttcgagcgtttaaatgtcacgcgaagactctgtccttccattgagtataacttccgacctgtgcattattcgagcttattaacttctgctggaagtttggtccctttctccacggcggcattgagaaaaaatttctttgaacagcagagagaattggcccgagtccatggcattacaattgggaccagacatggcgtaattgatgatttactcgcaaaattatcaaacacagtgctgccccaatgttttatgaatatggttgcgtcggaaagggggcacgaaagcctcattgaactttcaagaagcttttggcgcaaattatggatttcaaatgtacacctggaccatgaggagtttctcgagagtctcagacaattgaatattcaaattccacccgatgaaattattttcaataaccgatgggggaaattgatcgaacaatggcattgtgagcttctgaatcgacaggtggatgatttggttgaggacctttacatggaagttgatgaagccgaatatgaagccaaaaaacgcgagcaccgttcctttgttgaaaatgatggtagtcattattacgatgaggaggatgattctga

SEQ ID NO: 96236 - DNA, 477 bp, Heterodera glycines
  SCN-specific regions: Sequence locations=1-380,402-477
cactttcgacatcaccgtgcaaaacaccgccagcaatttccttcgcaacaattacattttcataacggtcggcaaactcaactcggccgtcgaaacgattgaccaacaattcattgaagtccagaaatattccaagcaggacaaattgttggaaatgcttaaaactgatgccatttggaggccacgcccaaacgaagaccctttcttgaagccggccaagaaaacgctaattttcgtggaaacgaagcgaaattcggaccgtcttgcaattgctctgacacaagaaaaattctacaatacgcaaagtttgaacagtgatcggaccctcgaacaacgtcacttggccgtccgcaaattcatccagggccaatacgacattttggtgtccactgacgtggccgctcgtggtatcaacataccgaatgtcgaacacgtgattaactacgatttgcccgagaaagaaatcgacacttacat

SEQ ID NO: 96237 - DNA, 398 bp, Heterodera glycines
  SCN-specific regions: Sequence locations=1-156,189-371,393-398
aaattattattcacctttgtcgcccttcttaacactgtatcgtggctatttatcctaataactcacttcaatctgaacttacgataatgtaattgattctatttgaaagagcatgaaattctacacctgaataactgctcagaattttaaaatctctttaattagaattttaaaaaattattattaaactttgtcgcccttttttggtcaataaagctgaattagttgaaaactgttcctcagcctctcatcatatcaatatactttattacaaggacaatttgaacgtgtacttgaagcaattttataatccccggccccatttataagaccgatttttaaatagatttctgcacctgaataactgatagaattttaatttctctttaataaaaatt

SEQ ID NO: 96238 - DNA, 910 bp, Heterodera glycines
  SCN-specific regions: Sequence locations=1-537,559-910
tcaaatgtgccgactccaagcaactcatctgctcgctcgactctttctgcttcttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaattcacatccggacgaagcggtcaaattcttcacccgaattgctcaagcgtacggctcctaccctcacattttgtacgaggatttcaacgagccgctgagcgtttcgtggaccgatgtgctggtgccataccacaaaaaggtcattgctgccatccgagctattgacaagaaaaatgtgatcattctcggcactccaacatggtcccaagacgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgcc

SEQ ID NO: 96239 - DNA, 480 bp, Heterodera glycines
  SCN-specific regions: Sequence locations=1-26,201-220,476-480
attgatcagaccactccttcatagtttctccttctcttgctctctctcttcctttctccttctctttctctctctcttcctttctccctctctctctttctctccctctctttctctccctctgactttgcctttcactctctctcttttcctttatctactatcagtaagtctctctccctctccctttcttcctctctattacgctttaccattgcattctctctctctctcttactctctctccgacttctctttcgctctctgatttcctttcgcactcactttcttctcactctctgttaatctcccttttctctccatctctcttccttttttccttttactctctctctctctctttgtctctaattttactatttctgttttactttctctctttacctctctcctctctgtcagtctctatctatcactttgacttctcttttctccttctcttgtttttttttctagtat

SEQ ID NO: 96240 - DNA, 641 bp, Heterodera glycines
  SCN-specific regions: Sequence locations=1-169,191-641
aaattacacaattcctaaattgcttatttgaaaatgcattccaaaacagcacttaattgcttgctcatttgggcattggcatttatcgttgttggctttgtccaagtgactgtgcagcagccgccgaacgaacagcagcgggaggaggacaaaggcatcttcgagaaaagcaaggacactctgtcgaacgcggcggaaggcacgaaggattggctggtgggggcgaaggactcggttgccgatacgttttcttctgcgaaggaaacggcgactgacaaagccacggaaactaaggacaaagcgtccgattacgccgaatcagcgcgcgaaaaagcgtcggaagggtacgaaggcgcgaagcagggggcacaagagcgatatgagagcgcaaaggaatacggaaaagagaagacggaacagttgaaggagggcgggagaaaagtggcgggagaggccgaccgaaagactgagatctaaataaaaagaaggcgcaaaaactgttgatggaatggaatgggggagtgatgcccgaagatggtgttaattggatgaaccaatgagaaattggactctatgagccctttctttgctcgtttctctcattcttgccctagtattttttatacggataaaatttcaat

SEQ ID NO: 96241 - DNA, 873 bp, Heterodera glycines
  SCN-specific regions: Sequence locations=1-362,386-402,424-671,704-873
gaattgattcgtgagccaatgttcggaaattactatcagtttgatggcacttttctggaaagtgatgttcttgagccaacttctgtcacggctttggctaatgacagcaaagcgttgttggacgcccgggccaaactttgggatgaaaaattcggaaatgacaaatgcacattgcagaaaatcaaggaaatgggcatcgattcgttagtgaaaaaaatttttgattcgtctgtgagcgaagaagcgatggaagagaatgaaacggagcaaaaggcaaatggaaatgttaagttgcacgtcgaagtaaagcgaagcggcataaaaaacaaaaacggggcggagatttattgctcggacaattttccattggttatcgacagcagtggcctcttgaacagattcttggaggatgagccaatcataagacacgcgccggaccgaaaattcggtgtttggtgcgcgccgcgaaaatattcgatcgacggaattcaatggaaaattgtgcggattgatccggagagcaaaccaaagaaatcggtcccgaacggagttagcaaaatgaatgggttcagcaaagaatgtgtcagcaatggagggcagactgacgaatgcatttcgagttctccatcgaccgttccttcgcttccatcgacgactgttcgaaactccccgaaattggaggaggaggaggagaaagtggatgagaatgaactctttgagggactcatctgctcgcaaaatgaaacccatttcctcgtcttttcccctgggcgtcgttggttgggccgtttggacaaggcaaagtgtggcaaggacagtgcgtctattctcgggatgtggatccaattcaaaatcaagaataaagccggtatg

SEQ ID NO: 96242 - DNA, 475 bp, Heterodera glycines
  SCN-specific regions: Sequence locations=1-423,446-475
atttatccaaaaaattctacaaaaatagctcctgatcaatcattgttgccagaaaaaaaagttaaaaaaatatgggctcaactgatcaaacgaaggcattgttttccacgctcatccaacggccaactctcactgatcagctgttgcagcgaccacccttcaaattcatccacgacattgtgcatgagacattacgtgtgaccggctttttggacggtctgttcacgagtgatgagcttgactcaacaaaagccggctcgtcgcgcgacaataaaatggcctttctacaaaagttaattgacgcgctgaacatggacggtcaccttgacgacgtgaagccagcaaaaattgtggccggcaaggaagcagaaatgaccaatttgttgctgcagtcatttgcctctgaggccacaatgtacgcgaagcaagacaacaacaagcagcagcagggggatgtagcggtgaagaaaagtgc

SEQ ID NO: 96243 - DNA, 678 bp, Heterodera glycines
  SCN-specific regions: Sequence locations=1-498,541-558,596-678
tggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactatttgggaaatgattcgggattgggactccctatttttttcttctggttttactgggagggaaggagccagacaaaccgcaacggtttttttaggagtcgtctttttctggcaaaggtccaaatgctaaaggtcatggcattagcttggggaaaagaactgttgacttccccaattgaagtactactaaatgttttctttaatcgtatggacaggtctttaacgattaaaaatctatatgtcattattattacagagaattgcttggctcttggtcgttgctctatcgggtccctccaagtctctttgatatttctcgtcgaattgttgcagaaaaaatgatggaagaatttttaaaactgccatcacactttcgaattgctttttataataaatattaattgtgtaattttttttttgccttagttatagtcgaaatttatttttaattgtagaattttctaaaatttattttagtctcgaaaaatgcacagaaagacgc

SEQ ID NO: 96244 - DNA, 813 bp, Heterodera glycines
  SCN-specific regions: Sequence locations=1-64,136-141,194-813
aaagctggagctccccgcggtggcggccgcattcgactagtggatcccccgggctgcattactcgagcacgagggagagaactagtctcgagttttttttttttttttttttttgacttcttttctgtttcttttcccttactttctcctttcctttccctctctctttgctcctcctttcttccctttctcccatttgtgcatcaatgaccatcgatgtttggtgctttctttctctttgtctgtgagtccatgcgttttcactataaaaggcaacttcatatattcgtttcatcattcttttcaacatttttcgtattgttttcgtcgtccgtttgttttccctttttctctctttttcattttcccttttcatttccattccaagaattccctccacctttttctccaatttcttaaatgatgtccaacgcaaccaaaaacattctcggcactccaacaatcgtcgacaatgttagtttcgaccccaaagtgagcgccaatttccttcacaaagccatcgaagagaagcgaaaggtgagaaaggaaatagtgcgggaaaagaagagagagagaaagagaaattcaggatgagattatccatttgctgtgcaccatttccaaccaacagcggcaagaattggcacgcgaattcaaacaattgttcggcgaagatttgtccgccaaactgaagaaggcactctctggcgactttgaggaactgattttggctttgttggaaccgccagctgtttacgatgcgcagcaaatgcaccgcgcgatgtccggcctcggcactcgcgaatcggttct

SEQ ID NO: 96245 - DNA, 840 bp, Heterodera glycines
  SCN-specific regions: Sequence locations=1-840
taaaactgtaaaagaatgacggagaatcgccgcgcggcacgtgaaattcagcgacaacagcagaaacagcagtcgttgctgaagaaaattgatttttgctcgtccaatgtgttcgatttgttggaccgtcccacggttggcacttcgttggcaccgatcagtgccgtgtttgatgcgattgtcgatgcccatctctttggcaaaaatcggtacattgatcatactgtcgtggcctttctgcaccgcattcgtcgcctcttccgtcactcggccattgcccttaaaatggtcatttggccgcagtccgtccgcgcatggcacgtcatggcccagcaaatttggcccctggcggcgtccaatgtgtgccagctgagcgtggacagttatgtgttctcccgtctccgtgagttcgtttcgccgtccgtcctccgcgactgtgccaaccttcgccaaattgagtcggacggactgttccctgaaggcccacccgacgaccatccgcacgcgtcggatggccaagcgttggccaaatggctgcacacgccgcgcgcggacggcaggccgaaactgctaaatgtggaggcgatgacgggccaattccacgagcaaattgaacgactcaaagaaaataagcaagaggacggccgaaacaagtccaagacgccgaaaaataacttttattggtaagtttatccctcattttttgtgccattttaggcctttttgttcgcctcgtcgcccgtcagtttcgccatccgtttgtcgatgcatttgcccggtgcgtacgttccattcgccgtggacaatggccaaacgcaggaacggctgacattctgttgc

SEQ ID NO: 96246 - DNA, 480 bp, Heterodera glycines
  SCN-specific regions: Sequence locations=1-480
gaatgacaacggtcggcattttgggcggctcccatcaatggttccccgcggaccaaccggcggaattgatctgtgccgcctctgtttcttcgctggttgaacgcgtcgagtggaagagggccggcggggacgcgttgccttcggatgccagcgacgaggaacaccgcggggtgctccgattcgacccgttcaaacctgctgatcacgcgggtgagtacgagtgcaacgcgtaccgtaacgaggaagtgatcgccaccagcaaagtggaagtgcaccccgagggcgacacgcggcccgaccttttgcacgtggacatttcaccgccgcaagtgcgcatggtgaacgcgggcgactcaattgtgttggactgtgtggtgcacggccgttctgcggatgagttcacttattcctggtcactcgcgcgtggcggagcactgatccgtgagttgggcaggcaaagtcagctgctggtcaagtcgg

SEQ ID NO: 96247 - DNA, 605 bp, Heterodera glycines
  SCN-specific regions: Sequence locations=1-55,77-412,434-565,588-605
gtcaattgttgacgaaattcttttaattttgggaaagccaaatgcacatgaccaattgaagggtgctctttacgtgctgaccaatggcaaagagcagtcgcttctgctaagacaagattgggccgttctgttgcagctttggcccgcattgtgtttggttgacaattccgagaacaaacaaagcatcattcaactcactgatttggcccgtgatctcattgtttccaacttttcatcttttcaaattgaatattatcttcccgactccgttatgcctttggctgaacaactgttgtccgattaccccggcatttgtcataaaccggcgtggccattgcccgacaaacaaaaattgggagaatttcgggaaagggaagcggagatatgcggacgaaatcgcgaaaattttcttgccttggccgagaagctgctgacaatcgcaaaagacgagaatttgcactggcggcaggtcgactttgccgaaacgcttctctcattgctgcttcggaaggactgcgacttgccggagggtgttgtgctgcacttcttcaagctgctcacttctgacattataaacactcgcaaaattgccattggcttctgta

SEQ ID NO: 96248 - DNA, 875 bp, Heterodera glycines
  SCN-specific regions: Sequence locations=1-121,143-875
gagaaacaccccttaaattattctaaaattacaattatttcttggtctaaactccaacaaaaatggaccggtccatcctcgtcccctacacttctcggttgatgtccgaaatttcgcccggtcaaacactgaacattcatggcaatgtgaacgcggatgcgcaccgtttcgaggtcaatttgttgagcaattgcgtcgaaattgatgcccacatgggctccgcgccgctgcacttcatcgtttgatttgacgaaggcaaagtcgtgctcaactcatttgctgccggagaatgggggaaggaagagcgccactcgaaccctttcaccaagggacagcccttcgacctgcgattccgcgtccacgaagatcgaatcgaaatattcgccaatcaaaaacaaatcaccgaattcaaacatcgaatcctttacaccaacgttgaccacattcaggtccgtggcgacgtcacattgagtggcgttcactggggcggtcgctacttcgaacttccattccaagcgaatttccacggcacttctctcaaaagcggccaacgtctttttgtctatggcattccgaagggcaatttcagcatcaatttgatcggtgccaacggggacacacttttccatttgaatccgcgttttagcgagaaaaagattgtccgcggctcccaaaaagacggcgtgtggggcgaggaagagcgcgagggcgccttcccactgaagaaggaacaggcggcggacatcgccgtgttcaacgagccgtactccctgcagattttcatccacggccaccattactgcgcatttgcacaccgggtggaggcgccgaacaccgactacaatttggtgcccgtcgaaggagaccatggactg

SEQ ID NO: 96249 - DNA, 666 bp, Heterodera glycines
  SCN-specific regions: Sequence locations=1-666
gagatatctttcacacttacaaataataaccataataccgaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggctggacaacctcatcaagtcagatggaaatcgctttcctaaaatcacggaaatggcttatatgtcggtgccgcgggtgttgttccttgagggaacggagcaaatgtccgcgcgccatttgtcatcgatgtcgcaagacggcgaagaaagcattgagccggtgcaggtcgttacgaatgtacacgtgcgacagctgaatccgcagcttaatgacaaggagcggttcaagtacgaggaattgcaacggaaagtgccaagcgtgcttctcaaacaatccgatttgacatgcaaatgcactttcgctcaggaatggcccggagtcgtccacctgcttcagactgttccaaaaccagcctgtctggttgcgcacaatggtctcaactttgacttccgaattctgtgccacgagttgcgcaagagcgacctgttccgtacccatccgatcccagaacaggtttatttcctcgacacg

SEQ ID NO: 96250 - DNA, 619 bp, Heterodera glycines
  SCN-specific regions: Sequence locations=1-6,28-102,124-136,160 -372,394-572,595-619
gtttgagttgttgttttttattattacttttcttcattttgataatggcatccgcaaagtgtgccagggaagactgtggcaaaacggtgtaccctttggaggaattgaaatgcctggacaagctacaaaggctacgacaaaaagccatactgccaagcttattaccccaaaacggttccgtcggccgtggccgcaacgccggagatggaacaagcgaagcgaaacacggcctatcagagtcaggtgaaataccacgaggcgtatgagaagcaaatgaaaggcacgaagatggaagtggccgatgacccggaaacgatgcgacacaaagccaacatggtaaaccaatccttggcccattaccacggcgaactgcagaagaaagagaagcaggactcacagagggacaccactgcaggttcagccccgtctgttggttttgcggtgcacagttcgccctctttggattcgcttggctctgccatttccaccgcctcttccgtcgtccgtccgtccaacggcagcagcagcggaaatattggacacgttcagcagaacatccgccggaattcaccccaacagcaccaccaacagcagacgtactcctacgggcaactgttct

SEQ ID NO: 96251 - DNA, 527 bp, Heterodera glycines
  SCN-specific regions: Sequence locations=1-527
tagactagtggatccccgggctgcaggaattcggcacgagggttcaacaatcacgccaaccacttcatgccgaatttttgcattcccccacctccgccaccacaacttcctcaacctttgaattcggctcgagttttctttccgccggttcctcatcaccatcatccggcttattaccttcaacctcaacatgcacatcctcatatgaaccctcagttcttcaatttaagcgttccgcctcctcaaattacgcaaaatatcagcagtttgatcgcagcaaatattaacaactatccaactcgtcatccgctcaatggcacacatcaaataaccacatcggaaaggttcagcaaaacgttccatactgggcatgcgaatggtttcacatcgaaaggcaatggagcgccgctcagcaggtcaagaaagcgatttcttgaacaaattaccaacgaagaagggtggatttaattttaattaaatacatgtttgaaagattcagcacctcgggagaacttcgaattgaattg

SEQ ID NO: 96252 - DNA, 564 bp, Heterodera glycines
  SCN-specific regions: Sequence locations=1-161,184-359,381-564
ttgtttttgttgggtcggaagtgctgctgttcgacagttccatgctcagcgacagctaacggattcgggtcgattcaacggagaaggctttggacttcgatggcacggctttcctcttccgatgtgtataaacatgaccatttcctgcactttgaccatctgcacattgacaacattcactgtgccaggaagttggtcgtccatttgaggcccagcgagcgcacacttttgctgcaagcgctgaccgaattgaacgccgaggcgaagacggatggaaatggtcattcagaccatccgccttcgcctgctcagatgaagcagttgttcttcgtcaacacaatcccgttcgtcggcttcggtgtcctggacaacatgatcatgatcttggccggcgaatacattgatctttaccttggcactttgctgtgcatctccacaatggctgccgccgcgttgggcaacatcatttcggacgtggccggcgggggggtggcccattacgttgaacaattccccaggcatttgggctacaaacaccccgtgctccccccaaagcaattggag

SEQ ID NO: 96253 - DNA, 251 bp, Heterodera glycines
  SCN-specific regions: Sequence locations=1-15,87-251
agaatgtagccagcagacggggacgaggaggaggaggaggacggacggggaaaaaaggggagaaatgagcgaggggaaagggagggaccgactgatcacaattaaggagggcttacaaaaaacaatcataatgcatacatacatagacatataatatttcctttttacaatacaacacattatgttaattgattcctttctagaagcagaagaagcagcggagggagacaagcagcggcaggtggtaaagc

SEQ ID NO: 96254 - DNA, 178 bp, Heterodera glycines
  SCN-specific regions: Sequence locations=22-178
cccaattttggctttttggctaaaaaaaagtcctaaattaaaatgaaattgttaaaatcggaaaacgaatatttgaaattaaagaaatttcttataaattttagattattgtgaatgcgagtgccgatgaattttacaaacagccaatgttttatttcttggcacatttcaggttgac

SEQ ID NO: 96255 - DNA, 548 bp, Heterodera glycines
  SCN-specific regions: Sequence locations=1-548
gtgaaacggttaatctttactcattcattccaaacgaagaatgggaagtgatgtccttcaaaattcaccgagtggtggagaaattcgtctgctgtgatgagccgtgggtccttttgcacgcttctttggtcgttcgacgaaagcccctctattacattgtgaatctcgttctgcccacttcggtgatcactttggtggcggtcaccggctttttcacgcccgcctccaccagcaatgaacgccgcgaaaagctcagtttgggcatcgattcgttattggcaatgtccattctgatgatgatggtcagcgaacaaatgccaaccacttccgaatatgtgccattgttcggtctcttctacctgtccatcattgtcattattttttctggcactttgatcaccgccctcgtcctcaatgttcaccttcagaagacctataatcgtccgattccgcctttgatcaccttcatctttttccataaaatcgccccttggcttggcatccgtccttcaacaattcttttggaactttggcaagaaactggagtg

SEQ ID NO: 96256 - DNA, 599 bp, Heterodera glycines
  SCN-specific regions: Sequence locations=1-148,170-285,311-319,350 -393,415-556,580-599
ctttttaaacttgacagacttgaaacccgtagaaaagttattgatcttaccactgcttttaaaataatcaactgtcatactcatttagaccctcaaaaactttacactttctcaaaaagattaagatttaattgtattagattaatatctaaacacaaaaccaacaaaaccgaaaactcatttattaatagaacaataaaacaatggaacaatcttgattctaaaattacggcatcatcttccatatgtagttttaaaaacaaagtcataaaatgggttaaagcccctaaatacaataaaaatatttacattgcatgagaaaaatatttttatttatatatttatttatcactatgtcgttgttgtgatctgactttattttcatgtgtgatctccatatattctccatttttgtattcaccgatcttcagagtaagtggctaatgcccttctgtagatattttattgactgaataaatacatctgaaaagtgcggatgaaattgaaatgtggtactgtacaagtacactacagtactcgcaatattgtgtaatgggaaataaaaattgtaaattatcaataatgccttacttgtccct

SEQ ID NO: 96257 - DNA, 481 bp, Heterodera glycines
  SCN-specific regions: Sequence locations=1-481
gtgactcggtgccgaacgccggagggtattggtcaacgcctgcagcaaaagaagtgcggaaactcgtgccataattatgccggatttcaattttcctcccccactaattttggcacaaaaattactaaacgccgctccgagtgagtgctgcgcattgtggtgctggtcgatgctggacgggtgccgaaagtccgccaaatgtgccaaggacggagtcatgggcctgagttggtgcagcggtgagccgtccgacggacgcggcgacgaggagacactgttccgcgcgaaggaagggcgcgagcggcgccggaagtcgtccagcgttttctgagaacggaccgatcgaatgaaaatgagggcaatcattgtgagctgatcaaaagaagcgattgtcctacgtaaactgttcatgatcagaatacggaagcattctcgaatatatcaattggtctttgaattattatcaaaatgttgaacatta

SEQ ID NO: 96258 - DNA, 690 bp, Heterodera glycines
  SCN-specific regions: Sequence locations=1-131,153-632,654-690
atgggtgtccaccgtcgctttgtcgtgggtggaggtgaacaagcagtacttgcacttgtagatgggcttcttcagatgcttctccagcaaatgcagcagacgacgcttcttactgatagtctgagatgggcaaaagtttaatttggaaaatgagtctcgggcgggggctttgaactcaaaagaatggatggaaacggaaatgccattttctcattccttggaaacgccccaatttttccccatcaaatggcaatttgtccccccccccctcactgtctctcacctgagcacatcctcggcactttgcccttctgctttcgtccgcaattgtaatgttggacaaccgttttggtctgcccgggaagcattggttgtgcaactccgagaattcggctctgtgcttctccacgttggcgatgggttccatgcccttaaatttcgtctgtccctttgtcttttttaccctttcgtctgtccgttcgcttgcctcgcattccttcagcgtgtgattgttgcgcatgtgtcgttgcacaagccgtgcctcggccgcgccgtactcgcacaatggacactggtgcagcgggatgttcaggtggtactccgcaatgtgccgcgatgtttgccgtacgtccaaaccgcagaggcggcaccggttgaagtcctccgtgacactggcgggcaggcgccgat

SEQ ID NO: 96259 - DNA, 484 bp, Heterodera glycines
  SCN-specific regions: Sequence locations=1-76,98-484
caagtttgagatttcgatggatgccccggccgatgcccccggggtgcatttgtttggcactgtcgtccccaaagaagtgttcctcgcccaactcttttaccttctctacttcgcctcctttggctctctgtttccgcttttggccgtttactttaaacaactcggactgtccgctgcccaggccggcattttgttgggctcgcgtccattggtcgaattcgtcgccagccctttttgggggagtttcgccgaccgtttccgcaagggcaaactgttgctgctgtgctccctctgttcaatggtcgttttcactttggccgttggcttcgtccaaccgctcactccttattgcgttgtgctcgaccaaaactctaccggcggcgaatgcaaatttttggtgccggccagcgaaattgtcagaggaggcgcactcggatacatcaaaaaagttgccggcattggacggcgccggaggggcaaaacc

SEQ ID NO: 96260 - DNA, 550 bp, Heterodera glycines
  SCN-specific regions: Sequence locations=1-179,202-550
ggagctccccgcggtggcggccgctttcgaactagtggatcccccgggctgctttacctcagcacgaggatttgaaatcactccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgacgacgacggcaaaaccaaagggaggatggacggcacacgacgaaaaccattccgatgactcatcaattcgcggcaaagcgcgcgagaagcgacagcaaacgaaccaacagcaacagcagccgaacttggagtctttgcccgtatgtgctaccggacagtcgcccattgcgccaattccgcccgccggccccgtccttccgatcggcgccattccgcccaccgtcgtttgtctgaagtgccgcccgcccaacggcccattgtccg

SEQ ID NO: 96261 - DNA, 475 bp, Heterodera glycines
  SCN-specific regions: Sequence locations=1-61,84-475
gtttctctagctccattccctagcatgaaaatggcaattcggagctttcttggccccgcttgctgttcaccaactggcgccgctgtattgctgctgatttctggcttggctaataccgtatcattggcctccattgccacgggcaacggggcacgccttggcatttttcgtccgacacgcagcatttcatatgacggacaacaggaggagacggaatatgaagtggagcccggctttgaaaagcgttcaatgacgcttggccgtctgtcatttcggcctggaaaacgttggtcctttcccgtctccggtgcttatgcacacgatcggcaaaacagacgctatgatttgttgctgctcagtgaaaaacagccgtcatatggtttggcaccgtctgaagtggaatacaatgtgccaattcaagccaagcccagtgtcgtccgtcacatcaattttcgtcttctgcccgagactggaa

SEQ ID NO: 96262 - DNA, 611 bp, Heterodera glycines
  SCN-specific regions: Sequence locations=1-342,373-462,502-611
cacggattagggaaaatgcccatccgaagggattttaattagggcggcaacttcataagggagtcgaataggtttggttcaaaggactcccttcctatcgggttgggcttttgcggtaaaaccaggtttggggttggggcggctacttcaaagactgtactccttcataggcacgggatgggcgagcgatacccgcaaccttttgacagtctgtgcaattttatatagggtatatatttcactgataattaggtatttcatttcacatcagcactaatttaatgaattcatcatgtcattttgctaacttcttccgccaaaatttgaagggcaggcaaaatcttaaaaatttataattttaattgttaattagttcgtccttaattacttgtttggccaatttgtttatgcccttttccgggtacacaaactactcccggtcgcggcatctgaagaaaaaacaaaataatatattcaattattaattaaattaattaattacgcacataaaatttcatcaccgtgtgctcatagtcgtcagggtttacagatggaatctcataaatatcaagttggtcgagaattgaatgtaatattgtcggttgcgagct

SEQ ID NO: 96263 - DNA, 412 bp, Heterodera glycines
  SCN-specific regions: Sequence locations=1-412
aacaattggcccacgccttggaaatttcttttctgccgccgtatccgcccaacggcattctcgaccaataccgtatccggtggactgtgcacggcaagttcaactaccgagagcagcgagtgcccgcctttgagttggagtgttccgactcgcgaatgcgtggccgcctctgctaccgaatcagcggattggagccggagcaggagtatgagattcaggcggcggcacacaccgaacgcggcgattggtcggattggtcggagccacttgtgaccaagacgacggagcaagacattccggtgctggaacacccgctggagttggaatttgccaagtcaacgagcattggcgtcagatggcgcgggttggaggaaaacctggccgagcacatcaccgggtacgcgttggagta

SEQ ID NO: 96264 - DNA, 227 bp, Heterodera glycines
  SCN-specific regions: Sequence locations=1-12,193-195,220-227
agacaagtattaaaaagaaaagctaacaaagagctatgaaaaaagaaattttaaagctaagaaaagaaaaaaaaaagaaaagcatatgataaaaaaaaaacgaaaagcccagcaatgaaacgaaaagccatgaaaaagaaatttttaagctaagaaaagaaaagcgggcgaaaaagaaacgcaaacgaaaagccattaaaaagaaaataaattttaaagctaagaag

SEQ ID NO: 96265 - DNA, 469 bp, Heterodera glycines
  SCN-specific regions: Sequence locations=1-154,177-469
acttttaaatccgaagtcgaacttttcgtaaaattatgtcttttttgcctatatgaattcgccaaccaatttcaataattttcattcaactactaaatgtgttccgcttgaaaatggctctgatagagagaagggttcgaccagtaacaacaatcacaagagaaggaaggataatgttaaaagtgagttgatagacaacgccatcggaagtccgaaatcgaacaaacgggcatttttttctgctgattgtgcactgaacccaacggcattggctgaaatgatgccgagttcgagattaagcatgggaatggccggccgtttgcgtgacatcgtggcgattttccctcaaaatgatttggcttctcctggaaaactgctctttcgggaacaaatgacaaattcggaccaaagggtattttctgccaagggacaagcggatgttccggggatgaacgccaaggaaataagc

SEQ ID NO: 96266 - DNA, 550 bp, Heterodera glycines
  SCN-specific regions: Sequence locations=1-235,367-550
aaagctggagctcaccgcggtggcggccgctttcgaactagtggatcccccgggctgcatgacttcagcacgagggaggaattcaaacctggaagatgggaataatgatttaatacataaatcagcggatcattaaactgaaatgcttcttgacaacgcattaaaagcttcggctgtcaacagcggcggcgaaatgccaaaacggatgagttactcgtcggtggtgatggcacgttcttcctcttcatcctccgcttcttcttccatctcttcttcttcctccaccgctcctcctcctccccttccgaaatcctcttctgcttcttcttctttctcctcatatttgtcctgttcatcttcatcatcattagcagcgaatcgggaattcgtgccgaaaaacaaaggggaaccgaaaaaaatgccgaaacgacaccagcagcggtggaagcgttggcgaaccgtaacgtccgagtccgcgttcttctaccggtcgtccagctcctcactgctgtcgctggactcggccacttccaccaccaccagcagcagc

SEQ ID NO: 96267 - DNA, 480 bp, Heterodera glycines
  SCN-specific regions: Sequence locations=1-158,296-454,479-480
ggaattcaaacctggaagatgggaataatgatttaatacataaatcaccggatcattaaactgaaatgcttctcgacaacgcattaaaagcttcggctgtcaacagcggcggcgaaatgccaaaacggatgagttactcgtcggtggtgatggcacgttcttcctcttcatcctccgcttcttcttccatctcttcttcttcctccaccgctcctcctcctcctcctccccttccgaaatcctcttctgcttcttcttctttctcctcatattcgtcctgttcatcttcatcatcattagcagcgaatcgggaattcgtgccgaaaaacaaaggggaaccgaaaaaaatgccgaaacgacaccagcagcggtggaagcgttggcgaaccgtaacgtccgagtccgtgttcttctaccggtcgtccagctcctcactgctgtcgctggactcggccacttccaccaccagcagcagcaatt

SEQ ID NO: 96268 - DNA, 265 bp, Heterodera glycines
  SCN-specific regions: Sequence locations=1-43,66-265
gatattgttgccgactgttcagacaatgttgccactcgatatttgatcaatgatgcttgtgtgttgagtggaaaaccgttggtatatggaagtgcgcttggttgggagggccaatttactgtctacaacaatggaacggtttgaagcgaggaagcaccaaaatgttgagggcggggtggaaggcggatttaaaatatagtttctggcactttttttaaaaagattttctttaaaatttttctaaatcaaagaaaaatatataact

SEQ ID NO: 96269 - DNA, 182 bp, Heterodera glycines
  SCN-specific regions: Sequence locations=1-182
aaattacaaaaatttccccggcggcgcctcttggcgccaccggatgcccctctccaacccccaattttttgaaaaaaacgcgccgcaaaaaaaggcagttttaaaaggcaaaaaagtcgtcgcttggttgcaaaaattggcctttttgatgaaaatctgttaacaaatcagaacgaaattac

SEQ ID NO: 96270 - DNA, 475 bp, Heterodera glycines
  SCN-specific regions: Sequence locations=1-475
gtttgagagatttatttcccgcgaatatgcaaatgcgtgtcgaatggaatgaacagcaacggcgtcgactctaccgaattgcgctcaacttttttaacaaaacgccggaccttggcgttcagctgctgatcagttggggctttgtacggaacagtccccgggagttggcactgttgttcatggaacggcgcgggatcagcaaacaaatgatcggcgagtacctcggcacattgcgctcacaattccataccgccgtgctaaattgtttcatcgaacaaatttcaatgtacgacatggaaattgacattgcacttcggcaattgctcaaacacattcgacttccattggaagcgcaaaaaattgaccacattattcaggcctttgcacaacattacgttgcgtgcaaccggaacagactgtgcgcattggacacgccggactcgatgtacattttggcatttgctgtcatcatgct

SEQ ID NO: 96271 - DNA, 667 bp, Heterodera glycines
  SCN-specific regions: Sequence locations=1-16,38-667
gctttcaaattttccgtcccaccaccacctccacttccgcttccgctgctgtctgtctatctgtgccggttgaccaccgtacccttccgcgatgagcaattcactgtaccgtagtccaagcactgccggaggtgctctctacaaatcgccctcaatgagtgccttcgccggcggcgctccgttcggcgccatgtccgtggctgacctgggcagtctgacccgtctggaggacaaaattcgcctgctgcaagaggacttggagtcggagcgcgagctgcgcaaccggattgagcgtgaacgtgccgacctcagcgtgcagctgatcgcgctcactgaccgtcttgatgatgccgagggcacaaccgaccaacaaatcgaagccaaccgcaagcgtgaagcggagctgcaaaagttgcgcaaactgttggaagagtcccagttggaggccgaagacgcgctgaacgtgctgcgcaagaagcacaacgatgcttgccttgactacaacgagcaaattgagggattgcaaaagaaaaatgcgaagattgatcgcgagcgtcagcgcctgcagcacgaagtgatcgaactgaccgccaccattgatcaggtgcagaaggaaaagcatgcagcggaaaaggctgcagaacgcttcgagggccaggccattgac

SEQ ID NO: 96272 - DNA, 462 bp, Heterodera glycines
  SCN-specific regions: Sequence locations=1-462
gaagaggaagagagaatgagcagttcgcgcgccaacaaatttgccgttgcatttctcgatgatgagcaaactgacgagacgacagaagcaaatagtgaaacggaaaatgaggaaaatttgacgaatgaaagtaaacaaacgaaggcgaaaaatgagggaaaaaacaaaaatcgaaaaggcacgaaaaaacagaaacgaacaaaggcggagaaagcgaaggaatttgggacatcagaacaaatgccaatggcgacgaaaaagacaatgccaccaaacgaaacagcacagaaatctaatttggtggatgatccgttggaaaggcttttgaaggtcgacttgcgcagtttgaacccggacgatgaattgcgacgacttttgggccgaacatttggcgctgagcagcgccgacggggcggacaacaacagcagcagagacgaattggggcggcacaattgggcgga

SEQ ID NO: 96273 - DNA, 550 bp, Heterodera glycines
  SCN-specific regions: Sequence locations=1-447,480-550
aagctggagctccccgcggtggcggccgcatcccaactagtggatcccccgggctgcatgacttcggcacgaggcaatcctcctgtttcccagcgtcgctggtatgagcaaaaaaaaaaagctaaatggattcaccaaaatgtatcgttccgtacttctcgagggttggaattccgtgctgaacgaatgttttctgccgttattcaatcagaaaatgaatatggccgagtcggccgacagcaaacagttcagacagttgcgcggccttttgttcggtcgattttcggagagtggccgttgcgatgtcattgttgctcaagcaaagagcgagaaccacttactctgacgacaataggtaaatgtgcgacatgaggcggagattatgcgtcaaattgagcgattggaggaggaaatcatccatctgagggccattcttcagacttagcgatattggaatatttttaaatattcattatatggatccactctttaaaatggtctctaaatggaaatgacaatccaaatatatttccgcttttgccaatttcct

SEQ ID NO: 96274 - DNA, 289 bp, Heterodera glycines
  SCN-specific regions: Sequence locations=1-289
cccgttttagaatattatcgccaaatttttgtgattaaaaattaagtgcaattttggggaaatgctgtgccaaataggcaccgtggggaaaaatgcgaaattcttaatgcatatctttattctatttgagtccggcgatattagtcgcctgaccattcggccgatcaaaatctccgcgcatgcaatcacagtcaaatggtatgcgatcagtcgtggctgcatggaaaacattccaattcacaaatacttacttttctacacacttgccacggacgattacaattggaag

SEQ ID NO: 96275 - DNA, 564 bp, Heterodera glycines
  SCN-specific regions: Sequence locations=1-388,410-564
tggagctccccgcggtggcggccgctctccaatagtggatcccccgggctgcaggtactcggcacgaggaggttttggtgtctgtgacccttcgccaactttgtacgatgtcacggtcacattatgacaagattatgttcccgccaatttctgcccatggaatgcttacattggacaggagtaagttcaccaagtctatccaaattcccttcgtctccgtccctgtcaaatgcatcgacagagtccgtttgctctccgccgttcgtgcggtttgtcttgagagaatgccccgcctaaaaccatggcatacaccgccaaattgcgacggatcagtcgaaaggcttttgctgtttgaccccgacaaattcggagaagaagcgacgaacgacttggctcagcaactttcccaaacgatggattcgtcgccagaattcggcaaaatggcatatacgatggaatacgaagattgggacttgagacggtgcattcagtcggttctgccggatggcttcgaattcagcggattcgaacagtgcggacacatcatccacttgaacctcagag

SEQ ID NO: 96276 - DNA, 253 bp, Heterodera glycines
  SCN-specific regions: Sequence locations=1-28,69-253
catcttcattcctcctcccaccgtttttgcccttcttcccatccccatcatcatcatcaataaatgatgatgattgattgggttgtcacctcaacaacaaacagcaggtcggagttggaaaatgtgtgtcggtgatttgtttcggggttatgatatgttgtacagttgtcagtcggggggtctaatttttggtggagtttattaattgcacgactaattggcacacttggacggaatgtggtgattcaaattt

SEQ ID NO: 96277 - DNA, 437 bp, Heterodera glycines
  SCN-specific regions: Sequence locations=1-80,102-179,356-437
agcaaaaagtgccaccaacagcagcgactgttcgcctcgcggcaaaaatgccaatttgaacagcaaagggacggcccctcccccgccacgccctctctttcgttgccctcagctttgtttgttactcatcctccgtttgtgccctccacgccgcccccttcggcaccgttcccttccggcttttcctcttccccggcaccgttcccatccggcttttcttcctcttcgccgtccacttcggcaccgttcccttccggcttttcctcctccccggcaccgttcccctccggcttttcttcctcttcgccctcctcatcggcactttttccctccagcttttcttccttttcgtccttgccaatgcctctgacttttcttgaccagcttcgactttattaccaacagctacagtccgttttagcttccgcatctcttca

SEQ ID NO: 96278 - DNA, 485 bp, Heterodera glycines
  SCN-specific regions: Sequence locations=1-485
tacaatcctccatgacatggagaatgattatgccacgccaaaagaaccgccctatggagcagaatatgcaaaaagtaatcgtgcttcttgtaaaggatgcaagcagttgatttcgcaaggcgagttgcgtatggcggttcgtttcccttcaagatttttcgatggaatgcaggaaaattggcatcactttgagtgtttctggaaaaaagctcgtaaaaatgatatcaatgaagcctcaattcgtggaatggaatggcttaaatgggaggaccaagagaaaattcgggcgcgaattacggagctcaaagagtccgatgattctgcttacacacccaaagccgccgtaatgacaattgagcacgcgaaatcagggtcatcgaagtgttacaaatgcaaaaacagcattgcaaaaggggaccttcgtgtttcaagcaaagcgtccttctaccacctcgaatgttttcattcacttggaatttttcaaa

SEQ ID NO: 96279 - DNA, 1169 bp, Heterodera glycines
  SCN-specific regions: Sequence locations=1-115,137-415,437-448,471 -1169
caatgtttgagctgatgcttcactgtctgtcaagtgcagtcgtcgatcgtcagcaaatggccgtccgatgtttgtccgaacttgtcaagaaaatgggcgagcgaattctggaaattgttttgcctttgctggaagaccggctgagacaaggcggcgtcaacgaccggcgtggtgttgcactcgcactgaacgaaatcatcggaaatgtccaccgggaaatcgtggagaaccacgcctcctccttcatcggctccattcgcatttgtctgtccgactccgacagttccgtccgcgacgcggcggggcaagcgtttgccgcttaccactctgctaccagctatctcgcggtcgagcaaattgtggccccaatgctggacacttacaacaaaactggcgagccgtttatactggacggactttgctctgtgatggctggacctaatgggcgtcagctgttccaaagtctgttgccaaagttggcacggtcgcctgtcaattcggcggcactttgtcggttggctctgagcaccgacgctatgaagagaaatttgaacaaagtcatggaggcaatgcttaacggggacatcaacacttcagttgatgagcatatccaaaattgcattccggtgcttctcactttggacgacgaggacgacatgcgggcgatgttttccttgctgttgaagttcgcatcgaagaaggaaagtgcggaggtggcgtcgctgttgctcaggacgtacattgacgagtgtgacggaatggaatattccgagtctcaactggacacgcttttctgtggtttggtcggcctttacaactcggacaaccccaacgttctgcaaaatgccatcgaatcgcttgtcgctttggtcaagcaaatcgacccatcttcttacatccaattgtccttgctgctgaagagggcaatcaaaggattggcgagtgacacgcgcgaattgtcgtcggacggttgttcccgcgggttatgcgtttccaccgggtggcagccgtttttggccattctgagagaggctcttctgatgggtggggtcgaaatcaaagaagtcgctgctaattgcctctcgcaactcatccctctgagcagtgaggcgggacttagaccccacgttgtgaacatggccggtccattattcagaattttgggggac

SEQ ID NO: 96280 - DNA, 394 bp, Heterodera glycines
  SCN-specific regions: Sequence locations=1-232,259-394
ttctctctctctctcccattggaattattcattgagatgggtttttcaaaaactatcgctttcctttcgcttttggcacttttttgcgcaacaattgctgaagaaaatggggcgacagaaggcacagaagcggaggcgacgacagtgccaacactcaccgcagcggcggagggaggcaaagggggcgaagaggaagtgaccacggcgaagccgacggagacgagcgaaacggcacgggaggagggggaggagaagcacaaggcgaacgaggggaaagcgattgagggaagtggaaccagatcgttgttgcaaaaagtcacctgtatgttgttcggctttttcccatttcgcgccggctgtccgggcaaaaacgatataaaagcggagtcatcat

SEQ ID NO: 96281 - DNA, 514 bp, Heterodera glycines
  SCN-specific regions: Sequence locations=1-70,92-143,166-259,281 -465,488-514
atttactattaacaataatctcaaaaaatcaaaaatagtgggcctttttaaatggagttttttaaaatccaaaaattaaaggaaaattaaatgactttataacgtaaaaatattcaaatagaaagttataaatgctaaaatctttataagaaataatttataaatggatatatataaaagtgatcagaattgggttggatttccccaatttcagtcaaaatcccgataattgataaattaaaagcatcatttaatcttgatgaaaatgaatttatttctccgatttaatggccgctccgatgaattccgccaaaaacagctgaccatttgtgttgtttacattgttcacgtattcggtgttgctgctttcttcgttcaaatggtcccatttttcgttcacttcgtcacattttttgccgagtttaaagcgtcgcgaaactttcgcctcccatttcgcattcctttagaaagcaaattcaaattttgcccaaacattttgccaagaaaattgaat

SEQ ID NO: 96282 - DNA, 432 bp, Heterodera glycines
  SCN-specific regions: Sequence locations=1-26,48-230,257-296,327-432
cttgtttctggcatgtttgggtttcgtttttgggaataaaaaattgtgaaaaattggtggaactccctaaaaatttgaatccatcaaattttgtattttaaaaatttggtacaaaacttatattacatcccaagtgttattgcgaatgaattttctcaaggaatattaaatttcttttctattacgcctttaattatgtatatgccttttcttttatgactaacacagacataaaattttatttatttttttatttgtgtcttttgccgtgcgaaaatttagtttttccaattaataaattaacattttttaatgaaagcatttattgaattgaaaataataaccctttttaatttatgtgaaaaaaagtctaagaaatttttaagcgttgtggagacttttttttctctgttcaccgcggtaaattttgtg

SEQ ID NO: 96283 - DNA, 475 bp, Heterodera glycines
  misc_feature (461)..(461): n is a, c, g, or t
  SCN-specific regions: Sequence locations=1-14,67-475
gcgcatggtaaaagaaattaaattttaataaatcttaattaaaaattaaatgtttaatttttaaaacaggaattccacccatcatctacttggcgttcaacaaaactgttcgtcgtgatgtttacattatgcttgtccgtccgcttgccatggtgttaccgtgcattaccgtaccgcccgagctttccgcaacacaaaactttggctcaaattcacgcgtagccggggccggcacacgaattgtgtctatttctttaaccgtccaataactacaatgtggtggagccagaatttcgaagacaaaaaaattcacaaataattaatgcatttattaattggataattaatttgttgtaattgtctaatgtccagccgccgctataccaccacaaacatcattattacttttgtttatctatgtattataataacaaatgaatgttgacagcatatttgagtanaacaaggtcggaat

SEQ ID NO: 96284 - DNA, 802 bp, Heterodera glycines
  SCN-specific regions: Sequence locations=1-355,379-490,512-544,577-802
caaaaagtgcggaagaaatcgcacgaaaaattggaaaaaaccgtcgaccctccggcgacgtcgtcgtcctttcgcttcattggggcggcaattggggctacgaaatatcgaagacggagagagactttgctcatcagctgatcgacagtgggacggtggacattttgtgcggtcactcatcacatcacccgaaagcgattgaggtgtataaagggaaattgattctttacggatgcggtgactttctcaatgactacgagggcatttcgggccataatgaattccatgacgagctcaccttgatgtacttcccagttgtcgatggcaaaaatggcataattattcggttagatgctgtgccaatgaaaataaacaaaatgcgcctgaaccgtgcaaatgccgaggattctttatggctttatcggacgatggcacgcgaatgtgccaaattcggtgtccgcgtacaacgcgatgagaagacaaatgttttatcatttctttggtgaaacgaaaggcaatcagtttcatttggatatgaatattctaattttatttaattaatttatttattttttacgactatttattaaacgatggaattattctatttattcaaaggcattatcatttcacccttttgtcatttttctccattataaatttacagcttttgccttttctaatgcccagaaatgtaacggtccaacaaattttggtaggcgaagtgaaaacggcgaacgatgctcaatttgtgagtgcgaattgttcagtcacctttggtggaagagaaaacgagcaacga

SEQ ID NO: 96285 - DNA, 482 bp, Heterodera glycines
  SCN-specific regions: Sequence locations=1-20,42-482
gaatcattggccgacgatgggacaaagtcagggaatccctcagtctccgccggaggggccctcccaggaaaacaatggccgaactgcgcagccgaatggagccacggacgagggcattttccgtgtcaaagtgtccaattgcccaaacacttcgccacgcaatttgcgccagactttccaaatgcaacacaaccggcgccagtcgagaagcaaaagtttggaaccaaatgcggcactggacattcgaacaattggacacagaaaatcatcgcggttcgggacaaaaacggagttaaaaaagcggggtcaaaatcaaaacttatggaatccggaaaaagcggcaacacaaataattggacagcaattacagaatccacatactcagcctccaaccattcaattgcaaactgtttcaattcatctgaaacaattccgtaaccaaaatggcaaaaccgatctgctggaagacaacaaaaaagatg

SEQ ID NO: 96286 - DNA, 920 bp, Heterodera glycines
  SCN-specific regions: Sequence locations=1-325,347-739,761-920
ggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacagaatattcggctaaaaacgggtttgatcatttttagcgcatttttaggtatacatttgagacaattgggcaggacaagaaaagaatgaagttgatgcctcatgaaactcggaattggttatgttttgtcgaaaatattcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacagtatacatttgagacaattgggcatgacaagaaaagaatgaagttgatgcctcatgaaactcggaattggttatgtttagtcgaaaatatccttacataatactc

SEQ ID NO: 96287 - DNA, 551 bp, Heterodera glycines
  misc_feature (51)..(51): n is a, c, g, or t
  SCN-specific regions: Sequence locations=1-189,211-551
aagctggagctccccgcggtggcggccgcccccgaactagtggatcccccngggctgcatttccttcggcacgaggcacaatatacctatatgttaattatgtcatttcggtcagcagcggcattagggcttaacttgcgtaaagcatccaaatttgtgttgttcggcgcattggccaccggtggcagtgtgttgctgtactcgttggagaatagcggtgcgcgtgcctacgactttgttgtgcacccgagccattttttttgggttcgtcgcggttaccaagtgtacaagcaagtgtgtgccgcatgccattccttgaaattcatccgttacaaccattttgtcgacaatttcatgacacgggatgaggcgaagacggaggctgccgagaaaaatgctttcacaagaagaaatttttcgaaatacacgaactgttgcccaaggattggatgcattgagggaagaaaatgaggccatcaagaacaaattgttggtagggatggacgtgttgacacctgatgaacgtcaactcatcgatgagaaggcgtcaa

SEQ ID NO: 96288 - DNA, 486 bp, Heterodera glycines
  SCN-specific regions: Sequence locations=1-11,33-486
acggtggcagtgtgttgctgtactcgttggagaatagcggtgcgcgcgcctacgactttgttgtgcacccgagccatttgccatggtcccacggcggactgatggacgcaattgacatgcgatcggttcgtcgcggttaccaagtgtacaagcaagtgtgtgccgcatgccattccttgaaattcatccgttacaaccattttgtcgacaatttcatgacacgggatgaggcgaagacggaggctgtcgagaaaaatgctttcacaagaagaaatttttcgaaatacacgaactgttgcccaaggattggatgcattgagggaagaaaatgaggccatcaagaacaaattgttggtcgggatggacgtgttgacacctgatgaacgtcaactcatcgatgagaaggcgtcaattgtggaaaaaaatcttgaaaacatccaactcggactggaagaatcgcaggtgatgttggcattggcatcgcat

SEQ ID NO: 96289 - DNA, 150 bp, Heterodera glycines
  SCN-specific regions: Sequence locations=1-150
gaatggcaatggcacggccaaattaaatttggcggtgccaaacgttggccgagtggcggcgagtgctttattgccgctttgggagttatttattttggacatgcgcttttgttggcattcacttcggttggcacttggcgatatatcaaa

SEQ ID NO: 96290 - DNA, 1289 bp, Heterodera glycines
  SCN-specific regions: Sequence locations=1-85,112-191,213-584,608 -620,644-1039,1062-1289
agagaatggccattgaagcggaagaatttggtgagcagcatgagacggacgaagttgagcagcaggaaaatggaagtggaaattcggaagaggaggaggaagaggaggaggcaccgcaaatccgacggcagcagggccaaattcggatgatgaccagcagtggcgaggaaacagtgcaagcgaccgaagcggccgtgccgccccccgccgcccaacaggcgcctccgcagtcgccagccgcgaccgctgctgccccacaatctccggcgccaacacaaactgcagcaccggcatctccgggctcggccgccgctattccgcagtctccagcagcggccggagccgctgctgcagcacaacaggcggcgctggaggaagccaaacgacgccagcaagaggccatggaaaaagcgcgggcagaggcattgcgcctgcaggaagaggcgcgggccagggcggaagcggcacgccaacagcaccaacaggccgctgaacaagcccgtctccaggcggaacaacagctaaaagcgcagcaagaggcggccaaacgacaagcggaagaacgagcgcagcaactcaaagcgcaacaacagcaacaacaacaacagtctgtacaagttcaacagcaaaaacaacaacaaccgccaattagcccttccgccacggcacaacaacaaaaagcggcgccggctcccgccgctcaaccgccggccaaagcaccgcagcagccccaagcgccaaaagcagcggttgccccggcacagcaacaacaacagcccaaagcggctgcccctccaccgccaaaggccgccgcggccccgcaacagcccaaagcgactgccgtcgctgcgccgccgaagcccaccgcccctcccgcggtggcacctcaaaagcgcgcgccttcgcccgttgtgcgcgaagtgcaactgcccgaagcgccgacccaacccatcttacgacacgcagaatacacgccgaaattggtggacgcatctgtcaacaaactgccgccagggcaagagccggatgaggaacaattggaggcgagcgcagtgccccgaaatccgatcattgaggacaatgcgtggcaagtgcagcggcgtgtgcagcccgaatatcagccggtccaacccgccaaattaaatgcgactggcgactttttggtggagagtgaggcaaagaaatcgattgtgcccgaggcggtgggctattcgaagacaaaatggaacgaattcccagaagaggaagagaaagagcgccaatcggtgccgaaagtcaagcgcaggaat

SEQ ID NO: 96291 - DNA, 766 bp, Heterodera glycines
  SCN-specific regions: Sequence locations=1-42,64-81,103-109,139 -252,275-410,440-766
ggcaaatgcaacaaaaccaacagcatcagcagggcaataccatggaggatggaaatgacaatacggtagtggtggtgatgggacagcagggcgggactacggtagactgggacagcagggaggagcagcaacagcacttggacatggagacggcacgcacatcgcgcaccgaggacattatccattatccctcaatggacacgctaattgaccaaattctgttggcggacagcagcgaggagatgagacggaacgacgacgacgacgacgacgagttcaagcagtacaccaaccgcacatcggcagcagcagcagacggaagtgccgacgagtggacaaccgcgcggaatgggaacagcgacagatgcgaattggaagcggtcgtctcttgccatccgtccccgtgttcgtcgtcctccgcctcctcctccacttccggctgttccccaacgcgtaacattccgccgaccgctaccgtcttctccgccaccgtgcctctgccgcccgctgtgctgcccgttcggtgccgccaccgcgccctccacctttccgccagccgtgttcttcactggggccgccagtgatttgttcatgtcgtcgcaggactatgcacacgaatgcggcacagctgctgcggcgggtggcggcagcgattccgcggtcgccgctcgtcgtcagactgcgctggcggtgcccgcctggccgcgtccgctgggcgcactgcccgcgctcacccaatcgctgtttgatgcgtttgtggtcactt

SEQ ID NO: 96292 - DNA, 613 bp, Heterodera glycines
  SCN-specific regions: Sequence locations=1-31,53-117,142-240,266 -487,509-613
attgtccgccttttaaccatttaaaacaaagttttcccactttctaaaaacatactttccaattttctttcctattttttacagattgttgaccgtgttcgtgtccatcgccattcgttgtgtgctggtggtgctgctggtccttcttctttctgttgcccatcatcattttcatcgttatccatttccactccgccgcttgctcctaatcatcatcatcaacaaccgaaacaacattttcatcagcagcaacagcagcagttgtccttcatctcggccccgtgtgcgttgcattcttcgcatggcccttcaacgacaacggcaaatgccattccggcccagttgtttatgctctcaaaaaatggtcgcgaatgttccaaactccgtgagatggtctcttctctcggcgaacaattgaatgtgccgtcgacaacaaaaatttcttaaatttacctatgcttcaaattcgttaactgtctgttgatgatctgctgtttctctctcttatggaattttaaaaatttcttttttgtcttcttttttttctttattcactttgatcaaagtgctgctatgtcttttttattcgtcagttggtcaaatatttgtttca

SEQ ID NO: 96293 - DNA, 1149 bp, Heterodera glycines
  SCN-specific regions: Sequence locations=1-550,572-679,701-704,733 -781,803-1149
cacagttgtacctcttcaatcacagttgtacctcttttaatcacagttgtaccttttctgatcactgttgcacctcttctaatcacttttgtacctcttcatcaaatttgtacctcttcaatctctgttgtacctcttctaatcacttttgtacctcttcatcaaatttgtacctcttcaatctctgttgtacctcttctaatcacttttgtacctcttctgatcactgttgtacctcttctaatcactgttgtacctcttctgatcacttttgtacctcttctaatcacttttgtacctcttctaatcacttttgtacctcttctaatcacttttgtacctcttctaatcactgttttacctttcttaatcaagttgcacctcttctaatcacagttgtacctcttctgatcactgttgtacctcttctgatcactgttgtacctcttctaatcacttttgtacctcttctaatcacttttgtacctcttctaatcacttttgtacctcttctaatcacagttgtacctcttctaatcacagttgtacctcttcatcaaaattgcagaatttctggaaaaattcgaattttcagaaaaaaattcataactcggttctgaaaagatagtctggaaaaataaaatactacaaaaatccgcagttttttgctctattatataaattttatttggcatttttatcacttttttaagaatttttataaaaataaaagtgattttgagattcgggaccaaaggggggtgcacatggtttttgagtgaaaaaattttttcgacaaaaatcttccaaaaacatgtcattaggggttatttgggccgctgatcacgaatacgtgatcagattttacttttgacatcgataagacatcagaatccctgtgtgattggggattctgaggcatcattttgagggggggggggggggcaggttcgaatccggacggtgtaacattatttttttgtgcattttaacgggcgcgaagcgcccgtcttgaggccgcgaagcgtcccaatgtcctcaacaaaattaaaaaacgggcgcgaagcgcccgtcctgaggccgcgaagcggctgaatattctctacaaaattaaaaaacgggcgcgaagcggccgaatgttctcaaaaa

SEQ ID NO: 96294 - DNA, 475 bp, Heterodera glycines
  SCN-specific regions: Sequence locations=1-204,226-475
gtccaattaagcacactggctttcatacattaagcatgctcgtaattagatagacgttcatatacaatagttgagttggttaccttcacgcacatgctgcaatcaattgttccacctcgtttccatggagtggttctgtgtcgggtgtggcttgactttgtcggggacgctgagcaaccgaaggaaagggaccaacttccacccataaccatatgtaaaacaaaactagccactgaaggacggcgaatctcaaacgaagggggcgcaatactcacaatcaacttgtggccaacaaccgatgggatgttgaaggggaccggaataccctcgctcacttctctcataactcggaagagcatcgaatttcatttcaattttccatttcttacctaatatggttgtccattgcgagagtcgtctgcttgacttatgctggccagtctgcactcattttggaaataggtttaaggcgttt

SEQ ID NO: 96295 - DNA, 716 bp, Heterodera glycines
  SCN-specific regions: Sequence locations=1-144,166-487,509-716
aaagctggagctccccgcggtggcggccgcttatcaatagtggatcccccgggctgcagtctctcggcacgagggaacaacgccagcgggacgagctgagagagcagttcctgaacagcgaaaagcgcaaccagattctccagagcgagaaggaggagttgatgcaccaggccgaacaggcggagagggcacgccgtgcggcggaggccgatttgatcgaactgcgcgaagcagtcaacgacctgtcgaaccaagtgaacagtctgaacggatacaagcgcaaattggagggcgaacttcaagcattgcacgcggaattggacgaaacactgacggaactgaagaacgcggacgaactgagcaaaaaggcatcggcggacgcggcacgacttgcggaggaacttcgccaagaacaggaacactcgcaacacgtggacagactacggaaggggctggaactccaaatcaaggagatgcaagtccgcttggacgaggcggaggcggcggcactcaaaggcggcaaaaaaatcatcgccaagttagaggaacggatccgagccttggagcaggaattggatggcgagcagcgccgtcaccaagaaacagacaaaaactaccgcaaggctgagcggcgtgtcaaagagcttgatttccaggtggaagaagacaaaaagaacacggaacgtctgacggatctgatcgacaaattgcagggc

SEQ ID NO: 96296 - DNA, 583 bp, Heterodera glycines
  SCN-specific regions: Sequence locations=1-239,261-453,475-583
aattagtgatgtacatccgagagttagaatctccagatgagcactccctggttttattcaatccgcttcgttcttgctttcgtcctactagagatgaattgttttcggcaattgcctgtcagcgacgctctatcgttcgtctgaacactgaaagggcccgatttgtgcgtcagaacggggctttgctacggatgatcgtgcgattgacaggtggcatcccgccaaattttaatcatgctcattttgctgctgctgcacagccggtggtcaatgtgactgcggttattgccaatgccaatcccaatggacagaattataaccgccttcagcgtttgcatgcggaattatcggagaccattgaccgttttacggaggaaaattcccttttgggatatatgaacgatcaattgacggaacaacttgaacctctgacagaagtgcctccgaatgcgaattttaatctggatgatgttgtgtttcatccgcccctcgaccaacagcacgaagtgcctccgaacccgaattttaatccggctttgcttgagtttgatgatgttgggcttcagccggccctcgaccagca

SEQ ID NO: 96297 - DNA, 472 bp, Heterodera glycines
  SCN-specific regions: Sequence locations=1-362,384-472
acctgaacaacgtggactatgctggactccgctcggacaacagcgaagttcggcgcaaacagttggacaacatcgcagtggccgcgttggaatttcagccgaagggcaacacactcgagaccacggaagtaaaaactgaagttccctttctgattcgaggcgacctccgcgagtatcagctcgtcggactcgattggctagtcactctgtacgagaaaaatctgaacggaattttggcggacgaaatgggccttgggaagacaattcaaaccattgctctgctcgcccatttggcttgtgaccgtgccgtctggggtcctcatctgatcatcgtgccaacctctgtcattttgaattgggaaatggagctgaaaaagtggtgccccgcattgaaagtgctgacatatttcggtacagcaaaggaaagagccgagaaacgaaagggctggtccaaaagcaatgctttccacgt

SEQ ID NO: 96298 - DNA, 636 bp, Heterodera glycines
  SCN-specific regions: Sequence locations=1-288,310-505,527-636
caagtttgagatttattcgtttcgtttttgacctgtatttccatcacaatcaactgaaaaacggcaatggatgattcggttggttttcttagcataataaatcttgcatttgggtggtcttccaccccttacgacagtaaaattagtctgttccgttcgtttacagttatcctctcgacggctcccttccgacttctccttctaaaaatttcatccaatcttctgtataattttttctatttccgtatgcttaacagctgtaaattcccaaaaatcatcctccaagtttgtgggaggggaattcaaaaattgatatggatgttgaaactgaaacacagggtagaacattttggccgacgaccaaatgggaaggaaactcccagccgaacttttgttcgaaattgttctttgtgttcgaagagaacatgcccacgcgagcatttgcctctcgtcccttgttttatgcaaattaatgctacctcgtgcttcattatggcggaaaatttgggtttcagtatgattttggatgtttccgctttttttttttaattttcgttgttgctgtttggacttgtctttttatttttgcactaacaccattttctgagctcgtgagctttcttcaattctattatt

SEQ ID NO: 96299 - DNA, 801 bp, Heterodera glycines
  SCN-specific regions: Sequence locations=1-104,133-801
gtcctagagagttaattggttcattaataaacaacaaaaatcgactaatttggcagttttcttccttttcttcaattttatttaataaaagccgcaaaaaacaactcaattttcttcatttaaattttttaaggagtacttctgcttcatcttcgtgcgtcgagtcttttcccgaatggcggcatcaaaatatgtccaacgaatttagtccgtcaaattggccaattcttccgacgactgttcagcccgactcggagcagtttaaacagaacgaagccgaaatggcagaatcgataagcgaattcaaaaatgtggtcgatgcggtgatcgatggccaaatggtggaaaaaacagtgatcgaacggcacaaaaacaaaggcaaattgttggccatagaacgcattgaacagctcatcgaccagggcggttcctttctcgaactcagccaattgacggcttacaaagtgtacggccaagagaaagtgccggcgggcgggcgttgtcgccggcattggcccaatctgtggccgattgtgtgtcattgtggcaaacgacgcgaccgtaaaaggtggcacttattatccgattacggtgaagaagcatttgcgggcccaggaaattgcccttgaaaattgtttgccctgcgtttacctcgtcgactcgggcggtgccaatctgtcgcgccaagcggagattttcgcggacaaagacaatttcggccgaatctttttcaaccaggcacaaatgtccgccaaaggcattccgcagattgccgttgtgatgggttcgtgtacggctggc

SEQ ID NO: 96300 - DNA, 420 bp, Heterodera glycines
  SCN-specific regions: Sequence locations=1-278,300-420
gttgttgtgcttcgttggacggagtgttcgcttttgctatggcggacaaaaagttcctttatttgggcagagatccaatcggcgttcgccccctcttttatggcttcgctggtcaagctttgctaattggttccgaggttaaaagtattgagaaactctgcagaagggtcaactttttccccccgggcttttgcgcacaaattccgctgggctcaacattctcaacagataatcagcaaatcgcatttcaacaattctttcaaatcccttcaattgtcaattattccatcagtgcttttgatgcaaaagcaattatccgcaaattgttggttgaggcggtcgaaaagaggctaatggacaatcgccaatttggctttatgctctccggggggttggactcgtcgctaatcgccgcgttgg

SEQ ID NO: 96301 - DNA, 499 bp, Heterodera glycines
  SCN-specific regions: Sequence locations=1-499
gaacgtttatttttgaaaatgggccgacggaggaaaacggcgcctgcccttttgcgcaacaaacggacgcgaattgacgaggacgaaatggacgaagaagaagaaggggcatggaatgggcatggccaccaaaatatgggacttcgaccgagaaagcagatccaacggacaatcagtgcccagtgggccccgcgtctgcgcgaaaggcaccaaaatggacagaacacaacggaggaccaattggcggacatggaattggaggacgtggacatggatgaggacgaaatcgtcaaaacattgaatatggtgttcaccaacctcgacctctcccaattgcccgctttgtctcccggcgccggactttatgcaatggccaattatgcaattgaagagaaatccatcccgaaaagaaaggcggcggagaagaaggttcccgaggatgtgttggagcccactttcctctccctggagcaagccatgcaaagagatcagaatttca

SEQ ID NO: 96302 - DNA, 477 bp, Heterodera glycines
  SCN-specific regions: Sequence locations=1-68,127-212,243-339,391-477
gcgtattaaaaaaaatttgctccttccaaaagtgttttcttaatcgtttttaaagcatgtttctgatgaattttaagaaaaataatttttaaaaaatggcatttttaatttcataaaaaaaattatgaatccgtgtacaattggcagcatttttcacatgttcttcaaaatgttaacaattcgtcaaaatatagccaattttttcaccgcaaatcattttttaaatttaattttccatttaaacaaaaattattatcatgaattgaccacaaaacacagtccacttgtccatatagatcggaatttttggatgataaatgagctaacaaaaaagggttgataattttctaataaattttgacatttttttatatataattaattaaatttgttcgttaattattttaaagcaattcagatttatcatattttgcaattgctctatgcgcattaactgtgttttgccctttctctggt

SEQ ID NO: 96303 - DNA, 1778 bp, Heterodera glycines
  SCN-specific regions: Sequence locations=1-63,85-114,136-1196,1232 -1778
aaaggttacgttcttatgcccagagaatggccatttttataattaatgacatccgaatccaccaattttttaggccatttgaattggtgttgtcaacgtggcagcaaccaacggctgtggctgtggtccctggtgacaaccacgatggcaatggtctgctccatgccgcgtcgcttggcatttggggtgtccacgaccggcagctgaactggcgcaactttgcacgatgtgctgaaattcgggagccgaaaacatgccatctaccggcgttggcgctggcacgagtccaagaacaatttcgcatcgggcttggtgctgtcggaggaggaatggcgccgggaatggactaaagtgtacgagtcgttggagtgtgtgcatgtgtttgcgctcgcgcacattttgcaccggcccatcattgtgtgttggtggacaccattctgcgcaatgcgaaggccgaagaatgggcaccgattccgtttggcggcaacgcccgcccaaacagtgccatcgctcggagagttcagcactgagcactggtgtgcaggccagcgtccactttggagcacattcgatggtcggtgcgcaaaagtcgtgcacttctgtcgccaaactgttgtggctgctcaaaattgcctccgcttgcccttccgaaaagctgatgaatgccgtggatgagctgctgttccgctacgtggacaccattcagccggcgaattgctttttttggttgaacgaactgatcactgatgtgcaacagcggaggggcaacgcgatggccgagattctaaagcgagtcggtctcctgcagccgcaagaagtgttctgcgcattgtgcatcgaacttgggccaagccatgttggccgttacattgaacaatacataaacaaactacaactactagtacttgcttcttcgggtgcaaatgcttctgctgctgccgtttctcaccatccttgcatggcaattgcaacacaacaatcatcatcatccgctggagccctaattagcggtgaaaaccgacttttcgatgtgttggatgcctttctggagcgccatttaacgcaaatttgcgtgctgagccaaatgttggacgaacttgacaatttcagcattcgtccagccgagatcacattggacaaattccgtcactttctctccatctgccattttgatcagttcaccaaaatagccgatttgacgaacacagcatctgatcctcagctgctgaagagtctcggtgaatggctgtaatctcccgaaattgtgatggccgctaatgctaacactgacgaacggaatttgatgcgtggcgtccgtcctgcgcaaatgggtcgtccaaatcagtgcccatttgcgacaaacgttgggaaaaggcccaaaacggctagtcgattcgagtgcttttctggaccaattcaagaacaaattggcctcaatcaacatattcgatggacattttaacattgattttgccttattttaacactcaaattgcgcaattgtgccactctttgacgaggttgtgcgtgccgactcggtgtttcgtctgttccatgtccgttcattaacactgcacggagttttgtccaacacgtgctgttcaccggctccaactgtcgtcttttccgctgttgcccatcggcctttcatcgcgtcaacaaaatgccaattcggattattcggcgcacaattttgctctgttcaccgccattctgagcgacatgatcaatgccagccaggtgtagtgcggacgccgttggcactgactgtgatgaga

SEQ ID NO: 96304 - DNA, 477 bp, Heterodera glycines
  SCN-specific regions: Sequence locations=1-8,31-102,124-455
gccactttttgggcaagcttttcatcgtccacgtggcttatcagttcgccttctgcttcttccactttggccattctttcgtcgcccatccgaagggattgtctgaactcttcgaacttcgtccttagttgttcgcactgctccaagtcgttgccacattcttcgatgttcgtcgtttgcttctgttgctccatccattcctccaattccgctccgtccgccaaaaacgaacgcactgccaataccgacccggcaccccgtgccgcttccttggccatgccctccaatgcttttgcttggttctccacccgttccattcgctcggctacgctttcatgcccccttttggccagctgttcgccccgctgtctcagttcgccgaatgcctttctccacggcactatctcattttgcaaagtgtttgcgcatgccaacattttcttggccccctccgacgtcccaaggctctctctgcac

SEQ ID NO: 96305 - DNA, 317 bp, Heterodera glycines
  SCN-specific regions: Sequence locations=1-317
ggaaaggattaattgattgaatcgaattgaacatttttgatgcgcagtgaagggtgaatgaattcatcaatcacttcgttcgccattaatcagactgccaccgatttcgacctttcccttccccttttaccacatcgtcaattttcgtcctttgcctttaaacgtcggtagcaactttgactcacaacaatcagccgttgaattagcatttcctggattttgaatttgttttggagagtattcgtcgaacagaacgcggcggtattcatgttcattaaacaaacaacaaacatctgatcgctccttcgccaaattgc

SEQ ID NO: 96306 - DNA, 730 bp, Heterodera glycines
  SCN-specific regions: Sequence locations=1-37,59-730
cgaaatcgttatcggagatcccccgggctgctttactcagaacgaggtgacgacggacgaggaggggagggaagtcactctcgaagtacaaccgacagcgacgaggactcagctgtcggagcatcagaccaacgtcaaaaaggcagaaatgcgacttggacagctaaacaaaacgttgtcgaaaaagcggagtgaactgcagcaaacttcgcggcattccctttctcaaaacgacaccaaaagggagttggaagttggcatcgaacagcttgaacaaaagttacgcgccctttactttgatccgcagttggaccaccagcttgagcaggagcgtgttcaattggccagagaaagagggcaatgtgcgcaagaattggaccggtttgaggccagaaatttcaaactgcgctttgactatacaatgccttacaacggattcgaccggaacaaagtgaagggcgtcgttgctaaactgtttaaaatgaacgaacaaagatatgccacggcattggaagtcgttgcgggtggtcggttgtttcacgttgtgatcgacaaagtgaagaccggcgaggatttgcttaaggcggggctgccccgtcgggtgacaatgcttccgctggacaaaatcagtgcaaatgttctcgaccagcggctaattgggcaggcaaaacgaatggtgggcgaggagaacgtgttcttccccggagagctgatcgaatacgaacgggaa

SEQ ID NO: 96307 - DNA, 676 bp, Heterodera glycines
  SCN-specific regions: Sequence locations=1-439,461-676
aattcgattttatctttgggttcatatttctcggctatctaaatggcaatgctgaatgcgtccttcgataaattcaatatttctaattcggataaaatccgaacccagcggctcatatcaatgagtgaaagttgcgaagagtggaaaacatgcaccaagcgagaaacatatgcacttctcgaccaggagctgaacaaactgttgaccacgtcaccccccgagaaaatggagtattggaaatatttaactcgatggatttatggatctttttgctcgtttcttgcgcgccaaaaccaccgtcgaatggtccaaaattgagccgttgcccgaaggggcaataacgccgtattcgaagcttgaacaaacaccgcgggaccgtgtccgtgaactactcaatgggttggttgtggtgaagctgaacggcggactcggcacttcaatgggctgcaaagggcccaagtcgatcatttccgttcgcaatgagctgaccttcttggacttgaccctgcagcagattcagagtttgaatcgtgaattcgaagtcaacgtgcccttgggtactgatgaattcatttcaacaccgaccgactacactaagaagctgcctcaagacagaccccacatgtttaaggtagagggggcacttctttttgcccaagtcgagataccccctgta

SEQ ID NO: 96308 - DNA, 1220 bp, Heterodera glycines
  SCN-specific regions: Sequence locations=1-727,750-1059,1081-1220
gtccgtccttcgactttacccaaccgatgaagtcgaatacggcgaacagacaaaaacggagcctttgagtgccacaatgttcgaagctctgagccgacactttctcggcattgattttcgcgagagaaatgccggacatcgaattgacgaacacatgcgcgacgaagggttcaatgtgaaggcgtacatcgacggacattccggactgatctttgggggcaatcgatggaattgcggcacgtggatggacaaaatgggcagctcagaacgcgcgggcaatcgcggagagccggcgactccgcgggacggcgcggccgtggaactgcagggactcgccctttgtgtcgcccggggactcgaccgcctctgtcgcgacggggcattcccttataacggaatgaaaggagaatcgtcgtcctttttgtcgtggtctgattgggctgcaaaaatccaacattcattcgaacaacactttttcgtcgaccacaattgccagtcggagttcgttcatcgccgtcccatcgtcaaagattctttcggcgcttccctcgccttcgctgactttcaacttcgtcccaatttttgcattgctttgaatgcctctccggacattctcccccctgaaaaagcatgggccgctttggaaattgcaggcgaagttttggcgaaaaatgctccgtacggaatttgtactttggacccaaaagattgggcttacaacggcaattacgacaacgacgatgatgggacgaacagaatcagtgccaagggatggaattaccaccagggaccggaatggctttgggttgccgcgtgttacatgagtgccaagttgaaagtggcctcgctgctgttgcacaagagtggtgactcatccgcttggctgtccgccgtgggcgaaattcgacagcgattattcgccctcgagcaatgcttgaaccgaagcgactgggcctcgcttcccgagctgactattcgcgcgggggcattctgcgcccattcgtgccctgcccaggcgtggtcggtcgggtgtgtgatggaaacgctggacactttggaagcaatggaaaaagaaggaatgaatttggaaggacgaaaaagcgatcgaagggcaaatgacaaacagaagaagcactgatctgacagatcacttcactttcaacacttacttaggcattgttagcactgtgaacttattgcgagccgttaatcttcggcta

SEQ ID NO: 96309 - DNA, 257 bp, Heterodera glycines
  SCN-specific regions: Sequence locations=1-257
taaaaaattatcccgggggtggagtcgagttgctcatagaatcatagaaaattcatttttctaaattgccgaaaaaataattgaaaactgatcaaatcgctgttgtaatttttaggtttgcggtgcctacgaattttcctttgttgtacacaccgacagattctgtcaggcgagccggccagggatgtcctgttacgcgttcagcagctctacgccaaaatgagcagcgcacaacggaaaaaacgaattcttcttag

SEQ ID NO: 96310 - DNA, 773 bp, Heterodera glycines
  SCN-specific regions: Sequence locations=1-156,231-313,338-660,682 -748,770-773
cctcttcttcgtccgcttccgcttcgtcctcttcgtccggcttgaactcatcggcatctccttcttcggacctgttccccaccgtccgctggggtcgtgccaacgcactcaccgctctgtctgccagtctgccgatttgtgcccccgcggctgtgccctcttcctcctcatctctctgctcggtctcctctccctcgtcctcctcttcctcgtactgcaactcctccttcaatttcttgcgcatattcaccgccgcctttcgcaggggccgccccgtctccgtccgctcgacttccctctccactaatgtctcctcgtcttcgtcgtcttcctcttctaaagaactcgcttttggcccccattttctgtggtgcgtttggcttttgggtgcctttgacttttttctgctcgaaggcccagcttcgcagtcagtgtcactcagttgcaactcattttcatcatcgctactgctcgacatttgtctaattttcatttttggccggttattaggcgggaaaagtaacctcttccgtttttttgctcgttcgattcgctttccgacaatccctttcttttttgctgaaggcgtgtaatcgctgtccgagtcgtcgttgataaattcgtcgtcacttcttcggcgtccctggaagccaattccccttaaaaatgttttggtacttttttgtggctctttgccaaatcacctcgcagatcgcctttccgagggcagatactcgtcctccgatggttctgggtcctcttcattttcatct

SEQ ID NO: 96311 - DNA, 232 bp, Heterodera glycines
  SCN-specific regions: Sequence locations=1-232
taacccattttgaaaaaacatttgtattccattaggtgcggatgtgccaaatctccagtaattttgacggattcccgccctcccctttaacgtacgaccgaaaaattgaaaagtttacactcttgcgctgaaacggcgtgcgcccgccacttcgctggcacgggatttgaagtggtcaagcaaaaggtcggcatctttgcgcagcatttggcccgactcactgaagttctgg

SEQ ID NO: 96312 - DNA, 536 bp, Heterodera glycines
  misc_feature (306)..(306): n is a, c, g, or t
  SCN-specific regions: Sequence locations=60-222,246-536
attttaattttattttttaatttaattttcaatcaattcaaatatttttattaaaaattcccgaccatcgtcggccacgagggtgccggcgttgacgagtcggtgggccccggcgtgcaaagtgtccgtgcctgtgaccacgtcattccgctgccgttgtgccaatgccgcgagtgcgacgtttgcgcagacccaacgtcgaatctttgccgaaaatttctttatttgtgagggaattgatatggcgtgtcttttattattggaaatggttgacaaaaacgaccaaaaaatcacagactttttttntggggggtggcaccacccgtttttcgtgccgtggacagcccatttaccatttcgtcggttgcagcacgttcagtgagtacacagtgacgccggaaattgcggttgccaagattgatccgtcgttgcccctggacagaatggcactgctcggctgcggtgtcaccaccggttacggtagtccgatcaaagggtgtcccatccgcgccggcagtacggtgggcgtgtgggga

SEQ ID NO: 96313 - DNA, 491 bp, Heterodera glycines
  SCN-specific regions: Sequence locations=1-103,125-164,187-368,390-491
cttcggagtttggcaaatatcgtcctttgccatccgacagaaaatgttcccgcaaaggctgcgccagcgacccgcccccggccactcattgtcagcccggacattcttctgaaaatgggactgtccaaccgacgaaaacgagcagtttgatcagctcaaagaatggatgcgctgaggcggaggaggagcaatgcctttttgtggaacattttggcccaattccccaatacagcgaaacggacgaaaaagagaatttgcggctgcggaaattgcacgaagtcgcattagaaatttatcagaaacaacgcgcttatgttatgaaattgcaactgattgggctcaattatccgaggcatttgaatgactgtgaaaaaagaatgaacaaaaaattgctccattccaaacacgtcatcagacgaatcgcggatcactttcagactattttaaatgttcatcttacgtttttgcataatttttatgacaaaattctt

SEQ ID NO: 96314 - DNA, 392 bp, Heterodera glycines
  SCN-specific regions: Sequence locations=1-392
cgaaatggtgagaccggctgcagcgagcacaaaggcccccaccaatcccgcgaatacatgtgaatggtttgtggaagtagtcgagacttccttggaaagctcgtgaaatttcgtcgtcattccgctaaactttccatcaaagtcgctacggaccctcttttcaagggtgagcaagtcctaaacggagtttgttcgattgagttaaacatttaaaacaactttccaatcgacgacaccaacagtcgaatagtggcgaaaagagtcgcttcttaaataatatttgggtgaattgcaaacactttcgtcatttggaccaaccgagagagattggcctgcagagttgcgcccgattgacccgtcacccacagaaggcgaacacccacttcaaaggg

SEQ ID NO: 96315 - DNA, 540 bp, Heterodera glycines
  misc_feature (96)..(96): n is a, c, g, or t
  misc_feature (537)..(537): n is a, c, g, or t
  SCN-specific regions: Sequence locations=1-379,401-540
agctggagctccccgcggtggcggccgctttacaactagtggatcccccgggctgcattctctacatcgccttgtatacattcccatgtatgtaancagctaaaatatatcatgaagtgccagataaatccgcatgatgagtctacggcctgagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctaagcctagaaaaaaatggtgtaagtaaaaatcgtaattttgctcaaaaagcttctcaaacaattttagcgcatccaattccttctacaatcgcctttatgcatcccattatgaacgctaaaattatcagagtgccgaaaatcgcatgtgatctacgcctaagaaaaaaaaaactcgagggggggcccggtacccaattcgccctatagtgagtcgtattacaattcactggccgtcgnttt

SEQ ID NO: 96316 - DNA, 652 bp, Heterodera glycines
  SCN-specific regions: Sequence locations=1-195,222-391,421-563,585 -587,611-652
gtccaatgtatcccaagcaatcattcaattccggactgctcgacagcttcgtcttccgttccgttttcactctccacaaataggggctgctcaatgagtgaaaataattttcggtcatttgccgtacaatgtgccaaaaattcgtcgcaatgccgtccttcgtccaccatcacttaacgcttctgtgcctcttcctcggcgccctttgcgccttcggtgccgtcccttcgctgtgccaacttttgggcgcccctggcggatgttccccaatcgccgttctcagcgcggcgcaacagccaaacggcggcggcgccgcggcacagtttcagcagccctttgggccggcttttggctgcccgctgaatccgctgggtgcttttgggcgcccatttcccccaccgccgccgcccccaccgccgggcatcggaggccaatttccatcgatgcaaggccagaccgtgaatcttagcccaaatttcatgggcggaggccaacagcagcagcaaaatggggggaatgccttcggcacaatgggcggcggcggcaattgcaattgtggcacgtgttgtcagcagcagcaggagacgaacggcaacagcaacaacaacaattttattggcatgccaacagccaacgaatttaccggcttcaa

SEQ ID NO: 96317 - DNA, 480 bp, Heterodera glycines
  SCN-specific regions: Sequence locations=1-176,198-437,462-480
ctttggcagcacattccagggtggtcgcggacccatttttgcatactttgaccatccgacacgaggatggaaacacttacgaagttaatttgttggaagaacaagcagctgatcctgaagccgcggcctacatttcgtttgtcagggatggggaatttccagctgatttggatgagaaagaaaaataattatttgctgtaggcactgccaattacaaattaatttcgggaattctttattttgaggacaagggttccccccccaagaatttatgtaccaatttcattacgtgggctcattttcgaatcgtttcactcctctctattgggagacggtcatttaaattacagaaaaacaattgccaaatgtaaaaaatatttttgtggaaccaagaaagtatgaccttagaaaaaggacgagaacttggaaagatttagtaaattattgaaacttatttgattactttcaatttttattttt

SEQ ID NO: 96318 - DNA, 626 bp, Heterodera glycines
  SCN-specific regions: Sequence locations=1-120,142-626
cggggcggcgctctaaactagtggatcccccgggctgcaggaattcggcacgagggttctttcaagggacaattggctatggtcatcgatcaatcgctgctttgattggttaattaattcaaaaaataaattgttttctgtctgtttgatgaatttcttcggtcgaaagggcaaaaagggccccgtcgttgggaaggagggcaaagagaagggggagagaccgtcacatcgtcggctgcgcgttttgggcgtccctttggcccaggcgctgcgcaacgacccaagccacgacggagtgccggtgcccgcggtggtgcgcgagtgcctcgacttcatttcgctctatggccttcaggtggagggcgttttccgcgtgtcgtccccaaagtcgcggctcgacgaattggaacggatggcgaacgaaggcaggacagacgaaattgtgttccaagatgcgcacgaagcagcgggccttttgaaacgctttttacgccaattgccggagaatgttttaaccactcaactcaaaggacgattcgaaaacgaagcgaatgtttgccgatgcgtcgccctctgtcgctgttctgcggtcattaaactcagagaattgcttctccaattgcccc

SEQ ID NO: 96319 - DNA, 481 bp, Heterodera glycines
  SCN-specific regions: Sequence locations=1-481
ctaaaacagaaaacatctgcgaatacaattttcataacattttgtcaggtcactgatggattttgaaaatgttggcacttccgtcgctgctccatttttggcaccattgagcggaatcgttgtcacatttaccggattgagcaaagaaaaacggcaagagttaattggtttgctgcacgaaatgggagcgcaaagtatggcggcgatgaattgcaaagtcactcatttgatcgctgagagatgcgaccccgaatctgagaaatacaaggcaacttttccagaaacaaacggcgccgttttgagttgccttgcaaccacagctatttagttcgctttaaggaagctcggcgcaggaaattgccggtgttgttgccttcatgggtttttgctgccaattccatggaccgccgtttaaaggacactttaaatgtcatcacttcagagaaacaccttgacactcataaaactccactttttgctg

SEQ ID NO: 96320 - DNA, 605 bp, Heterodera glycines
  SCN-specific regions: Sequence locations=1-184,206-393,415-544,568-605
ctcttcaacttcggcatgatcagtccctgttcttcttcctccattcactggccattgaattggcgtcccttcgctttgtttgtcgtcctttttggctttttcactgcaaatagtcaaatgtttgtgtccgcttctgatgacaaacgaaacagcttcggcagagatttccttcccttcggcaaaagaattgccaactccgaagaaaactttcaacgcgattttatggcatttggaaaacgttcgccaaatgaggccttccaacgcgaatttatggccttcggaaagcgaggggcaccgtctgatcacttccaaagggattttatggcattcgggaaaagagtcccggacggatttcagagggaattcatgacatttggaaaaaggagcagtgacattggcaggggaggatcattcgacagggaattcatggcatttgggagaagaaagtgaagccgaaagggagagacggcgcgagagaaaaggacggcacgcactgatctaaggatgggattgatctgatcgacagaaaacagcaaaataaacagattcaaatcaaaatattttctgagacgaaaagcggataaaagtgaggatgttgataaaag

SEQ ID NO: 96321 - DNA, 481 bp, Heterodera glycines
  SCN-specific regions: Sequence locations=1-31,53-481
gaatgctgtaccgtccgtcgtcgtgttgccgcactgatcgttcaaattggatgatcgcctccgtgtcggcgtcttgtgttgggtcgtcgcgaattccgatcgcttcaaccgaccaaaactgttcgattgctttgaccgatggcatttgatcccgctcgtcctccccacatggggggatcgcgaataccgacgaatcgggagtaactcccgtcgtggtctgaaactgctccccgcaaatcacagtgccgaagacggtgtcgatcagataagtcccctccgccgtcttccgaaatccttgtacgaagtcccaaaatcgccgtattccgatcagcagctgcggttgcactgtgtcggtcgccgagcagtgttgcccgggagtacctcccgggattacgaattcggtcctgattggagtgcaaatcgttggcacctcagaaagctcaatactttcccattctccgtccagccgtttgagcttcac

SEQ ID NO: 96322 - DNA, 216 bp, Heterodera glycines
  SCN-specific regions: Sequence locations=1-216
cacactttttccaattattacctttatgttttataaatttagtcatattcaaacctagtggttcctccccgaccctatctatctgagaaaaagtcggggatgggggaggatattcttcgaaaaaatgccggcgatggctggggaaatttaaaaaaaacgtcggggagcaataccactgttggcgtctaaatttctttaaaaattgaaaaaattatt

SEQ ID NO: 96323 - DNA, 223 bp, Heterodera glycines
  SCN-specific regions: Sequence locations=1-223
atggaagggaaaagcagaagcgggcggaggagagactgtgagggattatgggagaagcaatcgctgctcgacccccccccccccttcgtcttgtacataaactgtccgtcgttgcccacgtctatctgctgcgcaaataataaaatgcttactccccccttcccccggcgcatttgcccattcgattccatcgataaaatattgagaaattctaattaaaaat

SEQ ID NO: 96324 - DNA, 635 bp, Heterodera glycines
  SCN-specific regions: Sequence locations=1-363,385-635
gtttagattaaaggatgagaagtgggcaaggggctaaagaaccagacaaaatttaatggtcacaaatcgattggccggcggaaggctttgggagaacgacgacggctgacgcacctttttgagggggaggcacagacagaaggaaatgtgagagacatgcacactctatgaatccactcgacggcgcgctgtcagaaatgggattgtgcgagaaaagaaagaagctcaaaacgatcggcagatggttttcatttatttgggcagtgattgggagaaaaacgatctcaacaaaagaaaagtcagggcttgggaaatctcgcgaaaattggctcaaagcattgaaagcgacggagggctgacgactaattacaaacaaacaaacaattaattagcataattaagtctctgctgaaaagtcaaagccattttggtcttttgttgcgttcgctttcgtttcttcgtcctcgaaacgctcattgcggcatcgcattttgaagaacatgctctcggaccattgcttcgtagtcggcactgttctgatgaaatgctgccttgaaacaaaataattgataaatttgacagattaaacaacagatgaacttacagctgcatcctgattggccgcactgtcatag

SEQ ID NO: 96325 - DNA, 166 bp, Heterodera glycines
  SCN-specific regions: Sequence locations=1-166
caaataaaatttaaatctctttctaaagggtcttgaaccaatggttgtgccatcgaactgtccagaagatttgccccgaacaatgcaagtggacccatttgttaagcaaacggcacgccaaaaggcgaccgatgttgcacagcgaatgattgatgaaaaagtaaat

SEQ ID NO: 96326 - DNA, 466 bp, Heterodera glycines
  SCN-specific regions: Sequence locations=1-219,241-466
attcaatacaaaataaattccaaaccaaacaccaacttttccctgctgatggctgaccaccagcacaatgacatcgaactggcggaggacgcctccgccactgaacaaggcaccaaacagaacgtgtcggttgcggtcaaatggttcttccacggaaactggcgacgttttcaatgctccgagtggacttacagcgcacttcaggctgaaattcgcaccattgagcccaacttcagtggccaatttttttatagagacgccgatggagatgcaattgttttcacaacggatgccgaaatgcgtgtgatgctcgaccactttcagaagaaaatgaacaaagacacagtgacactcgaaacgatgggaggcgaaggaactgttaagaccggagttgtcaaaacgggttgcccttacatcaacaaaatcggcaaaatgcgtgacgtcactaatggcaatggggacaagt

SEQ ID NO: 96327 - DNA, 462 bp, Heterodera glycines
  SCN-specific regions: Sequence locations=1-462
tacacagtgccacgcaagattcagtcgcttacctttccgttgatcaaagctggtaggtcataacattattcgacggatgcgaattgaaacaaatttaggacacgacttgaagggtcatgcagagacggggagtggcaaaagtgcagccttcctgcttccgatcatcgatgccgtcatgaaacttaaaaaaggtggccattacaaatcgcggcgctgctgtccgtttgcccttatcgtggaaccaactcgtgagctgaccgttcaggtgtacgaccaggcgaggaaattggcagaaggttagtgctcatttcatgaattaaaccaggcaggctttactgttttctttgaagagtgtgatgtgtctgtgtctcgcgcctacggaatgtttctgcgtcatgttaaccttcgtcaaatttctacggatggttgtgatattttggttggcactccgggacgtctttg

SEQ ID NO: 96328 - DNA, 521 bp, Heterodera glycines
  SCN-specific regions: Sequence locations=1-170,192-198,291-521
ggcgcctctcggcaccgccggacccccttctttcccaagagttttttggaataaacacgccgcaaaaaagtgatgtgaaaagtaaatctgaattcaaataatattcgatcatttagtccaaaatgattaattctttgaaataagtgaagaaaatttgtttgaaaattttcattaatttaatttagctttaacttttggattttattaaataaaaaacaaaataaaatttaattttgtataattttctcttggaataaattaaatttgaatttttttaatttttaaaatttcccggttggtcccggtcccgaacaaaaatcgaggtcccggtcccggcttctcaggtcccggcaagtcccggtcccggttttgcccaaaattcccggtcccgctgcactctagttgaaagcattagagaagcttaataacttttaatgatcagttgccaaaagtaattggacctataaagaataaagatgttttttgttgcgctaattgtacataattttaacttaaacaga

SEQ ID NO: 96329 - DNA, 604 bp, Heterodera glycines
  SCN-specific regions: Sequence locations=1-160,200-604
tgtgcttttaacagataaaaatgttttcaacatttttatgcctaaaaatttcgaccccccaaaaattgaattggcaaattctcatatttctcgggctccaaaccgagacaaatattctcaaaactaagttcgagtcttgactattcccttcgtgttttggccaaaatttggtcccgaatttttgggccaaaatttcaattctcgaattttctgggtttgggccaatcgcatctctcgctgctcaagaaccgggccttaattcttgaggcccccgagtttctgccatagtgaattgccaaattaaattctaaattcctggaccatgcccatggcggtatgtgactgcgtgacggcaccgtcggcccatcggcataactgtgccggtgccgcgcgtgcggtgtggacacaaaggaggacggtgccgtgccaacgcccgctgaaaattctgccggtgccaacgctccaaacacttcggcgtccatgcgcagcaacatttcgttgagcacctgtgagaaaaaataaaatacagtattccctaaaataaaacccccttgggctttatttttcaacccctctcaaaaggggaggggctttatttcatgga

SEQ ID NO: 96330 - DNA, 972 bp, Heterodera glycines
  SCN-specific regions: Sequence locations=1-972
aatatgcccaaaagcaaaatccaatcagcgagcattctggcagaacagcaaaaaagtgtcttttcctgtcagccgacaatccccgccgccgatgagtcggatgatctgtccaactcctcccatttgaattgttgtcagccgatcagcgaaattgaacaacatcagataaacgacttacgccaaattttggaaacacagcttctgaagcaagaggtggacgaagcttatcttctcagatggctgaggtcaaaggaaggcaaatttgacgaggcggccgatggcattcggaaggatttggtgttccgaaaagcatggggactggacaaaattgtaaattgggaagcgccggaaattttggaaaaatactgcggctacggcttcctctctgaccacgacggcaatcccattctgatgtctctgctcggaaatactgacgtagaagggatgttgcgatctgtccaatcgaaggattacatcaaattttcgctcgcggcaattgagaaaggcatcacattgtgcagggaacgcgccctgcagacgggccgacccttcgagcagatgatgctcgtgttcgacttggaccacatttcttcggcccactactcctccaagcagttcgcctcctccttcaccaccctcgtcctcctcttccaggagcattttcccctcgttctgcgaaaaatcctcgtaattcgagcacccgaaatggggagaattgcgttcaattcgatgacgccctttctgtcaaatgccatcaaatcgatgatcgaaatgccttctgaggaggggtggcagtccgccttaagcaaatacgtgaatttggatgcttggcctgtccattggggcggtcggatgatggaccctaacggagacccaaagtgcccctccaaaatccgctacggcctcggccccgtccccgactcgtttttcgtcgacccttcccaagcaatgcccgactatgacccgttgacc

SEQ ID NO: 96331 - DNA, 641 bp, Heterodera glycines
  SCN-specific regions: Sequence locations=1-410,432-519,595-641
cgtctcggccgagtcgcctctcagcgacggttcctcttctcccaatggccctacgccgacgtgccgcgcttcgatggtcgactcaaaagcaattcgaaaggcgcactgtcaggtgtgcaatttggacatttgttcaaccgcacgacagcgacacgtttatatggtccatctgaagaagaaagatttgttcaaatgcccccactgcgaatacacaaattcgaattccgtgtgggaagtgcaaaagcacagccgcgtgcagcacggcaaagacgcgcgaccgatcagtcaggaggagaagcacaagttggaaattcagatgtggagccaactttgtttccccgaatggaaacagaaacggaaaattgagcacggcgactcgacggaagaggagacagcgctgaaacggcgcagagagggcgaaggcggcgctgaagtggacgacttgttggagggatttggcgaactgttggggcacattttgcagcagcaaaacgaagcgaaaaacaacggacaaatagcggaggaggagggagaagaggaggacgaacagcagcaggaaagcggaacaacggaggagcagacggaggaggacgaatggcgggacaacgcgtcaccaagtgacaaagcgccgacaacggcgg

SEQ ID NO: 96332 - DNA, 485 bp, Heterodera glycines
  SCN-specific regions: Sequence locations=1-485
aatcgagcccgaactcgaagtgctcggctgtcggtggtcacccagaccaaccgaagcagcgacgtgaactgccgaccgaattgtccgaattttcaatttttgatcacccgagaagtctgactgagtgaaaagccaggccttcagtgctcgcacgccagcgtccttcattagtccgtcggaagtcactctcatattgtcaaaggagttgccgaatcggaaaagttcgtgaattgatcgcccttttttcgtcacccagacgggaatgaaggggtttaggctcatcattggtccaagacgtgcgaccagttcttcgtattcgtcgtgcttgtcatggacataaggcgggcatgtccagaagaacttcacgtgtgcaaaacgacggcacagattcgcgatcatttcgtactgttccatcatcatttcgacagtctctcctctcagaagagagtcgcgtccggcaatgatcagagctgccttcactttgc

SEQ ID NO: 96333 - DNA, 309 bp, Heterodera glycines
  SCN-specific regions: Sequence locations=1-130,152-309
atatttttttataaatttcagtaaaactcgcaattgcactgtcctttttcagttgaatagaaaaagacatatgggagaaggaacagacagacagcagaaggacaacaaacagaaaatgagcaattagtgataaaagggaaatgataaaatataaaaaaatatgggaaatgataaaatgggaatttgacggaggacagagaaagaaaggcgttattttgcagcagcaaaaggaaaagtgaggacaaaaacgaattcgcaattggaagagtcaaaacatttgggaggagcaaaaagagacaaacattcaat

SEQ ID NO: 96334 - DNA, 298 bp, Heterodera glycines
  SCN-specific regions: Sequence locations=1-45,81-142,178-213,235-298
tgatggttggtggtttgtgaactaattttttgatcaattaaactgaaaaaaaaatatatatatatatatagataatttaacttagtttattgcctgggcctaaattgatggagcaattccttgcttagcttatgagtaattcaaatatttttaaaaaattattcaaaaatttttataccgaccaggtggtggtgccctcctgagccttgccactttcaatttcttcaacaacagtaggggtgtggtagaagctgttcagatatgattttatgccgtaaaatttgccaccagctccttt

SEQ ID NO: 96335 - DNA, 551 bp, Heterodera glycines
  SCN-specific regions: Sequence locations=1-293,315-551
aaagctggagctccccgcggtggcggccgcttacgaactagtggatcccccgggctgcaggtcctcggcacgaggattccccactttgtttttacattttgtgatcagctcacatgcattttgctgacctgtccctaagtgaacgggaaaaagcgctgagtgttcgctatttgcaggagcgtgatgcgatgtttgagcgtttttcggagtggacggagcaggaccagacggacttctgcaaacaccttctgcagcgcatgtgtcaccaccaacacggccaaattgaccaatttttgggcccaatgcttcagcgggacttcattgcgttgttaccaaccggtttggcggagaatgtgcttcatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggcctcgccatccgacggggatggaagaagtacttcttttgctccaaggaccaggcgacacgc

SEQ ID NO: 96336 - DNA, 286 bp, Heterodera glycines
  SCN-specific regions: Sequence locations=74-86,109-224,264-286
aaataataaaataataataattaattaattaaacatttttataataatttaactaataaatattatttaattataaccctcgttcctttttcctttaaaatcaaaaattgggaaaattccgttaattgatttgtttattaggccttattgcagcactcttccccttcttcattgatttgtttattttgttcatcttaaggggtcctgtaattaatttggtttagttaaaataattatgcaaaaaaataaataaataaaaaattgggctcataaattaaatttagat

SEQ ID NO: 96337 - DNA, 636 bp, Heterodera glycines
  SCN-specific regions: Sequence locations=1-200,222-636
tgcactgacacagtgcagcaaaatcctctccattgtctgcgatgcttttcccctatcaaatgccccgtccgtttgccttgtcagcactatttttgtcgtttgtgcatcgccgatgagaagtgttgtgtgatttgtggtcatccgattggctgttccgagttagtagaggacaaagtgctgaattacgtgttggaaagttcgagtgaggtcactgagacatgtgcaaatttttatcagatttcgcaaccgatgttcttctgcgacacgtgccatcagcccctttgcagcgggtgtcgcgagacgacccacaaagccaaaatattctcgactcatcacatttttgagttggaggagcgcgggaggttgagaagtcgccccatctgtccacagcacaatgagccgttcattttattctgtctcgactcgaaatcgctgatgtgcatcgaatgcttcaattcgtcttcgttggaacgacgcggacatttcgtcaacatcgaactggcgcacaaaatttgctgtgataaattggagaaaaatgcgttgaatttgcgcatttttcaggaggaacttcgtgagcaaattgagttgaggaaacgattgacggacgaactttcgaagaacagcgagaatttgaga

SEQ ID NO: 96338 - DNA, 876 bp, Heterodera glycines
  SCN-specific regions: Sequence locations=1-89,111-111,160-160,182-876
attatgagccacccaatttggcaaatcggtcttttaaaacgcattaaagaagattcagtcgattgcttggagtgtaagcaaaaaaacgttattaatttttcatcttcatcattttttggtttaaaaatatatttgtatacttttttatactttgaaagacttttttattaatacagaatttttgaaaattcctaaaatccgcactcctgcgcaggatcctgcagattttaaatgcatgatttgcaggattaatcctgccggatcctgtcctgtaaaaaattttgaattccaatcctgcaacgggatccgcaaatttgaaatttccggtctctaactattaccccatttttttaatctttttgaaaaaaataagcgaattttttttaaatgactaataaataataaagagcttcaaatggccctatttgctaatgtttttaccacaaaatatcttccaaaagaagtgacacttttggtttttcgccgttcaaactctgaatttttttgcgttcgtcgttcgccaacgatttttgagcagacccgccagcaacactcgaactcttcgcgacggaatgaccaaatccaacaaatcttagaccaatttgacaagatgcaattgccctctcaaaatgagcctttggcgacttcgcaacagcaaattgtgcaattgtcggagagactcatccaattggcactgacggcgacaaatttggtgtgcaatttgttgcaaaaaaacggagcagcagcgacggatcaatttaaaggacaaacaaaaatgccgacggtggcgactattgagccgaaaaatacgaaaagagacggaagagcggcagaaaatgagaagggatggacttggatttgtgagaagtgtcgcaa

SEQ ID NO: 96339 - DNA, 644 bp, Heterodera glycines
  SCN-specific regions: Sequence locations=1-77,99-644
gtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctcttcatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccgccagcggttggtttaagggagacacaggagcaaacgcatcactaatattttgtttttgcagccggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcattttgctg

SEQ ID NO: 96340 - DNA, 625 bp, Heterodera glycines
  SCN-specific regions: Sequence locations=1-24,46-350,373-398,420-625
agaagataaaaaagcggctaacaacacttgcagcagcaacaacaataatagtctatcggatgtcaaacagaatgatgacgtctcatcgcttgactcacttggcgtttttctaaaccgttttcgtcaaatggacacaaaaaagttgcaacaattggcttcaaatccgacggtggtggcgcaatccaacggaccaaacgaaggcaccgcaaaagacacaaacaatgataacacttcgatcacatcaactcgggagaaaatgctcgaagtcgtttatgggaataagctaatgggaaaggagaagcagccgaaatttatgtgttttgttgtggatgcgcaggaaagaaaaattaggataatgagcagagaggagcagaaaaaacaggagagttccgccatcattttggaagaccttacggatgaccaattttctcggtttggcaaatccgtcaaggacaaagaggctgataactccgacgcattcgtccattgtgaaaaatgttctctgttctacgaattctgttgccttgatcatccgctttatcagtgcaaagatcgggtgccttcgtcttctcccacagaaattgaggacagagcggcggccactcttcctgcctttctttttatt

SEQ ID NO: 96341 - DNA, 422 bp, Heterodera glycines
  SCN-specific regions: Sequence locations=1-158,180-422
tcattattatgtaattttaaacattaagttaccaattcaaatattgttgatcatcaataaacatattatcatcacgaattaaaggtttaggaaaattttgccctaaataaattatatcattgtccttcactttcacaagttcaagtgggtagaaacgttcattgccattcttgtgtttttcgatcacgcaaggattgcttgaatagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagtttttcctttgacgtatttttctactttttgtatctcatccgggtgatttaagcggtcg

SEQ ID NO: 96342 - DNA, 1195 bp, Heterodera glycines
  SCN-specific regions: Sequence locations=1-253,289-389,415-1070,1092 -1195
caatcggacttccatctttatgatgctttttctcggcatcgaacggtacgtcgctgtgctcttcccaatttggtaatcaattagataattgactaattattatcaattttaagtgaaaaaaaattctcaggtcaaggagtcgcaaccaacgcaaatatgctttttggacttgcatattttctgtgcttctccatgcaccgttcagtatttaccaatgcttatctgttgggttcaacgcaccggaaaggcgccgatttatttttatttaatattttaattttaattttagattacttttgtgctcctcaattgatgttgtggcgggaggtggaaacaattttatcatcacaattttgaacaacggagtgatgggcggcacaataattgtgtacactttgttgtggttgaaaattaaatttgcgtcttctccaaatggtaaggcaaaggcaaaggtcgaaaattgagtgtcaccaaattacagtattccgagggaatttggtgcgctttagagctctaggtgaaaaaaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaac

SEQ ID NO: 96343 - DNA, 394 bp, Heterodera glycines
  SCN-specific regions: Sequence locations=1-168,190-247,334-347,369-394
gttgataagagccaactgaggccggacgatcgggaccatttcagcgccgctgatcggtcattttaatctactttataatatatattttggatggtccatgtatagtaaattgtaataaaaatgatatcttataggcaggcatacgataactggcagacaatcgtggtgaaaataaataaattaaaaaatgaaatggagtaatcagatcgaaacgacaattgcacaaattcggcccaattggcacaacaataaaaataaaaataaaaattaaaatgtaaaatagtaaatagtaaattaaaattaaaaaaattaaaattgaaattgaaaatgaaatgaaagacgaacattattcaattgaattgaattgatgatgatgtgttggcgcgatcgtggt

SEQ ID NO: 96344 - DNA, 172 bp, Heterodera glycines
  SCN-specific regions: Sequence locations=1-138,160-172
acaccattgcccaagaaagtgcaattttaagatatcatttgataaaaggatgtgggctttgactaacaaataagttaaaaagttaatggtctatgaaaaattgagattgtcactgattggacgcctaaagtgaattacaaaaaaaattaaattaataatccgccgaatggat

SEQ ID NO: 96345 - DNA, 562 bp, Heterodera glycines
  SCN-specific regions: Sequence locations=1-508,530-562
gttgcacttgaggcaagtggcgtccttgaatgtgcagtcggagcgccaatggtcggatttgccacatgatccgcatggatgcgtcggttgaccacgcgttggctttccgcttgaatttgcaccttgtgcgaatggcgtttgtggcaattggtgggttaaccagcgaaagggcgctctccttgacaagctgaattgcccgaagttcctcctcaattttcttgagcgaaatgtcggtgccgttcttctgcgagtcatccaacattttcaatgccttttgtcgcaaatcatgatgttcatcattgagcgcgatgaccaaaataatgcacttgagctgctcctttgtcagactcaggtcggcattttcacatgatgcgttgatctgcgcaattagtgatgagatgtcttgcccttgttgctgtcgaattttaaaacattcgaagcgacggacgaacagcgaacgtgtctcggcaaaaagctgtttgagctgtgaagtgatgtcattccaattcacttggtccggttgggttgggctgatcgtgtccctgatatttgctgtactcct

SEQ ID NO: 96346 - DNA, 411 bp, Heterodera glycines
  SCN-specific regions: Sequence locations=1-411
attttgatttagatttgttaaaaagtccaattatcactgcattcttatgattcttgcttcttcgtcaaagcgattagcttgtcaattcctcatccgaaaagtgcctcattttgctgtgacttcctcgagaaaagagtccaattggtctgaagttcttgatgaagcggtccccgccagaaaatcataccgcgattttcagacactcaacggaaaccaacgcgatgctttggccgcatcactcgacgatagtaagtcaatggtcaccgttttgggctcaccgggcaccggaaaaacgctgttggtgacggaattggtgcattcgatgtgcacaaaaaaacaacgcgtgttggtcatttgtggctctcgagagcttttgtacagcaccgtgtgccgatacttccgaagggctaa

SEQ ID NO: 96347 - DNA, 677 bp, Heterodera glycines
  SCN-specific regions: Sequence locations=1-189,212-677
gtttgagaagtgcttggctttgcttgccatcattcctgtcatctccccatgcttttcccctctttcggcatgctcagcagtgccatccaccaaaatcagcaccgccgttccgtccattctgttcgctatcattcgccgctgctttcatggccgaagcttttcctcatttccatcgcaacaattccccttctccttttgtcgtgcattgacttcgtaagtgccgtttcggacgacggcgcgccttttctgtccgaccaacagaaacgtggcggtgcgcgcgccttcaatctctttgcttctgctgctttcccaccgccgaatgagaagagaagcggcggacgtgcctttggaggtggcattcagacaattaacgacgatttcgatgctaatttggctggagaactgaagcgtgccggtgcccggttatttcggatgagtgacctttcatctgacggggacagtttcgtgccggaagggacaaaacgcggtggtgccaggcccttttacggcggcggatacattgacggagcgtggaaaagagcgggtggacgatatttcttgcgtcaatttgacgatgtgccgtttggcggcggatggatggccaaacgtggcggcggtcgctcatttttcgaaggcaccaaaggcccttttaattctgcaaattattgggctccaca

SEQ ID NO: 96348 - DNA, 476 bp, Heterodera glycines
  SCN-specific regions: Sequence locations=1-256,278-476
acagcatcattgttgacctgctccatggacagcacaaatcgacgctcacctgcaatgtgtgcagcaaaatcagcatcaagttcgagccgttctgcttcctgtccgtgccggtgccgaccaaggagcacaaggcccaatcgacgatcgtttttatgcgggccgagaaatgggcaaagtttcacgtcacacacaccagcaaaacgacggctggccagctgaagcaaatgctgcgtgaagagttgcagttgccttccaacacacagatgatcatttattcgacttacagtaaccgaatattgaaggacgacagcacattgtcctccacctacatgtacaattacagtatgaaactgtatgcctacgctgtggagccgggccccgtcattttggtggaaaatctgttcatggccacctctccgccgttgttctttccacgtcccaccaaactgacgcgtcgtgcgctgcttgccgaactg

SEQ ID NO: 96349 - DNA, 486 bp, Heterodera glycines
  SCN-specific regions: Sequence locations=1-486
cttctcctcctgcccaatgaaacggccaaaaagagacaattcccgtacaaaatcggcctccgtcgtcgacagtttctccttcaacggtcaacgtttgtcctgctccaactcgtcctcttcacctccgccgtttcattcggacgaagcagcgaacgatcgccaacaccgaagggcatcggcacaacagcagaagaagataacgaacaatgggacggcggatgtgatgaaaaaaatgccgaaaatgaacggcacaacgagcagaggatggacaagggagacggacagcagaagtaacgacaacaacaacaacgaggacgacgaaacggacaatgggacaacgacggaagaacaacagaccgggacggggacatacacaggcatgcgcgactcggccacttcgtcgtcgtcggcatgctctgcttcatcgacgcttcgtcgaccgttcgaccatcccaccaacctctttttgtgccaacaagcgctgaa

SEQ ID NO: 96350 - DNA, 799 bp, Heterodera glycines
  SCN-specific regions: Sequence locations=1-237,259-312,334-417,442 -534,556-603,626-742,764-799
cgagcttcagctcgaatctgaagaccgatataaccgatttccattctcgcaaaaggaattcattgaagattgtccggcagaacgactttacgtccgaatccttcccgaaatgactgaatatgtaattgccctgctcaaagtcattctcgcttcgttgccttcctccaaagcgaaaatcgatgctgtcacaattctatccgatgtgctgacacccgaaactgacacaaatgagtaaataaagagccatttattcccttttgggacccttactccgattccctaattatttagagtcctttctaattcgatcagtttggaccttgccagtttttcacacacaaatgtattggaagaaactgtccgagtcgcaattgacataaatcgacacaaagaactgatcatcaaatcggcttcgtctcttctcattcttttgctgaaacacttacgtttgaaccacacactccaatttgaaaacttggcccgttatctcgtcttggccaattgtcttccgctggtgcttaagtttcttgaccagaatatttgtcgatacttccaagcaaagcacgagttggccccgttcaactatcctcagtgtgcactgttttttgtgaggaatggatatgtttgtcctccattaactgcggaaaatgtcgacggttgcggtggttccagcgactcgccttcatattttctgtggcgcaatggcttttcctccatcaatttgcttcgtgtgattaacaaactcacaaagggaaaacagtcccgtacccaaatgttggtcgtttacaagtgggccccg

SEQ ID NO: 96351 - DNA, 430 bp, Heterodera glycines
  SCN-specific regions: Sequence locations=1-102,124-161,216-430
ggcaaaagcctcgaaacctatcaaaaaaaaatccgttaattttatgatttaccacttttttaaattgccttatcaattggctttgctgctgttgctaatgtctcctcctcccccttcttcagcttttgctcattttcttctccgctgattgcttccaaaaagccgctgctgctgctgctactgctataacttgtgttgcttgtgctgcttttgctcatttgggacaatttcgaattagaatgagcacaacaatcaatcagcaaaggctaaattgacacgcatttatgtctgttcgatgggcttccgtggtgaatgagggataaaacatttgaaaatgccttggttgaaacatcgggattttctgatttcccaaaattttagggcattttaattacatccccagaggaatgcgctcttataggaaaaaaaa

SEQ ID NO: 96352 - DNA, 504 bp, Heterodera glycines
  SCN-specific regions: Sequence locations=1-303,331-504
tggaactccccgcggtggcggccgctttccaatagtggatcccccgggctgcaggaactcggcacgaggctagtaaaattcattctcacaaatcaatcaaattgttgccccattttgtcactctccatgattcacattgccatcccttcccatcgaacattggccgaccatgaagatccgtacaacaaatttacggtttacgatatccacgtgaatggcgccttccatgccagtgtgcggtacaatttgctgtactcattgcacgaaaagctgatcgacctgttcggctttcggttgaatgcgcccgattttccccccaaaaaattgtggaaattggacgcaaaagcgttgaacgagcgccgggaagggctggccaaatatttgcaaggagttgtcgcgaaccccgatgtgtcgaggcaccccgtcatggagcgtgtttttctcgattttcaagtgaagtccttttctgctgcggtaagccgaatgacaaaattggaaattttt

SEQ ID NO: 96353 - DNA, 481 bp, Heterodera glycines
  SCN-specific regions: Sequence locations=1-241,269-481
ccgacctctagtaaaattcattctcacaaatcaatcaaattgttgccccattttgtcactctccatgattcacattgccatcccttcccatcgaacattggccgaccatgaagatccgtacaacaaatttacggtttacgatatccacgtgaatggcgccttccatgccagtgtgcggtacaatttgctgtactcattgcacgaaaagctgatcgacctgttcggctttcggttgaatgcgcccgattttccccccaaaaaattgtggaaattggacgcaaaagcgttgaacgagcgccgggaagggctggccaaatatttgcaaggagttgtcgcgaaccccgatgtgtcgaggcaccccgtcatggagcgtgtttttctcgattttcaagtggtatcccccacattttcaagaagtccttttctgctgcggtaagccgaatgacaaaattggaaatttttctgcccgatggacggccgg

SEQ ID NO: 96354 - DNA, 459 bp, Heterodera glycines
  SCN-specific regions: Sequence locations=1-22,46-332,354-459
gccgatcatcgattgagtgctcttagattctgtctttcctttcctaagttttcctttgcttgtttttttccatttcattagatagtctttcttttcattcaaactgcgtccattgtgaatgttttccaatggataaaagggtggatctgtcattgatgagcttatgtgtcaattgcttaatgatagtaatttataatatgaaaccctttcttaacagggccaatgctttttagtttataattgcctcggccttaattatgttcgcggtttgtctccctatgcacgaaaagtgtgccgcagtggaggcagtccgccaattggtttgcctctcctcagtgccaaattcaattggccattcggctcttggccaaactcagtctcttcctccttttggcattccgcggctccattgttttggccgatgcctttcctttggctgtttttcagctccatcttctg

SEQ ID NO: 96355 - DNA, 494 bp, Heterodera glycines
  SCN-specific regions: Sequence locations=1-38,60-494
aaacgacgaaggcaacgtgcgtccctaccttttcttttccactttttcttgttcttaggcggaggaaaaggagcaaacggtgatttatgacgaagttaatcagctgtcgaagaacggcaattgcgtgggaattctctccgattgttttttgcccattggcggtgatctccgcacttttctttggtgtcggatgcaacgccaaccatctctattccgagggtggctctttccccgtcctttcctccgatttttcgccgcccattccaaatgatccgccgacttttggttccccagccgaccttcttgacaatgaattgcagcagcccaaccaacagtaccaaactgagtttgccccttccatggaacaaatggtcgacgaacaaaggcgcaatcggctggccaaaattattgaacaaatgagggataatggacagtttagccagcaggaaattgccgatgggcccggactctttttggaagaaggagaagcgaat

SEQ ID NO: 96356 - DNA, 606 bp, Heterodera glycines
  SCN-specific regions: Sequence locations=1-466,491-606
ctccctcgcgccttcccatttttgcccccctttgccgcccgagccaacaagtggtgccgttagcaaacaaagatgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtctaggtatggaggtcgagctggacgcgtgggctgccatcatgaacggactgcaaggcccagcgagagaggcggaggaagcgcttttcactgcctttattcgagatgaccggcacttgacggaatggttggaagatgcgcgagaaatgctggctcacatagcagcagaactcgcagatgagcccaaccagccaatcgcggcgggaggacagcaaccagctgttgctgtgaatccacccgtgccagccgtgccattcgtcaacaatgccgcatttctcggcggtgccaatgttcaacagccagctgctgttgccaaccatgccaatcagccaccattggtgccaaataatgcccaaatcgtgccaaacccgcgttttgg

SEQ ID NO: 96357 - DNA, 651 bp, Heterodera glycines
  SCN-specific regions: Sequence locations=1-46,68-226,252-493,530 -565,589-651
gatttttccccacatttaaggcagatgctgaacatcccactgatgctgctgttgtggacaacttcgagacgcgcgctcgccgcttcttcgacctgatcaacgacggcaacatccaacacttgtgacagatcgcaaacggaaattggtagagagacgaaaatttgaaaaattccataattttacccatcatttttctcccacagccgcatttgccatcggacaacgaacttcttcttctgctgctgcttccccggttcaattacatcacagaaagcaagcaaaggacacgcaccaacaacctgcgcaccctctgtcagtgcatggcacccgcattttgttgtgtttgagtctctgaatcgcatccctttcccctctttcagcactgatgatggcaccggcaacttcttcctgagcgcatatgccatgtcagcgcaaaaaatcgccagcgattcggagtggaagaaaacggtgggtttttgggggatttggccggaaattttttatttttaaaattaattcatttatttttcagcccatcggacaaactggccttttcaacatggaaaacacgtgcttcatgaacgccactcttcagccactgttccatacgcccggattttctcaactgttccaagaaaagagcgcgcagcg

SEQ ID NO: 96358 - DNA, 461 bp, Heterodera glycines
  SCN-specific regions: Sequence locations=1-171,194-461
gtgattggtaattagtaatgtacccctctcattattatcaaattaattgtttaccaaaacaaacatattgtactagtatatacacacacccattgtctgccaacctgggcgggcgtccgcgcgagcgcatgcccggataaatgtacttgacaatcacacgcgcgcgcccggtgccacggccgccgcgcatgccgcgcgggggccgattggtggaggacagcccgggcacattggtacgcttcggcatcaccttgatctgacggcccaggaacagcgagtcgttcaacgaggtggacgtgttcaccgcgtccacgtccgcgaattggatgtacgcgaaactggaggaaatgtggcaaacatatgaaaatgtgttagcaaaaggactataattagtaatgtacccctctcattattataatcagtcccgcccgcccccttccgcttttcttccccgaaaattt

SEQ ID NO: 96359 - DNA, 270 bp, Heterodera glycines
  SCN-specific regions: Sequence locations=1-40,63-143,165-196,233-270
gcacgttggccataatttataagggtcgagggtcgataaaatttggtatatttttatgtatgaacttggaatttcgaaacaaaaatttattgtttcactgaggcaaacgaaaaaaaaggcaaaaaaaaaaatcggtttgtaaatataaaaatgaaatattgtgtgtgaaaagatagaatcaacaaatgacggatcgaaaatttcttttataaagattttgacaaaaatgaccatggtcatgaccatagctatgagagtgggaagagaagc

SEQ ID NO: 96360 - DNA, 629 bp, Heterodera glycines
  SCN-specific regions: Sequence locations=1-119,141-309,331-629
aaaggcgtcactgctcactatcattgccatcgacaaccgcactttgccagcacataacagccatcaaaaaattccattgccaattgaatgtattgacaaaattgaactgcattacacgcttatcattgtggttgaaggatcaaataatattattcataagctttcctaaatatcattattatttatacagttgtgggtttttgggtaggaaaagcagtttttcattttttacgagatttgttaaattattgtgtaacacccccaaagtgtatgatgaccaagacgtacgttggagttcagtgagaatgagtgtgtggtggtgtctctgttcgttatggtctccgtccccatttatgtgcatcaaagaactcgcaagtttttgttcaaaaaaataccgaaatacaacaacgggaaaggaatcaaaatttcaaatttttctcacctaccgcgcgttatttgcgcaaaatacgaaattttcagccccaaatgaatggtcaacaccaaaaatggtcatggtatctctcatatggtagtgttcttctgtttggtgctcaccattggttgttggccttcaaatggtggatggacaccatttggatttgtacatttggggggtcttgggctcaaaa

SEQ ID NO: 96361 - DNA, 340 bp, Heterodera glycines
  SCN-specific regions: Sequence locations=1-88,110-340
agaaaccgctgatcagagccgagaacggtggaatggaaatcacccgccaaccgctggaccaacgtcggcatcatttcggaaagccaatgggccatggattgggcatttcgccaccaatttggcggataatcacttcaaaattgattttaacattggcgcaaaattgtcgagaatttcggaaagatgccaatgactcattccattttctgtcccccacacactcactacggttgcaagtcgtgccggtgccggtagagacgaatggtcgggtaactgtgcacgtattcaccgtcgcaaatgtccgggaacgcttcgcagtcgacggagccaaaagacaccc

SEQ ID NO: 96362 - DNA, 280 bp, Heterodera glycines
  SCN-specific regions: Sequence locations=1-104,142-280
aaaaatatgtgcaaaaacaggggcgaagcgcaaaaaatgccaaaacagggacaccctgtagaaaaaagcagtaaaacataagaatctaagaatctgggtcccacaaaattatttataatcaaaaacaaattaattttatttcttttaagcataatgagcaacaaagatttttggagcaccagaattttcccctgacagcatgtgctcgaactcccgtttttaggagagtaagagaggtagttaatccgtgtttaatcaattatgaaattcaaaaataaac

SEQ ID NO: 96363 - DNA, 477 bp, Heterodera glycines
  SCN-specific regions: Sequence locations=1-27,49-191,213-477
gagaagagagcaaacagccccaactttgtccttccccttcatctgctgatcttatcttctccaatcgctttcccattcctttgccgaaagtaattttaacaaataaaaaagaccggcaacagaaagagacgcctttcgtccatttgttcgcctctcactgagtctctcttcgactttactccccaaatggtcgttgctgatttggccgtcttccaattggaccttttttggacaattatattgggctttcttatcgcatttgttttggcttttgcaattggagccaatgacacggcaaattcctttggcacgagtgtcggctcccgcgtgctcaccctccaacaagcgtatttactcgcctccattttcgaaacgatgggcgctgcccttttggggtatcaagtgacggacacaatgcgcaagggagtgattgaccttaacatttacgagggacgcgagaaggaactgatgttggga

SEQ ID NO: 96364 - DNA, 168 bp, Heterodera glycines
  SCN-specific regions: Sequence locations=1-168
aagagagcgaacagccccaactttatccttccccttcatctgctgatcttatcttctccaatgctttcccattcctttgccgaagtaattttaacaaataaaaaagaccggcaacagaaagagacgcctttcgtccatttgttcgcctctcactgagtctgtctctct

SEQ ID NO: 96365 - DNA, 357 bp, Heterodera glycines
  SCN-specific regions: Sequence locations=1-115,137-357
cacgacagtaccagtattacagtccccatgattcgggagagcattcacaattgagtgtgatgcttcgaaaaaggctattggagcagttctccttcaggaaaatggtcctgttgcttacatttcaagagcattaaatcggcacgaaacaaattacccttcaattgaaagggaggcgttggcattagtttatgcagttaaggaattctcgccatatatcgttgggtctggggttacaaaagtaataacggattgtagtgccttaacaggcatgatgaaagcgaaggagctaaaagggagacttgagaaatatcaagtaactctccaaagtttcgaattagaaattatttatcggcctgg

SEQ ID NO: 96366 - DNA, 612 bp, Heterodera glycines
  SCN-specific regions: Sequence locations=1-31,54-328,355-612
ctacaactagtggatcccccgggctgcaggtttccggcacgagggcgctgaggaggcaatttccaaatacaacggcgaatggcaaattgggtcgcccactgatgaaattttggccaatgattatggactcattgtacggactaaggctcgacaccacgccatttctgcgcgacttcgaaagcctttcaaattcgatgggagtccattggtcgtccaatacgaagtgaaatatgaacagggtcaagaatgtggcggtggttatttgaaactgttgcgggacgacgcctcaaaggatttgaagcagttcaacgacaaaacaccctatgtgatcatgttcggaccagacaagtgcggtatgacaagcaaagttcacctgattctgaagcacaaaaacccgaagaacggaacaatcagtgaacaccatgctaaacagccgagcaaatcgctcagtaattactttgaggacaaaaagaaccatctgtacactcttgtgatccgacccgacaacgcgttcagcgtgtctgttgaccacacggagataatgagcggcaatttgctgacggatctcgaaccatcggttgtgccacctaagcaaatcccggacccggaaga

SEQ ID NO: 96367 - DNA, 222 bp, Heterodera glycines
  SCN-specific regions: Sequence locations=1-13,40-50,72-222
gttttaaattttgaaaaacaaatatttatttctcagatattcatttagagaaaatttatttatttaataaagcgaaaatgaatgattggataaaatggcagaaggatggacggacgaaccgacaaaaaacgatggaattgaaatgattcattcatttgctggcgatcactaaaaaagagttggactgaaaagccaaaagcaccacaaatattatgtgaaagc

SEQ ID NO: 96368 - DNA, 345 bp, Heterodera glycines
  SCN-specific regions: Sequence locations=1-60,82-223,246-345
cttcgtttcggcttcatttgtttccgtatgctttttgttttgtttttttgccatcactttttgcttaaaatatttttcaccatggcatttcccattgctttttccatttttggcattttttcagtgcttttcggtaataaaaatgatgggcccaaactgcgcgtgaagcgcagtagcagcgtcgccagcagcgcaagtgccgccggtgccatcgctggcggtgccaatgccaattcgaatgccaacaatgcgtttgcatcattttatgccgatgatgacaataccgttttgtgttgtgtgtgccctgcgccgatgacattaggcgatttgaagaaaagttcgtcg

SEQ ID NO: 96369 - DNA, 465 bp, Heterodera glycines
  SCN-specific regions: Sequence locations=1-58,80-99,145-207,229 -329,362-429,464-465
ggggatttaatgttgtttaaacgctaattgatttggaagattaatgtgatttatggcattttttaaaccaatttttcattcggttcgatgacatcactcaaaattttaaaaaaaatgaaaagaaattttttcttaaatattattctgtagcctctaagtgttctcaattaacgattgaaagattgtttattttgattgctaaagtcaaaagttatggtcaattattttttgattttgaagattaaatccgccgccgatgaattaatttatttgagggattaattaggtaattaaatgccaaattttggtcagccaaagaaaataggcacaattaaaatttttataaaaacattttaaaatagaattgatcagccatttttaaatatgtgcattattaacatgcaaataaaatttggtggattttagagcatattttttgaaaaaatatttataaattaattttgc

SEQ ID NO: 96370 - DNA, 354 bp, Heterodera glycines
  misc_feature (247)..(247): n is a, c, g, or t
  SCN-specific regions: Sequence locations=1-62,149-197,220-354
gaagattttaatttttgcaatatgagtaccaatacgcacaatatatttgcatatatcatttgattatttttattattaatttttttaatagaaattttacttaatatttatataaatatattttttgttcttgaattaattaaaattagtcttttgccgcggtaacgaagaaatgataaaatgctctccaaaataaatttttaacaacacttcaaaaataaatgcattatggtatcttcatatatantttttatttcctatcaaaaaaagggtctgtatcagggatgggccaaattgaaaaataaaaagcgaaatgcgaaaagcgaaatttgcgaaactgaaaaatgcgaaatg

SEQ ID NO: 96371 - DNA, 547 bp, Heterodera glycines
  SCN-specific regions: Sequence locations=1-440,462-521,543-547
atggccatcgttgaaaatatcggattttctacttctaacagctccgcagtcagttccttgtcttttctgcttagaacttattttgagcaattgtgtcgcgactcgcttaactcggccattaattctggtcgtgcagaagttggcttggattttgtttcttatgttttcggagccaatggaattaatataactgaacttcatgattatatccagcaagttcaaccatatgcggctgatgagcatcctttgtttcccgtcactgaaccattaaatgtgccgccgccttcctctgaaattgcggacacatccgagcgaaaaaatggcgagagagaatcagcagggaatgacggggctgaagttgacgaggaagggaatagggagcaaaacaacaaacactccttgaactcattcaactcgaggtccaatgttcgaaatgcaatttctcaaaagatttttccaaattttgtcggtgcgtttgccccgaatctcggcttttccgtccgaaaggtcgaacttccgacggagaatgtctctgtggaccaacatt

SEQ ID NO: 96372 - DNA, 745 bp, Heterodera glycines
  SCN-specific regions: Sequence locations=1-6,53-155,178-675,697-745
gtcaatgaagagaaagaggaacaagagagggaggaggaggaagaagaggagggagcagcggaaaatggcgatgaaaatagaagaagcgaagcgaacgaattggactcggcctttcccgcaatgatttccaatcttttcggcactcatccgttgcgcaccgaaataaaaaagaaaaggccgtcgcagcgtcgggggaatgccgaggaagagacatttcactttattattgactgtcacggcaaattcgacgcgaaagacacgcgaaattttaattcatcgctggtggaggaggtcagcagacacccggcactgttcgacttcacaagggacgagtacaaatcgaccgaggcacgcaatagacattgggcagaagtggcggaagaaatgcagcaaagtgtggaatttgttcgtacgcgatggaaaacgttgagagaccgtttcaaaaaagaggtgcgaagacagcaccaatgtgtggagggtccgatttggcaacattatgacaaaatgctttatctgttgccgtttattagggacaaagacgattctaccgaagtcggaacaacagtatcaaatggaagtgtcggaattcgttcgaaaaacggcgcgaggagggcggaggggccgacggacaataccgacagggggacgacgctttggcatggcgagcgggaacagaagcgacggacgaacaacgggaatttgctgcacccgtcaccaattaattcgtgcaccgccgccattttgg

SEQ ID NO: 96373 - DNA, 550 bp, Heterodera glycines
  SCN-specific regions: Sequence locations=1-550
aaaataattgctttgattattaacatgaaatatccggaaaatttaattgagtattggttatccaattttcacattaatatttaattgtccaactttgaattttttgcaatttaatccactgaactttttagcagttttaattttttttttttcatctcaaaataagcataatgaaatacctaacaccaaacatatttttgattgttttttaataatgcattcctctaaatttgatcaatcacaattttttgttttgcttttcgttatttaattttattataaacacttttatagggaaaccaacggaaattctctcacttccatattttatgcttaaatgcgatttggacccatttcgttccgaggccaattccatgtctcgaattcttagttcatgaaccgtgagcatgtctcttaaccgattttctgatcggtctaaattttggtcaaatctcggctatgccaattttgacattccaaaatttggcgatggcgatcaggccctaccttcttcaaataattatttggccacagatttgtacaatggcgc

SEQ ID NO: 96374 - DNA, 478 bp, Heterodera glycines
  SCN-specific regions: Sequence locations=1-228,271-478
gtcacagagtctgcgcgttccattcaaattcctccccttttggcttttttcgccgcttaatccctccaaatcggtcgcttttccgtgaacacttttcgccagctgccgcttctttgcgcacaatgaaatcagattgaagaagctttgaacagataaaaagggctgtagcaaaaggatgaataaaatgggtccgacaagcgaaaacgacggaccgaagaagcaaaagaagggagggagacggagggacggaatgccaaagccaacgccaaagccaaaaggcatggcagcagcatcaacggcacttcgccaactgtcaccactgcacaaagtactgctcgtcgttgtcgcactgctccaatggacaacgacggggggaagggccgctctgcttcaaggttgcgactttagcgaagatttgtgcaccgatggcgaagtctgtttgccggacgggctgttcggccagtgctattcggacgat

SEQ ID NO: 96375 - DNA, 165 bp, Heterodera glycines
  SCN-specific regions: Sequence locations=1-165
attaatttgaatcaccactcaccgcaaaactaatgaaattgtgaaatctacggcttatatttttattaaaaatgcgatcaccacttctccaattaaattctcagtgcctttcttttgagaaataattcgaaatattcccgaacttttacaagattctgcaaaaat

SEQ ID NO: 96376 - DNA, 461 bp, Heterodera glycines
  SCN-specific regions: Sequence locations=1-432
aaatccgaaaaatcacgcgaccgttctgaatccagcctaaatccccaaaaaccccacatactccggcgtgctgcccttcatggacttgatgagttcgatgagtgggtttttgtccgtcgatttgttcaacagctcgcccccgtggtcgaacagcgttttcatgtacaatgggctgaccgccagcagcgcgaccattgacggcgtttcgcccgcattgttcagcgaattgatcaacgccctgcccgcctcctgttcaagcagtgtctccaacatttgggtggacacccgggcagcatagtgaagctgaaaatgggaaaaatatgggaaatttgtttgaaaaaagcaataaaatattgaggatgtgctgccattcccaccgatgttaccaaatttaaaaagtaaatcgcaaaaattcgattttacaaaaaaacgaaaaaattttctatataaaaatattaaat

SEQ ID NO: 96377 - DNA, 497 bp, Heterodera glycines
  SCN-specific regions: Sequence locations=1-59,81-386,409-497
cttacaagccaattcgtgtttccgacatgcccattcaattatgcgaacatggccgtgtcatgcccggcccgtttattcggggtgaaataaaggcggtgaacacttcggctgcccgacgcctgatcagggtaattgtcgagtgattgggtattttacacaacgccttttaaggaatttaatgtgaacacgactttgtacacggggtaagtgcatatgagatgacgacataatattaaatttaaatgcccattttataaagagctaacatctgtgtcaactgctgctcaagacttcgtgatcaccaagaaactaggcgaaggggacggacagaggcgattttatactaccccgaaggcgctactttgtttatcaaattggtttctaattattctttttccctttacttttccttgatttttcagaatggggatgagaatgatgggaacacaacaaagggcaagaaaaccaccactggaccatccgcggcagtgacgcgt

SEQ ID NO: 96378 - DNA, 161 bp, Heterodera glycines
  SCN-specific regions: Sequence locations=1-11,52-161
aatacaaacagaaattaaaaacagaaattaaaaattttccaagaaaattaaggttttttagggtccggtggtgccgataaaagccgccgaaaaagttttgatgatttagtgcaattaattacccaaaattgtacaaaaactgctatttttgaaaaaagatt

SEQ ID NO: 96379 - DNA, 474 bp, Heterodera glycines
  SCN-specific regions: Sequence locations=1-474
attaagtggtacaaaatgagtattattgacattgacgctgaacaaaataaccattcttttgctgttgattctcagtccaacaattattttttggtcggccgcggcggtgacaaatcgattttactcaacgaaacgagcggcaattcgtatgctttcagtaatgtgcccacattgccgtccgtccattaccttttcaaaaacaacaaaatccactttaacggcatcttctcctatgaaatccacgagttcttccaatgttccattgacaacgctcgcacattgtactccattcgcgacttgaaagagttcgccaaagcctgcggcggtggcactgaattaataccattttttggctacgctttgcgcatcgttgtcgaggcgcccatcgaattggggacggacacaaaaacggaggaggacgatggccaacagcagaaacaatggggcgagtgcgcaacttttgggagtggaaag

SEQ ID NO: 96380 - DNA, 482 bp, Heterodera glycines
  SCN-specific regions: Sequence locations=1-482
tggccaccgtttggagcaaattcgcttctcagctcagttcttggctgtcggaaatgccttcggaaaagcgaaggggtcgcgccgagacgaggccaaacggtggggacggagttgcgggggtgcgcaattcgcggtcacttagcgcactcagccgacggcacaatttggtcagaacgtcaaaaagctcggagaatttgcaccgaatcagcctattgtcgacagcgacgacaattggcaatggacaacagagacaaaagccatttttggcacaattcggactcaatgggccaaatgcccattccgaggaggggtcggtgccgtgccaaaacagccgaaagggatcggtcgaaggccaccaaagtccattaacaccggcaaggacgaagacgaggcgatttccattttttggcaaagaaaacgaaacgacggcagcgccggggggagagggcgaaagcggatattcaagcggaagttcgtcgaga

SEQ ID NO: 96381 - DNA, 668 bp, Heterodera glycines
  SCN-specific regions: Sequence locations=1-150,172-493,567-668
aaattagtcaaaatacatgtcagattcgtgattagcgacctttaaaaccccggataacaacacaaaaaaattttgcaaaacaaaaggatcccccctttttaaaaaattttcaaaaacgaggcaaatggagcgtgaccgtattctcttccaacgccaacgctttcccaccgtcgcctcaattcaccatcagccggcgacttcgtccgcctccggcgttttggtgccaattccgacgacggacggcgccgccgctgtgcccggcagcgccggaggctatcagaggcgatattcgacacatcgagaacagcagctgcagcagaggaacagaagggacagcaaattcagcaggcgtttggccgtttacacttcaccgccagaagacagtgctgccggggccatttcacttcggccgctgaacactacaataatcagcagttcgcccagaacggggagcagcagtgacgccgaattggacacggacgaaattgccaatgcggcggcgacaacggagcgacgacggcgactgcagcagcgacaaaggcggcgactgtcggcggacgacggcgagtcgcaagtgatcgccgcgagtccatcacggcggcaattgcttacacaaccgctgacgaacccggacgcgggactaatcccccaaattgacaagccaatgt

SEQ ID NO: 96382 - DNA, 476 bp, Heterodera glycines
  SCN-specific regions: Sequence locations=1-369,391-476
ccaagcgtatgaagtgagtggacagaggggcagaaccatttatcttgttttcacattccatcggtttttcaatcattaaaatttcacagatggaacagccggacatcgaattggagctgcacttgcacgggctgggcatctccctggtcaacaacttgaaaagcgttgaagtcctttacatggtcattgattcattcactagtacatatttaattcaatatcaaaatttaggccatgtctgcatttttacagaagaaaagtgacgaagagtcgctcaaaatggccaccggtttctggtgtcaatatcgtcagaccactcatcagcagacgcttcacgtgaaattgcacaatttccaaatggacaaccaattgccagcctccaccttcccctcattactcgccatggtaccacagccgaaatatatggttaaaaatggttgtttatttaaaagtttttggcataaatgttacaagtt

SEQ ID NO: 96383 - DNA, 585 bp, Heterodera glycines
  SCN-specific regions: Sequence locations=1-585
ctcgacttgagcatcaacagcacggtcattctgcgtgacgaatggcttctgctcggtgcccaggagggactgttcgccactccgatgagtccgcaacagttgcgcgcccctttccgaattgcgggcgtcagctgcgtctattggatggagctgttgcccgagttcgacatgctcctcgccatttgtggttccgcccgccaattggccgtcatccatctccaacaaatccaccgcgcattctttgttgcacaacagccgacggtgtcctgcacaaacattgccaacatcgaacaatgccatattgcggttgttagcaactcggaacatcaccgcgacaaacggtccttcccctccccatcactcttcgttccctcttcccttatccattgtctgtttccatttcagtttcgtttacattgccacaatcgacgaaattgtcgtgctccaatacgtcgccaaattgggcttcttttctcccgtcgctcaaatcaaaacggaggagccgtgcacttgcatttgctccgcttcggttggtttcgttttcggggccgacaattttcattttgcgcgatttgatgacaattt

SEQ ID NO: 96384 - DNA, 519 bp, Heterodera glycines
  SCN-specific regions: Sequence locations=1-204,226-328,372-519
tgcacttctcgctttgcatcggcccacccttcccgaacgtgacccttgacaaaaaacggagtatttttcggatgccaaacggatcatcgattacgtgttggtctacgaggagaaggaaatgacgaacagcaactacaacaacaattgcgatgacaacaaacaacgcgataattcacgatcatcccccaacggcacgcacaaaaacagttgtttctctgctccgtctgagtgcccatttcttagccggtcttcatgcattggaacggctctgacaactttccatggatgccaatgccatcggcggaggggcgaaagacaacgcaaagggcggagagacggcagacgccgagctgcctctgcgcagtgcttccctcgaaaaattggatctttcatccaatgccttgcgcagagtgccgaccaaattggtggcccattaattgcattccctcaaaattttgagtttggcggcgatttcaatcgaacggatggaaccgaaattaatggccaatttcagcgcat

SEQ ID NO: 96385 - DNA, 555 bp, Heterodera glycines
  SCN-specific regions: Sequence locations=1-354,377-555
aagctggagctccccgcggtggcggccgcaatcgatatagtggatcccccgggctgcatttacttagcacgagggtttgaggttaacattaatgagcttaatttatcatggattttacgggaggaaatacgccaaatttgtttgaggtgcttctgcgaaatttttgttccgagtcgtcttcaattcaagaaaaggctgtttcctcaattccttcaattgagcaaagatttgctgaggttgaaacaaatgaatttaaagcagcgttcggtgaattgtcgggtgggacgcttcgtttggttgccgatgatcgtccatcaacttcttcagaggccaatgatcaacagtataagccgattgaaattgtaattggtgatgacgctgagattgttcaacagccctcttcaagttcttctctgatcagttcccatcccgagactgtccaagatgcgaaggtttacgcgaggatacgcgaacttagggaggcggggctgtggagcgcgacgcgactgccaaagtgcgaagacccgccgagacggaaattgcactgggattatt

SEQ ID NO: 96386 - DNA, 730 bp, Heterodera glycines
  SCN-specific regions: Sequence locations=1-128,150-692,714-730
ggagctccccgcggtggcggccgctcttcaactagtggatcccccgggctgcaggaatccggcacgaggatgacacattcggacaatctttggctgatgatggcaaaagtccgacgatgaatagcgattttatttttgttggtgtgttaagtgcgcaggtaaattgatttaaaaaaacaattcctgttgagttaatccatcgattataccctttttttacgtttttttgataaagcatttgcttctccccgtccccacagcgttttctcgacacgcgtgcatttcaaatttggcgcagttgggcgcgccgagtgcctggccgcgtgctgttctttgtcgccgacggcactgtgctcagtgcgcgagtgcgtgcggcgcgcatgccagtggttgtgttgcgtggcgtcgatgacgcgtaccctccgcagaaaaaagcgtttgcaatgctccgctggatgttcgacaatcagctctccaacttccattggtttctgcgcgccgatgacgacctttacgtacgcaccgatcagttaaagcagtttttgatcggcatggaccctgacagagcacatttcatcggccaggccgggctcggcaattccctggagtatggccaactgtcgttgggtgcccaggacaattactgcatgggcggcccgggtgttttgttgtcacgtgaaacattacggcaacttggcccccacttggaaaactgtttacgccacttggt

SEQ ID NO: 96387 - DNA, 697 bp, Heterodera glycines
  SCN-specific regions: Sequence locations=1-80,103-116,143-697
gtttagagccaaaaaattctttactctattaaataaactcacttattttgccatggaattaatcagaggcgtgaccgacagaatgtctgcaatgtgtttctaaagtcatgcaaaagcgtgcggctgtctgtgtgcttgttggtgatgaagacccgaatgtgaaagggaagattaacttcatccaggagaaggatgactctccggtgaccatccagggtgagatcactggcctttcgcccggaaaacacggtttccacgtccacgctttcggtgacctgtccagcgggtgtatgtctgctgggccccacttcaatccgacgaacaaaacccatggtggaccgtgaggatgagacacgccatgtgggcgatctcggcaacgtgttggccgggcaggacggagtggcaaaactcgatttcacggacaaagtgatttcactggtcggtccgcacaacatcatcggccgcgcgcttgtcgtgcacaagctcgaggacgacttgggccgtggtgaaggactcaagaagccggagagcatggagactggcaatgcgggtccccgtttggcgtgcggagtgatcggaattgctcagtgatgggggaatgacgaccataagcggaagagagatctgattattgacctatctcattttgtcgatacgacagttattcaatttgtaagacatgtttaaacattcaaat

SEQ ID NO: 96388 - DNA, 549 bp, Heterodera glycines
  SCN-specific regions: Sequence locations=1-164,187-352,382-549
aaagctggagctccccgcggtggcggccgcttttcaactagtggatcccccgggctgcagtttccggaacgagggagcaatgatcatcaaagaatatcggctcgttttacctatgaccgtcgatgagtatcaaatcggtcaactgttttccgtggccgaagcatcgcgacaggagacgggcggcggagaaggtgttcaggtgttgcgcaacgaaccttttgaaggggagagtctgttcaatggccagttctcttccggacaatatacgcataaaatttaccatttcgattcaaaagtgccgtctcttctgagagcgattatgccaaagggttcgatgtcggtccatgaacacgcgtggaatgcgtatccgtactgtaaaaccgagctgaccaacccggacttcatgaaggacagctttttcattcggattgaaactattcatctgaacgaccgcggcaccactgaaaacgcgctctgtctgacgacggatatgctaagtaaacgcgaagtcgtgcgcattgacatcgcgaacgacaaagagtttataaa

SEQ ID NO: 96389 - DNA, 341 bp, Heterodera glycines
  SCN-specific regions: Sequence locations=1-41,64-229,253-341
tgagtatcaaattggccaactgttttccgtggccgaggcatcgcgacaggagacgggcggcggagaaggtgttcaggtgttgcgcaacgaaccttttgaaggtgagagtctgttcaatggccagttctcttccggacaatatacgcataaaatttaccatttcgattcaaaagtgccgtttcttctgagggcgattatgccaaagggttcgatgtcggtccatgaacacgcgtggaatgcgtatccgtactgcaaaaccgagctgaccaacccggacttcatgaaggatagctttttcattcggattgaaactattcatctgaacgaccgcggcaccactg

SEQ ID NO: 96390 - DNA, 479 bp, Heterodera glycines
  SCN-specific regions: Sequence locations=1-479
agatggacaaagatgtcaaaccggaggacccatcggtttctttcggttttttgtccgaggaagcgcgggaagcgatgctcaaaaattgcctcagcggtgcagtcgactgcaaagcgcagcccttcggaatgattcaaaagcggacgatggttttacagcacgaaatggacttcatgagaaaagtgcgaccgtaccaatcaggcgaaatggtacaaaagagagtggaaatggtgcagaaactgaagcaaaagatgctcgaagtggcaggccttgacgaacacgttcaacccgtaaacgacggcaccttccaacacgatgtgctgcttacagagaaacaatctgaagaactgatcaaagcattaaacaacgtgccgaaaccggcgaaaaagcttcaccggtacgggtacgggcaccgcttcaagcgtgcctcgctgtttttggagcagttcgcggcacaaaaatggccaattggacagcca

SEQ ID NO: 96391 - DNA, 474 bp, Heterodera glycines
  SCN-specific regions: Sequence locations=1-15,37-474
gaaggctttgttgatgaacatcatcagcagcagcacattagcactagtgttcatgccaatatgcaggaagacggagctgaagttttgcaccacgaggacacttcgccaacccacaaaaaccacgagacagcgacgggcggagagaagggcggaggccaaggccaacaacacggggacggctcttttggggacataatggtctaccaggcgattcacaccattgaatttgcgctcggctgcatctcgcacacggcttcctatctccgtctttgggccctgtccttggcacatgcgcaattgtccgacgtcctttggtcaatggtgctccgcaatggattcgtccaaagcggttacctcggcgccgtcatcacttatctgatcttcattgtgttcggcacactcactctgtccatcctcgtgcttatggaaggactgtccgcctttttgcacgcgcttcgtctccattgggtcgag

SEQ ID NO: 96392 - DNA, 525 bp, Heterodera glycines
  SCN-specific regions: Sequence locations=1-41,64-101,123-180,255-525
ctcatccgcttttcctcctcctcaacttttcttctctcactgctccaaattcacttccaaatttcctcttccaaaatgcgttgctcccttttgctgccccttctctttgttctcctcccacttttggcaaattcgtgcatctctcctccaaagaaagagtgttgctgccagccttgttgccagcagccccaatgtcgccaccagcgcagcagaataataacagtaacaatcagccccagcagcagcagcagcaggaatcagccgctgagaagcttgtcacttcattcatgcgatacattggtcaacgtcccggtcaagatgggcatgccttggtgcaagagtttgtccaacagtctgctattcctgtccaattccgttcattggttgctgaacagcttaatcatattgtggcagctgcgcgcgcgaatgtgtaaatttggagagagagagagacccacagagaaagagtgcctcgctgatctttttttgcgttattttattcattgattatcatttgaattaaat

SEQ ID NO: 96393 - DNA, 636 bp, Heterodera glycines
  SCN-specific regions: Sequence locations=1-548,570-636
aaagaaaaaggccaattggacggagaaaagtgggacagagcgggcaccatcatggactttttggcatccctcttgactcagtccaaaagtgcgtttatttcctcacaaaatgccgagtcgtggggtttcgtctccgactacatttggaccgtccaacaggcccatttccccactcatttgctgccctccatcgtttcccccggcactttcattggccgcacttcgcttcccttcgcccatttgccaaaaggtgtcccagtgactgtgcccctgggcgaccttcaagcgtcgcttttgccctttctcagtgctggagtggcagctcttcacattggcaccgcttcgcaaatagcctttgttagccagcgattagcagaagaaatgtccccaaaagtggtgcttcccaattccatccgtcgcgaccctttctttgacgacgactttttgctggtcgccccttcacttaacggtggcaatgtttttacgggcctttttcaacaaattgcttcttggtccgccgatttgttcggctttccttccgatttctctcctttgtccttttctgctgccttttctctgctcgaccgaatatttaattcaccaaattcgcagccaaatgacggcgaagtgccgccg

SEQ ID NO: 96394 - DNA, 599 bp, Heterodera glycines
  SCN-specific regions: Sequence locations=1-29,56-599
tttttgtgtgtaaataaacactaattacctaattaatattttattaattaataatgcaacaattttcaatttgatcatcgactggctgtacatatatccttctatgtcagatcatccacgtgaagagaaacgaatttttgagaaaatttttatctgcaatgacattttgttggattcattgcccttttgtgggcacgcaaaaatcggtttggaatttgcggttgtctcctatagatttgatgtagtggtggacactcatcttaaacgaagaaaatggaagcttggaagtttgagaattgaacgttccagcacgaatgacggagcggaaattgtcaaatgtaacagtgacaagacagttaaacggttgccaattccattaaagccgcttcctcccaatttgatcggtttcaagcggattgccgtttatcacatcaaccgaaaagtgatcgcttttctccaccgcattcaacgccttttcgcaacagatatcacgttggaattggccatattttttagacaacgccaaagttgggatgttgtgacctacgggatttggcccgcgctgaatgccgccgggattgttaaaatccgtttccata

SEQ ID NO: 96395 - DNA, 586 bp, Heterodera glycines
  SCN-specific regions: Sequence locations=1-9,31-586
cagcttatcagaataactttcccataataacacatcgccaatttggacattcctcatcagcagcatcatttttgttgagaaggattgctgtgcttgttctgctactgcttccccataatgacggatccccaaggctgcccgggccgccaatcttcgaggccatttcccattatccaagcatttgttacttgcctccagaatccggcatgtgcccgccggcgacaaatcggacaacggacactgatcacatcaaagtggcggctgctacagtagacgattcgcgcgctaccgtaggcgaggggcttgcggagggtgacgacgacgcttcgcaactgcgacacgcgtcaacaccgttgctgacgcgctactattttgacgcggtcaccgctcaatgttatccgtttggtgcgcagacatgtggcggcaacgaaaatcgcttcgaaacgaaggagaaatgcttgacgaagtgtcgcattggcaccgattgatcttttcaaatttttatgtgattcaaattttgttccatcattgcctcgtttatttgacattttggcattcttcagactataaaaaccgggttggcaaa

SEQ ID NO: 96396 - DNA, 482 bp, Heterodera glycines
  SCN-specific regions: Sequence locations=1-482
gtagtgacctcagcattggatgatctgcagaggaaagcgcgtcttttggaaaatgaaatcgatgctcaacttatttctctgaacaagttcaatccttcagacgctctttcgtcttactcttacaactcaaatcagacaaagggtcaaggcaaacgggcggtgttcgattcgttaacaactgacattgaaaataaactctcaaaattgagcgaaataaacgatgcgatgcgcgattgctttgagaatgatatggccgagttcagcaaaacttccgtccaacacattgtgcgacgacaccgcgacattctcagggattacagcacggaattcactcggacaacttcgaacatcggaaaccaactgcacagagaagaattaatggccatcgaatcggagtcatcggtgaataatcggtgcaaaccgacggactatttactaaaggaacacgaaagcataagcagctgtgatcggcttttgaatga

SEQ ID NO: 96397 - DNA, 461 bp, Heterodera glycines
  SCN-specific regions: Sequence locations=1-461
ttttcaaagaaattggaaaatgcgaaacatccgatgattgtcgtcggagcacaagcatttcaaggcgaaaactcctcgtccctccttcaaaaacttcatcaattggccgaaaaactccgttcaacttcacagacgaaacaaaacaccaagggcaacggacagccgaaagtgctcaatttgcttcatgagttcgctggccacgtggctgcgtttgaccttggcttccgtcccttcaatgaattaaattcggaagtgaagagatccatcaaattgctttatctgctcggttctgatgaaaaaccaatttcgaggaaagaattccacccggatgttttcgtcatttaccaaggtcaccacggagacaatggcgcagaagtggctgaccttgttctgccggggggagcgtacactgaaaaagaagcgacttgggtgaacatggaaggccgtgcccagaggggtta

SEQ ID NO: 96398 - DNA, 482 bp, Heterodera glycines
  SCN-specific regions: Sequence locations=1-482
ggaaaaataaaattaatttggcctacagttgctgaagagctacaaactagtgctgaacgtcgtcgccttcagcgcgaccgcgagcagcggacaaaagcgcgcatggcgggcataaatcgaaccagcacaactcccgacgagaacagcaaaccaatggagttgacggacaaaggcaaaacacccaaactgaagcaacagacactcagccgattctttgggacaatgacaaaaaacagtgctccaactcccgttccaccgatgggtcaacaacaattgcaaaattacaccaatcctaagcagaagcagccaaggaaacgcagcagtcccggctcattgtccacttcaagctcttcgtcaatcatcgcaatcagctcaacttctcctaccgctgttcctgattcagtttcaccacctttccgtcctctggagacaactgggcctactaacagcaaagccactaaattgcataatgctgaagaaat

SEQ ID NO: 96399 - DNA, 638 bp, Heterodera glycines
  SCN-specific regions: Sequence locations=1-317,339-638
attaatattttaattcaactttgacttttcattcaagaatgtcaaacattgcctttataagaattcaaaaagaatgcaaagaaatcattttatgtaaagagttacaagaaaatggtgtaacaattgaacctgtaaatgagacgctttttgaaatcattggaaagatacgaggtccaccagatagcccatacgaaaacggaatatttattttggacgttaaaattccacaagaatatcctttccaacctcctaagactggtgctatatgtttggatattctcaaggaccaatgggcggcatctatgactctccgaacagtgcttctcagtgtgcaatcgttgttactttcaccggagccaaaagatccacaggatgcaattgttgcgaaacaatgcttaagtgaccctgcattattcagatccactgcaaaatattgggcacaacattatgcaaacgctccgggggaaatagacagaaataaggcaaaatgtgtgtccacattacaggagatgggagcaagtaaggacgccagtatatccgctttaagctgctataattggaaccttgcaaaagctaccgaatttctctttacataatttattgtttaataacatcattttgaataaatgacgccttac

SEQ ID NO: 96400 - DNA, 466 bp, Heterodera glycines
  SCN-specific regions: Sequence locations=1-466
cgcagaaggacattttgaaaatggccgccgatcgcgccgctttcattgaccaaagccaatcccttaacattcacatagcgcagccgaactatgctaaactgagctccatgcacttttacgcctggtcattgggacttaaaaccgggatgtattacctgcgcactcgtccggctgtcgatgctgttcagttcactgtggacaaaatggcccttcggggaacaattgccaaggacgaatctgtcgaaatcgacgttttgaaagacaaggaaaacatttctgccaattcggagttgcgcttgccgtccaaacgcaaatacaatgaacaattggaggagagcgatgggtgtttgatgtgttccggttgatggattgtttttccatttatttgattgtatttttgggcattttttttatttggctttaaccattggttttcgttaacatatgataaattgatattttgctt

SEQ ID NO: 96401 - DNA, 475 bp, Heterodera glycines
  SCN-specific regions: Sequence locations=1-475
aaaatggatcatgggccagcgatgaagcaaagtaccctcacttttacgaaccgattcgaaaaacagaaagtgtacggacgtgatggcactcttttctttgccccgtcagttggcactttttaaacgaacggaaacgattgtttgtgatggcactttcaaaatggcaccgcgaggcatttatcaaatttaccgagtatttggatttattgcacaaacgcattgtgttccattggcaacagctttgttacgtggaaaatcaagagtgctttatgatcaattttggacaagattgcggcaggaattggacaaaattcccggcattttaatgatttcccaagcgaattttgactacgaatctgcgtcagtgaatgcattttgcgatgtttttccaactgtcagaccaaaaatgtgcgcgtttcatgtgaagcaagcgataaatcgccgaattcaatcaatgggatttatgcaattgtac

SEQ ID NO: 96402 - DNA, 474 bp, Heterodera glycines
  SCN-specific regions: Sequence locations=1-474
gcataacattgattttccttgatattcttccatcatttgggctgagacaatgatggaaatgacaattctcgggaatcggattagcattaccgcggacggcgccaaagtgtcgccatttggcagcaaaatggacatgggggactattatgttgaaaataacaagctgagaaaaacacggggattgggctgggtaatggccgcactttttgtggtcgccgacatggcaggcggaggcattgtggcattgccaacggcggtggtccgatgccagttcttttccggttatgctgggccaatgttgggaaatattattgcgccgtttcccggtttaccgtactcactgtcgaaaaccgtacgctgaaattggccttaaggccctcgggccaaaaattaggtgactgccatacagtttcaaaaatacagtatcaaattgtatctaaacattgtctgtatttgccaccatttccagaacta

SEQ ID NO: 96403 - DNA, 479 bp, Heterodera glycines
  SCN-specific regions: Sequence locations=1-214,244-479
cggagggaaaagagaagcatcggcaaaaggacgacgaaaaatttgggcaaaaagaggcgaaaggatgaagcagtaacagcaccgccggtcactggcgttgtgctgccgtcctccaccaccgcagcggctgatgtgccaccgccgccgtgcccttcggaaaccgcaaatggccaaggcccgtcaacgacgacggcaaatgccaaatcaaccaccaccacagccagcaacagcaacgagcatcaggagaaggaggaggccactgcgatgttgctgaagatgcaacttggcacgccggtgccgatgagtcacaacgtttgcgctgacaagcccgactacgcggtggagaagcccgcgctggagaagtggtccattggtattcaagcgttccaacaccaaccgcccgcctcctccaccggcttcttcaaacggatgcacaaaattgtgaaaagtgtgcgcaaaaatggccccgcaggcgttga

SEQ ID NO: 96404 - DNA, 426 bp, Heterodera glycines
  SCN-specific regions: Sequence locations=1-426
ctgacatctacggcttcatcaacaatatctcagatcgtatatcacgacgcgtacgtcgcaagcgcccaacggagtctggggtttctggtgtcagcggcgcaccgccggagactcggaaggacgacaaggcgaagggcggcggctgctccaaaaagtgtcgcttgcatcatcgtgtgcagtattctcacgctcattgtgctcgtcatcggtggactcgtcctgcccgctgtcctgactgccttgaaacattcaaaaatgctcctctgttgagcctcttcgtgggcaaaaagaatgggggcgtggatggtgaggagaaagaaaccgaatgataagcgactctggtgtcctattgtgtggctatattgttcaataatctgtatctgatcttattgtacgcacacttatgtgtgggataaagaaaccgac

SEQ ID NO: 96405 - DNA, 504 bp, Heterodera glycines
  SCN-specific regions: Sequence locations=1-11,33-504
gtctttggcactctctcccctttcgttttttctcaaaaccgctgaatttgccaatgccaaatggccaattcttcactttcgcgtccctttggcctttgcctttgttcattgcttctcttcatttgcgcatttcctccaattagtacacaacgtgtcaacgtaacgctgttcaccgagtcccaatgccccttctgcacgcgactgcttcgagaacagatttggcaattccattcccgattccccggcattatgaatctgcaggtgattcccttcggcaaaggcaactgcgaattcacgcgcgaccggcggatcatttgcaaatgtatgcacgggcccaccgaatgcgacctgaaccgactgcagaactgtgccatatcgtatttcccacgacggcatattggcttggtgacgtgcattcaaggactgaagaatttggacgaagcctaccggcggtgtctgtcgcggctttcgccccgcacgcaattccgactaaagcaatgcgcg

SEQ ID NO: 96406 - DNA, 376 bp, Heterodera glycines
  misc_feature (355)..(355): n is a, c, g, or t
  SCN-specific regions: Sequence locations=1-208,230-376
gcaagaaactcacattgttctcggcattgcctcgctgtgctctctgctggcgattatcgccaccgtagtcactctggcatcgctttactccggagatgaaccaactggacaaccaaagtgcgcgacggcgttgaaagctttccgggtaaacaccgacctggtttggaattgccctaatgggacgtccaaaaatcctgggaccccccggaaaagggccggggaaacccccattaatccctttttttgggggcaaagttaaatttccccggaatttgcatttgggccccccaaaaaggaaaaaatggccccttggccacctgtgggccccggggacaccttgggaaccccaaaaaangggggagggaagaattccccc

SEQ ID NO: 96407 - DNA, 670 bp, Heterodera glycines
  SCN-specific regions: Sequence locations=1-670
gtccatttaagaacccactttccaataaatcacaatggctttcattggatacggcgctcttacggccgcgctgagtggcatcattttgtacgcaaatttgcccacccgtctgaccattggcgccattgtgccgaccgttgaatttttggccgagacccaactgaaaaagttggaacccggccaagctgtggctggaccacaaattaaggctagcgatctgttcaatgccggccatcctctgcttgtgatggctgtccgtcgacctggctgcgctttttgccgaaagcaggcgagcgcgttgtgcagcgcggcgagcacacattttgcggacaaaggcgtgcgtgtggttggcgtagtgcatgagcagcacggcgtggaccaattccgcccatttctgccctgcgcggacgcaatttatctggatgaggaaaaacgctttttcggcccttcacagcgttggcttccgctttggatgggctttttgcgtctgtccacctatgtgaactattacaaagcgtggaaggctggctttgccggcaacaccgagggagaaggccgactgttaaggggtgtttacctggtgaatggcgataacatgctttttgcacatttggaaaaacaatggggcgacgaggtcaaaatggacaaattggtggacgcagtttcaaag

SEQ ID NO: 96408 - DNA, 653 bp, Heterodera glycines
  SCN-specific regions: Sequence locations=1-653
ctgatttggccgtcttccaattggaccttttttggacaattatattggctttcttatcgcatttgttttggcttttgcaattggagccaatggcacggcaaattccttcggcacgagtgtcggctcccgcgtgctcaccctccaacaagcgtatttactcgcctccattttcgaaacgatgggcgctgcccttttgggctcaattggcggaatttggacatgaatttggaagaattctgaggacaatgcacgacgccaatctcatccacggggacctgaccacggccaatgtgctcgtcctgactcaacggggaccagtcgaattggcactgattgactttgggttggcccaattctcatcaaagccgggggacaaagcggtggatttgtatgtgctggagagggcaattcggagtgcgcacattggcatgggcaaaatgatggatgccattttggacgcatacaaaacagaagggggcggaggggacgaggacggaacgaatgccaaaccggtgctgctcaaattggacgaagttcggcgcaggggcgcaagagagacatgatcgggtagtggagacggcgagaaaaagagggggcgatggacttttagaaaagaagacggcgagaggaagagagggacgaaattgaccatt

SEQ ID NO: 96409 - DNA, 504 bp, Heterodera glycines
  SCN-specific regions: Sequence locations=1-504
atatttatataataattatctcgattactgaaacgatacactgataaatttccatacataatttagcttttagttcgtaaaatgctccgttatgtctgcctttttccaaggaggtcgtttcatttcagcacatttttgcccaaggattactacaaaatattgggcctatccaagacggccaaggagtcggatatcaaaaaagcatattacgagatggcaaaaaaataccaccctgacgtcaacaaagcgaagggcgccagtgaaaaattccaggaactctctgaagcgtatgaggttcttggggacccgaaacgacgcgctgaatatgaccgttttggggccggcggtccgcagcccggcgcggcctctggcagccccggaggcccacaaagtgcccgcgactttggctgggagttccactcgggcaaatcggcggagcaagtgttccgtgacattttccgcgacttcgacccgttcggcaatgccggcgcgtttggctccggc

SEQ ID NO: 96410 - DNA, 626 bp, Heterodera glycines
  SCN-specific regions: Sequence locations=1-626
aagtccattcaattctcaatgcgcaggacggagtggaaggccggggcgactgtgcccatggaaagtgcggagaacacctttacgtgcccgtccctctgaacactctgatcaaaaaaccgagcacggacgaactgcggccaagcaaagtgacattacacgaactgtgccgtgagggcgatttgttcatcgcggcacgtggaggcgcggggggacacggaaacgcattttacgtgtcgaatttggtgagaaagccgttgaaagcggaggagggcggacaaggcgaagagatgagctacgacatcgaaatgcgcatcatggccaccgccggtttggttggcattccaaatgtgggcaagtcgtaagccttctcttccgccttaattggtcactgtccatctcttcattattacaattagcacacttttgcgtgcgatttcgagggcaaagcctaaagttgccgcttatccgttcacaactctcagcccaagcgttggaatggttcagtacggcgacttcttccaattggcagttgccgacattcccggattggtgcaaggcgcacatcgcaacgagggactcggcttcagtttcctccggcacattgtgcgctgcgaatgtgtgctctt

SEQ ID NO: 96411 - DNA, 550 bp, Heterodera glycines
  SCN-specific regions: Sequence locations=1-114,136-443,503-550
aaagctggagctccccgcggtggcggtcgcttcagaactagtggatcccccgggctgcatgacttcagcacgaggttctcattcaaaagtgcatttcggcagaataaaaaaccttgaaaatgttggggatgatgaactgtcaaacggagaattacgagttctacgcatcgccgccctcctcgtcggctccccaatttcgtagccatcagcaaccggatgatgagctgttcaacaaccgcaaacagaagaagccacagattacttacacagattgtcgccgtttaattgacggcaaaatgggagaagcatcgcggcaagagccgacaaaactgtggaaccgcgtcattgtggacaatttgactgcgcgacggttgagacgcgagcaaagcaataggaaagaggaggaaaaagcgacggaagaaagagacgaacggcacaaagatgaggaggagggggaggaggaagaaaagcagagggaaggagaggaaaagcagggagaggaaatggaagaagcaatgggcacgagtcggaaacaaagtgagaaaagaga

SEQ ID NO: 96412 - DNA, 427 bp, Heterodera glycines
  SCN-specific regions: Sequence locations=1-427
gacacaacggaaaggacggagcccccgggagggacgcgcagtccatcccagcacctcttgaagagccatgcatcatttgcccgcccgggcccgccggtccccaaggacccgccggaccgaaaggacccccgggaccgaagggaagcccaggagagccgcccaaagacggagtaccgggagagcagggaatgcagggtcagcccggtcctgtcggacgcccaggccgcgaggggccgcgtggagcccccggacagcccggacgactcattcccgtccctggaccgcaaggaccgcctgggccttctggacctcccggagaacaaggaccgaagggtcagcccgggcccgacggacaatctttcgaaggtcctcccggaccccctggagatgctggtcgacctggtcgagaagggcgtcccggaggaac

SEQ ID NO: 96413 - DNA, 476 bp, Heterodera glycines
  SCN-specific regions: Sequence locations=1-3,25-85,107-476
agctctaattcgattcaaagttttgcaaaatcctaatttacccaatttacattaatttctcattttcttacgaatgaccgaagaatctgtaatcctcagtttttcctgtctaaatttgccacttgaatgttctgatggctgccgattggtaattacagcgcgatcggataatgacgcaaattttgttgagattggccaaacagaaacacggaatggcattaacccgaaattcgaggcacgggtttcgttgcttctgcggttggacaaatgccaacagttgcgcattgttttgtactccgtcgatgttcagtctggtcttctgcggacactgctcgccgacgcgcatgttttgctgctggcattgctttgtgccggttctaagccggtcgctgtgccgctggcacttcactaactacaaaaagccccacaccaacagtcgttggtgctggccgaagccgtgcagcaggaggaggcga

SEQ ID NO: 96414 - DNA, 842 bp, Heterodera glycines
  SCN-specific regions: Sequence locations=1-842
ttcaacttttctcgtcctttgcccctttcgctatgctttccctcaatggcactttccctcctcagtctcttaaacccttggctttggcatttgttctcgatggcgggattggttcccaattggaggagcttggctatcccatcaataactcggtgatttggagtggggaagcaataatcgatgcgcccgaccttttggccaaatgtcataaaaagtttatcgatgccggggcggacataatcgagacgaacagttaccacgtcagcattcagaaactcatggaaagccggggcttttcgctgggacaggccgagtccatcctccacaaatccgtgctgattgcccgtgaggcaattgctgcttcgggtcgtccggtggccctcgtcggtgccgtcggtccttacgccacctatttgagggatgcctcggaatacaccggtgcttacgtgaaaaagcccgacttccaagagcagaccatcatcgactattatctcctccaatgccgtcctctgattgccgcaggagtgaccacgctgaacttcgagaccattccgtcggtgaaagaagtcgaatgtgtggccaaagtgatggaccaattggacgacactgtgcaggcgtgggtttgctgttcatgtcaggacgggaaaaggacgcgcagcggcgacgcatttgcggacgcagtgaaaatagcaaatggacacccaaagattgtagcgatcggtatcaattgcactgcgcccgatcatatcactgaattgctaacagaggcgaaaaaagcgaacaattcaaaggcattggtggtttacccctacagtgggcaagtgtacaacgcggaaacccgc

SEQ ID NO: 96415 - DNA, 609 bp, Heterodera glycines
  SCN-specific regions: Sequence locations=1-158,180-505,527-609
ttcagcagctgaatgtaaattgcataaatacgacataacataatgacgggtgtttgtgagttatcggaaaaacattccaaagttcggttacatttgccgctggaattgcattgtgagctgctttctgcgcttccctttgaacatgccgctcgtctgcttttactttctaaagcaattgccaaaaattgcaattctctcgtgcaaaaacaaaaaaaagggtggaaggtcttttccaaaaattgtatcgacaaaattatgaaagtttatcacccgctcgtctctccaacactgaaaagcattgaagaggaacatcattcacttgagcattcggaagcgcaccagcaagacacatatcttaataagcgtattcaagattctcgtgccgaactttcctttttcgttggtgccaatttggtgcggcgtttggcaaaatatgaaacggcaggccaagtgatgaccgaactgttgaacagcgtcgttaacatgcaccaattcattgaaaactttaagaagcgaatgaaagaaatggacgagcgattcaacgaagtcaaaaggcttgccgaccgaataaagtccgatttcctaccgcgcgacattccgtcccaaatg

SEQ ID NO: 96416 - DNA, 415 bp, Heterodera glycines
  misc_feature (414)..(415): n is a, c, g, or t
  SCN-specific regions: Sequence locations=1-327,354-415
gccattttatggactttgagtttggcggaggatccggcggaggcgactcgattgttcacaaaatttgtcccggcgtcgagcgaaaagtgttcgaaggctgatttcaatcgcaaagccatgcctactggtagaaagccccacacccaacagaaaggggccaaaattaaaggaaaacggcgctgtctttctgtctatcgctcatcccacttaataatttctcacaggtgcaacttcaccggcctcttcaacttctcaatgaactgcttcaaaaacccgagtgaatactcattacagagggatttgcagtgggtcagagtggactaacgaatgaagatgatgatgacgatgatgatcattgtgtctcaaagacattgtactaatgtaatttgtctatacaataaacgagaatattcnn

SEQ ID NO: 96417 - DNA, 927 bp, Heterodera glycines
  SCN-specific regions: Sequence locations=1-43,65-171,193-927
ccgttctctccgtgctgctccaccacactcgccatcacttgtccaccgtcaccattctgttcattttcaacattctcttctcaaatgtcctttttttggcctcctttttgtgtttgtattcggacattgccttggacacaaaatacactcgcccaatcgcaaattccaacgaagaagctgaggaagactcagccgacgcatcggccgaagacgaagacacaacgacgccgcaacttttcatagccgaaatactgcaaatccatctgtacaagccgtccgaattcctcaagaatctgatccaggaaacgcttctttcgttggctcagaatggctcactgctcggactcaccaatttgcttgtgcttgttttggtggtcatcaatcgttcgatgagtggcaaaggcattcgcatttcacgtgccaaagtgattgctgtgttcgccggcgtttggctgttcctcgtcgtcagtcacgtgcttttctccgcacttcagtacttcgctgtctcgcagctgcacgaactgttggagttgaccagcagcaaccccagccaatttgcatgtcgacgaagtgccactttcatggtgtacaatgaaatcggagagcgctgcgatcggttggccgtttaccaagagttgggccactttctgctcagaggtcacactctgttcaccgttgtgctgctgtccatttctttggtcattttcgtaatcactgtgtattgccatcgccgcgtccaaaggcaacaccattttctgaatgaaaatgcgacaaatggcaaaaatgccggcggaaggagcgacggggggacggacagtgaggcgggcggaagcactgtgaggagaagacgtgactcgagcccattccgccggcgtgaaacgctcttccaaactctcgtcctttcgctcattgctttcttcctgtcgc

SEQ ID NO: 96418 - DNA, 345 bp, Heterodera glycines
  SCN-specific regions: Sequence locations=1-345
ggaaaaattatgcgacgaattcattgaaaacggacgcaaattaacgcgggaatatttgagaaaaagtgccaaagaagaaagtgccgaaatgttcgaagtgttcgaatttgtgccgattgatcatcatggcaatttcgactattctctaatggccaatttgtctttgccccgaacttcgatcgattcgtccgccggcggggcattttcaccaaataataatccttcaatatcgaacatcgccatcaactttttggccgattaccgtccctttgcctacggtgtcccaattacgcgtgattcgccgtcggccaccgtgatttcacgatgcaaatcgccattctgtaa

SEQ ID NO: 96419 - DNA, 596 bp, Heterodera glycines
  SCN-specific regions: Sequence locations=1-22,65-183,205-596
gtttgagcaaaatcacttctgatgtctttaaataattcaaatttgttggggaaacggaaggtggcgttgaacgagcgcagaaaaatttacatccaacgcgactacagccaagcattagttgtgaaattcagcacagactttcctgaagagctcgaacattacattgacagggatatttggctgaattttgtcactgatctcaaccaaatttacgcggaggcggagaaactgacggcgattgcttacctcgagaacattctcggcctggtgacatgccatctttccatgctgtgcttcaaatcattgtggaagcggaagttggaggaagcgcgggcacttttatacgaaaccaaccaacagaactttgtcaggaacggagtctacgtttgcaaccccttggagaaggggttcagagtgatcgaagtcgttctgctcgatgagccgattcctctgcctgctgttcaagacgaaaagaatgagaaaaattccgttcccaagccaattgtattgcagccgaggcaatgagggagggagcaaatccatttctatttaacaatttgccgattcatttcacaaataaatacttaattcactta

SEQ ID NO: 96420 - DNA, 623 bp, Heterodera glycines
  SCN-specific regions: Sequence locations=1-430,453-623
tgctaaaggcggacggaaaatacgaattggacacaatggcgaaagggtcgctgaacgaaacgaaagacaccgaattcgaagcgcacaacgactgttttgactttgggctgaatccggcggcgcaagactctgttcatatcaatcggctggccatgaactattggcagaagcaaggcgcaattgacgtgtggatgaagttttttgaacgggcgcccaaccgagcggagatggaaaaatttttcttctcgcagttggacaatcctttgctgggcaaagccttcaaattggccatcatcggtgaatggttggccgccaacagtttggaccagggaagttacacgccgaccaactcggaattgttggagttttgggtgtcaaagagagcgcccgaccgattgttggcatgcgagcacggcgtggtcgactacgaaattgagggctccaaagtgaaaacgaatgttttgttcgaagcggcaacgaccgcaggaaatttgccgaacattttcaaggacaaaaagtgtgccacgtttgaaaagttgcaggaggaacggttcaaacaggaagtgcacgagttcaagcagcgcgggagcggcggaggcattatcggcagcattggcaacttt

SEQ ID NO: 96421 - DNA, 991 bp, Heterodera glycines
  SCN-specific regions: Sequence locations=1-238,271-319,341-991
gccgtcgatctacggcataacggatgagacgtatcaactcatttttccccttattatgcgcaaagttatggaggttttccaaccgagtgccgttgttttgcagtgcggcgccgattctcttaacggagaccgactcggcccattcaatttgacgctgaagggacatggaaaatgcgtgaaatttttccgtgattgcaatttgccgttgatgttattaggcggcggcgggtacactcctcggaatgttgctcgatgttggacgtatgagacgtcgttggccgtggacattgacatatccgacgaacttccttacaacgattattttgaatattttgctccaaattatcgcctccatatcgacgcctctaatgaaaccaatcacaacacagaagagtatttaaggacggttcagaatagcgttttggagaatctcagcaatttgtctcatgttccaagcgttcaaatgcaaccaattcctcgcgatggcatgcaaatcgatgagtcagtggagcacgacagagcaaacccggacaggagacttccagccgaagtcagtgaccacatgacagcacatcctggagaattctacgaaggtgaaaatgaaggtgaagaccgcaggaacaggcaagaatacaagcggagaggagggaatacgacgggcgaaccgagcgattcgagggaggacaagcaggacaattcgaagcggatcaaaattgaaaaacaaccgaaggcagagcagcaagaagacggcgaactgcttgaggaagatgcaaacaccaactgacgatcagcaggaggaggaaaagcccttttaagcatcaattcgacttattttctcgtctgcgctttgaatttgtcgtccaccgtttcttattgtttcgacaatattattactcataccttttcacagcttatcaatagcgtacctccttcaaattccgaatcctcttacccgtttaaattgcttgggataaaaaaatccgattcaaaa

SEQ ID NO: 96422 - DNA, 638 bp, Heterodera glycines
  SCN-specific regions: Sequence locations=1-612,634-638
tggacattgttctgtgcagcgcggcattgctttacgttgtgcccattttggagctgaacgacgcggacattcagcgatcgatggatgtaaatgcgatgggcaccattaatacaattcgcgtctttttgcccgaaatggaagcccggggcaaagggcacattgtcgcgatgggctcaatcgcctcacattttggcgaagtgttccaaatggcgtacagtccaacaaaatttgcggtgcgtggcgccatggaatgccttcgggtggagctgagggaacgcgggctggaggacattctctgcacgaccatttacccattttatgttcgcactccgatggtcacttcaaagggactccgtccggtggcacgttggttgccctttctgacggttgaagagtgtgccaaaagtgtcgtggacgcaattttgaaggagaaagtgaacgcgtgcattccgtggtggcttaactcttttgtggcgcttaatggcattttcggcatcaatatgaacaatgtatcgagggattttctcgacattcatttcgaaccttcgaattatgaggacgggcaaaaaagcttcggaagaattcgaaattcgggtgaaatcggacgaaaacggcgccaaaaaaggggacaatacaaa

SEQ ID NO: 96423 - DNA, 812 bp, Heterodera glycines
  SCN-specific regions: Sequence locations=1-683,705-812
caataatccaggaaaaaaatatggatttccatataattacacgccctaaacatttcaatgatttttaaatatgtacatagatgctaatgcctcaacggcagctgcgtttggttagcaaaagtttgctgtttgtccatggggcgggtgccaaacaatttttgcaaggattgacaaccaaagacatggactccctcaacaatgttccgttggtttattcctttctgctcaatgttaggggacgcattttggcggattttttcatttatcgtggcaacaacggcggaaatgccgaggcttttgtccttgaaactgaaaagtcacaggccgaactgcttgaaaaaacactgaagctgtatcggctacgcaaacagatcggaattgagccactattggacaaaactgtgcttttccgtttcgatgctgaaggggaaacgacgcaaaaacaaaaggcaactatccctgaaaattcgtccaattggatggtcgacccgcgagtgcccggctttggcttcagagctattcgaaagattgaaaatgagacagcacatgatgacgaggcgtcttcctctgcgtatttgcgtcatcgattggcttggggattggccgaaggaacagaaatggtcgaccaaattccgctgaatatgaacggggacattaccgggggaatcagcttcgagaagggttgttacattggccaggagctcgttgcccgcacgcatttcactggcattgtcagaaggcggctgatgcccttccgaccaatcgatgacaaaaatggacgcccagatttccctagacggatttctgctggg

SEQ ID NO: 96424 - DNA, 120 bp, Heterodera glycines
  SCN-specific regions: Sequence locations=1-120
cgcattggaaatgatcgaggaccttagaggagctttccaacaaatgcttgtggccaacgattggatggactcggacacgcgcgaatttgctatggaaaaggcacagcaaatgatcaattt

SEQ ID NO: 96425 - DNA, 476 bp, Heterodera glycines
  SCN-specific regions: Sequence locations=1-22,45-476
ggcaaatactcactcaacaagcacagtttgaagaagcaagaaaacaatacttggaaggaacgcgtcggagtcctcatagtattgcaatttggcttctgctgattcgcttggaagattcgcgtggtcggcacattaaagcgcggtcccaattggacattgcgaagaccaaaaattccaaatgtgaccaattgtggctggaagggatccgtatggaattgcgcgccgggcaaaaggaacttgcacagtcaatgcttgcacgggctctccaggagtgcgaacattcaggtcgtttatgggctgaagccattttcatggaacagcgacacgcgagaaaaacgaaaatagtagatgctttgaagaaatgcgagcacgacccgaatgtactgctggctggttccaagcttgtctgggcagaaaggaagactaagaaggcgcggagttggttccaacgaaccgtgaaggtcgatcccgacttt

SEQ ID NO: 96426 - DNA, 552 bp, Heterodera glycines
  SCN-specific regions: Sequence locations=1-188,210-419,441-552
acgaagttgtgctgaaggtgggccccgagcagttcactgtctccaagcactttctgatgtccgtgtcgcccgtcttccacaaaatgttctccgtcgacatgttggagaaggctcagggcgaagtgagcctggaggaaaccaacggggaggagttcggcgcgtttctggacgcaatctcgcccaaaatggcatcgccaaatcctgccaatgtgatgggaatgctcaaattggccgaccgtttccaagtcgatgcgttgcgcaaccgatgcgaggcgcatctgatcaattgcgtggagatcagtctgatcgaacggcttttgtgtgcggacaatgtaccgattggaaaagctaaagaatttcattctgaaaagtctgaacggcgtcggaatgcgcgagttttacgaggagaatcaggcggcactgaatttgctgagcaaagatttgctcatccaactgacagttcgcatctgttccagttcgaaaatcgatcggtcggcactgtgccataattgcacgaaaaatttgaatgaatgaaacgtaaaaccgaaggga

SEQ ID NO: 96427 - DNA, 392 bp, Heterodera glycines
  SCN-specific regions: Sequence locations=1-263,288-392
gtccaaagaacgtagtggcaaaagggttctgtcaatccaaagtcacgtcgtttccggctttgtcggcaataaatgcgccgtttttcctttacagctgcacgggttcgaagtggacgccattaactcagttcaattctccaaccacacgcagtatcccaatgtgaagggccagcggctgaacgaacgcgacttggccgaattgttcgacggaattcggaacgccgatttgcctgccaaatattcgcacattcttaccggctattgcggcgacgcctctttcctccgtcaaattgcttcgatcgttcgcgagtgtcgtcagcacaacccaaaactgacttatgtttgtgacccggtgatgggcgacaatggcaaatattacaacggaattccgc

SEQ ID NO: 96428 - DNA, 621 bp, Heterodera glycines
  SCN-specific regions: Sequence locations=1-135,157-621
catgattacgccagctctaataccactcctatagggaaagctggacgcctgccgtaccggtccggaattcccgggtcgacatcatcatcatcatcatggccgctattaccactcactataggggacaatttcgccttttcttcaaaaaagccttattgtactccggattactaatttatggaaaacgatcaacaacaatctccggaagaccaagtttcagcggaagcggcaatcaatttgttggccgttaccaccactcaccagcacatttttgggggcagaaatggtgcactttttgtggaaatacggcgaattgcggagcaacaactggaacacgcgttggcaccagtcgatgttgctggcggaaaatgggagctgtttgtgaaggacggcgaactgcgcatgtacagccgcgagttggaagtggagaatggcattgcggttgacccgttgaaagcgcttcatgtcattgatggtgtgtcggctcacgaattcatcgacctgttctttcgacctgaactcaaaaaggaatgggatgatactcttgaactgggtaaagttgtggagactctttcgccgcacactgccgtcatccatcaaatccatcgccgggtttggcct

SEQ ID NO: 96429 - DNA, 549 bp, Heterodera glycines
  SCN-specific regions: Sequence locations=1-522,546-549
aaagctggagctccccgcggtggcggccgctctgcaacagtggatcccccgggctgcaggtatcggcacgagagaaaagaaaatttgcctgacaatggaactcgaaatatttaaagacgcctgtggacaaacagcacttaaattggttggccgccacccgatcaccgtcaccgcttctgctgttccggaccttccaacgttcgaaacaattcgtgttagttttttcgatggttttgtcgccgcgtttttcaccgaacgaaagaagcaattgtcccgcaatcgtattgaactggccattttctctcaaccgactgatgagtcgaagaatgccttcaaatctttgtggtctcttttcaattcgcaaattggcgcaatcacttctgtttgcaatgcttctgccgctgaccgtcgtaacgccaaaaacacgagcatctacgacctggacccgtatttcgacaccgttcccgactggcttgtggctccgaccttgcgtcgtgttgatggagtttttggcttagagaccatttacaagtggattcacaatgacga

SEQ ID NO: 96430 - DNA, 480 bp, Heterodera glycines
  SCN-specific regions: Sequence locations=1-480
atcactccctcatagtccttccggctcgatcttcgtccgcctttcccactttgactgactctccgcccacagaccgtccgtcgtctgtccgtcgcttagccaatggactcccagcagtgtcccatgaaagagacggatgagcaccgtcagatgcgccgtatcgctttcgttgcggtcgttgtttcgacggttgctgtgattgcttccgtcgttactttgccaatgctttacaattacgtccagtccttccaaagtcatctgatggttgagacggattactgcaaagcccgtgctcgtgacatgtggctggagatgaccgccctccaaattggcaagggacatgtgaaccgcatcaaaaggggctggttgttcggccaatgggtgcccgagagcggcgccgatgcttacgctgcgggaggtgggccatccggcggtgctccgtcgggaggtgctccgtcttctgcttcggcacccgtcggg

SEQ ID NO: 96431 - DNA, 476 bp, Heterodera glycines
  SCN-specific regions: Sequence locations=1-476
caaaaatgctttcttcttccgcctgctgtactctgttggccgccctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccagtcgaccatcagatgcacccaatcgcatggggacgagtcgtaagtttgacgagtcgggcaaattaatgcaatgccatgggggctactgtagtcaaaattacggtcggcaattccattctaattagattattttatgccaatgacccgatttaattggaactctttgattaaccaattaacggggttggggaaatcattaaatgccattgggactactgtgatcaaaaatacg

SEQ ID NO: 96432 - DNA, 677 bp, Heterodera glycines
  SCN-specific regions: Sequence locations=1-406,428-510,533-610,632-677
caagtgaccagagggcaagtgtgcaatggaggagcccaaagtcagcagaaccaatttcgaattacggaaaaacctccagcgcatcaggcgccccaatgcgcgtcccagggatgcttcaacgaaaacatttgctgccagctgtggggtttggctggcgaatgtcgccgtaatccgacatggatgaactgtttctgcaaagtcagctgtggaaaatgcataccacaagactatgtgttcggatcatgcactgactaccatccgcgatgttgggaatgggccgaggaaggcgaatgccgcaacaatgcatggatgtcggagaattgtaaacaaagctgtggcacatgtgtcagccaatatgaactcaaacagatgtgccgtcggggaggccgtggtaagcgtcagattagcatgctgttggaaggagctgctggttctccgcccggaggacattcagaagaccagaaagattcacttggaccgcccaaaactgctgcttcgggagcgaaagaatttatttcaggacaaaaataaatgccgtaaagtaacggaatgccaacataaaaaccacttaaatttgaattctgtttcccttctgacccaataccaaaatcaaataaatcaatcatcaaatgtttctatgtgttaaatatcgtttatgaataaataatttccgcata

SEQ ID NO: 96433 - DNA, 538 bp, Heterodera glycines
  SCN-specific regions: Sequence locations=1-3,25-339,369-538
gaaaagactcaggaagctctttcaaagggtgactttcgcaccgcaattcaactgcagccaatgctcaaattcaacgggggcggccacatcaatcacagcatcttttggacagtgttggcaaaagatggcggcgagcccagcggcgatcttttgaagaccattgaacgcgacttcggttcggtgcagaaaatgcaagagaaagttagcacgaaagctgtcggagtgcaaggctccggttggagttgtcttggctacaacaaagagctgaagcgattgcaggtggccgcctgcatgaaccaagatccgctggaggagaccactggtctcattccactgttcggaatcgatgtgtgggagcatgcttattatttgcagtataagaatgtccgaccagactacataaaggcggtgtggacggtggtgaattggaagaacgtggaagagcgctttatgaacgcactgaacgaatagaacattttcagtcgattgtttccaaaataaacagcagattttgttgctagtaaagatgaatgacttt

SEQ ID NO: 96434 - DNA, 542 bp, Heterodera glycines
  SCN-specific regions: Sequence locations=1-542
agctccccgcggtggcggccgctcttcactagtggatcccccgggctgcggttttccgcacgaggcagacccgcaatacgagtgcatcgaattggagaacatttctgaacgtatgcagcaactctcggaccgccgaattcagtttttgctctacatcgacaaaaaattcgtcaaatcacacgcaattttgaaactcaacgagaagaagtatggtctgctgactcaacatgtcacattcgaagtggccagcaaagctcgtgctatgactctgtcgaatgtgctgaataaaatgaacatgaagcttttcggcttcaattacatgcctatgttcccgcaagcgtctaagagcaaattcaacatggatggaggtgatgtgcttgtgattggcgttgataccagtcgtcctccaaaggcaacgccgttcgaaaagttcatgcttcgcaagaaaggggttgagggactcatttctgaggatccgctgattgttggcatttgcgcaaactacctgaaaaacccttacaaattctgcggagattattact

SEQ ID NO: 96435 - DNA, 712 bp, Heterodera glycines
  SCN-specific regions: Sequence locations=1-215,237-639,661-712
gactagtggatccccgggctgcaggaattcggcacgaggcaagtcttttagggatggcgcaatcagctgaaaaaatagtttttgtgcttggggctgacggcgatgatgaaaatggcgacggaagtgagattaagccagtaaagaccttactccaagcccttcgactttcgcatggaacttcggaagtcgattttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaaggaaaaacttgatgttcctcgtccttcgcgatggctccggcttcctccagtgcgttctcaacggcactctctgtcaaaccttcgaagcgttgacactgactactgaaagttctgtttgcgtgtttggccaaatcaacaaattgcccattggaaaagttgcgcccggcggcatcgaattgac

SEQ ID NO: 96436 - DNA, 476 bp, Heterodera glycines
  SCN-specific regions: Sequence locations=1-120,142-275,298-355,378-476
caacgattggaccaacaaattcccccctcccccaaaattatctgtccaaatcaaatcacttcctcgtcaatgtacaaatgcttctgcttgtgcttctcctaattttgcttttcccttccgaatctcttcaggctgccagttttatcactttgcattgtcaaggcaatggcttatacgtttcgggacgatggaatgaaaacggacagacggcggatttgccacttccatccgaactcacaatgcaacgattagctcgtctaattaagtgcttatttatctgttacattttctttgaaggttcgtgtcgagaaaaaacaaagatggcaccgtttctttcatcagcaattccaatcgaatgtttttgacagttttgccaaatgcatttggacgcattgttttggctcagcataatcaaccgactgatgggtccaccaaattcaaattaattccctacacggacggcacttacgcaatta

SEQ ID NO: 96437 - DNA, 632 bp, Heterodera glycines
  SCN-specific regions: Sequence locations=37-38,97-352,376-479,501-632
cggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggactttttggacagcctggaggcgcaggacagcccggacagcctggacagcctggccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcacgcccaattcctggcccgaagggaccgcctggagcgcctggccaaaacggaaaccccggaagccaaggtcagccaggacagccagga

SEQ ID NO: 96438 - DNA, 322 bp, Heterodera glycines
  misc_feature (322)..(322): n is a, c, g, or t
  SCN-specific regions: Sequence locations=1-322
ccatttgcttttgggggacactgacgactgtttcctacggcatttgtgccgcacttttcctctggcaattcttcactcggtttcgccacaatgtgcttttgtccgaacatacttccgctggtttctcatcggagggatgcgtccggttgggcttttccttttggcttttgataagcgcagttttggcacaattcgcctcttgcgttttgctattttgggcattaaaggggagatttaagcaaacgaatgaagaacaaaaatcgaaagagcaagacaccgttttcctttattaacgaaaaatataaaacagaaaaccgagtan

SEQ ID NO: 96439 - DNA, 476 bp, Heterodera glycines
  SCN-specific regions: Sequence locations=1-476
aagcggccgctgaacgccactttctccgattggcttcagttattcctctccaaacggcgccctcggcacaaatgctattttaactttgcggcagcaacgggcgccaatcggagtcggacgatgcaccaaatgcaccaaagttgctacgcgggggtcgccgggcccaacggaggaccgctccgaccgtccgtctctctctccgttgtccacgagagcagtgcgctcggctcggacggcgaaagcatcgaagtgtcgccgtgtacgagcgatcagtcggcgggtggcggagacggaaatttgggggaggggcgacagacgacgaagacggaatacattccgaaggtcaaacttcgccaaaagccgaaccgacgctggagcgaacaagacatccaaaagcgactgtcacttcctccggacattcgtctgccccaaaatgtgatcgacaaattgaatagaacgccaactctggacaatcc

SEQ ID NO: 96440 - DNA, 632 bp, Heterodera glycines
  SCN-specific regions: Sequence locations=1-62,90-586,608-632
caagtttgagtttcccaaatgcttttctccccgtccactgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcatccccggcgacgggggaagtcggctaaaggcgaatttgacgggcaaaccgtcggtggtccattacttttgccagcgacagaccaacgatttcttcgcgctttggctcgatttgcaacaatttggcccttttgtcatcgattgttgggccgacaatatgcgcctcaacttcaacagaacgagcggaagggcgcaggatttggagggagtgaaagtgcgggtgccccggctttggacacacgcgaaccgtggaatggattgactcctccaaacgggtcgccgagccggttacttcgcgcccatcgtcgcctccctcgccaaattgggctaccaacgcggcatcgatgtcatcggtgcaccgtacgactggcgaagagcgcccgaggaactccttcattattttgttaaattgcgttcactgattgagcaactttaccacgc

SEQ ID NO: 96441 - DNA, 762 bp, Heterodera glycines
  SCN-specific regions: Sequence locations=1-170,192-268,290-307,400 -675,706-762
atcaatgatcgcccttaccattgtcgctattgccccaaacgatttacgcaaaagagccatttggaccagcacgagcgaattcacaccggccttaagccgttcacgtgccaatattgtgggcgtcaatttcggcaacggtctcagcaattggggcacgaggcaacgcatatgaacagggaaaggcattccatgggcagcatggcgatgagtgccgccgttttgggcggcttagtgggcgcggccggcggatacggcgacgcggcgctgtgcggcacggcgagggagcggacgacgcatttggcactgaaacaaccgcagcagcaacagcaggagatggcacaagcggccgctgcacaactaacggcggacgaacagcggcggcagcaacaacagcaacagtcctcttcgcccacccgaccgttgggtttggggaggccaaccgtcgccggaggggtcggcggcaacggcacgcgccattttcaacgatcgcaacagcagcaaatgcatcagcagcagacgaacatggaccagtgttgtgccggggataacacttcgccaatggcacacgcgcagcagcaacaccaaatgaactccttcaacggattgctgagggcagttcagtccaacgatagtgccgcggtggacggactgctcggcctccgcggttccatggcaatgaaacaacagcagcagcagcacggccattccgggatggagctgaacgaacagctccaacttgtcagtgcacagctgatgaaccga

SEQ ID NO: 96442 - DNA, 444 bp, Heterodera glycines
  SCN-specific regions: Sequence locations=1-284,306-368,406-444
ctccccacaaattacccaattctcattgacaaacctacgaaaaaatgcattctttcaagctttttgcatcgctctttcttgtactttgtgtggtttcacttgtcatctgccaggacaagccagcagcagcatgcaaaccgcccaaaagtgtgggaagaggcaacttggcactcacgcgatggtggtgggacggccgtagttgtaagcaattcatctacaaagggcagggcggcaacacaaacaatttcccatcaaagaagctttgtgaggacgtatgcaagccctaaatgaatgaatgatgaatgtgatgagtcggacggagaaagaatgtgctgcaacccaagaagagaattcaaagaaaaaaggagatggaaatgatttaaatttgtcaaaaaataaataaattcatagcggtagaaaatttttgataaataaatcattttt

SEQ ID NO: 96443 - DNA, 397 bp, Heterodera glycines
  SCN-specific regions: Sequence locations=1-86,116-116,138-217,244 -344,371-397
ttttgatgtaaaatttgtctccattagcattgctttcattcattttagtttctacaaaaatcaaagcacaaatcaagggcactgtgagagatggcaaagtctaagaaccacaccagtcataatcaaaacagaaaggaccaccgaaacggcattcacaagcctaaaaaggagcgttacatgtcgatgaagggagtggacccgaaattcttgcgcaatttgcgttttgccaagaaacacaacaagcggaatgtgaaagcgtcgaccgaatctgccaagtaaacggacgaagaaatggcgctggagggattcgataggctgatttgagaccaattgtcagacttttgttattattttctttcttatttttgttgagtaaaaagggcacgggaattccgtc

SEQ ID NO: 96444 - DNA, 480 bp, Heterodera glycines
  SCN-specific regions: Sequence locations=1-104,126-447,469-480
cccattcatccgttgacaaagggataatgctaagcggcgtaaaaatgcgaaaattgccgacaaaccgagaaaagggtggcaatttcgtgctgagggcggaagtgttggaggcggcgataaaagaggacaaagccaacggactgacccctttcattttggtggtcaccgtcggcacgactaacacttgcgcggtggaatcgtgccgcgagttggggccgatatgcaacagagagggcatttggatgcacgtcgacgccgcttatgcaggcagttttttcatttgcgacgaattccgccatttgtcggacggtgttgaattggcagattcgttcaatttcaacgctcacaaagcattgatgatcaattttgattgttctccgatgtggtttaaaaacggagacgaagcaatcgcatttttcaacgtcgatccggtttaccttaagcacgaacatcaaagggatgcgtacgattttcggcatc

SEQ ID NO: 96445 - DNA, 480 bp, Heterodera glycines
  SCN-specific regions: Sequence locations=1-480
ccaagtttgagtttagtcgtcgtctttggattggtgggacgccgctactgccgcccacggttggcggagtggggcgagagcagtagacaatcagggcttagccaccatcagcagcagaggggagtagcgaacgatctgcgcgcgcaagaagtttatgcgcagtagaatgacaatcgaaacacatcgaaaacggatcaggacagcggaaattccgctgctttttggtggccaaggaatgagacgccgtcggcaatagcagaaccaagcaaagaaaggtctgcaattgaaacaaaaagcgtgcagaaactgcacagagtgtgccacgacaaaaagcagcgaaagagtggacagactttccaagagtctgctggccaaagtgccgttgtgcgatctgatctgagcgctgcgtgctgtcagccgtgttaggcggatggacaacagaacagatgtggaagccactgatttctgactttttgatta

SEQ ID NO: 96446 - DNA, 554 bp, Heterodera glycines
  SCN-specific regions: Sequence locations=1-295,317-505,527-554
ggaatttgccaagtgaagattattttcacagccgcaaatattatttttaagcatccattagcattagcaaatagagaagcttgttttcattaacataaaagaagatgtcaagcatcagcccggccaatcccaaaaaattctccataccctcagagaccaattgtgtggtctgtgtagacattgccacgggaaatcattattcagtcgcatcatgcaacggttgcaaaacatttttccgtcgtgccattgttaacaatcggtcgttcatttgcatggggaatggcaattgtccaattgacaaaggggttcgctgtgcgtgccgtgcctgtcgtttggagaaatgtttgcaggtcggaatggacccgaatgcgatacaatccgagagagaccgaatcggttacacgaagagaacacggcgagaaaaacttgtgggatttgacgaaggcattggccacgagaggggcgatctttgcgcggagtcttttgcttcgaacgatgccgatttggaggagtccgatgaagatgacgtcatttttcgcgataccgaaccaatc

SEQ ID NO: 96447 - DNA, 435 bp, Heterodera glycines
  SCN-specific regions: Sequence locations=1-93,115-166,188-286,310-435
gttctgtaatgtctattcttcagaaactttctcctgtaaacatcgactctaaaggcgtttttaagtacattctcataaaggcttctgatggcgcaattgaaagatttttggttcgtggttatggtcgttgtaaatttcacgcggatattttggaggaagtgcaggcaagcgaaggagagaaggccattgaattttcttgtgttggcggaggccggataaaacatgagccggaagccaaacgtatcttcgtctacggatattcccaggggtttggccgtgctgaccatgcgaaatctgtcgaaatcctgagggaacgttatccaaactacacaatcgaatggtccaacgaaggatattagggcagtaaatctagtatacaatattgtaacgttttttgttttctatatttaaaaataaaattgggttctcggaaaa

SEQ ID NO: 96448 - DNA, 482 bp, Heterodera glycines
  SCN-specific regions: Sequence locations=1-436,459-482
gtccaatcaatagcttaaaacgaaaaaatgtcttcaaatttgatgggttcgccaagctgctttttccatccaacagctgagcaggcagcggcagcagaagaagtggacaaatatgaagtgttcagttggcacggagatttgagcgaccaattggcagcacaatttttggtcactgatcagcagctgttgaaggaatgccgagaaaaacttgccaactccgaattgagagagacgaaattgctgagcaaaaacggggaattgaatgcagagaataaggctcttaaagcagagttggagaagcaaaagatgatgacggaacacagtcaaattaaggccaaagtggagaaaatggagcaggaaaatcagcagcaattggacaaaaaatacgtttcattcgatgtgttcaatgcattggtggagcgaatcaaacgtttggagaaccagcagctgaagcagaacaaagaggagggcaaaaaggtgac

SEQ ID NO: 96449 - DNA, 150 bp, Heterodera glycines
  SCN-specific regions: Sequence locations=1-150
gtgcctatgctttcgagtttttcgaatttttagaaatcaattaaaattggtgcacttctgagcacacacccttcggagaatatcagtgaacaaaattttaagaaattcagaaatcgtaagtaattcaccagaatcaaaattttgaggctt

SEQ ID NO: 96450 - DNA, 485 bp, Heterodera glycines
  SCN-specific regions: Sequence locations=1-85,107-485
ccgcctttcccccctcctctttttgtccgttctcacattctccgtccgttcacttcgaattctgcaaattgtgcccggtttcaccaattcccatgtgctgttcaattatcggttggcccaaacgctggcggacatgggacattcggtgactctgtggacgcaaatggaaatggcaatggtttttgctggcgacttgaaattgcccgagggggtcattgagcatcgtgtgcccatccatttccgtgaccgtctgaaggtggaggggctcaaagtgttccaggaaatgatctttgcccgtggcactccgtacgagctgtggtggaccggccgcgagtttcaggaaatgcgtctggaagcgtgtgaacaaatgctgaacgaagcggacgcattgcgccaaaaatgggccaaattcgacttggccattggccacttccacgacttatgccctgtgatgttggctgagcgagtcggcgtgaaaagggtgg

SEQ ID NO: 96451 - DNA, 833 bp, Heterodera glycines
  SCN-specific regions: Sequence locations=1-163,185-415,438-744,766-833
aaaatatgcaatttacgccaaaatagatcgattttaatgcgtattttgaaaaaaaaattcaactttttgttcgaattcgggtccgggggtcggaattgagcaaaaccgagtccggattcgtaataggaaccctcgaaaacccccggaaactgattttaagcctaaaataaaaaagttaaattaggtacccccattcgttacgattgcccaataagcatttccaatggcattattttcgacatttgttacgacaggattgctgataagtcagataaaaggcatgaatgaataaattttttcccctcatcacctaaacgttccattggaaaggttcgtttgtgctcgaattccctcaacaaaaatgcttcgtcgtacatttttcggttcagcgcaaacagcgctggagcttctgcgcttcattttttaaagaaaatgacaaaaaaaagttacttttctaaattaaaatcacttttgaacagggaggaaacagaggacaggctcgacttttgctctaacaaataagggtcaaacccagtgttcgacaaaattggttaaaacttcaaaaaagtcattttgcgcgctaattcaaaaatatagatcagttacctttttggtagtgtttgtatcagggatgggccaaattgaaaaataaaaagcgaaaagcgaaatttgcgaaactgaaaaatgcgaaatgaaaaaaaagcgaaatgcgaaaagccaaaatatgcgaaaatgcgaaaagcgaaatttttttaaaaaattttaccaatacatgtaaataatttttttccatattcatacaaacgctttttttttgaacaaaagttacgatt

SEQ ID NO: 96452 - DNA, 473 bp, Heterodera glycines
  SCN-specific regions: Sequence locations=1-198,220-448,470-473
gtaagtacatgtaatactgctcggtacagacaaagcgctgccctaaaagaaaaatggcaaaaattggacgaaaaaaaagaaaagaaaaaataaataaaattaccatcaatgatcaaagaagcacagcgaaaatggttgctgaagcaatacgcactggtgaagaagggcgcaattggtgagtagtcgaacataaacatcaccggcacgggtttaaacgcgaacttagggcatagtttgacgacaaaaccaacgaaatttgcatggttttaccgggccatcgctgtccaatgaactgtttgcgtcgtttgaagttgaaggtgacccccaaaaggccgaagatgaattttgagaccgacgatagaacattctttttgcaggaggcgacgcaaaaatggaattttgacgatttgcatgtaatggtaatgacgagtcattttcttcgaaatcattctgttcatttttcacaaatgatg

SEQ ID NO: 96453 - DNA, 910 bp, Heterodera glycines
  SCN-specific regions: Sequence locations=1-246,268-910
atcatacctaacaagtaagagttgaaactttaaaagcttttttattgcacaaaaatcatggttgcttcttcattctctaataatggcaaaaatattttggaatcgccgttcaaactaacaggagaatgcaaattgctctattattgtacaaacgaattgggtcattttttgaaccaaacatcaaatgctttaatcggcaatcctctgagaatagttccgtttgatgggcttagctctccacaaaagcaagtctgtacaaatacatcaaattctttggaatttaattgtactgagcgatacatttcattgactaatggcactgctctttggatttacgatttacagaaagggagcacactacgagaactgcatgaccatgatgggaacatcagtggggtcgcctggcacagacaaagtccttggctcttggcaagtgtgggcgacgattgcacgttgcgcttgtgggatttacgttcgcatcctgctcaaattgcgattcgccgtgcgactaagccatacaggcgattggaattttcgcccgattgcaattacatcgcttgtgctggtgaacttgtttccatttatgatttatgcatggcccaaaatgttgtccatatgctttcgtgttcatcggtttttgatattaatcgtcttaatttgttttatattttcagtcgtcagctgtgcgtttcaacccttcagagtgccttttggctactgcggatgatgatcggacagttcgattttgggacgttgacacaggagaatgtgtcacacaaacgcccattttcaatgccaaaattggtcaaattcattttgaaccaaatggaaaatatttaattgcggtcacagagaaacaaatggcttcgattcgttgggaaccctttgaattggtttcgcagttcgacct

SEQ ID NO: 96454 - DNA, 476 bp, Heterodera glycines
  SCN-specific regions: Sequence locations=1-93,118-225,249-476
aatcggttcaaggaggccagtcaacgggggagcaacgacgaggtggaaagatttttctcggacttgcgcaagacgccccacatgttcaacgcgtttttgaagctgaccaaaaaaggcgtctgtatatcaggcgatccgtttcctcatcaacatcaaccgcaaggaggtgctgcaacacaaccgcagcaacagcactttgtgcagccgcagtcgtccttctaccagccgacccaaccgcagcagaacggtggcaacattccatcgtcacagtttggcgggcccttccaacagcaaatgccgtcccacggcgccggaacggcgcaatggatgcaacccccgaaccaatcgcagcaacagtccgccgcctcccaacggaattcgtcctgacaaatgagcaataactgtttgatggatgaagcaaataaatgttttggcggatgtccaacgacgaaatgatctgattgtgagcagctgat

SEQ ID NO: 96455 - DNA, 486 bp, Heterodera glycines
  SCN-specific regions: Sequence locations=1-29,70-352,374-486
caccgccggagcccaaccgcagcaagtggtacaacaacaccacaccaaacagcagcagcagcggttgtttcaacagcaacagcaaatcagaggcaaacaaaaataaaataaggaggagaagtccacgccaattggctcgactgggcaaaatcggcctgttttccattttttaccaaatgtccatgtaatttgagtttgatccgtaagtttagtgctgggccatcaagtgatgaacaataacgatatgcagctgctcatgaatcggttcaaggaggccagtcaacgggggagcaacgacgaggtggaaagatttttctcggacttgcgcaagacgccccacatgttcaacgcgtttttgaagctgaccaaaaaacagggcgtctgtatatccggcgatccgtttcctcatcaacatcaaccgcaaggaggtgctgcaacacaaccgcagcaacagcactttgtgcagccgcagtcgtccttctacca

SEQ ID NO: 96456 - DNA, 1005 bp, Heterodera glycines
  SCN-specific regions: Sequence locations=1-905,927-1005
gaccccttatcaaaaattttttgagtcatttctctgctaatgtttgttgcacttccaaactgttcttctcctcggaatcctttggccacttatccagattgcattgcttccttagacataaaccccgacagtcaaacttatggaaagctcatttctgtgcttgaaatgcccaatgagggtgacgaactgaacaatttgtgttgctgttcttccgatcgtttgattgtcacctcaattggcagtggtcggatttatgttgtggacacatccgacccaaaggaattgaaattggaaaagacaattgagccttcgacgctcacttcgcttggtgtcagttgtccgggcagagtttgctgtgcctccgattcagtgattgttggcacaatgggagacgatcggatggagaacaatggcaattttctgctgttggaccgtctcactttcgaaccaatcggattttgggcagagaaagaagggcaaaaaggcacaaaatttggcggaacagatttctgcattcaaaccaaacaaaatgttttgctgagcgtcgggtggggaacgccggccaaattccgcggcggacttcggccgagagacgtgacaaacggtcattacagcaacgaagtgaatgtttgggagtggcgccaacgccgactgatccaaaccatcgctttggagggcgactgcggatggatgccaatggccgtgcgctttttgcacaacgccgacaaatgccatgcttttgtgtgcactcttctcggctcggcaatttatcatttgtggagagaggagggcgaagaatccttccggcattgtttggccgctcatattccccctaagaaagtggacggttggcagtgtcccagtttcgtgccacaatttgttcaggatttgttggtttccatgaactgggccctgcccaaaatgcccgcgtttatttccgatttggtcatttcgtccgatgatcggtttttgttctcctcgaattggcttcatggcgatgttcgc

SEQ ID NO: 96457 - DNA, 164 bp, Heterodera glycines
  SCN-specific regions: Sequence locations=1-164
aatacttcatcttcaacttctgctactgactcttcaccagacggagggaactatatcaaagaggaaatgctccagagagaggtcaaattattccagattatctcaaaaattctgactttatataagtcgactatgggcattactggataatcttggctccaccc

SEQ ID NO: 96458 - DNA, 644 bp, Heterodera glycines
  SCN-specific regions: Sequence locations=1-206,228-644
cgccgcttaaacttcaacccgtacaaccgcccgttcaatatgcgcaacagcggcaccaaacgtcggcgagcagtacaacaacaacggcaccaccatttggtgaagcgatggaattttgcaataaatgctcgtacagatactcttgaaacatgcccagatgcctttcatcgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttctatcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggggaatttgaccacgcacagcgacggcgaaccgccgaggattcgctgtcgttggcccatttgcgaaaacactccgcgcactctgtggtccatcacaactcatttgcaagacatccattgcactgaaaatgcgttggagtcggcgatgctcccacgggtggag

SEQ ID NO: 96459 - DNA, 473 bp, Heterodera glycines
  SCN-specific regions: Sequence locations=1-98,146-473
cccatttcattcgcggccttttctcgccgttttgtgcccaaatcactttttgtgtttcccttctcaaattgccaacttacaacaaaatgccaatgccatcgtttccctctgcttcttctccgtgtacttcttcctcttcttcttcccgttccgtcgatgaacatccgttgcagtcgtcctcttcgtctccgttgtcatctcctttttctgccactatgccgtccacgccttttaaacagtcaactttcggcacttcctacaaatcgacgacaaaagggcaaaatgccaaaaaagaaatgccattggcaaaagataaaaaagcagtcggaggggcggacaaagagagacaattggatgaacagagcgaattttgcggaattttttgtccgcgttcgtttggccgtgccattggcaaattcctcgacttcgttatgggttccgcgcactcttccgccaacccttcgtcttccgtc

SEQ ID NO: 96460 - DNA, 996 bp, Heterodera glycines
  SCN-specific regions: Sequence locations=1-23,46-516,538-601,623-996
gagaaaaattttcaaatctttccattttttgtaattaattttttatgacttaataactccgtgtttgttgttgttgtataaattaattagagcacttatgcagaatggaggcagattttcacgctccttggttttacgggtcactttcccgcgagaaaactgagaagtgcttacagtcatgcgcagatgggactttcctgatcagaaattcaacaaactatccgggcgatttcacactttgcgttgcttgcaatttgcgggtcgagcattacaggatttacatggtgaatgaccactttacgtgtgacaaagaggagctgttcgacacgctcactcagctcgtatcggtcgcactacaaaagggatgccgacggactgtgccatcgtttggtgtgcccttacatttccgaggaatgccaaaggcagcgaactcacatcgatttggtgttagttgaggagcgcaaaaaggagttcgagcaagcggcgctgttactctccgttgaccatcttcggcttggcactgtcattggacacggcgaattcggagacgttctttcgggcacataccgaggcagaaaagttgcagtgaaaacgctgaatatcggaatggtccaggatttgctggccgaagcgcgttttatgattggccttcaccatgaaaaattggtctttttggtcggcgttgtcattgaggacccgcgcgaaagtgaagtgtacatgctgaccgagttcatggccaatggcaatttggtggattttctccgttcccgcggccgtcaccacgtggaccgaccgcgacttgttcaatttgcgcaggacgtggcggaaggaatggcatttttggagtcgcgcaattttgtccacagagatttggccgcccgcaatgtgctgttggacgaccgattgggggcccacatcggggaccttcggactccctccattggccaatcagcccgcaaaaaaagtcgcggaaagggaaagtttcccgatcaatgg

SEQ ID NO: 96461 - DNA, 429 bp, Heterodera glycines
  SCN-specific regions: Sequence locations=22-429
gctaaaccaacagagcttgaggagatttcgtctgatttgtccactgttcctacacaaatacatgtctccattcccgaaaatcttatgaattttgacggcactgaactaatcgaccttcccattgacaaatgcgtcattgtttaccattgtggaatttcttatggcattgaacctgaattgtggaaagcaaaaacaatggaaaaaattgatggggaccaaatcaaacaaactcaagaaatggacactaaacaattggaggattatgtcactgtttaccatcatggatggtacggtcgttttgaggatgaacaacaacaacaactaattgacgaagaggaggagcaaaaaagacaatttgacaaaagtgaaactgaccgaattgcattatcagtggagcagaaaaaagaacaattggctgccgttgaccac

SEQ ID NO: 96462 - DNA, 468 bp, Heterodera glycines
  SCN-specific regions: Sequence locations=1-468
tagttcaaaaaccgtattttgcttttgccccctcactatacattaatgtcctccacaattgctcccgtttcttccgccgatggcaccgctgggagtgccgccgccgtcgccagcgctgggccctcctccgtcgagccgatgccgccggtggagcagctgatggagggcattgaggagaagtgcccgccctcgttggaccagcgactgaacgccatggacgaggtggacatgcgcatcgacgacctgctcaccgtggtggccgaagtgatggccggtctggacaaggacaagccgctgtcaaaggcgaagatggaggagctgtacaagaaatacgaactgaagctggacgaaattcagcggggcatcgccgaacagctcacttacatggaacaggtgtgcgtcggcgccgagcaccagggctcaacttaccattaccatcaggtggcccaactgagtgccgcacggctg

SEQ ID NO: 96463 - DNA, 268 bp, Heterodera glycines
  SCN-specific regions: Sequence locations=1-268
atgcggctactgcaaattcacaaaacgcgcccatgacaaggccaagttcggcctctgggcccaccggctcactgtccaccattaccaatggttggccaatctcggctggcgacgttcgggtcgctttctgtacaagccgttgatgggccgcacgtgctgtccccagtacaccatcacgttggacgtgcacaaatttctcctctctcacacccaaaagcgcgtgctgcgcacaatgcgcgactttttgcgcacggaccaaaggccgaaa

SEQ ID NO: 96464 - DNA, 637 bp, Heterodera glycines
  SCN-specific regions: Sequence locations=1-38,92-116,140-196,223 -223,251-637
cgggccaaaccaagtttaaagcgccagtgcgacggttccgttcaatgctaatcagctaattgctcactaattaccccaaataacaaaactgtgcctgcttctcccaacaatggcccccaaatgccttccgctcgaacttttgttcgaaattgtgccttttatccctgccgaaaaagccgtcccgaatgcgctctcttcctgtcggctgctgcacaaactttttctgccacgtgtcatcaaatggaaagagcaactgctaaccgatttgatgagtttctcggcgatcgtcaacaatctctcggcgaaagtggacaatctatcgggcgtcatcaacaatcactcggtgaaactggacaatctatcgggcgtcgtcaacaatctatcgggcgtcgtcaacaatctatcgggcgtcctcaacaatctctcggggaaagtggacaatcactcggtgaaactggagacgattgagaaaaaaatggtagaaacgactggcaaggcgccaaacgaaacaaaagaagcagggaatggacacaaagcggtgatgggcgctttccaccaaaaaaatggcaccatccgaagggcccttaccaggaatacaaacgtcggaaaaggcgaatggtgaaaaggatttttgaaa

SEQ ID NO: 96465 - DNA, 269 bp, Heterodera glycines
  SCN-specific regions: Sequence locations=1-159,183-192,216-239,261-269
acgagtcaaatatctggactcggacgcccccccccaccactttttcccttttttctagaaatttttaacaaaaaataaattgcattcaatttccttaaagacgatgaccaatggccggacggatggactgcggtgacaaaggatggacgtaagaaaatgaatttttattatatatattttttgcggggttacaatttttccccaaaaattcaaaatgctttcgcgttacttaatttcggataaaaatgttaaaaattttcgataaatcc

SEQ ID NO: 96466 - DNA, 489 bp, Heterodera glycines
  misc_feature (204)..(204): n is a, c, g, or t
  SCN-specific regions: Sequence locations=1-73,95-263,285-489
ccaccacataacagccatcaaaaaattccattgccaattgaatgtattgacaaaattgaactgcattacacgcttatcattgtggttgaaggatcaaataatattattcataagctttcctaaatatcattattatttatacagttgtgggtttttgggtaggaaaagcagtttttcattttttacgagatttgttaaattaangtgctacacccccaaagtgtatgatgaccaagacgtactttgtagttcagtgagaatgagtgtgtggtggtgtctctgttcgttatggtctccgtccccatttatgtgcatcaaagaactcccccaaatgaatggtcaacaccaaaaatggtcatggtatctctcatatggtagtgttcttctgtttggtgctcaccattggttgttggccttcaaatggtggatggacaccatttggatttgtacatttgggtggtcttgggctcaaaaatgcggacctgctga

SEQ ID NO: 96467 - DNA, 196 bp, Heterodera glycines
  SCN-specific regions: Sequence locations=1-160,182-196
gccgacaccacgacgtgagcccaatcagaagaatggacagcacgggacaagggacatcggcggcgagcggaacggaagaaaagatcgtgaaaattcgaaaactgttgctgcaggccgccgacttattgggagaaatggcagacgaattgttcccgtataagaaatagggggacagcaaaaggaatatcaaaataac

SEQ ID NO: 96468 - DNA, 540 bp, Heterodera glycines
  SCN-specific regions: Sequence locations=1-360,382-540
ctggagctccccgcggtggcggccgcttttcatagtggatgcccgggctgcaggatttcggcacgaggccacaagtcaaaaaatgtttttccactcgccattaccacgaacaccggtgctccgacgttcgacgctcagtggcagcggccaagtcgaaattggggccgcacttcgtcaccaattggccgaagtgtttacgccgccatcaaacatttatcaggtagctccacaacgtgaacaatcagttgacgacagcggtggaccatctgctgcagaaacagtgccattaatagagcatcaacttttgatggcttatcaggaccagctgaacaacaacattgttcaacaacaaaatctgtatcagcagcaccagcacaattttgtggcaccgtccatcttggtgtcgtcgtcgtccatggagaaaagtgcgtcggcacaggacttggccggcacggccgcagcgctgatacgacggcaccgcagtgcgagcaaataaactaaaagatttttcctcaacacaccggaagctcagtgcgtaca

SEQ ID NO: 96469 - DNA, 120 bp, Heterodera glycines
  SCN-specific regions: Sequence locations=1-56,83-120
ggttcgatgaaactttttaaaatataagcctaaactttttggcctgtttaaaaaggaattaaaaatttttaaaaattttattcatctcccttttgatagaaaaagcatcagagagcctta

SEQ ID NO: 96470 - DNA, 389 bp, Heterodera glycines
  SCN-specific regions: Sequence locations=1-206,228-389
cgaacaaagcggccgttgagcgcactgagctgagaggatttgcgccactcgtcgattctttcgaagcgatttacgcccgaaattgttacatgcgtgtccgcgatgtttttgagcggccaattggcggtgtgccaggggcgaaagtcaaattggtcgaccgacaaacagatgacttctgctggacgttcaaatttcccggctctcaaacggaagtgataaatgtgagcagttacaattatttgggcttcgctcaaagcgacggcccatgcgcggaaatggcggcaaaagcagtggaaaaagggggactatcgacgtgtggcagtgcgcttgaagggggtcagtgctcaattcagtccgacttggagaaattggtggccaaatttcttggg

SEQ ID NO: 96471 - DNA, 540 bp, Heterodera glycines
  SCN-specific regions: Sequence locations=1-1,37-245,314-325,357 -486,525-540
tggacccccgggctgcaggattcggcacgaggaccattagtgggattggcgaatccgagcgccttttggtgtccctccggcgcatcgtttgcaacggcggacacttccacagagacaacgtagacatgcgcagttgaaacacagcgccagtgacgcattgaccatggactacggcttgggacgcatacgccgaagacggtccaattatggagcgatgtcaccgacgaagagtgtccaggaggtacaacccgtggcattgtcttggcacggtctcaccgctgtccatgccaaatcgggacggaaaattcttgacaatgtgtccggtatggccgacgcgggccaactcgtggcactgatgggcgccagcggggcgggtaaaacaacgctgctgaacacgttactcaaccgaaatctgaagagtctgagcgtggagggccaagtgctggtcaacggacattccctgggccggtccatcacttacgtcagcgggtacgtgcaacaggacgacttgttcatgggcacgctgacggtgaaggagca

SEQ ID NO: 96472 - DNA, 543 bp, Heterodera glycines
  SCN-specific regions: Sequence locations=1-115,137-187,209-492,514-543
caattttcgcagaatgcttcgagaaatctattagctccgcaatttccttgctcaacgtctcaattttcaaacgtcgcacattatcacccttcttttaatccaacaattgcaagcaacatttacataaacccatctgttttcaatacttctcacgaccagtcctttgttctcatcaatcagttacaacacctttcctcaaaaagcagccaaaattggcatttgatggtcgatgatttcgttaaaaaaactatttcggttcctccacgcaattacccgaagaatcgttccccatcctccgattcttcctttcccgtttctcacccttcgacgcgatcgaacagtcgaaattcccgaaagacatcgccaccgacacgcaaaaggcgtttgaagcacaatatttcacaaggcaaaagaacgcaaagacagacgaaagaggcgcatttatcaaagcaaacgatggaatgtgcgaaggcaattggacttgacagtgactacctaaggaaaatcgaagaacaaaagaaactgagagaagaaattgcgcgc

SEQ ID NO: 96473 - DNA, 343 bp, Heterodera glycines
  SCN-specific regions: Sequence locations=1-343
ctgtttattatgaattttgcttgttgctgtcatttttcaagagttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcagaccgggtaccaataataattgtgagtcagcaaatgctcggctcaaacactcattgcaggactcgttgcgattgacgcgggtgcagcgcccggctcgtggtgccaagtgctcagcgagttgattttccctaacaatttcgcacc

SEQ ID NO: 96474 - DNA, 150 bp, Heterodera glycines
  SCN-specific regions: Sequence locations=1-61,85-108,133-150
tctttattgataccacctccaagacttccctaacccaatttattttgactaaattttccaaaaacataaaattatcattttttggacaaaagctgttaaaacgcacttaaattttcaaaaaattttccccggctgcagctcagagcaaaa

SEQ ID NO: 96475 - DNA, 421 bp, Heterodera glycines
  SCN-specific regions: Sequence locations=1-283,305-375,418-421
agtcttcgttgccggcagagagacgcaaacagtcggagacggaccgagggcggcaacagtcggccaaaagttcgccgacacgcgaaatggcgccatttttttccgttttttaccggggaatcagcggaatcagcagagtgaccaaatcgcagagtcgcagcgaccttttggaaaaggacggggaaagggaaggggacaaagccaaagcgaagacgacgcaaacgcatggggagagtcggaactgtacaaccgccgataaacctccgcatcccttgaccaaggcgaagggaaattgtgccaccgatgggcacggagtttgggacaaagccaacaaaaaaggcggaatccgatcaaagtcaaccgccgatttgcatgccgcgaaggcagcagcagcagcagaaggaaagaattggagggaaag

SEQ ID NO: 96476 - DNA, 480 bp, Heterodera glycines
  SCN-specific regions: Sequence locations=1-232,255-480
cacgttcttaaagacccaacctattatcccgacgggataaaaacttctctgaagtgcgatggttcccgtcaaatccgccaaggaatatgaccgtcaacttgacgtagcagtgcttttttccgaatgtttgactagggctatcaaaatgggctacatcaccaaggaacaaattgatgattgtgacccgaacgtgatcatttctttgccaaggcttgccattgtttggggcctccttttttatcctggcggtgcccttaatgttaatgtgcccaaagaagacatatctgaaatgtttcggcatttccacaaagtgctcattcttgtccgtaaccttcttcaaactctcgaacccagtgaactttccaaactcgagcaaaaattggttggcgaacacgacggacttggcgaatcttgctcatcagtgcgtgccttggaacaacaaattgagcctttctcgggacgatcgttgaatcgtcatga

SEQ ID NO: 96477 - DNA, 684 bp, Heterodera glycines
  SCN-specific regions: Sequence locations=1-684
gtgaaagtgacgccagtaataataacagttcgaaatggacggggaattaaaccaagggacagacccgaaaattgtgcacagagatgtcattgaaatgtttcctgagttggatctgacgcaaattgtctctgaatttggccatctttcgcctgagggcctcgccggcattgtcattgaccgaatggcactcattcctcggaagaaaaatggaacattgaagagaaaggcagacaatgagagcaatgacgaagttttgtcggaatactcggggggcagtgagacggcagaacaattgggcaaccttctcgtggacaaaatgcttggcgaaatgttacgatcgtgcaaagttgaattgcgaagcaaacgcgctgtggtcgattcgtccgcatggactggtgtcaaaacattgatgattgagcactttccaatggtccgtgccgacttcgtcaccaaaatggtgcgccattttgagggtgccattgtaccaactgcaatcgcttgtttctttgtggagaacagttttggggacaagttgcagaaaattgctccttcgtttaatcagtcattttggtacaaaatggcgattcccattcaatgccgaggccgtcgtctgaagcaggcttatgtttctgagcagttgcgtgagcacttcaaactgtacaacgaactgatgtgtcagtacca

SEQ ID NO: 96478 - DNA, 1073 bp, Heterodera glycines
  SCN-specific regions: Sequence locations=1-599,621-727,749-1073
atgctataatgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcatcgaattgtacgctcttttccacgggacaatgtccggattggtgctggaactgatggagggcggttctctgagtgaattaattcaccagcgcaaaagcatcgtttatcagaattgtcatgtgattaattggactttccaagtggccaaagcattggaatatttgcacaagcttagtttcatccatcgcgacgtcaaaccctccaatatgttgctgtctcttgattatgtcgtcctgaaactttgcgacttcggcacaatcgctaagcatcggacggacatgacgagcacttgtggcacggccgcatggatggcacccgaagtgttcagaggggagagttacgactttcggtgtgacgttttctctcttgggagtctgtctctgagaaatgctcgcgccaagtccgccattcgccgacgctcccgaactaaattccttggccgtgttgtgggaggtggccgagagcggactccgcccgccgccaattgaaggagtagccgagccgttgcagcagctgatggtcagatgctgggccgacgagcctaacgatcggccgccgattgacgaagtaaaagagatgttggaagcacttttaaagcaattgcctcacggcgcattgtctccgttcgtcggtcgccttttgacgggtcgtccgtcccccgtagacttttctccccaagcacggaccaatgattgaattgtgcaatcttacaatattgtttcttttttatatgtttctgcttttatattattgtttttctttttaattttcaaatttgt

SEQ ID NO: 96479 - DNA, 623 bp, Heterodera glycines
  SCN-specific regions: Sequence locations=1-555,577-592,616-623
gttgagcgaatcgaatgaacgcctccaaatccatctgaaggagcgaatgcaggcgcaaattgacaagaacaaactgatgcagcggcttgaccaggccaagaaaatatttgatcagacggaacgtttcaaagagcggttgctgcgtgagaatgacgaccttcgcaacgacccgggcaaagtgcaaacgctgggcgagcaggaatggaagcgcattcagcaggcgaacgtgttggccagcatccaacaggctttttccacctcttcttcaatgctcaatgtgaacgaggcaccgccgcctgcgctggaccaatcgacgactgatcccctggacgcaataaacaacgaaattcggatgatccaagagcaaaaacagcaggcggaacgcgtcgctgcggaacaaagccaagaatggccaccgaacggcaccgtttacgagtacggcaacaacaacaacgcgagcaacggcggatactcaccacggcaacaacatgatcagcagaagaagcagaagatgcgatctcataaataattcatgcacatgctgtttttaaacttacttaattgatgctccaaatatgtattgattgtgtttaaattgaacaaaacataaacaaatgcaccac

SEQ ID NO: 96480 - DNA, 610 bp, Heterodera glycines
  SCN-specific regions: Sequence locations=1-610
gcggtgggcgagaagtatgtggcacacagctgctgaatctgtcggggtgtcgactgaccaattcgtcatttatgcgatccttcaaagccccgagcacaatgaccgggcgaacgtaattaactgttcgcagttctaccgtaacgtatgaatgaattggctcatctgcgatagtgccgccaaaaagagtggaaatgtgcgaaagggcgacgtgctgctgcgcgtgaacgaagtcgacctgcaaaattccacccacgcgcaagcggcacaaaccctcaaggccatccccaattactccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggggacattttgcatgtgaccagtgtgggggacgacgactggtggactgcgcgaagg

SEQ ID NO: 96481 - DNA, 638 bp, Heterodera glycines
  SCN-specific regions: Sequence locations=1-638
gtttgagacaacattattttttaaaaaaatatccatccaacttaaaatggcttctccttcacaaggccgaggtatgtcgaccatcttttacagtctggctgtgtgctatttcgggcttttgtttctcggcgctggccacgctttgatgctggggtcaaagaccaccgaatgtattgcattttgctccaggcaaacatcaccggaatcgtacagtacactgacgagacaaatgtgagccgttcatcaaatttcactgtgccaaatggcgggtctaccaaaattgcctacccgggctcggccaaattgcccagccattgtggccaacaccaacagcaaatgaccatcgaatttgtgccggatggcttcaaccacaccgagttggaagctgacaatacttggtatctgacgctccaattcaaccgcaccggcacaaaggaacagggcacgtttttgctggccaattacacactcgatgtccgtttcttcaacgtgcaaaatgcttcatcccattacaatggcacttatttgtacgcgaaggcgcccagctttaagccggaatggagcgcaacagtgcaaaacggacagccaaatatccttacctgctcaaagaatgggcttcatttggatgaaaagtcgtc

SEQ ID NO: 96482 - DNA, 447 bp, Heterodera glycines
  misc_feature (443)..(443): n is a, c, g, or t
  SCN-specific regions: Sequence locations=1-383,406-447
caaccttgagcttcccttcgtcacaaatttaactttcgtttcgtttccttttccaaaatgaattggtgcgccgttttgtgctttttgcttctcatcgaagtcgcctttgtgccaattgtgaacagtgcgccacttgagcgggaaaaacggctgactgccagccaattgggcaaaggcgccgtcgtcggtgccggcgtcggcttagtcggcgccgcactttacgccggcggcaaaaagttttggaacaaccgaaaagcaaatgctgcggcagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaagttgagaatgttttaaaataagaaataaaaaaatanaaag

SEQ ID NO: 96483 - DNA, 478 bp, Heterodera glycines
  SCN-specific regions: Sequence locations=1-274,296-478
acatacaatacatcattatgcttttacttgcctccctccgtggtccgtgtcgtcgtcctcgcgttctcaaaacgctgcgctctcttaaagtccctcacttttccacaatgaaccgtgactatgtcattgaaactgtgaatttcacttccgaacgtgactctgtgttcaaattcttgcaagaagtgtttttggtcaacgagccgatcacccgcgtcatcggttgcaccccctcggacacctcaccaatattcgacgacatttgtgagaagtgttctaaatttgatttgtcatttgcggccaaaaacaacgatgggaaaatactgggagttctgttgaatgcgcccttcaaattggaaaatattcacgaaagctacagagacattggtcgcatgccgaacaaaaaggaattcggagaagagattcgcaatggcccttttccatctcaaaatgccaatcgaatccacgccattctcacttt

SEQ ID NO: 96484 - DNA, 813 bp, Heterodera glycines
  SCN-specific regions: Sequence locations=1-60,83-110,135-585,607 -746,770-813
cccctccctccgctgccattcgccgcctttcgtccgtttgccgtgccgagtgaatgttcgtcctccgatgtttctgttcctccctccgtcactcccttcccgcctttgtcttcccttccttttcctccttttttacgcctatttcggcgacggatttcgtcggagatggcgcgacgattcattcataaaccgaacattcaaaccgaggcgatacaaattgacactgtccattcgcaatcacaatgtgacggatgtgcgtttcttccgactgattggagttgataacacagccgacttttacgtggccccgggcgacactttcaccaacacttacaccgttaacagaaaaggcgcctgggttttgtttgttgaatttcccggaaatcgatacgcaaaatcccagcggaaaatgatctcacgcgactctttcccccaatggatgatggaagtttatctgttcccacctgacaatgtcggcttctctgaatggtacaaaatacggaggacgaagaaacggaagcgaacgcaacgaaagcccaaaatgacttagacttttcagcagagacacttaattatgctaattaattgtttgtttgtttgtaattagtcgtcagccctccgtcgctttcaatgctttgagccaatctttcgcgagatttcccaagccctgacttttcttttgttgagaccgtttttcttccaatcactgcccaaataaatgaaagccatccgccgatcgttttgagcttctttcttttcttgtcttttcgatgcttaaaatttaatcccatttctcaaatgatttctttgtaa

SEQ ID NO: 96485 - DNA, 453 bp, Heterodera glycines
  misc_feature (452)..(453): n is a, c, g, or t
  SCN-specific regions: Sequence locations=1-397,419-453
attaagggctgcatgcaattaagaattacgtccttttcgatgccatcgttatctcttaaacaagcatggtaataaatcacacctggcccatgttgtaattccgtgccattttcaattggcttaatgttcaattggcgcattggctttctgatcaccctgctcatgctcatcactaattgcaattcatccgtctgatcatctagcgcttcttgaacagttccattttgttgtccaaactgatcatcgcgcttcttctgttcatcaacattccgttctttttgaagtttggcactttgttcaattgcattttcctgttgttgttctacaagtactgctccattttcttgccttttgctttgattttcatgccgttcttcatttgtcacattttcaccactttttgtcccattattttgttggatttcttgaataaattggcccatttggaaaann

SEQ ID NO: 96486 - DNA, 173 bp, Heterodera glycines
  SCN-specific regions: Sequence locations=1-173
ctgggctttgacggaattgaccgggaccgagctgccccgtaaaagcccccaggctcgtccgctcaatattaaaaactgcgtttgctcttgcctctggtgctagaaacgaaataaattccaagacggaagagattgtttttcattcattaataattgggagcaacacacacccg

SEQ ID NO: 96487 - DNA, 193 bp, Heterodera glycines
  SCN-specific regions: Sequence locations=1-58,93-156
gtttttctctccgataatgtgactttccattggatgtgcataaatcaataagcaaaacattaaaaaccattccttttaatgttgtacaataaatacccactttttgccttctttttcaatctctggactttcctttcgtatttgctttttattgtgttttaatttttgtttaataataataaacaattttatt

SEQ ID NO: 96488 - DNA, 886 bp, Heterodera glycines
  SCN-specific regions: Sequence locations=1-32,54-324,348-393,418 -473,495-657,684-848,870-886
atttggtccgaagtcagtcagctgaagggaatgcctctgctggtcgccggaaaccgtactgcgcgtagcgcatacggtagctgccaagagtgttgctccggcggtgcccaaggccaacccggacaaaccccgcagacgccttgcgagcaagtgcacccgcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaagacgttaagaaaagcgattctgatcagtggaagaagaaaaagcagaaaaacagcagcgattgccctcccctcccccggtgcccttctccgtccccatttcccactgcctttctttcccttcctttttttattttgtttagcttttccaattctcccaaattccctcccccccccccccctctgaatttcttttctttgtaatcgccgctatgccaagttgcaaaacatcagcaacaaataaagaataaatttcacatg

SEQ ID NO: 96489 - DNA, 476 bp, Heterodera glycines
  SCN-specific regions: Sequence locations=1-476
gcaatgcaactcaatggataagagcggaactcgaaaactcctggccactggaaataattcggcatgtcaagatcgggataaagaatccagtcaccgacccatattcgtacaattataccgcaaatctgatcgatgacattgtttcgccacgtgggcctttcggttacgtctcccaaattttggtcacgaatgacttcgacagaatcgaaaatttctggcagaggtgccctgcgagttattgcgcggtcgtaaaaggttacaaagggatcaatttttcattgtttcggcacaaagtggggcatttgacaagggcccacaaggcagagcgatggtttgaaagaaaccgtgacaaaatgtacgacatcatccttaaaaatgacaaaacatccgatcttggcactttgatgcgagcgattgaaatggaaattggccctgtgacttcgccagatttgttccactcctatgtaattgcccac

SEQ ID NO: 96490 - DNA, 482 bp, Heterodera glycines
  SCN-specific regions: Sequence locations=1-482
gtctctttgtcgtgtgatgagcgggactctgagaattggtgatcagcttaatgtcctccgacattcggcgtcctccgaagatgtttggcattctgtgaaaattggcactctttttcttttgatgggccgtgaactgctccccgtagagtgtgttcctgctgggcggatttgcggcgtcgaagtatccgacgggcgttggataggcggacaaacgctttgctcgagggctctggccgtcactgaagtgccgcggatgagttggcatcaaaagttcgccgaaccactcgtccgcgtgacggtaaggccgacaaatgccggaatggccgaaatggaggaattgcgaagtgcactgcgacaattatccgtgttggactcagcagtgcgcgttatcgagcaggaagacggagatttggcgatgcttacggctggcgaagtgcatttgcagaagtgtttggaggatttgaaattactcggccaaaccg

SEQ ID NO: 96491 - DNA, 483 bp, Heterodera glycines
  SCN-specific regions: Sequence locations=1-59,81-457,479-483
gttgttgttcatttggtccattgtttattttattctaattatttccataaagtgcatttcccccctaattgatttgttcagtgaattaaatgtcttccgccgtttcgtcttccccagcagtgctcactcggttggattggctcaaactgtacaaagcgttgcaaagggcgggttcagagttccctcaatacaattaccgtcacttcgcacgtcgtcgaatccgcgactatttcgagcagtacagcaagcagacgatgaccagggagaagctgtccgaagtttaccaggaaggtcagtccgccctcggcacaatccaaaggcaaagtcgaatctcttctctgtacccgactcgtccgcttgtcattgagacgattgatgaaaaaaaggagggcgccgtcctttgatataatgtcgtgacatattatttttgttgaccgttcttaattctatcgtgcgcctttttgaaataaaatatatgaataa

SEQ ID NO: 96492 - DNA, 630 bp, Heterodera glycines
  SCN-specific regions: Sequence locations=1-143,165-456,479-630
gtccaataaaggtatcattaatttttccaaatgcgttctgcaagggttaatcaacgccagcaaattgaagaattggcccaaaattcggcacttctgcaggacatgacaattctgccacacaactacaactttgagataccgaagacgatttggaaaatccggacaattgatgccaaaattgtcgctttgcaatttcccgagggcctcacaatgttcgcctgcgtaatcgtcgacattctcgagaagcacaccggcgccgagttcatcattctcggcgacgtcacttatggagcctgttgtgtcgacgatttcactgcgcgtgcgctcggctgtcagctgttggttcactacgggcacagctgtttggtgccaattcaggacactgttggcatccatctgctgtacgtgttcgtcaacattgacatgggcacggcccatttgctggacacactgcggcacaattttttgcccaccgccggcgatggcatggaaaaagtgccgaaattggcattggtcagcaccgtccaatttgtggcgacacttcagattgtcaagcgtgagttggccaaggacggtttcgacattgtcatcccgcagtgcagtccgatgagtacgggcgaactgctcggc

SEQ ID NO: 96493 - DNA, 512 bp, Heterodera glycines
  SCN-specific regions: Sequence locations=1-52,75-129,151-164,195-512
ccgtcattatcatagcaccaagatgtgtacagcaaaaaatttgctggcggagatatattttttaattttttaatccgtcccttccaaaatagaaaaatcccagaagaaattacacacatgtgtgctttgattttttggttttattttacagtaatacaattttcattttttgttaattttttaaaattttaattccctaattatttaatacgctaattaagtcgccctgctttaatgagcacgaatgttgcgcgaaatgggcagccgacggacagtgcgaatcgaacagcgaatacatgagccaattttgcaaagccagctgcaaaaaatgccaatattcgtacaacatgcaagaggaatgtgctgatcgtcataaaaattgcaaagctttgtcctaccaaatgaaatgcgattcaagctggatggctgaaaactgtcgaaaatattgcaacaaatgcaatgtaaaacgtatgcaaacatgcgctggcggttccccggggggagaaaaacgt

SEQ ID NO: 96494 - DNA, 487 bp, Heterodera glycines
  SCN-specific regions: Sequence locations=1-13,39-380,403-439,469-487
caagtttgagggcaattaaataattattttaataaaatggcacctcctccacccccgccaaaaagcaaatcgtcaattgaggaggatcaaactcagcagcacgagttggcggcatcgcccgaatgggcacaaaacgatgtggagcaccccgtagtgaaagtgttcggcttccaaccgaatcgattgggccgggaatggccaccgaacccacaacagcccgaagacacacagctggggcaggccaacaaacacaaaacgttgggggacattgactggatgacaagtcctgctgaagcaacgccagtgcgagaacaaattccactcagaggtaaacttaatgctcaatggcctccgccagaaaaagaataccgcgtcgaagtgttgttgccggagggggtcaaacagtgatccgctgctaaaagtgatcggaaaatagcacagatttataaaaaataaaatatggaataaacactcgaaactttgaaaa

SEQ ID NO: 96495 - DNA, 610 bp, Heterodera glycines
  SCN-specific regions: Sequence locations=1-610
cctcgtgccggagctaaaagcctaaatttattctcgctaaacaaaatgtcgatgtcaaaatcgtcctacacctacaatcggaagacatttgaagatgcggaattccctattttgtgtgagacatgcctcggcccgaacccgtacctacgcatgagcaaagacacacatggaggcgaatgcaaaatttgtgagcgtccattcacaacatttcgttggatgccgggcagaggggcgcgctacaaaaagaccgagatttgtcagacatgtgccaagttgaagaatgtgtgccagacttgtctgttagacttggaatacggccttcccgtccaagtgcgtgacacggcactccaagtcaaggagaccgtcccaaaagtgggggccaatcgcgactatttcatccagaatgttgaccgtgctttggaacaaacggatggcacagtgccgtacggcgagttggcgaaactgaccgatgcgggcaccaacgaaatgttgcgcaagctggcccgaaatcagccatactacaaccgaaatttgccacacatttgctcattctttgtgaagggcgaatgcacccgtggtgaagagtgtccgtacagacatgaaaagccca

SEQ ID NO: 96496 - DNA, 465 bp, Heterodera glycines
  SCN-specific regions: Sequence locations=1-20,50-339,361-368,436-465
tggtgatggcagctgtgatcatttccatgggcttcagtgtggacattccggcacacgtctcctaccatttccacatcgcaaaatggacagaagatgggcaacgacagcggacaattgaggaacgaattcgaatgtcattcgcttctgtcggctttcccgctgtacaagcatcaacatgtacaaacatttgcattctttgtctactcgtcgtccctgtctatccggcacaagtttttgtgcgaatcctttgcacatgcatcacactttgtacaatccattcactgtgccttcttccggcgttgttcaatttgttgggcactttggaagcatttctaagctcaaaatttgcataaaaatattctcatcacatttttttataaataaatatttctatttaattaaatttgtcaatattttatttttttgttattttttgagcttttttaaggaataaagaatttgaat

SEQ ID NO: 96497 - DNA, 652 bp, Heterodera glycines
  SCN-specific regions: Sequence locations=1-652
agtcttttcacaatgtacagcaacataagcagcagtggatgggttagcagtgaccacccgcaacagcaaattggcaacttttattcgtatgatgcggacccgactttaagccccaacggtggtggatacaatgcttattttgactatccaaatcagcaacccgccgcttcttcatccaattctaattttgtcccacttggctctggtcgccctttcccgcacacaatcagtcagcacgcacaactcagtttctctgacaattcgaatgcaaattttgttccgcttggctcgggtcattttctaccagaacgagatggtgatgtcgtttgctacgaagactcattcgaaatgcaaaaaataggacgaaagcgacgtcgagggaggaaatccggtcgccgtgctcgaatggacatttatggtgctggccaaccggcaactcatgattttggggaaattgtaaattacgacgattggcaacaatgggacaacggctggggaggacagcaacaattcgaacagaacgaagcggcgtcaaattatggccaatatggcattgaaccgagccaaaactacgaggactacgaaatttattacgacaattacgagacggaccaaacgaaggaactctggcaagaggaattggaacagcaaa

SEQ ID NO: 96498 - DNA, 475 bp, Heterodera glycines
  SCN-specific regions: Sequence locations=1-313,335-475
cattaatggtcctacaaaaaaagaagaaatcgttttccggttttaaaatacagaattttgtttatgggctagattcacagataagttcgctggataagtatttgttgaactttaaagcaaagaaaaatggcggttcttgtctcctctcgggcagaacaaatactggaaagacgcttgttctcgaatcactaatccagaaacatttctctgatgatgattgtgatataaacatcagaagagttgacgggctttcgaagatgacaaaattatttgaaaagttagatcttgaagggccggtcttgattgttgtcgatcattttgaacttttcgcatataaacaacaacagaatttcctatacagcattttgaacggcagtcaaactcttccttggtttgtcgttctaattggcacaacggaaaacagcgttaatctattggagaaaagagtgaaatcaaggttctcagcgctaagagt

SEQ ID NO: 96499 - DNA, 540 bp, Heterodera glycines
  SCN-specific regions: Sequence locations=1-540
ccatttaaaaaaaaatctgacaaaatgaatttttctccgatcactctgtttctgctctcttcacttgccattttctatgcagcggttgcattccgccaacaaacggtcgccgttcgcggccgtttaatgtgtggggataagccattgacggacacgaaagtgaagctgtggaataagaacaaaattggccgtgatgatcagctggcggacgtgaaaacggacgcgcagggaaatttcgcattggacggcggcgtcgggtccattttcggcatgaatgtgcacctgaaaagttgggcactccatttttgtaaatgcgaaattcgcgcgaatccctaacattttttgccagtttatcacgactgtgatcgtggcatccttccgtgccaacgcaaagttaacctcggcattccgggcgagtacgtcacgcggaccagcaccgttcagcgatggttagacgccggcacaatgaacatgcagctgaagtttcatgacgaatcaacttcatgcatcaactaatttaatgtttaagaggatgagatg

SEQ ID NO: 96500 - DNA, 475 bp, Heterodera glycines
  SCN-specific regions: Sequence locations=1-249,271-475
gttttgcttctgaattttgccttcatattctttgcatttttgtcttcaatttatgccgaggaagaagatcccaaagttacgcataaagcatttttcgacatttcgattggtggcgtcaaaaagggacggattgtgattggtctctttggtgaagtcgtgcccaaaacggccaaaaactttttggaattggccaaaggcacccatggctacggttacaaagattcaaaattccatcgcgtaatccggaacttcatgatccaaggtggtgattttacgcgaggtgacggcactggtgggaagtccatttttgagggcaaatcatttgaggacgagaatttcaaactgcaccactatggcgccggatggcttagtatggccaatgcgggccccgacaccaacggatcccagtttttcattaccacggtccatactccatggttggatggacgccacgttgttttcggtaaagtgctcg

SEQ ID NO: 96501 - DNA, 150 bp, Heterodera glycines
  SCN-specific regions: Sequence locations=1-150
cgattggtggcgtcaaaaaaaggacggattgtgattggtctctttggtgaagtcgtgcccaaaacggccaaaaactttttggaattggccaaaggcacccatggctacggttacaaagactcaaaattccatcgcgtaatccggaacttc

SEQ ID NO: 96502 - DNA, 244 bp, Heterodera glycines; identical to SEQ ID NO: 59554
  SCN-specific regions: Sequence locations=25-125,150-244

SEQ ID NO: 96503 - DNA, 360 bp, Heterodera glycines
  misc_feature (23)..(23): n is a, c, g, or t
  SCN-specific regions: Sequence locations=1-66,107-155,309-318,356-360
agctcgccgcggtggcggccgcnctagctcacctgaatcccccgggctgcaggtatcaaaacgaggctgaaacgcccggaccgcctggacccagcactgaaacaccaggaccccaatcaagcacatcaacaccatctgagggaccaggaactccgagcactgaaacacccggaccgcctggacccagcactgagacacccggaccgcctggacccagcactgaaacacccggaccgcctggacccagcactgaaacacctggaccgcctggacccagcactgaaacgcccggaccgcctggacccagcttttttttatctggaccgcctggacccagcactgaaacacctggacccgaat

SEQ ID NO: 96504 - DNA, 486 bp, Heterodera glycines
  SCN-specific regions: Sequence locations=1-272,295-486
gaagtgattttggccgctgaaactgtgtacgactgcgtgcacagctgctaccagcagaactgttcacgggccgcgttcactcacttccctcgcagcgtttgtttgatgcattttggaggcgaagtgccattggaccaaaagtgcgcggaggtcgaccgactcggcacgacttgggatttctcgtcggtgcccgaagtggtggaaattaaatgcgtgaaatgtgccggaagaaaggagtccgtcgaaaaaagcactgacaatgagcaaaacatcgcaaaaagacacttttccaacgacgaaaatgcggtgggacagcaggagacgacggcacggcacattctcaacccccaggggctcactttgaaatgcgatggtcgcgtggaattcgtggcttcgcccgttgccaatttgcacccgctgaacatcaccaacgatgtgccagccgacacagcagccgattgtgcacgaaagtgttttgaggcgatt

SEQ ID NO: 96505 - DNA, 487 bp, Heterodera glycines
  SCN-specific regions: Sequence locations=1-130,152-295,317-326,348-487
tggagctccccgcggtggcggccgctctaccaactagtggatcccccgggctgcaggaattcggcacgaggctcatttcgggtgcttaaatagcggcgcgtggggaaggtcgttgtcaaccgcagatactcattcccttcccacccatccatcgacgccgcacaaaatcatcgtccgctgcttggtgacatacgcgcgtccgacgggtgagaaaacacccaagaagtggcatcgtcttcgagtgcgtcggacccgacaacacaattaatcatttcatcactgaattctgtcagaaaaacaaatgaaggcacagtggaaaatgcgacgaaaaagacagacaacaaagaattgagcaccgacgaggatgagcagcaaaatgtggcgagcacttcgacgccggaggacggagaattttcaaaaatcagtcgtattcgaaagcgccgctacagtcaggcacgaatacagccgacgagagtgaaaaaagtaa

SEQ ID NO: 96506 - DNA, 510 bp, Heterodera glycines
  SCN-specific regions: Sequence locations=1-19,41-176,198-510
gttgtcaagcgcagttactcattcccttcccacccatccatcgacgccgcacaaaatcatctgtccgctgcttggtgacatacgcgcgtccgacggcacccaagaagcggcatcgtcttcgagtgcgtcggacccgacaacacaattaatcatttcatcactgaattctgtcagaaaaacaaatgaaggcacagtggaaaatgcgacgaaaaagactgacaacaaagaattgagcaccgacgaggatgagcagcaaaatgtggcgagcacttcgacgccggaggacggagaattttcaaaaatcagtcgtattcgaaagcgccgctacagtcaggcacgaatacagccgacgagagtgaaaaaagtaatgcaaagtgacgaagacatcggcagaatggtggccagtgtgccggtggctatcggcagtgccatggaagtttttgcggagaaattgttgctcgcagcggccgaaagtgtccaacacagttcaaccaaaacgctctctccaat

SEQ ID NO: 96507 - DNA, 404 bp, Heterodera glycines
  SCN-specific regions: Sequence locations=1-404
caatcacttagattaaaagaaaactcttagaataataagaattgggcaaaatgttaggcctcggatgggaatcgaacccactcgtgcaccctttccatgggcaagctctaccattgagctaccgaggcacatccgccctttcttttatggattatcaagcccgctttccacgttttaaccgcccagccagcttcttctttcagagctatcgaatgatactaagaatgtttaatttggatgcttctagaagaagttttgaagcgttaaagttgtcattctattttgtggtcatgtttatttttatgatcgtgtaaactgcaatagagccatttaattcaattaatcaagtgaatatcggcgcgactcgtgcggatcccttcgcgacggccaaattggacgcacga

SEQ ID NO: 96508 - DNA, 462 bp, Heterodera glycines
  SCN-specific regions: Sequence locations=1-462
atttttacctcctcccctcaattgaaaaaagttttgatcacttataaccagatcgatactgatcacttcactgaaaactcagtgctttcgcctcagggaaaattgatcaatcactttgcccattcattcttcacattcggctgatcacaacggtgaaaagcgaacatttcccagcagattgtaatcattaaaaaacagctttataagcttcaaatgcctccccttcggaagcggtttaggaggaaaagccgtggctttgatgctcttcggatttatccacctctcgtgccttacctttatcctccctctttgcggcttagttagccttatcccctgtgttgtggcttaggttttatccccacttgtggcttagctttatcccgtccccctcctttatggcttacaattagctgtatcctccccgccccttcccactcatctccgtgtctaatgtccattaaa

SEQ ID NO: 96509 - DNA, 360 bp, Heterodera glycines
  SCN-specific regions: Sequence locations=1-18,40-96,120-336,358-360
gactttgaattcgctgcttggcaaatgctttacctgctggtcaatccgcaaaaggtgtacaggaatttcatgtacagaaaaaaagccaaagatcaatgggcccgcgatgaccccgcctttctcctccttttggcactttctctgctcggctcgagtgttctgtttgcattagcgctcaatttgtccttttcttcgttctgcgcctttttcctttgggttgtgttcatcgattgcatcggaattggcattgccattgcaaccgcactttggttcatttcaaatcgctttttgcgtcggacgagggattgcgacgtggtcgagtgggcctattgcttcgatgtccatttgaatgcttttttc

SEQ ID NO: 96510 - DNA, 462 bp, Heterodera glycines
  SCN-specific regions: Sequence locations=1-33,67-462
aattgttcgccattttaataagctgagtcattaatattcaaaatgttttttaaatgccattttaatgaaaaatggaatggttttcttgcgaaaaaaagtccaaacaaatgcattcatataattaaatcagtctttacaaaagcaaaaagctttaaattcaacaaaaactgaataaaatttgaaaaaattctacattttcttatgaaatgataggagcattttttcgagaatataattctcgcgagatcggacggccggctgaatcaataaattgcgcacaaatttattgcatgaatggggtgcgagttgaggagcattttggggatgggtgaatttggtgctgatgttaagtgaataaatacggaaaattgaacgatgaattattttattggtgaagtgtagggagaagaagtgcagcagctgtcggcggacggacttttttggaagttgtaacaattataa

SEQ ID NO: 96511 - DNA, 435 bp, Heterodera glycines
  SCN-specific regions: Sequence locations=1-37,60-63,97-143,165 -168,208-357,379-435
gtgttaaaaggctttaataaagcggagacataaagaaaggcccacaaaaagaaaggcgaattgaattttaattaaaaaaatattttatgtaattaaggtccgtgtaaattaattacactaattagaattactctaaataggccttgaaaattattttctgtgtcgttgttttatttatttatttttatattttaaattacttttattgcactttcccccattttattcacatacccaagtgttttccattcagtgtgtaagtgattcggccgccaactcggttaacaccacagccaacaatgtcaccgacatccaacgagggtgtgccatcaatggcactgctggcaccatcgcgggtgctgccagctgccgatgtgctctgcccactcgtgccagccgaaaataggtcgtcataattaagtgcttaaattttgc

SEQ ID NO: 96512 - DNA, 477 bp, Heterodera glycines
  SCN-specific regions: Sequence locations=1-33,62-67,107-186,220 -381,414-477
gacggtttcgctcaatgctaatcagctaattgttcactaattaccccaaataacaaaactgtctgcttctcccaacaatggccaccaaatgccttccgctcgaactgttgttcgaaattgtgcctttcatccctgccgaaaatgccgtcccgaatgtgctctcgtcctgtcagctgctgtacaactttttgctgccacgtgtcatcaaatggaaagagacaatgaaaaaaatgataaaagagcttcgagatgaagtgttcggaaagatcgacgagcttcgagatgaagtacgggaccgcttcgcacttatcgaggaccgcttgacacttgtcgaaggggaaatacacgcaatgaaaaaccaatttgaggggcacaccatcaatcaaagcgctggtcaaatggaaggaggaggggcaccgacgggcaatgaagaatatctgccgctgccgccacagatgccgcttcagtccggccact

SEQ ID NO: 96513 - DNA, 501 bp, Heterodera glycines
  SCN-specific regions: Sequence locations=1-427,449-501
tggactctctttttaataatttattcaaataaaaatcaaagcgatggtgaccaatgctcagaataggcccaaagtgttcatcgttggggtcgggatgaccaaattctacaagcccaaatcgtcgggaaaagattaccccgagttggtgagagaggcagccaccgaggcgttggaggatgccggactcaaatacgatcaaatcgaacaggcgacggcttcgtatatgtacgggggctcgtgctgcggacaaagggcactgtacgaaatgggactgacgggcattccgattttcaatctgaacaatgcttgtgccagtggttcttccggcattttcctctgcaagcaaatcatcgaaagtggcaatgtcgatctgatgttggccgttgggtttgagaaaatgaatccgggcagtttggaggcgacgcagggaatggagggggacagggcactgccggtggacaaacacatccagctaatggccgacacttacggcttacaagc

SEQ ID NO: 96514 - DNA, 461 bp, Heterodera glycines
  SCN-specific regions: Sequence locations=1-27,49-461
cttcgaaagctgtgttcaagtgttgaagatggaggagaaggtaaattcaatggaaaaaagcgaatggtcgaacgaatggaaggcactcacacaaatagagcccgaacagtacaatcgatacttatactttttacgcactttttcgaaaaccagaattcgctttacagcttttcccacggccctagtctctgggtcttgaatgaattttggaaaatgatgcaaaagacctagagttctgttaaaaaacaagaattttgtctggaattctgtccgggtcccaggaccgtcacaggatttcggctttgggaaatacggggtgatgacgaccttttttcccatttttatgcggcgcgctttttcaataattttttggggaatagtgggtttttgcatggacacacccattaagattgtcaatagcagcagcaaagaggttgtccgtcttgagtacgtgttgccgt

SEQ ID NO: 96515 - DNA, 354 bp, Heterodera glycines
  SCN-specific regions: Sequence locations=1-354
atgacataagggtagaggctgaccacgtcaatgcacaaaatctcctccccttcggcacacacgtgatggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatac

SEQ ID NO: 96516 - DNA, 683 bp, Heterodera glycines
  SCN-specific regions: Sequence locations=1-683
ggcttttttgcttgccgaatgaggcttttgaaaattttcatctgcgagccctgggcatatatatacataattatttacacaatctgttgaatatcgttgttgtatgcataatatcgtccatctgattggtcagtcagttcggcactttcttctcaggccgtcttggtgtggctgccgccctccggtgtccacaattccatgttttccctcatcatgcgcaagttgagcgaggcgtcatcagccaatggtaccgtcaatgtggcaatctccgcctgggccaagtcaattgcctaaaaatccggggagaatttagccacattatacaatgaaagaaaaagcatgatgaaaatcatcaaattggtcccactttttgggccaatttgcgcgcctcgtccaccgattttaagatttcgaagttgaacacggagaagttgagtgcaaggccaagacgagtcggattgatcgctgcaattttggaggtggcgatgtccatggcttcttgcaaaagaacaaacttcgcgtgctttcccgacccactgaactcgtaagtttggggcgctgatttttggcagacaatacattcaacggtgacccgaacggcgtgatgccgaaacaccttgtgtggctcgactttgttcgtttggtgtgccaaaatagatgcgtttgtgcatatgtaatttgtc

SEQ ID NO: 96517 - DNA, 856 bp, Heterodera glycines
  SCN-specific regions: Sequence locations=1-82,104-413,435-856
ctgtcgacgattccaaggtgtttaaagtggatgagttggattttttggccacaaacactgacagagccatccaaagaatccgttcttttcaacaaaaacatgcgccgttgctgatgaaacatggagcaaaattggacgcaattgtcactgatttggtgctgcaaccgatggaagaaaaaatggagacggccgaagccgaagttaggcatcaaacagaagatatagctgtggcctcctccacttgtgagcccgagctttcagtccatgcccaatttcttttgactgacacattaaacggtctgaaaagaacgcttgacgacatggcccaggagcacaagcatcccatccatcatctcatctcgcgttgtgggaaggctatcgacactcgcttcttctccgatttgagccgtttgttgaaaaatgaaaaggaaattgagacggactctgacaatttgcggcatgcaaatcgtcttattctcgaacatttgatgggacttggacggaccgaagtcgccgatgtcttcctccaggagtccgcaatgtcgtctttggaagtcccagacatagacaattttgaaaccttgagaaacatcatggactccttcaaacggcaagactatttgccaacaattcaatggatgaaagcgaatcgaggcgaagacaacgaccgacacgacttgctgtttcgccttcaatgccagcatgtcatccgattgttggaaacaaatggtaaaagacaagctttgggttatgtgaaggaaatgcaagacgaagagaaggaaaagtacaaagaagaattgaaacatttgatgttcgtcgtgatgacccacccgcagaagggcccccacgactattt

SEQ ID NO: 96518 - DNA, 483 bp, Heterodera glycines
  SCN-specific regions: Sequence locations=1-99,197-405,427-483
taatgtttttactgttgagaataaccataataattttttctgtcttaatttcttggtttttggctccattctaattccgtagtgtggtgatttcaaatgaatttatataaataatatttagagtaatataaattttaattaaaattttaaaattaattattttaaaaatttatttaaaaatatgttttaaataattcatttgtgctctcgacattatttgatatttaattgcgaccgaatccagacctataataaaaaccgaagggccaagaatccaaagttgaacacgatagtgatttcggtcgcacgtatcaacaaaaatggttcttcaaaaataattcggatttccataatcatggacggcaaaacgatcaaattcattgccgacagtggatcagacatcaatattattgatgaaatcgcatacaaatgcatcggatccccgacgctaggaaaaagcgacgaagagggcatttttttcga

SEQ ID NO: 96519 - DNA, 518 bp, Heterodera glycines
  SCN-specific regions: Sequence locations=1-332,370-387,411-518
acgaatttgattgagccgacccggcttagacgaattcgttgagccaaactggcttttacgaattcggagagccaacccggcttttgatgtctagcagtttctttgactgcttttagaatgtgccgactcggcttcaaaacaattcacagccaatcccggcttttcggtgaatttgttttgccgtctcggctttttgctttgtcctgaaaacaaaatttgatgttttttctcacccgaagatgtagagcaggtcctttgctgattgcgccaaattgttgtgtatttactacaacaataaaaatgtttggtttttaaccaaaacaaatgttgtcaaataataaataaattatttatttaacaaataaatatgggaggaggacagcagagaataaataataaaataaaataatgaaatggtggaatgaatgggagaatgcccggagtgagggaaaaggagacatatttatggggctggtcaaggggcggggagagagacaataagagagggagtgaaaggg

SEQ ID NO: 96520 - DNA, 479 bp, Heterodera glycines
  SCN-specific regions: Sequence locations=1-187,209-342,366-479
caaaagtggaatggacgtatgggcggacattgcgaaagcggattttatggatgaacgattttcgagggttattacggctaataaggcgtacaacctcttccagaattccattgctgaacttgatgaacgttcgttccgggctcaggcggccattctcaacggactgttgacgcatcacttggatttcatccatggcaaatgtgtggatttgcgcaagattgggcttttgttggaccattttgaccgattagtcctccgttcggaatgtcttttggcccaaaatgcgaacatttcgttgctccgttgtctggtcaagtgctctttctattgtcgtttcgctgatttcttactctgttcttccatttaccaacaatccttcaacgaattccgactgcttgcgatggcaatgttttgctacggtttggcattgaaatgggcatgccataaatcggtcaaaggaagtgatggagcggatagcg

SEQ ID NO: 96521 - DNA, 475 bp, Heterodera glycines
  SCN-specific regions: Sequence locations=1-399,421-475
gtcatcgaaaaacaaagcgaccctttgcctatctcacgcaacacttccgtcgcaattgtacttagctatgacctcatggtttccaaggccaaacaattgaaaagcaattccatttatgttgttgtttttgatgaatgtcatttgctgaaggagcagacaacgcagcggacaaaagtcgcatttgaactttcgaaaattgccaatcgcgtcattcttctcagcggcacaccggcgctgtcaaggcccagtgaattgttcacgcaagtccgaatgattgacccgaaaatatttcctagttgggtgaaatatgccgtgcgttactgcggaggaaaaaagggacgttttgggtttgaggcgaaaggaaggtgcgcactttgtctaaccccgacgaattaaaaactgtgatggataaaattatgataaggcgtttgaaaaaggatgtgctggacgatttgcccgagaagagacgtgaagt

SEQ ID NO: 96522 - DNA, 280 bp, Heterodera glycines
  SCN-specific regions: Sequence locations=1-7,29-174,196-217,239-280
aatgaataaaaataaatcaaatgttaaaaattcacaggtgattaaaatatagtgtatatgtggcacagaaaatttcctactcagaactcattgcttttagtaaacccctgaattcctttgccttattaatttgcacctaaattcgcatttttggagctcaggttcgaatccaacataaaaataaatatattttaagtaatctataatgtaactaaatcatttaaaaagccattttttacactaaaaaatgtatgatagtttttctttagtagaaatgagc

SEQ ID NO: 96523 - DNA, 402 bp, Heterodera glycines
  SCN-specific regions: Sequence locations=1-229,251-402
tgtgtgtgcgctaaataatatgttgttttttgtttttgttgttgctgctttatgacatacatattgagattaattaaaggaaaaagtcaaaattatcgattgatcgctgctatggttaataatcaataaattatcgatcgattgattggcgctcatctgtcagttcatgaacattgagtgcacaaactgttcaaaatcgagcgcattttcaatggtacggccggacgccgcgtccacgtagggcttcatgcgctgtttgcagtattgcgcttgttcctgggtcaaattcgcgaacagttcttccgcgaacacataggggcggtactctttgctgagtgcgcggaatgccatctcaatttcgtcactggaccgcacattctccgtctccttgttgatcatgaa

SEQ ID NO: 96524 - DNA, 292 bp, Heterodera glycines
  SCN-specific regions: Sequence locations=1-50,72-111,139-161,199-292
acataaaattgtaaaaaagaaaaatatgcgcatacatttttccaaattgttgatgaggataaaattttcaaaatttttcttcaattacgttaaatttcagtgaaagccctctcaaaataaaccaaaatttaaattttgctatcattcaatgcccctaaatgttttctatttttctataaaatttatttcataaaattcgttactttgggaatatttgtgtcagtatttgaatgggacgcggaaaatgccatcgaataattcaagtgccattgaacgcagtaaaataagaaag

SEQ ID NO: 96525 - DNA, 479 bp, Heterodera glycines
  SCN-specific regions: Sequence locations=1-42,100-302,330-479
caccggcgccgaaacgccagcgccgaaacgcgtgggtccccggtggaagcccctttttcgaaaattttttgagattttaaaaagccaaaaaataagttataaggttttaaaaatcgctctgatcatgaatttgactgttgacttaaatgataatgctctgagataacgatggggatgcggagttgctataaaagcgcgtgatggccaacacattcccatcattcgcttttacatatttttttgttgaattgccaacaacttcttctatcgtatggcttattcattgtctcttcaaccgtggccttcgtctgcttctgcttcttctgttttgtcagtgttcgtcttcgtcctgctcttcgcccgttgctgctcccaatcggcggatgccaacagcagtttttcattgcgcggctttgcctgtgcgaagaaagatgccgcagtgcacggcggcacgttcactgttgttggagagaagcggc

SEQ ID NO: 96526 - DNA, 483 bp, Heterodera glycines
  SCN-specific regions: Sequence locations=1-483
tttctggcactgtttgcgccgattgcggtgcctcttgtccgagttgggcttcgctgaatcacggcgtgctgatctgctccgattgttgttttgtacatcgaaatttgggccgtcacttcagccaagtccgttcactgacaaaaggcgtttggcacgacaaacaattggctctgctccaattgctctgtcgtaatggcgccaacaatgtttgggagcattcgctgatcgattcgttggggggcgcaggtcgggcgaagaagaagcccgtctccaatgatccgataattcccaaaaaggaggcgtttattacggcgaaatatgcgcaattggcattcgccatcagaccggccaaggacgaattcaatgtggacgatttgaatcgccagctttggtcgtgtgttcgcactgcgcacgttgaaaccgcgttgaggcttttggcgcttggcgcgtgtccaaattacgcggacactgagaagggaaaca

SEQ ID NO: 96527 - DNA, 481 bp, Heterodera glycines
  SCN-specific regions: Sequence locations=1-481
aattgtgcgaggccatgggaacgaatgttcatctgcggaggaagccgactgctgggaaattggaggccggaaaaggcgttggaaatggccagagaaacggaggacggcgaagagaatcagtcgcagcagaaaacgaacagcggaagaaatcagtcgtcttcgtccgtttggcgtgcttccattgagttgggccctgaggacagtcagcgtcttctgcgctttcgctttttcctcggcttccctctccaaatcgacccttctaattgccaatcgtccctttctttgctcgtcgttcgctgggaagcgaaaatgtccccgcgttgcattttgccatcgattgagtccaattctatgggcgaatgtaacaaaggagtgaccagcgaatttggcagttacggcggccgcgatcgattgataatggacgggtggctgcacggaagggaacaacgtcaaattttcttgcggatgttcggcaccgcac

SEQ ID NO: 96528 - DNA, 217 bp, Heterodera glycines
  SCN-specific regions: Sequence locations=1-217
tataatttttgaagatgggcatttgtcaaagcattgaagaaaaagctatggaccttaaaacgaagcaaatagaccgagaacttattcaagagcatcttgacgcacaaaagattgtcaaactattattgcttggtgctggcgagtgcggtaaaagcacaatattgaagcaaatgcggttattttttaaataattgctttattgaagataaattaagtg

SEQ ID NO: 96529 - DNA, 170 bp, Heterodera glycines
  SCN-specific regions: Sequence locations=1-36,97-97,121-170
aaagccaaattaaagtgaaatgcaataatgtaagaccaattgggtttcgtctgagcagctctgaaagctttttccgctccaaaaaataatcaagccaattggcggtcggttcgtgttgcagaaaattgagttgcacatccatcgaaatgattaacaagaattggatagat

SEQ ID NO: 96530 - DNA, 497 bp, Heterodera glycines
  SCN-specific regions: Sequence locations=1-7,43-220,242-396,418-497
gtttgagaaatttttaaaactaaaaaattaaaaaaaaataatggaacaattggacagtacgctgaatgccgctaaaaatgagacggaacgattggctgaacagttgaaaaaaagtgcagaacaggcccaaaaagaagtgcgtgaacggacactgcaccaggacccgtatttgcgcttggtttaccaactccaaacagcccatctgatcgcattgggcattgaggtgctcactctgtacttgggatggcgcgacgtgaactttgtttggctgctgttgccgcttttgttttgcgctggcgcaatttggattgtctctcagcgatggtaccatcagatggacggacgttcggactttaacaaagtgctgagcgctgacaaaatgccagttcgtgcaaaggccgcttcatgtcttgttggcggctttgttctgtctctgcttgcccagtggaccgctccgacaatgggcagcacatcgatcggactgcttttcagtctct

SEQ ID NO: 96531 - DNA, 480 bp, Heterodera glycines
  SCN-specific regions: Sequence locations=1-480
gcggtccaaatcttttacatttacatttgtgcagcaatcaccatcaaatttgtctaccaggaatcccgtcgctatttgtgtccaaatgtcaacagatgtgaacttggccccctgtgaactttcattcgctgttgaccaatttgatgacccattaacgcggcaagcaatcagcggtgcagtcgatcaagcgcggacattgtttgcacagcgacacacggctatcccgaacattgtcgacacccaccacattcttgtgtcgcgttctccgcatggctttacagaagggtcttcggtgtctgcgggttcatttgccgcctttttttcactcatgatcaaccgttgctttcgaatggacgacgtggccttttcgggacaaatcggactcgaaagacaagtgcagtatgtccagcaaaattgtggagaaagttgtaggcatgagtgacttcgggttacgcaaggtcatcgtgcctgacggtaatc

SEQ ID NO: 96532 - DNA, 459 bp, Heterodera glycines
  SCN-specific regions: Sequence locations=1-459
caattgatgaaactataaaatttcccgtctttcattgctgcaatggatctcatcaggaatctttccaccaatcgtttggtcaaaaagcgccgaatgagccattaaaaaaacgcgattcttctgtagaacttctcaatgacaataattcatttttcaaaatacgcgattcttcggcagaatttcacaatgatgtaaagctgctcggagttggaggacagtctcatcaagggcctttccacgagtttatcgatgacgattttctattcgagaaggcggagcaacacccaccaattgtcgttgccaacccatcagcaccgaatggcccattcaaaatacgcgattcttcggcagaatttcacaatgatgtaaacctgctcggagttggaggacaaaaggatgtgttcagaaaattgaaggacgtgtttggcttttcctatttccgcttcaagcaaaagccgg

SEQ ID NO: 96533 - DNA, 542 bp, Heterodera glycines
  SCN-specific regions: Sequence locations=1-155,177-197,219-239,261-542
gagctccccgcggtggcggccgctctccaactagtggatcccccgggctgcaggaattcggcacgaggcaattaagaaggaatttcgcgttgggactgctaatctttagtctcaccatttttttttcttcctccaatcattaataattcaaacaactgatcagttcctgatcaatcattgcttcaaaatgtccgacattgctggtgcttccagcagcgctttttctgccgatgcttcttcaacaaagaaaaagggcgattttttgtttctcgctgagttgggcgaaggctcctattcaaccgtttatttggcttcagagcgccaaaccagtcgaaaatttgcagtgaaaatgtgtctcaagaagaaaatcatcaaagaaaaaaaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaagatcttatggcccggc

SEQ ID NO: 96534 - DNA, 844 bp, Heterodera glycines
  SCN-specific regions: Sequence locations=1-133,156-270,293-811,833-844
taagcggaacagtataagggtaacaataacaattaaaagtgagaaagcgacatttctgaaaatttacgaaaagaatcgccatttttgactgccccaatttgtactctggccccttacccaaccttctccaattgtttttggtttttcataatttcccgctcatattcatcctccgctcgtctgttgcgcaaaacaaggcccaacaaattgtccaaataatgaatgagtttattacgtcgaaattgactttcaccgacgaaaggataaatcaaagcagtttggttttccaaaataagtttacaaacgattgtgttaaatgggaaatggtcgcgcagattcaaatggtccatccaaaagacagcctttggcacttcgttctccaaaagggttttaatttgagcaatcgcaacttcaaccatttccctgtccttcagatggaatacggaactgatcgcttcgatgtatttggttttaagtcggaaacacgggacgagcgcatccaagagaagagtcttatcaatgtgaaggtcaaaagggatttgttggccttgcgcgattccgagtttctgaaattcgtaaaatgcgagcagagcgagtttgacgagcgaaatgtccaattgctcagtggtaagtgacttcacatatttgacaacgttcaaaaagccttcaaacacatccgaggaatcttccgactcaaaatacattcgcatcgttctttgaattatgtcaaatttctccatgtcgaaggctctattaatttcttcatgggtttttttaattttccgaacactttcaaggaaagatatttttgtgtccaaaatctcttcagcggaaataagggcgc

SEQ ID NO: 96535 - DNA, 366 bp, Heterodera glycines
  SCN-specific regions: Sequence locations=1-366
ggtaaaccgcccgcgcaaccaaacgcacctgtctgtactgctggtttctggcctcggttgtggtccattccagcagcgggtcatgcgcaaaagcgtgcagaacggtgcggagcatgcgactctcggcccgcattacctgttgggagtgggaagcgtgtgcatcaattagacaatgattaacggatgaatccatccatccatgttcccaccttcatacgccttttcacacgactttcggaatgtaccctccacaccggtggcgccaaatccgtccaccatgttgcgggtgagacggaacggcacaatctgaaattgacaaacgagaaggagtgtgattttttgtattagaattttatcgcaaaattt

SEQ ID NO: 96536 - DNA, 548 bp, Heterodera glycines
  SCN-specific regions: Sequence locations=1-124,146-548
agaacaaataatattttcgattcttaaatatgtttcgtcgttttatttcatccgctccaaatgttgcaaaagttttcggcggagttggactgtccacagttgtggccgctgcaattcccgacgttgaattgaagaagaagccggactggtaccaggagactgtgcaccgcctggagaaaacgctcaagaaacttagcacatatgcttacatcgagaacagtgacattttggaagacgcaaaggacattttgatgcgttgtgagaatgtgaataattgcgatatttcctggcgtctcggtcgcgctctgtcagaaaagggtgacttgttttctgttgttgactccgagaatcgaatcgaattcttcgctaaggccatcccccatttccaaaaagcgtttactctcgagccgaagaacggaagcgcaggggcacacaaatggtacgccatcactctgaagcgactgaggctgatcacttcgcagcacccttatgtgaagaacgcgaacaaagaagtgattgaacacttggaaaaggcccaccaaatcgac

SEQ ID NO: 96537 - DNA, 584 bp, Heterodera glycines
  SCN-specific regions: Sequence locations=1-176,199-584
aaatcaaaaaaatttgagttttcatccccaaaacgatgtcggtggtggcggctttctctcgtcgtattttttgcccactcataaaacgatcatttacaaccatttcacctgtaagaaaattcgatgctaaaatttgaatgttttctcttcaggcaattgctgtgcctgaaattgctaaaaaattgaaatgcacattaattccaggcgatggtgttggacctgatcaatcctatgccgtccaagacattgtcaaggcgaccggaataccaattgagtttgaggaagtctttctcagcgaagtgtactactcgagatcggccagcattgaagatgtggtcgactcgattgcccggaacaattgtgtcgcattgaagggggccatccagtccagccttgacgacaaaacggatgggttgaacacgcagctgcgcaaacggctggacctgttcgccaatgttgtgcacatcaaagccctggaaggcatccgaacacggcacaacaaaatgttggactttgtcatcattcgcgagcaaacggagggcgaatattcgcgcatggagcacgagttggtgccaggtgtaatt

SEQ ID NO: 96538 - DNA, 468 bp, Heterodera glycines
  SCN-specific regions: Sequence locations=1-468
aaatgcatataattaacaactcaatttggctcaaatttctcatcaccgcatttctgttcaaaattgcttgctctaaatttggttcaagtgaaaataaaggcttctttttttattttggttatggtagcaacttgcttgaagaacgtatccatgtacaggtaaaaggtgctacttttgtggcaattggagcgctgaagggttacaggctggcatttgttgatttcgaagaaccgaatcgttggcacagtgcagccgcaacaattgagcagaagcaaggctcacttgtttggggatgcatttggaaagtgccaaattcatttgcggacgaactggataaacaggagaccaaatacaagcgaattgatgttactgtttttccacgcccaagtacaaatgaacgtttcaatttaaatatgcgattgttttcaaattttgttataaaatgccgtacctatcaatatgagaggc

SEQ ID NO: 96539 - DNA, 566 bp, Heterodera glycines
  SCN-specific regions: Sequence locations=1-77,99-99,164-566
aagctggagctccccgcggtggcggccgccctacccacgtggatcccccgggctgcagttacaaaaacgagggattgtttatgttcttcactatttgctccttttcccgctttcccttctcctcccatttgcttttcttcgctcccttctcttcccgtgcctttgtcaattccttctctctccggactcacaattgtggtgagcttcgtttgtctgatgtcggcagccgagtgaaactcttcggatggatggccgccaaacggatgaacaaattcgtcctcctccgcgactcctatggttcagtgcaaacagtgttgccaaaagcgctcttttcgtcgctcaaaaataccaactttgaatctgccctttgccttgagggagtggtggcggacagaggcaaagaaaggaacgacaaaatgcccaccggcgacatcgaagtggtcgtcgacggacttgaagtgctcaatccttccgatgcgccgttgcccgtcgatgaatcgtccaacgaatacacgagaataacccatcgttacttggatttgcgttcggagaaaatgcaacgggca

SEQ ID NO: 96540 - DNA, 663 bp, Heterodera glycines
  SCN-specific regions: Sequence locations=1-663
gccaaacggaccttgcgctgctcatttattgaatttggctgtacaggaggcgttgaagagagatgaatcaatcagcagtttattggccaaaactcgtcatattgttggccgtttcaagcacagtaacactgccttcagcgaattgaaaaaaattcaaaaattactcgatgccccttctcatactcttttgcagatggtatgtgtccggtggaacagtgcgcttacaatgtgtgagaggctgatagaacaaagggcggcaatcacacaatatgcagtcgacaacaacgaattcgagcttttattgaagaatgatgagtgggagcaaattgaagagctggttggggtattgaaatgtgctgaagaagcaacaaaaaggttcaccgcagagccaatttcatttgtcattcctcaagcaagagcattacatgatgagttgtacgaaatgaaaattgttaaccggactgtggagacaatcagaacaaccctttattttgcggtcgagcgacgcttttttgggctagcgaatttgaaggaatatgcgctagcgactttttttgatgtgcgattcaaggacaaagtgctgactgaaaattccgcaacttttcgcgctcgagtcactgtctggatcaaaaatgaattgaaggaatgggaaaatgataatga

SEQ ID NO: 96541 - DNA, 467 bp, Heterodera glycines
  SCN-specific regions: Sequence locations=1-12,59-73,95-467
gaggcaaaaccgataatttaaaaattaaatatccaaaaataatattattgtatatattctccatcatttttttagaattattgtaaagctttcttctcatcaaaacattgcatgccttcccttttttcagacttatgaccgggaaaattgcattttaacgccagccccttgcacaatttgcgcatacgccgcgacccatggccaacttccggcaaaacttttcgatttcaccaaagaagcggtcgccgtgttggagtccattcggttcatcaacaattccggcgtcgcatacttggccgaattgttcagagggcaattgggcaaaaaggcagtgaagcgaaaagtacggaagcgcaagcaatccaccgacaataaatgaccatgtctttaggtggatgacaatggacacggacgactgccaattttcgcaatgggcagagggttgagtgaacaggtggaaaattcgt

SEQ ID NO: 96542 - DNA, 420 bp, Heterodera glycines
  SCN-specific regions: Sequence locations=1-303,325-420
cattgattttccttgatattcttccatcatttgggctgagacaatgatggaaatgacaattctcgggaatcggattagcattaccgcggacggcgccaaagtgtcgccatttggcagcaaaatggacatgggggactattatgttgaaaataacaagctgagaaaaacacggggattgggctgggtaatggccgcactttttgtggtcgccgacatggcaggcggaggcattgtggcattgccaacggcggtggtccgatgccagttcttttccgggttgctcattctgttgtgcatggcgatcatctccaccttttccgcagttatgctgggccaatgttgggaaatattattgcgccgtttcccggtttaccgtactcactgtcgaaaaccgtacgctgaaattggccttaaggccct

SEQ ID NO: 96543 - DNA, 476 bp, Heterodera glycines
  SCN-specific regions: Sequence locations=1-27,70-476
gccaaggggttgcagccttggcgcagtacgacaacaacaacgaccacgacaacaacggtgacaacgacaccgattccgcagcgaccgccggcacccgtcgtcacccctccggcggcgccgccacgtgccgttctgcccgatttgccaccacaaaccgtgccaacaaatgcgagattgcaaaactttggcccatcggcgaatgagttgcagatgaaccgacgggtggacagctccacagacaacgatggacaatcagcatcgacactcagacaggcaaacaaaggggggacgagaaggggcgggacgaaaagacaggataaagcaaatagggcacttcacatgcgattggcacggttacgccaaagtcagctggcagcaaagcgcgaatttgaacggaacatgcaaatgaaagcaaataatgccgcccaatcaccggcatcgaattgcttcgacagagctccatggtgttccggatg

SEQ ID NO: 96544 - DNA, 424 bp, Heterodera glycines
  SCN-specific regions: Sequence locations=1-154,176-207,321-424
gtttctcttttcttattgtcaattaatgctcagcgatacggtagccacagttatgggagcggaacatacggaacaaattattggagcagcagttacggtaactcaagaacacagcccagctatggatacggtgggcaacagagcagatacggtacccatgaacaaaacggtggcgaaaatggacaattcgagcgacaaaacgcatggagaggaggaggaggacaatggggacagaatcagcagaattggggacagccgcagcagcagcagggagcaacagcagctgtagaaggaggatggggacgacgacagcagcagcaattcccctcccccgcgcccccaaaaacgcaaaacaattgggacaattccgacaatttcgccccttcgaccgcacaaaatcgcggaaaattgcgcgtcgaccttc

SEQ ID NO: 96545 - DNA, 613 bp, Heterodera glycines
  SCN-specific regions: Sequence locations=1-277,299-613
ggtcggccaccaaagggattcgttccgcgtcggttggtgcgaaagttgtgccgactttggtgtgccgccctttgtgtgcacgactgtcgctacaccgcgatcaccggattgtacgtggagaccgccggcttcctgggatcggcggggcctccgctcgcgcaaatgcggtacagaccgccaaccaaatggcaaagatcggcgccgggcaggcggcagaacagcagcggcgatgccgtcggccgtggattggccaatgttgcaatttttgacaacccttggccagcctggcccccactggaggcgcccgtgggcgcaaatgccggcacgccgttgcctcgggcagcaactgccgaaaactaaatatggaacaactctcagcggtacagcccgaaaataaaattgaaattgaacaaccaaacgaaggagacgctgacggagaacagcaaccggcggaaccgattcaattgaccgatgaggaaagagaaattttgactgtaaaggaggccagtagagctgttgtttcgcatatgtccgagtggagtcacccaaccgagatgacgtatacaaatgaaggaaaaggcgaaacaatgaggaaaatgcggagcaaaatttg

SEQ ID NO: 96546 - DNA, 609 bp, Heterodera glycines
  SCN-specific regions: Sequence locations=1-99,123-609
aacttcttaacttaactcatccaccgttaaccctccctaactaattgcccacccccctgccccgcccctcttaatgcttaaccacatttacaacattaacaccaccaccgccgccaccgcgcagcagccgcgcaagcgcggcaccaccggcacaacaaagcacggcacaatgccggccccaacaacgacaaaggcgagcggcagcagtgaacgcggaggcggcacgcaatttcaccagttcacgaatgggcgacaggttaccactggccaaagacggaaaggcgccacaggaaatgaggcacgcgaccgtaccctggccagtcagccgcctttgctgccaccgctcacttccgtctacgatttcaaagatgtcgttggcatcggttccggtgcgtttgccaacgttttccgcgcccgtgaattgataacggcggcgccggccgaacgctaccgccacgtggcactcaaacggattaatctgtcagccatcgaaaaagagaaccagctgatgtacgaatcggtgctgaacgaggtggacattttcaagtcgctttcccacaccaacattgtcaaatgcttctactcattcaccgaaatttcgccccattc

SEQ ID NO: 96547 - DNA, 528 bp, Heterodera glycines
  SCN-specific regions: Sequence locations=1-135,157-528
ccacaaaagccaaccgacgctgttgccgcgggcgaatttgctgcgtttctcccgcgaaatcgcggaatggaacgagcgatgcttccccggatggatcaatcggcgcctgcccgccagtgtcacggaggacttcaaccggtgccgcctctgcggtttggacgtacggcaaacatcgcggcacattgcggagtattttcctgaacatcccgctgcaccagtgtccattgtgcgagtacggcgcggccgaggcacggcttgtgcaacgacacatgcgcaacaatcacacgctgaaggaatgcgagggcatggaacccatcgccaacgtggagaagcacagagccgaattctcggagttgcacaaccaatgcttcccgggcagaccaaaacggttgtccaacattacaattgcggacgaaagcagaagggcaaagtgccgaggatgtgctcagactatcagtaagaagcgtcgtctgctgcatttgctggagaagcatctgaagaagcccatctacaagtgcaagtactgct

SEQ ID NO: 96548 - DNA, 445 bp, Heterodera glycines
  SCN-specific regions: Sequence locations=1-354,383-445
tgacgctgctcgtgcgctaatggaccgttacccgccgactgtcatttgcgagtttcgagaagagtaccttcgcatctgcgacaggcataagcggctaattgcggtagaacggctgcaaaaacggatggagatggaacccatcagaagcggtggtgcccgtcgttcttctgcctttctcctccctttgctccaaagggacaacatttacgcgttggctggtgcgggtgccgtcgctttgctcagcgcagcaattgtccattattggacctactgattttgggacggtggagactcaacaacatacaaaacaacacatgcacacatacattccacacagaatatattacccatcacatatatataaatacatatttatttctcattttctcaattggaatgatttatgtaaaattaacaacaccatttaatgtaatatgtgaatgaa

SEQ ID NO: 96549 - DNA, 790 bp, Heterodera glycines
  SCN-specific regions: Sequence locations=1-230,252-790
caccacttttctgtgctttttgtcctctcttttttctcttttcccttatttttcgccgtttttgtttcatcagcagcggaacaaaatgcgaatcttcaaaagcaacaacaattgttcaccattgagggcaaaacggttgtcaatgccgaattgcagcggataaagccaaattggaaggcctttgaagaggatatttttggactacggaaaattcgttgggtttatcagacaggacggctctttcattgttcccgacgtgccttccggctcctacattctcgaggtggccagtggcgactttcaattcgagtccgtccgtgtggacatcacaaattcgggcaaaatccgtgcccgtcgtctcaacttggtccaaccgaatgtcgtctccacattgccttaccctgtcaaattaaccgcacggcatccgatgagatatttccgagtgcgcgaagaatggcgtgtcactgacgtgttgatgaacccgatgatgctgatgatgggcgccgcatttatcctcgttgtgttgatgcccaaattagccgctcaagacccgaacgtgcaaaaggaaatgcaaaatatgcagctgccaaaggttgacatgccagacatggccgacatgctggctaacatttggtcatctggtagcaacaagaaaggcagccgtaaacagatttcgtcgggccagagcacgaaacgtgtcacacgatgaatcatgacaaatcacaaagaccagccaatcatttccttttggaaattttattttgtagtcagtgcataaattttttaaatt

SEQ ID NO: 96550 - DNA, 470 bp, Heterodera glycines
  SCN-specific regions: Sequence locations=1-123,147-282,305-338,379-470
gtacatttatttttgttgcttcgatgtcgccaaaatcgtctcatgtcaattacgatcttctgccggaaatttctcacaccttccgcagccctgaaccccgaccatctgttctagtttctgacatgttttctgttttgtgtgcttcgccgcttatcatccttttccttttgtggcttcgtattggcatcaattttggaaaattcaagttttcgctcagtgctcttgggtttcatcttggcctgtgtgttttttttgggctctacgttttcttttggctcgagttgaacatgttccagacgttgaaatggctggctgttattggcgtgcccactttgttccttggaagtcgtctttccttttaaaaccatggctttaaagcttaacacacaattttttgggatatattgtatttcttaatttatatgttgggaaataatattatggttttttaaattccatttatcccccac

SEQ ID NO: 96551 - DNA, 576 bp, Heterodera glycines
  SCN-specific regions: Sequence locations=1-576
tgcttttaatttacgcgtataaaatgaccttgcgcaatgatactccgatgcctccggacgaagaattgagagtgcctcatgagatttcgctgtcttcgccttggctaagggctgtggcggtttatatgggaatcgcctgcgagaaggaggccaaagagtttatgcttttgcgttccgaacgcgacaacgacccgcgcaaagcgttgccggtatgggcgcgcagtgactgcgtgcgctatcaattttttgcgcaaaatgcgccgcgagtgcggtgacgaaatccgcgactacgccaattgttttcacagagagtccggcagaatgcatttgcatcagtgtcgccgtgcacaatttcctatggatatttgcgctgacgaaaagctgggcgttcgtcgtccgatggtcggttacttcaacaaattgcatgtgcacgaaagcgctgtcccaccgccggaccctttggaaagacagaaattgtatcgcgattacaaagcggagggcggcaaattgttagaagagctcccggaggattggaagacggaccccaaatcagttcagaagtaccggaaacacttc

SEQ ID NO: 96552 - DNA, 611 bp, Heterodera glycines
  SCN-specific regions: Sequence locations=32-220,242-261,284-611
cctcgtgccgaattcggcacgaggccaattaagcattttctagttttctattgacttttgcaataaattgaagccttctcatctgagatgtctgtgcctgaaactcattcgccaaccgttgagcaattgccaaaacttccaacggaattgcagtccgaagttgctcaacgggctgggctaaagcatgtgacgacgctggaaaagaatgtgctgccgactaaggaggatttggaggaggagcgcaagcacgagagcttcaagaagggcattcagaactttgacgcgctcaaattgcgccacgtggagacggaggacaaatgcatgttgccctcatcaaatgacattgccgtggagaagacgccacagctggccgcggagttcgaccagtccggactgaaacacgtggaaacgacggtgaagaccaacatcgaagtgattgacaaggcggaacaaaactaagccaatggcgtgacataaacaacagatgttttgaagacggatttatgacgattatttttggtgtcttgatttgctttctattttgtaccttctttatttggtgagctttacaaattccagagattatgagataaatcgcgttaattcaaaaa

SEQ ID NO: 96553 - DNA, 478 bp, Heterodera glycines
  SCN-specific regions: Sequence locations=1-478
ggaacaccaggcggtgaacagaccattgacggagttgcggtgcattggtattctccgggggactacgataagctgacaaaagtgcacaatttgcggcccaacaaattcatttttgcctcggaagcgtgcacgggctatgaagtttttgagcacaaagttttgctgggcgattggtcccggggccgagcttatgcccgcgacattctcaacgatttgcgcaattgggtggtcggatggactgactggaatatgtgtttggatttggagggcgggcccaatttggcacggaattttgttgactctccgatcattgtgaatgccagtgctggcgagttctacaagcagccaatgttttatgcgatggcacattttagtcgctttgtcccgcgcgattcatcagtcattggctcctcactttttgtcgccaatggtggcgtgaacaaattgggcgagaaaaaagtggacaaatcagtggtgc

SEQ ID NO: 96554 - DNA, 342 bp, Heterodera glycines
  SCN-specific regions: Sequence locations=1-254,278-342
ggctcgacctgaacagatacgacccgtacgagctgttggcccgctgccggcactttgtgcagcagagggacctgctgaacgcagtgcgggtggccaatctgatcagaggcaagtcggcccgcattttcagcgattggctcaaggacgccaaattccatctcgaagtgcgactgctggttgagctgctcttggcacattcccaggcttcgggaattaggacgacatattgaaaataggcggaaacgaaacaagaccagtttaatttgtccaaaaaatattgattggaatgataaagtttagacgacccatttcggacaacccgcaaagcccaccgacaaaaga

SEQ ID NO: 96555 - DNA, 633 bp, Heterodera glycines
  SCN-specific regions: Sequence locations=1-79,101-423,445-542,564 -565,588-633
ctgaaatggacgtgtcagttggagaagaatcgcctcatcagcaacggtttctggaagaatgtctgaatttgagtcagaaatttctgaaggagatgagtaaagacgaagagcagcaacagaatgtaataaatggcgaggcgaatgatggcaaatcggacgtggcaaaagagttgctgatttgccattcttcctctcccactgcatcgcctcaaccgagcggatgtttcttaacgtccgccaatgtcgtagcggaattggacagaattcgaagggaacagaacagaagcggggccggagaagcggacggacaaagcaccgccgcaacgacaccgaacgcatcgcgaaggccgagcaattcatccgctgccgcggtcagtggaagcgttgaagacgaattggccaaaatcaaagtggtcttacgacagcacgagaggaggatccgattgcttgaggaccaattggcggatgccaacatggccaatgcttatggaatatgaaaattaatacggacagaaatattgtgattgaagaaatgacgaaaggaaaatatttgaaaatttatagcaaacaaatgcaatttgttcatcacaaaaaatggaatatccgccagctttttgtaaatgagcttcaaat

SEQ ID NO: 96556 - DNA, 519 bp, Heterodera glycines
  SCN-specific regions: Sequence locations=1-495,517-519
gcgtgcatttacacggcaactgctccgaatttgacttgccatcgacaggatcagagtctgatggaaattctccgctacaacatggaatatcgacaacaaattgagggttggtttgaaaatcaaagtgccgatcccaactttttcggcatttcttatgcccggttttgtttttcaaaaattccggtcccaaattactcattttttcccaataatttatgtatttttaaatcagacccatcatttttgacccaactgaaccctgcccacccgcgcagttcaaacagaccgttgcaatcgtcgggaatcagaggattttttgatttgctccgtggtaagcattttggcggttctcaaagtgaatggcttcaaagagttcaatgttgctgatgaacatcatcattatcttttgtttttattcattttcgtataaatttgggcataaatggaaaatcgttaaatgattgccaatttgggaaattaacatttaaataagattttttcattttgtctccatttgtt

SEQ ID NO: 96557 - DNA, 687 bp, Heterodera glycines
  SCN-specific regions: Sequence locations=1-21,43-287,309-687
attatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggattcccttaccgcgatttcttaattccattttccgcttctgcatacgtttttaatttattccagcttcttttcttgaaaagtagtcaatgaatttgcgcaagaagcctaaggtcgaaccaatagaagatgagattcctgagaatgagcagcaaataaacatctctacccgttcacataactcttcttataactctgatcgtgtcaatgaaaatgatttggttaaatcgctgtctcaatgtcttctggcaaacgtttctaaacgagggtttgttcgtgatgccgacattggagaaatgttctcagaccgaagagaacgcgagttgcgagcgaatgttctgaagaagagtgagaaattgctgatggatgttcttggataccgattagatcgagatgaggaagggaagcgtttttacctctcgacaaatttatgtaaaggcattgcaatggctatggagatatctgacgacacacaccgaggacttaacgaattcgcagatgaagatgcgtttgaggaagaatcaactcaaactgaacaatt

SEQ ID NO: 96558 - DNA, 614 bp, Heterodera glycines
  SCN-specific regions: Sequence locations=1-8,32-438,487-614
attaggctgaatgataatgataataataatcattagctaaaaggtcgcgtggacattgttctgtgcagcgcggcattgctttacgttgtgcccattttggagctgaacgacgcggacattcagcgatcgatggatgtaaatgcgatgggcaccattaatgtgagcactgatcaaccggttaatcagtgatgtattttgacttttaaattctcggggtagtcccggccccgctttaaattgtcctttttttcttttccaatttggcattttccattctcttcccaattgctaatggctttttgtcagacaattcgcgtctttttgcccgaaatggaagcccggggcaaagggcacattgtcgcgatgggctcaatcgcctcacattttggcgaagtgttccaaatggcgtacaggtggtcaatgggcaaagatgaaaagtatttttgtaattagatatatttttttaatattttaaaaaataattttgtgtcagtccaacaaaatttgcggtgcgtggcgccatggaatgccttcgggtggagctgaaggaacgcgggctggaggacattctctgcacgaccatttacccattttatgttcgcactcccatggtc

SEQ ID NO: 96559 - DNA, 552 bp, Heterodera glycines
  SCN-specific regions: Sequence locations=1-552
agctccccgcggtggcggccgccctacaactagtggatcccccgggctgcagttatcaaaaacgaggtgagatttctctaaaatatatttgatgaagccgcaagaattttctggagctgacaatgagcagccatctccgagtcgccactcaataattggtgttaagcgcaagttcagttcgattgattatgcgtcatctaacagtcctgtaaaagtgctgccgagttttactagcacatttctgcctgatttatcaaatgcgcaagtgttgaagccaaagcccaccaatgttgatcgtcttcctttatcaaatgaagaatttataactccaactcagccaaaaaagcagcaaagtcgtccaaattccccagcaaatggcgtatccaaattgatacttccgagaagccgagtcgcttcaatacgtcgtgagtcggattgcaatccagagaaaggatttggtgaggcggaagcggcacacgaaaaaatggtaaaatcggcacagcaagtcgcgatgggttttgaggatttttgtctcgacgacaaggctttcga

SEQ ID NO: 96560 - DNA, 496 bp, Heterodera glycines
  SCN-specific regions: Sequence locations=1-23,48-496
tgagcatttcatcgcttttcctaaaatatttttcatttttaaatttgcccaatttccttccaaaacgccaatttatttctgctcctccccaccctcaaaatgctcgtcgactctctccgtcccgccactctttcgtcctccaaaaaacgttcagcgcattccatcgacgacaccgaccaattcattgaccacagtcccccgcacaaaaaacaactaatggacgaggaaaatgaccaaattttgacacaaaatacaccaaatgattcattggaccggcggaggccaattgcctttgccacaaaagcaattcacgcggggaatcggccagaacagtgggacatgaaccaggtcgttccgccaatttcgctgtccaccacttacaaacagtcgcgaccgggagagcccaaagggcacgactattctcgagccgggaacccaactcgcgacgtgctgcaggagaacttggccagcctggagggcgcgcggttcgcccgcg

SEQ ID NO: 96561 - DNA, 619 bp, Heterodera glycines
  SCN-specific regions: Sequence locations=1-556,579-619
gacattcgagccaagatgaatatccaaagttcacgttcagtgttggatgaccaatggcacactttgctagttgagcgtgaagcgggcgctgccgtgctgtatttggacggtcgacttgaggcgcaaaatcggaccaatttgggcaccattgaactgcttcaacttcaatcgccactgtacatcggcggtcttccacctgagcttgttccccttgctgcgcgacttttgcctggcgttaagcccgaatttggtggatgtttgcgcgaattttcgctcaatgatttggcattggaggagcccgttgccgagaaggacattgcccaatgctcccaattcattgaacagggcattttctttggcaaagatgggggctatgccattctgagtccacaatttgtggttggcttgtcgttcagctttgagttggagttgaagccgcgcacaaagactgctgtgttgctctccgtcggtgtccttgaatttctgtccctgcaactgttgaatggcacgggcaaatttcgcgagggacaacggtggcggcatggaatccggtgctctacgagccaatcagtcccaacttcgtggtgtgacgggccttgggatcccgatccgaaccttc

SEQ ID NO: 96562 - DNA, 475 bp, Heterodera glycines
  SCN-specific regions: Sequence locations=1-176,351-475
caacgaacgaacgacttcagtgcgcccaacaacaacacaatgacttctcactttctcgtcggcgttgcagccttcggggcgggaatgtgcttcgcgaagacgtacatggagaaaccgaagagcgaagacgacaaagaagcgcccaagaaggaagaagccacgaccggcggcgaagcggaggagaaggcaaagaagaaggacaagaaaggcgacggcgcagctgcggcggacaagaaggaggagaagcgctaggacaaacacaaatcgaaggaggggaagagcgacgacagcaaccgccgttccaagaaggacaagcacgggaagaaggacaaaaaggacaagaagaaggacgccgccgagccagccgctaacgccggagaacaaagcacagcggagacgacccaagcggacgaatagccagcgatgagaacgacgacggtgcacgacgacctcttccttcacgatcagtcccccc

SEQ ID NO: 96563 - DNA, 561 bp, Heterodera glycines
  SCN-specific regions: Sequence locations=1-2,38-301,324-470,492-561
ttttgcttttccattttatttttgcattcaaaaatgtctctctcctcttacaattgaatttgcgttttatgtcgtcggtccgtcggatgttgtttttgttgggtcggaagtgctgctgttcgacagttccatgctcagcgacagctaacggattcgggtcgattcaacggagaaggctttggacttcgatggcacggctttcctcttccggtccatttatttgtatgatgccactcaaaaaacgacaaatgttcatttcagatgtgtataaacatgaccatttcctgcactttgaccatctgcacattgacaacattcactgtgccaggaagttggtcgtccatttgaggcccagcgagcgcacacttttgctgcaagcgctgaccgaattgaacgccgaggcgaagacggatggaaatggtcattcaggtggaccgccataactccatgatgcttttccattccatcgcaattggaaatgcttttgctttcccttggcagaccatccgccttcgcctgctcagatgaagcagttgttcttcgtcaacacaatcccgttcg

SEQ ID NO: 96564 - DNA, 491 bp, Heterodera glycines
  SCN-specific regions: Sequence locations=1-221,243-491
gtccaattaagttatgatttttcgacaatttttgagacgctttttggtagcgaatcatcgctttgtgccattggagtctttttgggttggacgtctcaactcagttttgcattcgactgtttgtggagttggcccctccaatttttccaccggttttgcaaatcatttggttcaacatcgctttttttcttcacagtccgatggtttgaacgtcttcgaacttggctctgagaatgactttgacgatcgcgttctccaagcccaacagcccgtcatggtccaattctacgccgattggtgcggcccgtgtcagaatttggcgccgagaattgaggccaaagtgaacggacagaacggagaagttttgttggcgaggattaatgtggacagttctctcggttttcttactgcacaattcgatgtgacttcggtgcccaccgttgtgtgtttccataacggagaggtcattcaccgctttgagggcgacgtcg

SEQ ID NO: 96565 - DNA, 150 bp, Heterodera glycines
  SCN-specific regions: Sequence locations=1-150
attcgatagccctaattgttctttgtttgtctactgaatttctttaaaaaacttacgacaaaaaaaaatttaaaaaacgtgttttcccgaacacttggccttgacttttttttaaacgggtgtcgaaaacccgaaaaacgattccattca

SEQ ID NO: 96566 - DNA, 628 bp, Heterodera glycines
  SCN-specific regions: Sequence locations=1-94,116-446,474-628
gtgatgctcgtttccaactccgtgagcagctgatcatgtactgcataaatgatgttgccattcttcgagaatccgtgttgcgctttcgaaaactcatcggagaacacactcagggcctcgatccctttttggtgtcttcaacagctgctggtctggctttatcaacgctccgacgttgttttctaccgttcaaccgtttggttcactcacctgagggtggatacctccgtggacgacgagcttccgccgaatcccgccgatacatccggttcttcgagcttgaaaaccctggagcccaagtgcagtgcgcggattggtctgtgggagaggccaacattgaagacacaggctatcgtgtggacggcctctggcgacgagagcctccgcttcgtccactggccatcgagtggatgggttgctactatcatggtgttttatcgtcttaattttcaaataaaaatcttaaacgattaaaggatgtcccgactgttttccaaatcgaagacaaaagttggctgctgggagaactgcggaggatttatacgaaaggacgatgcggcgactctttgaactcgaacatacccatggatgtgagcttcacgtcgtatggggttgtgagtggaaagaa

SEQ ID NO: 96567 - DNA, 229 bp, Heterodera glycines
  SCN-specific regions: Sequence locations=1-148,175-229
gcacatttgggcacagttttggggattaaaatttaaagcatttacccaataacttaaaaaaataaaacaattctatcattaactagcagttgttagacttgaatttttttaacgcttacatacattaaaaaggggggggggtgtcgacaaaaaattttttggtttaatttattttattgattgatggctgcgcatttgcaaaaaatattgggcaaatggcaagaaattt

SEQ ID NO: 96568 - DNA, 483 bp, Heterodera glycines
  SCN-specific regions: Sequence locations=1-151,173-483
acggcgcgtgctgatatcgcatgcaacaacgtaattgtggctctggacagactgatggatgtgccgcaagcacccgacaagaaggcaatttgtgtgctcgcaaacaaccgggcagactcaaaagagggtgtgggaaccgtcatgtttcagcagaaagatggagaggatgtgcgtgttacggttgtaatcggcggcctcggtcctgaccatcagcatgcgctgacgatttatcagttcggcgaccttactgtttcttcgggcaatttccattcaactggaaagcattttagtcatgctggccaaaaacatagcccaccggaggccgtcagtcgtcacgttggagatttgggaaatatcaccgctgattcgaagggagtcgccaaaaggaattggtctgacaaagtgatctcactgtttggtcagaataacattattgggcgctcagtcgctgtacatgcacgaaaggatgactttggggagggg

SEQ ID NO: 96569 - DNA, 505 bp, Heterodera glycines
  SCN-specific regions: Sequence locations=1-354,382-399,421-505
cgcttattctggtacacgtcagaataattccgcttattctggtacacgtcagaataattccacttattctggtacatcagaataattccgcttattctggtacacgtcagaataattccgcttattctcagaatgattccacttattcttgcacgcgtcagaataattccgcttattcaggtacatcagaataattccgcttattcttcaaaatttgttgctgactgacggtgccgctgagcccaaaggaaatttatgaagttttaggtgaattatgaacagaattagtcgacaaattatgattcgcaatttagagccaatttaaagtgtaaaatggaattacctgaaaagttgtttaaattaaataaaaattaattttttccttcgcgcttcacctcctcttctttatgtttcatgtttttgcccgcattttctgctttaaattattgaaaataatgagaagtattttgatacaatcgtactaaaatccctgtggtaatagtac

SEQ ID NO: 96570 - DNA, 340 bp, Heterodera glycines
  SCN-specific regions: Sequence locations=1-1,42-340
gaatttttaaaatttaaaatttttttgaatttttaaaatttcccggttcccggtcccgaagaaaaatcgaggtcccggtcccggcttctcaggtcccggcaagtcccggtcccggttttgcccaaaattcccggtcccgcttcactctagtaaaaacctaagaatcctctccctactcatgattcagctccaatttgcgaatcttttaaatgtttttgctattgtcaatgtccgggcgctatactgtgcttttggttcgcacctttaaaatacgtccatttttcagttcttacgggttttctagcaaggaaatacggaaaagcttttttgacttttttgt

SEQ ID NO: 96571 - DNA, 321 bp, Heterodera glycines
  SCN-specific regions: Sequence locations=1-151,173-284
gttacctcccacgcttcaccaatgaacttttcacggtggcagaggtgcactctgagcgttcgccagttgtttatcggttacgtgatgacaataatgaaattattagtggttggttttatgcaaatgatttatgcaaaacgctagaagacaaacagcaaaaaatgtatgaaattaaaaagattttgaagaaaaagaggcagaacggtgtggattatgcatttgtgaaatggaaagggtatggcactcgctttattagttggattcccgtaaattcaattagcgagaaaaatatataaaaagaaataaattaataaaatttat

SEQ ID NO: 96572 - DNA, 804 bp, Heterodera glycines
  SCN-specific regions: Sequence locations=1-804
gaacggcttccgttgcgcgccttcaaaaagatcggtcgcgttggcactttgcctgccctcgcgcacacttccgccgcttcggcggccattcagtcggtgatgagcagcggagacgaagcgacgacgccggcactgaccagcggagggggcgctagcagtacacggacggcgggcggaggcagcgcattccaacgatggggaggcaatcggagaggaagtcatttggtcggttgggactccgcgcggcctcagtctgctgcgcgacagcagcagcaaatgctggagagaatgtacagcaaaagcgaactgcacgaatatcagcagctgttcaaaatgttcgacacggacggaagcggcgccatcggatgcgaagaactgaagggagcgatgctgtccattgggttgcaagcggacgacgcggaaattgaacgactgatcaaagaagtggacgaagacggaaatgggtaagctgatcatcaactgatcatataacagccactctgtttgtctgatcagttcgattgatatgtgatcactctttgccttcggattgtctctttctcctcccgcccattagtgaaattgatttccccgaattctgccaatgtatgaagcgaagtcagcagtcgggcggcatcaaaggtcgtctcagcaacgaagaagtgtcacggcaatgttttgaggtgttcgaccaggacagcaacggactgatcacggagaacgaattcatttacgtggccaaagaggtgggcggcttctcccaggaattggctgagtttgttttccgcgaattgctcggcgact

SEQ ID NO: 96573 - DNA, 999 bp, Heterodera glycines
  SCN-specific regions: Sequence locations=1-6,29-247,269-639,661-999
gtccaattaagccggaaaaaggaaatgtttcggattgttgcaaaacgctcgttgtccaccactcgccaatggcttcagcagccgacccatcgtccgccgtcctccgcgctcagcgctgagccgttcatgaacgccacatcaggtgtgtacattgagcaaatgtacgagagttggcagctcgaccgtggctctgtccacagatcatgggacgcgtttttcaccaatgtcaacgcgggcgccgcgccgggccaggctttccaggctcccccgtcagtcccgtcgcttagcaccgttccgcacgccacggttgtgccgcgtgacatgcgcgaggtgcagccgcaaacagcaggccaagtgatcccggccgatgaactgacacgtgccatcaatgaccatctcaaaatccaagtattgatcaggagtttccagactcgtggccacaacattgccgatttggacccgctgggcatcaacagtgcggacttggatgacacaatcccgcgcgagttggagctggacttttacggcttcactgagcaggacatggaccgcgaattcttgttgccacccaccacattcatcgggggcgaacgcgccacattgtcgttgcgcgaaatttacaaacgacttaagaaaatctattgccatcacattggcgttgagtacatgcatttgacaaacgacgagcagcaggattggatccgaaaccattttgaggcgcccgaagtcacagaattaccaccggagcagaaaaaagtgcttttcaaacggttgatccgctccacaaaatttgaggactttttggccaagaaatggcccagaaaaacgcgtttcggtctcgagggttgcgaagtgttggtgccggccatcgaacaggtcatcgactgctcgcacgagctcggtgttaactccattgtccttggcatgccgcatcgtggtcgtctgaatgtgttcgccaatgtgtgccagcaaccggtgagcaccgttttgggcctgttc

SEQ ID NO: 96574 - DNA, 632 bp, Heterodera glycines
  SCN-specific regions: Sequence locations=1-343,366-596,618-632
actccgaaagttgggccgtggcgtgcactttcttctcgatgctcttcggctaccctccgttccacagttccaatttggagtcgacttactcgcgcatccgtcgctgcgattactcttttcccgtgcgttatccgcccctttcaaagagtgctgttgacctcatcaaacggaccttaattcgtgagcctaaacagcgacttaccattggggaaatgttggcgcattcgtcactgaatccgcctaatttgaaccgcagttttattgatggaaacaatttgcagcaattctcaagaagtgcttcttgtcaacaatttacaacattagcgaagactgtggtactttctatttaaaaaatatttataaatgttctgattgttaattttttatcctcaacaaccgacagtctccaaaaatagtcctccgcctaagcagcccccgtccgcccacgactcgggcatgggcagtgacgaactgtcgggtggatgggtcgggagatttatgtgccaaacattggacaagtacataaactcgatgaccatggtaatgagtccattctcttctctcagtaagttatttttgtgtgtgatccgtcttaattcatttatacatgaaaaaagagtgatcgaccccct

SEQ ID NO: 96575 - DNA, 342 bp, Heterodera glycines
  SCN-specific regions: Sequence locations=1-342
ctattcaaaaatttggtaattgattttttaagtcaatcacgacctgcactaatatgtagagaacggcgttaccagtttggagagcgagatgagatcgaaatgtggctttacataattcacgaggctaaacaaaaaaataaagctgcgttaatttgcgatcagcaattttgggaattgtttcgtactcagaggctgcaatttgagacgtcatctgtctcaatcgaaaaacagtaatgattttaatgggaagaatatatccgaaaaactggaataactactaaatctttataaatatcggaaattgagcgcgataattgaatttttcgggatgactaaaaacct

SEQ ID NO: 96576 - DNA, 490 bp, Heterodera glycines
  SCN-specific regions: Sequence locations=1-315,359-465
ttattcaatttgataaacaaattattaagccatcatccatccaatcgctcataaaacacactctttgttgctatcatctttatcattttcatctcaattgttttcgccatttgtccattggaatgccaacgccaagccgtgcccgggtgtatgccgatgtaaatgtaaacaaaccgcgtgaatactgggactacgagtgccatcagattcgatggggcaacattgacgactaccaattggtgcgcaaattgggccgtggcaaatactccgaagtgtttgagggtgttatggtgccatccgagcaaaaagtggtgatcaaaatactcaagccagtgaagaaaaagaaaatcaagcgagagatcaaaattctggagaatttacggggcggaaccaacgtgatcggactgctggacgtggtcaaagatccggtgtccagaacgccggcactcgtgtttgagtatgtgaacaacacggacttcaagcaattgta

SEQ ID NO: 96577 - DNA, 594 bp, Heterodera glycines
  SCN-specific regions: Sequence locations=1-194,218-230,254-594
gaatggaaaaaaacaaaagagagatgctttaactcttcaaatttaaaatcaattaaatccgactaaattaaaaattaaaaatgactaaaaatcaggccgctgaacaagcccgtctccaggcggaacaacagctaaaagcgcagcaagaggcggccaaacgacaagcggaagaacgagcgcagcaactcaaagcgcaacaacagcaacaacaacaacagtctgtacaagttcaacagcaaaaacaacaacaaccgccaattagcccttccgccacggcacaacaacaaaaagcggcgccggctcccgccgctcaaccgccggccaaagcaccgcagcagccccaagcgccaaaagcagcggttgccccggcacagcaacaacaacagcccaaagcggctgcccctccaccgccaaaggccgccgcggccccgcaacagcccaaagcgactgccgtcgctgcgccgccgaagcccaccgcccctcccgcggtggcacctcaaaagcgcgcgccttcgcccgttgtgcgcgaagtgcaactgcccgaagcgccgacccaacccatcttacgacacgcagaatacacgccgaaattgg

SEQ ID NO: 96578 - DNA, 550 bp, Heterodera glycines
  SCN-specific regions: Sequence locations=1-94,180-466,491-550
aagctggagctccccgcggtggcggccgctcttccaatagtggatcccccgggctgcaggttccatttcgtctccccaaccagctgaatttcatctccatcgtcatcctccgactcttccttcagttctccatcctctttctccacctttttcttggccttctcttcctcctctttttcgacatctttgttgtccgcgcactttgacgaccacctctttgtccaattttgcctccaaaatttctgtgagcttttcgggctctttttcgctcaattcgtcaacatcaagcgcatttattcccaggtatttttcgcccacgtacgagaacatcgcggtgaccacactgctctccggctgaacacgatcggcgatttcgacgcgcaggaacaggcttttcatgggcgatttcacaatgtgatcgcagaagtgcatctcatttcgtcattaaacattcatttacattaactttttataattttatattataatacctttaatagaatctgggataggatttatatgtgctaaaacttgcagaatcctacagtcg

SEQ ID NO: 96579 - DNA, 477 bp, Heterodera glycines
  misc_feature (322)..(322): n is a, c, g, or t
  SCN-specific regions: Sequence locations=1-75,97-477
aaccaatcaagtcccctgttgatgccacgctccacgcgcgccacaatgagttgctcgagtagggctactcgttcgggctctcgtttctgtgggagtggtggacctgcgccacgcttatacatttggtcgggaggcgttcttccgacacgcctcacctcccggttgaactccctcttcagctctacgtccatcacgacattcccgagttccatctcctcggctgcccatcccattgcccggcctaattgttgctttaccagttggacaagtgagagtgggtcaagcatcggttctggttcggattctgtgggtgggtgtgtcnacacatccgtaggtgcaggcccgtccacctctggaaccaaatcttgttccttacgtgaagaggtggatggaaccctgcgtttccgaggtggaaccacatcgccaacggcgttgcgcagccgcttacgcgtgatcctctctgtcgcccctaagtcg

SEQ ID NO: 96580 - DNA, 831 bp, Heterodera glycines
  SCN-specific regions: Sequence locations=1-66,88-222,244-258,280 -526,548-831
tggagctccccgcggtggcggccgctctacaactagtggatcccccgggctgcaggaattcggcacgaggattacatttttattcataaattttgagcaaaacacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattattttttatttttctgtcgaaaaatccttcactgtcgaaatgtcctttgctgatttctttacaatacccagctttttggttcttccgtactctttcctctccattacccgtaccctggcttttttccctccggacaaattgatgcccttctctccaatttctgtttgatctccgtttggtaacaccgaaaaatccgcagtgagtgcgcatgctttcactactttagcatagtgctgttcgtccggcttttcttcttcggtgactgggaaaattatattctcgcggagcgtccgattcaaaatcctttgctgcaattaattaattgagggattaacattcatcactaagttttaggggctaattaggtcgcaattactgaacctgttgcggcacataggccacagtgccacgaatgcccacgtaaccgtacactttgtgcatt

SEQ ID NO: 96581 - DNA, 481 bp, Heterodera glycines
  SCN-specific regions: Sequence locations=1-481
atcgattataataactttccacaacgaggcaaggtccacattgttgcgtacaatttggtccattttcattcgcactccatcgcatttacttaaagaaattattcttgtcgatgattactccttcgatgccactattggcagagatttatttggtattgacaaaatgcgaattatccgaaacagaaagcgagaggggcttattcgttctcgagttcatggtgccattatcgccagtgctcctgtcctcacttttttggacagtcattgtgagtgtaacgtcggatggttggaaccggtgcttcaacgtctggtcgaaaatgacaaagctgtcgttgcacctgtgattgacgttataaacatggacaacttcaattatgtctcggccagctcagatttacgcggaggatttggttggaatttggtgttcagatgggaggcattgggaagagaagaaaaattattccggcgaaaaaaacccgaa

SEQ ID NO: 96582 - DNA, 370 bp, Heterodera glycines
  SCN-specific regions: Sequence locations=1-109,132-189,212-370
tatatttactacataattagagcaaatacggtatacaaacaaaaaacgaatcaatacaaaaaatgcatttacatttgcacattttctatattctttggtagttggattcactcaaaattatgttgttttaatgattcatcatacacaaactttgttttcagaatttgtgttcatttacaaacttgcagcaaaaaacaaaccagcaaaaagatgaaacgcaacggaaattccatttgctcagaaaccaagtctccgcttttggaattgacgccaaagaatgcattaactttccgtggtattgtgtgggctgggccatttgtgttccgggatgtaaccccaccgaaagcaataagtctgaattccgaggtac

SEQ ID NO: 96583 - DNA, 654 bp, Heterodera glycines
  misc_feature (588)..(588): n is a, c, g, or t
  SCN-specific regions: Sequence locations=1-654
agcacaacacgagtgctttattggagaatcttgaagagcacaacacgagtgctttagcggaaatcaacggatttttggccggaacgatagctgaaagaatgagttatgggagtaataaagttacgacctcgtgttcttcggacttgaaaagcgcctatcagtgctcccgaaatcattctcggcctgcccttccgcgaggccatcgacatgtggacgttaggctttgtgattgccgagttgttcctcggttggccgttttaccccggctcttacgagtacgactaaattcgcttcatcgttcaaacccaagggcttccgccccagcaaatgctggccgaggcggccaagacgcatcgcttcttcaaaatgatcaaagacatggcctcctattggcgtctgaaaagcattgagtacgagttggaaatgtccacgaaaagcaaggagacacgtcgctatgtgttcaactgtttggacgacattggccaagtgcaccttccgtccgacttggacgacatcgaccgaatgtgcgagcggaatgaccggcttgaatttgtcgacattctgaagcaaatgctgagcatggaccangaccgtcgtctgacaccgacccgcaagttgcaacataaatttgtaaaaatgacgcatatgatcgag

SEQ ID NO: 96584 - DNA, 519 bp, Heterodera glycines
  SCN-specific regions: Sequence locations=1-118,141-519
taagaccccggtttggtggtcatctgagcgccatataggtttcaaccatctggtgcaggccgtcgatgtcggcgactttgtcgagctgtacgacggtggtggaccaattcgaaggcttcctccgggaccggcactgcccaaaacgcgaatcctcgacggaagcaatggcactcgcagctgcttgaaggtcaaagtcaacttcatgccgttggattttctgcttttcccggtctcggcgaaggagaaaaacctcagaatggcaatgagcgccgaactcggaccaatcccaatcgccaacgaaaacagtttcaaattgcattgcttctaccggggagtggcgacgctttttttcgccaaggacagcaaagaagaaatgatcgcggaagtgtacaacacaccgtggctgatcaaaagcgacggcgcgtcattagccgaatcggacttttccaccatcgtccacactttcgctttctgccaatcgcaggacgttcatcgtcagggattggtggtggacgcctc

SEQ ID NO: 96585 - DNA, 589 bp, Heterodera glycines
  SCN-specific regions: Sequence locations=1-109,142-150,194-554,576-589
cgcaccatccccgaaagaacagcacacagccacgggcaaaatccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtgttttttacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctggtcacggggaacccttctcc

SEQ ID NO: 96586 - DNA, 945 bp, Heterodera glycines
  SCN-specific regions: Sequence locations=1-316,339-381,408-909,931-945
tcctcaaaagcttcaattggccaacaaataccgtcgaccggtgctttcattgcggaggatgtggacggcgaggcacttaccacgctggtgttgaaccgtttgaaagttggtcttcaagtgtgcgctgtgaaggcgcccggctttggcgacaaccgaaagaacacgctgaaggacatggcggtttcaactggtggcactgtgtttggtgaggaagcatcgctgatcaaacttgaggacatccaaattcaggactttggcgaggccgatgaagtcacggtgaccaaggatgacacgctgattttgcgcggcaaaggctctcaggaggacgttgagaaacgtattgcatcaatccaggatgaattggatgcttccacatcggactacgaaaaggaaaagctgaatgaacgtctcgccaagctgtccactggtgttgcactgctcaagattggaggtgccagcgaagtggaagtcaacgagaagaaggaccgtgtgacggacgctctgtgcgcaactcgtgcggcggttgaggagggaattgtgcccggtggtggtgttgcattgcttcgcgccttgaaaaagttggacacactgaaaccggacaatgatgaccagaagagcggcatcaaaatcgtccaaaaggcgattcgccagccaatttccaccataatcgccaatgcagggcttgagccctcagccattgtggagaaagcgttggccaatgcagagaccaactaccggtacgatgccatgaatgaccaatttgtcaacatgttggaagcgggcatcatctacccggacaaacgtcgtgcccgacggcgttgcacgacgcggccggcgctggtctcgttgatggcgacgacggagtgcgttgtcaccgaaatcccgaaagaatagccgacgatgccatccggtggtggaatgggtggcatgggcggtggaatgggc

SEQ ID NO: 96587 - DNA, 424 bp, Heterodera glycines
  SCN-specific regions: Sequence locations=1-424
atttaacagtctcctattctttgatcagtgatttaacagtctcctattctttgatgtgatttgatcggtctcctattatttgatcaattatctgatcagttttctgttcaccacctggtgttcgtacgttctttccgcgtcgtcaggaaaataaatgcatgccaacccaaagtcggcaattcgcacttggtttcgcaccgtcaccaaaatgttgtccggcttcaggtccttcaaattttagtttggcattaaatgtcatgaaattcatgcttagtcagtccccagcataggtcgattttcaccggatttcgctaaaaaatttttgacaaatttgatcagcttttttcactttattttccttaaaaattcaaaacttttccgctggcgcctataaaaacaaaaattttattgaaatttccaaaat

SEQ ID NO: 96588 - DNA, 473 bp, Heterodera glycines
  SCN-specific regions: Sequence locations=1-193,215-473
gtttctgacattacactgctaaaatgggcaaacacaaaaagccgttcattgaccgcaaaagtgcagtgaattattctttacacaacaaacatttggaggaggcgcagcggaccagtaatcgtaaaagtgttgcgaattttcgtccctttgataaacactttgaggatttttatgagggatatgcgaatgaagcggaggaggacggagcggaggaaatgcatgacggagaagggcaaattgagaccgatcctgcgcttttctcttctctgctggcggatgggcaatcacagcgatgtggcgaagagcgttttcagcgggagctgcctgatcccgaactgaagagcgcggtgttgcgctatgtaaaagcgatggaaattggcaaaggaagggccgagccgacggaggacattttggtggacaatgcgaagagaaaccgttgggattgcgagtccattctctccattcattcaaac

SEQ ID NO: 96589 - DNA, 527 bp, Heterodera glycines
  SCN-specific regions: Sequence locations=1-527
actagtggtccccgggctgcaggaattcggcacgagggccctattagactgctaaaatgggtaaaaacaaaaaaccgttcattgaccgaaaaagtgccgtaaattacacactgaacaacagagagttggaggagacgcagcggatcagtgattacaagagcttttcgtttcgttcactcgacaaacgttttgagggtatttacgaggactatgcgaatgaagaggaggagggagcggaggaaatggacgacgaagaaggacaaacgggggctgattctgcgattttccgttctctgctggcggatgggcaatcccagcggagttgcgaagaacgttttcaccgggagctgcccgattccgagctgaagggcgcggtgttgcgttatgcaaaagcgatggaaattggcaaaggaagggccgagccgacggaggacattttggtggacagtgcgaagagaagccgctgggattgcgagtccattctctccatgcattccaccctttacaatcatccgaccgaaattagg

SEQ ID NO: 96590 - DNA, 549 bp, Heterodera glycines
  SCN-specific regions: Sequence locations=1-549
aagctggagctccccgcggtggcggccgctcttcactagtggatcccccgggctgcaggatttccgcacgagggttcttgccatggcaatcgctaggcagttccgctactcaatttatcttctgttagttttggttcgtttttctctccatcaaagtgccgaattggaggacctccaacgcctttgccccgacttaaaaggcgctttctgttcccattgtgaccacaaaagtgttgagcaaatttgtccaatcgaatgcaacttttgctcaacttttcgctcaaacgaaacgccaaaattcttcggaaatgccgcagaaaatttgattgagctgaaaaggcaatgcgccaccattcgattggccttttgcaacgtttgtaagatcacttcgatcaacgaattgtgcgtggaagaatgtttggactgcgaagcgggcctaagagacgaacagaaagaagtggtgccattggtacagacctggcaacagtcagcgggggatggactcgcaattggcgacgatggcacaaattcagcgggagaagctgccga

SEQ ID NO: 96591 - DNA, 492 bp, Heterodera glycines
  SCN-specific regions: Sequence locations=26-492
cctcgtgccgaattcggtacgagggtttgagaatgcactcattgctttgtccacgtgcgtccagctcccaattatcggccctttttaaacgtttttccgtcgggaatggcaccgcttcgaccgattgtgccaccaaaaaagggcctgtcgatgtgctgcgtgcacggcttctctaccagagcagaaagcgtgggatacgcgagaacgacattttgatcggtgggtttgctgaggaacacttggtcaaaatggaggaacacgagttggagcagtacgaccggatcatcaacggacgacacaccgaatgggaattgttccattatttctccggcgtaaaagaagcaccagacgatttggacaaaaatgcggttttccagcggatgcgccaacactttggggagaaaacaccacgccaattctgatggacaaaatgatttgttaacatttacaaataaaaacccagtgcttggtaaattgtgtaattgcaaaaaa

SEQ ID NO: 96592 - DNA, 446 bp, Heterodera glycines
  SCN-specific regions: Sequence locations=1-18,43-88,112-446
ccacactatcacatatcaaaaatggctcccgcaaagaagaagtggtctaagggcaaggtcaaggacaaggccaacaatgccgtcacccttgacaaggccacctacgacaagatctacaaggaggtccccacctggcgtctcatcaccccctcggtgctcgttgaccgtctccgcctgaacggctctcttgcccgcgttgccctcaaggagctcgctgacaagggtgagatcaagctcgtgtctgcccacggctcccagctcatctacactcgctccaccattggtgccgagcccgttgccgctgcctaaattgccccggttgttctgtttctcccacacgaaaaatgaaataactcgtcttttggtcttggcaatttgatgcggtttcgtctgacgcaacctgctgttgtccgtcgagtcgtaatgtacattgttctaccgccaaa

SEQ ID NO: 96593 - DNA, 560 bp, Heterodera glycines
  SCN-specific regions: Sequence locations=1-560
aaaagctgggagctcacaccgcggtgggcggccgcttcttgcatatagtggatcccccgggctgcaggatttccgcacgaggcctcaacctcaagtcgtcaacactctcatcatgtctgccccgctccagctcaacctgatcgaagccaaccacgcctcgggcaacggcattggccagttcacgtccacgggcatcgacgcggccgccctgggccgcatccagccgggccaggacgtgcaggtcaacgtgatccagcagaatgccgcgtcgggcaacaacattggccaggcgcaattcaccaacgtcgacgccctcgtccacaagatcaacgccaacccgaacgtgggcgacgtgcaagtcaactttatcggtgccaaccaggcctcgggtaacaatatcggccagtcgcaggtgtcggacattggtgtcgtgtcgacgtcgggtcacgcttggtccggccatcacggccatggccacgggcccaccacgggtgacatccagaccaacatctcccaagccaaccaagcgtccgggaacaacattggccaggcgcagagcg

SEQ ID NO: 96594 - DNA, 481 bp, Heterodera glycines
  SCN-specific regions: Sequence locations=1-481
gttcactcacaatcaataacgatattttggacgacgttatcgccttcatcaaacggtccgaattggctcaaaatttctcattggtgagtcaccatttcaattcgcttgcccaacggagaatgcacgacgccaacgcacattgggtggagggcgactgcgtgttcattgccaatgcgaccaccacgcgaatgatcatccccaggggaaacaacgggggatttgaggaagttcccgtgcccacggttgctcagccatcatatgtgctcggctttcgtggcacaattcatttcaacggcacactcagcgacaacgcactcgccttcttccgtcacgcgttgcccccgcccacaacgctgtaccgcttctcggtgctggacgaattttatcgtgccaacggactgctgagcccgttcaaaacaacggaacgcatcaacacctttctggacacgtgcgtgcatttggttgagttgggcggcgacga

SEQ ID NO: 96595 - DNA, 463 bp, Heterodera glycines
  SCN-specific regions: Sequence locations=1-400,424-463
ttgtcaaataaatctctaatttcctttttcctcctccaaatcttcttcgtaagctttgcctctcgtgccgtaaaacggtcgctttactcggcgaaatttccattggcactaaatgaaattcgatcagtcgtatcactgaattcgtactttagcaaaattgtccaattttgcagcggagtgttactcacagaaaacattgttctgaccgctgcccattgcattttgagcgacgaatttggtttggccgattacatccacgtgaagggattcggatggaatgcccactccaccgaattcgtaattcgaacggattttatttttctcgatttggaagattcaatttgcgcggacattgctttgatttttttgcccccaaaagtgactggaatttttggcactgccaaattcacaaaattcacagagagcgaatggtccaataaaagtgactccgacagtaaaattt

SEQ ID NO: 96596 - DNA, 251 bp, Heterodera glycines
  SCN-specific regions: Sequence locations=1-61,85-149,177-251
attttgttttgtgccacatttgtatgccattctccgccattgattagaaattttgattttcttaaaaaatatatttttttaaatgaacattttgttttgtgccacatttgtatgccattctccgccattgattagaaattttgattttcttaaaaaatatatttttttaaatttttgtgaattgttaccaccacttttcgttttggcaattttgctgatctggtcacatatataataaatgtgcactttat

SEQ ID NO: 96597 - DNA, 476 bp, Heterodera glycines
  SCN-specific regions: Sequence locations=1-476
cagctatctaaataaaactgacgcattaatgctgtatttaatcagaatttttttgtctcattattatcaaaatggcgtcatttattttgtttattattttgattattacgaaagctaataactcaatgggacaggattctggtactaatgatgtccaattaacgttggtcaacggttgtccatacaaaatttatgttgccggtgcggtgcaagtgaatttgacggtcaatgaaagacaaacgaaaaatgtgccgtcagtgagcacagcgcaacgattatgggccaacactgactgtgacagcgaaaacaacccgttgtgcaaccttcaagcagcgatgccgccaatttcactcttcgagtggacctttgatgcggacgggaaacaaacatatgatgtcagttatgtggacggtgccaatgtgccgatcagtgtacgtgtgctgaattgtcctggtgtcaatttcaacaaaaaattg

SEQ ID NO: 96598 - DNA, 558 bp, Heterodera glycines
  SCN-specific regions: Sequence locations=1-171,193-388,428-558
gagggtcggaacgcaatatctcaggaaaattgccaaaattggcgagggctgccatactttgattaattcaatctgctttatcagcttcattgttgggtacgagcaattgttgccaatcaaatggcacggacagcgcgcgagtggtgccacattttcaagcggttcaattcgggcacgtacaacaaccagtggctgatcgttgactacaacaagttcaaaccgtacaccgaattgcctgaccatggcctattttatgtgctcgagcaaatgcccacaattgttctataccaggacatgacccagtggctaaaacagaatgggtattttgccagctacaacatcccattcttcaagaagaccagcctaattagtggctttgagcaaaaagtttaaaaaataaattttttaaattaaaaattcttaattaccctcagggcaacgaattttattggttcagctggaaaagttgtccacgcgcaaaaatttttgccagggaccaacacaaagtggtggacgtggacagtctgaccaaactgatgcgttataacgattacaccc

SEQ ID NO: 96599 - DNA, 233 bp, Heterodera glycines
  SCN-specific regions: Sequence locations=1-233
cgctgttctccgttttcccacagaatctcttcgggtattcttgcaaatcgttgtcgggaaaggaggtcgattggtttgtcgcttacaaattgcccgatttggggtccgatggcgacggcaccgcctttctttattcggacgcgaacaccgccgcttggcgcctttccgacaaaaatgtggaggacaaaacttcagcaattggactgaccgtctcgcaactgttcacagcaaag

SEQ ID NO: 96600 - DNA, 551 bp, Heterodera glycines
  SCN-specific regions: Sequence locations=1-237,259-394,416-551
gtccaattaagggggagcgataaatacggcaaaattggcttttaaatggctcagagccccataaaattgttcgacgttgccaaggaatggtgctttgcgagcgaacattttcactgtcagagcctttgctgcccgaaacaatcaaattcatcaaggagagcttggaaaagcaaggcgaactccatttcgaattgccccatgtttttgtggttttcggcgcatcgggcgatttggcaaaaaagaaaatttacccaaccctttggtggctgttccgcgacggattgcttccaagagacactcacattattggctatgcccgctcaaggcttacgcttgaaacattgcgcaccgcctttgaaaaacattgcaatgtgcgagacggggaaaggcccaagttcgagcagtacatcaaacattgcagttacatttcgggtcaatacgacacggacgagggcctaattgcgctggacagagccatcattgagatggaacacacattcaaaaagcccgccaaccgtctgttttatttggcactgcctccggaagtgttt

SEQ ID NO: 96601 - DNA, 416 bp, Heterodera glycines
  SCN-specific regions: Sequence locations=1-387,409-416
gggattggcgaattgtatcggtcgatgttcgtctccgcccaggtcaaactccttcagagatacgttcccgaactgaggccggaagacgtggagaggggattggcggggattcgagcgcaggcgatggatgccgaggggaatttggtggacgactttgtgtttgacagcggagaaggacccttggccaaaagaatgcttcacgtcagaaacgctccgagccccggggcgacgagttcaatggcaatcgcacaaatgatagtggagaaaagcacggagaaattcggcatttaattgctcacacataaaatacggatttaattgggcaatgggcattttgcacttaaatattaacttttttttgttttgccattccaatttttgaagctatttttgtggtaaacatttttatcccttcc

SEQ ID NO: 96602 - DNA, 275 bp, Heterodera glycines
  SCN-specific regions: Sequence locations=1-275
gtttgcgtttcaaatatcgtaagattgtttgatagggccagacaaaagaaggcaactgttggtaccaagtttgcggtaaaaaaatgagaaaaaagatgtttgatagggccagacaagagaaggcaactgttggtaccaagtttgcggtaaaaaaatgagaaaaaagagataaccattttttagtcaagaattttttttgtttgcgtttcaaatatcgtaagattgtttgatagggccagacaagagaaggcaactgttggtaccaagtttgcggt

SEQ ID NO: 96603 - DNA, 381 bp, Heterodera glycines
  SCN-specific regions: Sequence locations=1-344,367-381
caacacaaaagataaatttgaggttggattagacgtgcaattttttgctccacaagaaattgaggtcaaagtgtcgggccaagatgtgatcattcattgtctccacgaaattcgcaaagatcagcacggaagtgttaagcgcgaaattcaccgtcaataccgactgccaaatgacgtcgacgcggcaacattgaaatctcatctgtccacccgtggcgtgcttacattgacagcctcgaaaaaggactaactgagaaggaaaattgagtgaatttgatgggaaattaggacggaaattttgctcatcttgtgagctgctgttgaaataaattgaaacaaattgctaaaattaaaataaaataaaatgctccaaccaaaaaa

SEQ ID NO: 96604 - DNA, 399 bp, Heterodera glycines
  SCN-specific regions: Sequence locations=1-399
ggaacaccaaatcccaactgatgagcggacagagtgcacagaaagacggaaagatcgccgccacaattctaatcgacccggtgactcagaagagtgccaacattaccatccgaacgccggcgcaacagttgcgcatggagcagatcgaagtgccgtacaaagtgcgccctttcgcttttgattcgccgcggagtgcgcaacagaagcattcgctggctcagctggtccacccattcgcttcaattcccccccccatggaccggttgaaggggcaaagggaacttttcgaggatttgtctaccgggcccccctctctccaatggtataccggggggggcaaaaaggggggtcaaaccccccccatttggggtggttgtaaaaaaagtgccccaccccccc

SEQ ID NO: 96605 - DNA, 552 bp, Heterodera glycines
  SCN-specific regions: Sequence locations=1-202,224-435,458-552
acgaattggagccaaatgacttatcgggacggagatcgcccgcaacgcaaaacatgggtccagaaacaaacggaagccaacaaatccacgccgactttgaacctttcttcttccggcaacggcggtccatcagtcgaaggacggacgagggacacgcatttgagtggggacgaattggctgataacagtccgcaaaagggacagcaacaaattttgaatcagacgttcaccaaatcgtcgaccaaagagtacgacagcgcgactctcattgcgcctgtctcaaatggcaccgaatcgctcaacaatcgcagcggggggttggtgctcgaggacgtctgtgactcaaattcggagatgacgccggaaatgcaggcaaagcgacgcgcgattttggccagccaaattcgacgcaaagagcgaataatggcgaggagtgaggagaaagagacggaagagatggaccgactgcaggtcaaaatgcagcggatggagcaggcggagatgcgcaggatggagcgggagcaaaggcgtcagaaactgctcgaggactac

SEQ ID NO: 96606 - DNA, 524 bp, Heterodera glycines
  SCN-specific regions: Sequence locations=1-3,27-180,203-246,268 -372,394-490,513-524
caggaagcagacgaagaggaggagaacggggagtctcaggagaagcatctcgactcggtgctttacgacgagggcgcatttttggtgcttccctcaggtgctcgcattggtcaccggtcgttggtccgatactttcgccagcgtttgggctatggccttggcgacggtggcagcggcgattggaactctaagcagcagcagcggcaactgatgcataatgccaaacagtcgcgcattttgaagcaattgggtggccctgctgtggggggcggttgttgttcggttgccgttttagaggcgtccgttaaagcgcgtgcgcgcgatgtttcgttcatgaagcggacggtggcgcggtaccaactcagacgcgcgttggcctccaacaaattgttcaaatcacgcggccgaaatgatcaacagtgatcggaagcaaatcaatcgcttgacgaatattattgttgatatattacgagaatttatttgtttacacatttcccaaaatattggagaaaaataatataatc

SEQ ID NO: 96607 - DNA, 565 bp, Heterodera glycines
  SCN-specific regions: Sequence locations=1-316,338-565
cccaattaaaccgagcaaatttcaaatttaaaaaatgtttctgaaaaggagaatctccgagcctagcgacgaagatgaaaaacaacggacaaatcaaattcctatcgataacaattcatgtgttgacggtattccgctgaacatccaatcattacgaaaaacttatgtggacagagaagagccatttttactggaaaaggacatgctttcctgtccatttgaccaattctctatttggttcggaaatgcgatcacgcaaaccgacctcaaatacgaagaagtgaatggctttgctttgtcaactgtctcgaggaatggaaggccaagttcgagaatgctattgctcaaaggtttcagtaaggttggtggtttcgtgttcttcactcactcaaacagcaaaaaggggaaggaattgagtgagaatccgtacgtctccgcactgttttattggccaaaggtaaaccgccaaattcgaattgagggtcgagtggaaattctcggggaagaagtggccgacgtttactggtcaaaacggccaattgagtccccgagagggctcagaagt

SEQ ID NO: 96608 - DNA, 464 bp, Heterodera glycines
  SCN-specific regions: Sequence locations=1-464
ataagatgaaattgggcatctgcataagctggggacgaactggcgggcgattgatggtgcctccgagcaatgagccaatccgaccattcactctgatttggaataagacggatggtttggttgcacttcttgggcaaaagttggaaaagggaacttgggttctcttcacactgtccactcggacggcctttttgcattctgtcgaccgaaaattggttgaccgcgtgtccatcacagaccaacgtcgtgagacagcagttgacagtatgaacattcaggtgatggcattcgttcgctccttccgacggtacaacgattattatcgcattggcatggaccaactgatcggatgggttttggtgtcggaggattcatttgtccgaagggtcgtcctccaagaaaacctcgctgctcaaatgtccatcatcttccaacatgactgtgtgcgtggcttcaattgggtg

SEQ ID NO: 96609 - DNA, 481 bp, Heterodera glycines
  SCN-specific regions: Sequence locations=1-481
ctgcgccgcaacaaattccgcaaacttcccaagtaattgccgcaactgttattagtgcgaccggtgcttctggcgttttgcaattgggtcagcaaagctcaaattctgaatttctgtcagccttcgaatgtcccgtttgtcttgattacatgcttccgccatatctgcaatgtccatcgggtcatctggtttgtggaaattgtcgtcctaaagtcactgcttgcccgacatgtcgaggtccaattccgagcataagaaatcttggaatggagaaaattgcagcaagcctgcaatttccatgcaaatttgctcattccgggtgcacccaattcttttatcatcatgagaaagttgagcacgaagagatttgcgagtttcgtccttaccaatgcccttgtcctggagcttcctgcaaatggcaagggagtctggcagatgtgatgagccatctaatgaaattgcacaaatcaatcacaacttt

SEQ ID NO: 96610 - DNA, 331 bp, Heterodera glycines
  SCN-specific regions: Sequence locations=1-285,316-331
gctgacatggatatttggtcattggttggctcaaaattgaaagtgctcggtgaagtgaatctctctaacgaaacctatcgcggcattgagaactcagagaaatattgtggggcgagctcgcttatcacggatttctttaacgtgatgaattgtggcgatgacaacggagaaccggtgacaaaacgcataaaaccgatggattttggagtgcaaagaatgcaataggacatctgtgagccattgtaaagaaagagtcttggaacttttaattgtttcccaattgtaattcctttctttatttatttgctttaaaaatacaatatgacaaaat

SEQ ID NO: 96611 - DNA, 235 bp, Heterodera glycines
  misc_feature (235)..(235): n is a, c, g, or t
  SCN-specific regions: Sequence locations=1-235
gtaaatacaacatctgaacagaccgaatgcgaatcgagttcgacacgcttttctcatgaaattgttttggatgacgatggcgtcgactgtccatccgttgttagagacgaattgccggcgaaaaagccgaagagaatttgaatgaatagaaatgaagaccttttatttcttttcgggtattcgttttgtttatcgtcgctcttttttacggtgctcaataaatttatacatttan

SEQ ID NO: 96612 - DNA, 628 bp, Heterodera glycines
  SCN-specific regions: Sequence locations=1-628
gtcgcgcaagggggagacgacggtgcagcctttacaagtttctttggaagacctgtacaaagggaagaatacaaaattgcaattgacgaagaaagtgctgtgcaaaacgtgcaacggaattggtggaaaacaaggctcggttcggaaatgtgaccgttgtcagggaagcggaaaggtctttcgcacgcgtcagattgggcctggaatgatccaacagatggcggcgcgatgtgatcaatgctcgggtgaaggagaaatggttgatgaaaaggaccgatgtaaaaaatgtgttggaaggaaaacggtgcaggaacaaaagataatcgaagtgaaaatcactccgggaatgcgcgataatcaaaagattgtcttctacggagagggggaccaggagcctgggattgaaccgggggacgttgttttggtcatcaaaacgaagtcacacgaacaattcgagcgaaagggcgacgatctcttcatgaaaaaaacggtaagtctcgcagacgcgctttgcggtttcactacgaccattaaacatctcgacggaaggcaaattaccctcaccacgatgcccggcgatattataaagccagaatccatccgaggagccatccaagaaggaatgccc

SEQ ID NO: 96613 - DNA, 544 bp, Heterodera glycines
  misc_feature (544)..(544): n is a, c, g, or t
  SCN-specific regions: Sequence locations=1-544
gtccaataaagcacttccattttcagtctttcgcttacaatccgtggccattgctctgaccctttggtcgtgtgcacttcgtcccgaacattcggcgcaaaggacgtcgaagtgtccaacactttgctgttgctcgacgggacgccaaacggcgccggagcaaatcagcaacatatcgtctccatcacaaatcgctttgtggagctttccgaagcttttcttcccgaccaaacgttccgtctgaaggcgcttttggagcaaaatttgctcgatttttacaatgaaaatgcaccggcggcggaggaatcgaaaggaatcaaactgaatgaactgctcgaccatgtgcagatcagtgagcagcaattgcgtgaagaattggccaaatttgccgtcgttgaaccggctgaaggtgttgcgacttttaccaggctcattcttaacttggagatttatttgctctgtatttgttccttgataattgtccgttaattacccattggtttttgtcacaccacgggtaattattttttccaacttaaaaaan

SEQ ID NO: 96614 - DNA, 554 bp, Heterodera glycines
  SCN-specific regions: Sequence locations=1-334,356-554
tgacatataaattctctgctttgaacatttttaagatgacacttaatccgcctcatttaactttgcgaggttatgagggtcacgattacatgggagacactttcaagaaaacgaatgattacgcccaaacttggttcgttccgttgatgaggggacaatctatagacaacagacaaattcctggcgatgattgtggattcttcgaagatcaatcggttagatgttttactgcttttggtgcaaaattgggccgtttatattgcgaccttgagcatagggaccttcaggaatgtgtttcgcgcacaaaaaagaataaacggttctggaagatcagagatgttcgcttcaaaaaatggctcagaggtgaaacgccacacattttcgaaccattggctgactatttgaaatcggttcatggtgctccgacttcctatccgactggtcatcgtgtgaagaaatgattagattagatatatcgtgagattctggtttttaataggagtcacatatgcatatgtatatttctgcgcgataaaatgcttttgttcaaaaac

SEQ ID NO: 96615 - DNA, 478 bp, Heterodera glycines
  SCN-specific regions: Sequence locations=1-53,107-131,153-228,253 -399,432-478
tgctctcggtctcgttctcggccgacaaccgtcaaatcgtctcaggctcccgcgacaagaccatcaagctgtggaacacgcttggtgagtgcaagtacaacattgagggtgctcacaccgagtgggtctcgtgcgtccgcttctcgcccaaccccgagaaccccattatcatctcggcaggctgggacaagctcgtcaaggtctgggatctctccaagtccaagctgcgcaccaaccacattggccacaagggctacatcaactcgctcgccgtgtctcctgatggctcgctctgcgcgtccggcggcaaggacggtatccccatgctctgggacttgaacgatggcaagcacttgtactcgctcgatgccggagaggagatccacgccctgtgcttctcgcccaaccgctactggctctgcgctgccaccacctcgggcatccgcatctgggatctccaaaccaaggagcacattga

SEQ ID NO: 96616 - DNA, 402 bp, Heterodera glycines
  SCN-specific regions: Sequence locations=1-152,174-181,206-358,380-402
gttttgcagaatatatgatcaaattctgcaccaaaacgtgtttaaagtgtggcgaggctacgacgagcaaagcgaacggcgcaaaatctgtggcggcggtcggaccaccgcccatcgaattaatcattgaaccgatgatggagacaaaccacgaaaaggggagaaggagcagtaacagaaacaacagcagcagcggggggaggagggaatgtgtggacagaggcgaaagatgcatccaatggaagggcgatggactgtgcgatgccaaaagtgggacgactaaattcaacagaggacagcgaagggcgtgtgccaaaacgtgcggcgattgcaaatgatcagaagcaaaagaattacataaatgtacaattacttattgtgctttgcataaacacctaaaat

SEQ ID NO: 96617 - DNA, 480 bp, Heterodera glycines
  SCN-specific regions: Sequence locations=1-79,101-480
gtttgaggacaaaatcacaacgtaaatcaaagaatgtcttcaaatcctgtagaagggactgaaaacttgggccaactacgccaaacggcaccacaacaaacgactgccgcggatccgtcgtcattgaattcttcgaattccgctgccgttgaatcaatggattcggagggtgtttatctttttgctgaccgtacccaatcctccaactcgctcacccccgaacaggccttcgtccacatggtcaaggcaatgcttggcaccggacttctctctctcccttatgcgttttcccattctggtctttatcttggtttaatccttttggtcttaatttgtcttgtttgtatgttttgcatgcggcaaattgtttttgcggcccattacatttgtacaaagaatggtcgtgagattattgactatgccaacattatgcgtggtgctgttgaggcagggccgtcatggatatcgagcaggggatac

SEQ ID NO: 96618 - DNA, 609 bp, Heterodera glycines
  SCN-specific regions: Sequence locations=1-228,250-609
ctcatttgtccattttgccattccgatgtctccaccaaaacgtgccaaagtgtcagccgatgatgatggggagacaatttccgacgacggggagccatcaacgtccgcgggggcaaagcgaaagcaaaaggcgtcgaaaccacgccagcggaaggcgcacgaggcattcattttgctggtggacgtgggccgttcgtctgccgaaaactcggcgggggcacagagcgatcacggcaccaccactgacctcgaccgatcggtgcaaatcgtcgattgggtcctttcacgaaaaattttcaccgaatcctccgatcgcttctctctgatgttcttcggccacgaaaacacgtccagcgacgaccatccgaatgtttacgtgcacaacgaacagttcgccacggcgcgggtcgaatggctgcacgtgttgcagaacgaagtgcagacgaacgtcaaatgccccggcgattacgtcgacgccctttacgctgcgttggacgcactgaaagtgcactttgacgacgcaaaagaggcgggcgaaccgatgagcggagcgacggtcactttggtgagcaatttgagcggattggacgacgagcgggcggtgatgga

SEQ ID NO: 96619 - DNA, 549 bp, Heterodera glycines
  SCN-specific regions: Sequence locations=1-192,217-234,256-263,293 -491,514-549
gtttgagatatggcactctctctattccttctgttggtcggaacaatcattgctaattgcaatggtgacccaaagatgaaatctgttgaagagaaaagtgtgccgcctgccgccttttggccttacattttgcatccaaaaacacctcggcataaatcagaagagagggaggattactacgatgccgtacgagcagaagaggaggaggcggagaaggcaacattgacaagcagtacagcagcaaacagaggcaacgaaaagcaacaagaagaggaggagggggaggaagaagcgcgacaattacagcaaatgatggcacttctgttggccaacattgacccggtgccaatgtttaccgccaacagcgaaaagccaaaaacgatagcacaaacgatggcaccgacaaaggcagcaaccgcgttgacaatgtctaaagtggacggggaaacgtacgacgaacggacagaagcgggcaaagacgacgaagagacagacgatgatgatgacgaagagcatgaaacccgcaaaatggttgacacggaattgaag

SEQ ID NO: 96620 - DNA, 487 bp, Heterodera glycines
  SCN-specific regions: Sequence locations=1-487
cattgcgttggtgagaatgtgtaaggcccacagggggatgacagtggttgcgattggaccgttgacgaacattgcaatggccgttcgcctcgatcccgactttctctcctacatcgacaagctgtacatcatgggcggctcgctcctcgccaagggcaacgccacgcgcactgccgaattcaactttgcctgcgacccagaggccgcccacattgtcttcacgtcctcgaccaagcactcgacacgcgctccgaaaatcgtgctcgccccgctcgagctcacgttcgaccaagcattcgactgggacctgattgcccgcctcagcgacccgtcgcggcacgccgcgcacccgtggtccaagttcctgtaccgcatcacggcggcgctgcgccgcatgttccggtcgcccgcgcacctggatgccgtggcgcaggcaaaggacaagcaccaggcacgacgtgcatgtgccgccgcaccatgttgcgcg

SEQ ID NO: 96621 - DNA, 354 bp, Heterodera glycines
  SCN-specific regions: Sequence locations=1-205,227-279,301-354
gagactttagctcaaatttcttagagaagagtgcgttctcttaatttttcaacaaaatttatgtgctccgacaacaacgaattgctgaaggacccttccgccgcccacaaattgacgcttttgttggccaaccgccaccgttgtcataaaagcagaaaaactttggccgattttttacgaaaaaaatttcattttcataaccgtcgtgtgaaaaactgtgccaccaatttgacgacgacgacaaaattttttaccgatattagaaagggttgttacacgaaaagcattgaaagaggaggaggaatagcctaacaaaagtcgaggacaaagtgccgaaagtcgagacaaacgaac

SEQ ID NO: 96622 - DNA, 559 bp, Heterodera glycines
  SCN-specific regions: Sequence locations=1-175,202-475,533-559
caatagtcgctcatttgtcgccaaatcatgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgacgataagaagccggacgaggatccggcaaaaaagggcaacggaacggacacgggcgacgacggcaaaaaaacggacgaagcgggcggagcatttggcgcggggtccatttttgttgccattcttttcggcatggctttgatgttcggactgatcaaaatgtatgtccattgggagaagcggcgcgagtcggacccaccgaactatcagatgtattgaaaaaacatggaaagcattgggccaaaacaaacaaagatttccttatttcatttgttgttgttttttgcatcatttttatcacttctcattaaaatttctctaaaaa

SEQ ID NO: 96623 - DNA, 476 bp, Heterodera glycines
  SCN-specific regions: Sequence locations=1-39,70-476
cgagtgttgttcatctgtttctgcttctgacaatggcactgctccttcttcctcctcctcttcttgggctgagttgggtctttctgatgcgactcttaacgctcttggcacaatgaatttcccttttccaactccaattcaaaatgctgtgattcctatcgctgttaaattgaaaaaagacataattggtgcagccgaaacgggcagtgggaagactctcgcatttgccattccgattctcgagcattggctgaccaatgcaattgccacaaatgtccaacattttccggtcaaaggctctctttttgcgcttataatttcgaccacgagggaattggatgttcagcagggatgtgcctagggcaacgaacatttggcggatttgtccgcacttcgatttttggttgttgatgaaattgatcggatgttggagcaaggccattttgagaatttcaagaaaaagaaatttaaaattt

SEQ ID NO: 96624 - DNA, 433 bp, Heterodera glycines
  SCN-specific regions: Sequence locations=1-291,359-433
gttttcagcgcgcaaatctaaaaatggcatctacccaggaattggcggtcatttacgctattttggcacttcaggacgaggagttgccgatcacggcagaaaaagtgcaaacgatggtcactgctgccggcgttaccgttgagccgttttgggctgggctctatgttaaggcacttcagggtgtcgatgtgaaggctcttctgtccgccgttggcagtccgggctcgggagcggcagcacctgcgggaggcggagcagcggctgctgcgcctgcggctgaagcagcaccggccaaagaggagaagaagaaagaagaggttaaggaagagtcggacgacgacatgggattcggacttttcgactgatcacgtacacatgctattatgtgtttttgttgtttaccagaatttttgcgtattaaatttgtttgttg

SEQ ID NO: 96625 - DNA, 476 bp, Heterodera glycines
  SCN-specific regions: Sequence locations=1-476
gcgagatgcacactcgacttgacagtataaaggcgtcctgcaattcgggtccttcaagctcaagtctggtcgcacctcgccctactttttcaatgctggtctctttaacacgggcgaccttctcaaccaagtcggacggttctatgcatccgccattctcgaccacgaggccacattccgcccatcagtactcttcggtcccgcgtacaagggcattccgctcgtcgccaccacggccgtcaacttggccgtcatgggccacaacatgccctacgtgttcaaccgcaaggaggccaaggaccacggtgagggcgggtcgctcgtgggcatgtccaagctacagggcgagcgagtcttgattgtcgacgatgtgattaccgccggcacggccattcgcgaaagcttcccgctgttgcgcgaccacaatggcgccaccgtggccggtgtgttggtggcgttggaccgcatggagcgcg

SEQ ID NO: 96626 - DNA, 358 bp, Heterodera glycines
  SCN-specific regions: Sequence locations=1-358
aaagctggagctccccgcggtggcggccgccctaccactagtggatcccccgggctgcaggataccggcacgaggtgtacctcttttagacgaagcgtcctaatttccctacaaagtttgaaaacgggcgcgaagcgcccgtcctgaggccgcgaagcggccgaatatcccccaaaaaaaattaaaaaacgggcgcgaagcgcccgtcatgaggccgccaagcggccaaatgttctcaaaaaattaaaagacgggcgcgaagcgccagttcttaggccgcgaagcggccgaatgtccccaaaaaaattaaaaacgggcgctatttttccgtcatgaggccgcgaagcggccgaatgtt

SEQ ID NO: 96627 - DNA, 549 bp, Heterodera glycines
  SCN-specific regions: Sequence locations=1-273,295-549
ccccgcggtggcggccgctctacaactagtggatcccccgggctgcaggtacccggcacgaggaatcgcttcacagcctaggtagcgaagctcaagaagcgcgaagcgcttatttagaaacgggcgcgaagcgcccgtctgaggacgcgaagcggccttaatagcccaacaaatttagaaacgggcgcgaagcgcccgtctgaggcatcgaagctgccttaatagcccaacaaatttagaaacgggcgcgaagcgcccgtataagcccaacaaaatttaaaaaacgggcgcaaagcgcccgttcgaggccgcgaagcggcctaacaagctaaaaaacgggcgcgaagcgcccgtatgagttcaacgaatttaaaaacgggcgcgaagcgcccgtccaaggccaacaaaaattgaaaaaccgacgcgaagcgcccgtaacgggcgcgaagcgcccgtatgaatcaacaaactttaaataacgggcgcgaagcgcccgtccaaggccaacaaattaaaaaacgggcgcgaagcgcccgtcttgagcctcga

SEQ ID NO: 96628 - DNA, 201 bp, Heterodera glycines
  SCN-specific regions: Sequence locations=1-201
cgccgcaccggcaaggactgatcgacgaagaggaaatggagaaactgcccaaagaaccgctcaaaatctcatccgggaaccaagttaagcagtccaaaaagagaagcagcaccgcaggatgaaaggggagaaggaaaaaggagtttagagcgtttagcctttgtttttttttgtttcattttttgtcgataaatgtaatgt

SEQ ID NO: 96629 - DNA, 906 bp, Heterodera glycines
  SCN-specific regions: Sequence locations=1-78,109-906
aagctggagctccccgcggtggcggccgctcttcaactagtggatcccccgggctgcagttattcggcacgagggtccaattaagactttcaaaaataataatttaatcgacaattttccccgcaaatggccgaagagaatacaaatcaatcggaaggactcgacttctttctgaaccgaagcggatggacagatgcccaattggaggaagtcattcggcttttgtacggcaaaaggctccaacaactttcgattgcccagcgtttcttggactcggcgcaagaagcaaattttgagctgaaaggttttcaaatggtggcgcaggaggagcagtgccgaaggccgaagaaaatgcgcgtggcggccatccaaaacaaaattgtgttgtcgacgagtgcgccggtgcaagcgcaaagggacgcactgcaccaaagagtcggcaaaatgatcgacgcggcggcacgagcgggtgcccaaattgtttgcctgcaggaggcgtggacgatgcctttcgctttttgcacccgcgaaagattaccatggacggaatttggagaatcagccgaggacggagcgaccacaaaattcttaagcgaattggcaaaacgacttggcgttgtgataatttcgccaattttggagcgtgacattcacaaggatgaccttttgtggaacaccgccgtgatcatctcacagacaggcgcagtgatcggaaaaacgcgcaaaaatcacattccgcgggtgggcgacttcaacgaatcgacttattacatggagtccacccttggccaccccgtcttcgaaacggcttttggcgccaaaattgccgtgaacatttgctacgggcgccaccatccgcaaaattggatgatgtacgcgttgaatggtgtgcttctgctgatgcta

SEQ ID NO: 96630 - DNA, 478 bp, Heterodera glycines
  SCN-specific regions: Sequence locations=1-478
cttcgcaagtgtatgctctgaatgattcggcagagaaactgcgcgacatttttgtggaacaccgacaaaaattgggtggccatttcgcactgattgacccatttgagaagcaaaaagagcggcgacgactgatcgacgcttattcggcactgaaaggcatcgacgcctttccctcttcgaatgcgcttttgcaacttggcgaatattttccgaagcaacaaccggggacggcacagccccaatttgggatgactcagttcggtcagccctctgttggtggtggcctttttagtgcctcaaaagcgcccgccttcagtttcgccccctccgctcaacagtcctccaccaatctcttcggcacaccaaaaccaacgccttttggtatgccaaccacaactgccacctcgccaagtcctttcggtgctgcggcagcagtcattccaacttcggctggcgcgtccgctgtgccgtcgctttt

SEQ ID NO: 96631 - DNA, 321 bp, Heterodera glycines
  SCN-specific regions: Sequence locations=1-21,45-114,136-321
atctatatctattccaacaacaaatatatgatgagctcaaactaaacaaccaataaaaccaatactaataatagcgtaaattattcctaaataaccaaaaagaatttttttacctgtatagaattggatagttaatctaactaaaccaaaagcaggtaaaattaaaacataaacctctggatgaccaaaaaatcaaaataaatgttgaaaaaccaaaggattacctccacctgttctatcaaaaaaatttccattaaaattacgatcaactaataaaagagtaatagctcctgccaaaacaggtagagttaaaattaaaag

SEQ ID NO: 96632 - DNA, 494 bp, Heterodera glycines
  SCN-specific regions: Sequence locations=1-369,391-494
tggaggtcgacttggacttggacaacaaagactacaagaagacgttgaaagtcacttggctggccaaacgtgccgaaaacttcgcggtgaaaacggtccgttttgatcatttgatcagcactccgatcattggcaaggaggaggactggaaggagttcgtcaatcgcgacagtgagcattttggcactttgttggccgagccggcacttcaaaaagtgaactgtggagacattttgcaaattcagcgcaaaagcttttacatttgcgacgcgaagacagccaactcaatgacactcatcgaaattccggacggcagagagacgaaaaacgcagcgcaaaaggggccagagggaaaagagacgaaaaaggaaggaaaagagacgaagaaggcaaagattgttaattgagacagtgtattcatgtggaagtattcgcaattgttttgttgtttttatttggtgatttctggtgttgattaaaaagaaagaaactgt

SEQ ID NO: 96633 - DNA, 492 bp, Heterodera glycines
  SCN-specific regions: Sequence locations=1-345,367-382,413-492
cggaaaagtcactttcaaaattactttgacaagtgatccaaaattgccgttcaaagtactgagtgtccccgaaaatgctccgttcactgccgttttaaaattcgccgctgaggaattccgagtcgacccatccacaagtgccataataaccgacgaaggcgttggagttaatcctgcgcagaaagcatcggacattttcatgaagtacggctcggaattgcgactgattccgagagacagagttggccaaggcgaatgaaagaggaaatgggtctaccgacacacgcggacatatcatttggcaaaaagggaaactgacaggaccgtctattgagactattgtgattgtttctttgttattttttggtagctaattattcggaaaaaaaaaaaaaaaaaaaaaaaaaaaaaactcgagggggggcccggtacccaattcgccctatagtgagtcgtattacaattcactggccgtcgttttacaacgtcgtg

SEQ ID NO: 96634 - DNA, 479 bp, Heterodera glycines
  SCN-specific regions: Sequence locations=1-1,23-479
caatctcaaacataaataaattgaatatttgcaatggcgtcaatgtcggatcggatgaagctgatgctaagctcgggaaagggcgccgatgtgcactttttggttgggcaaagcgacgcgaagaagattctcgcagcccataaaacaattctgatttcggcctcggatgtgttcgagacaatgtttcgctttgacgccaaaaatgcaaatgttggaaacgtgaacaatcccgtggaggtgcccgatgttgaagttggtgcattcaatgtgatgctcagcttcatttatgccgacgatttgagccaattggacggagacaacgcaatggcagtgcttaacacggccaaaaaatacaacatcactggactggtcactgccattaagaacatgccaattgcgaagatatgcggcgacgttttcatgacattggcccaaagtcgcctatttgaggaatcggatctcgtcgagcgttctttggc

SEQ ID NO: 96635 - DNA, 226 bp, Heterodera glycines
  SCN-specific regions: Sequence locations=1-38,60-226
atcgtagcagccccactaattaatgtgaaaatatgaaaaattattttttattttgatgatgcaacgcatttgttttcatttctctcctttatgaaaagagccattcattcttcattcattgatcatttgtacacattatacacacaaaattgaccacacaaaattgatgatcggactagtataactttctgtaatatttttgatcacttttaaattttgattaccg

SEQ ID NO: 96636 - DNA, 613 bp, Heterodera glycines
  SCN-specific regions: Sequence locations=1-613
aagaaagggcttgtccttcaaggtggttgtggacatgaatggaaacacggtggtgtacaacgacagggacgtgccgatagggacgggttctgtgcggaaagtgggcgaacgatcatatgaggcggtgatcagcaagaatctattcatcactcggctgaaggatgtccggaggggcccatgctgcagagagttgacgggcgaagaatgcaccgaacccattaagttggccaacccgcagttcagtcacccgagccaaagggacgacaatggcacgacgaggctgacctggcccgactgtttcgacatgtccatcgatgtcactttgccaccaactgttcatatcaatcggctggccatgaactattggcagaagcaaggcgcaattgacgtgtggatgaagttttttgaacgggcgcccaaccgagcggagatggaaaaagagttcttctcgcagttggacaatcctttgctgggcaaagccttcaaattggccatcatcggcgaatggttggccgccaacagtttggaccagggaagttacacgccgaccaactcggaattgttggagttttgggtgtcaaaaagagcgcccgaccgattgttggcatgcgag

SEQ ID NO: 96637 - DNA, 477 bp, Heterodera glycines
  SCN-specific regions: Sequence locations=1-477
taaattcaaccttaaagaaggactttttgtcttaatcaaatggttcgaattttgttgccaaacggtgagtcggccaacgtcagtccttcagaaagtgttgaagaagcgattaagcattgcgttggtggagatatttcatcgcagaatgactattcattggttttctttggtcgcaaattaaactccgaccaacgcttagctgacattccgcatttggacggcgagtcacgctcagttcgattagtctgccgaaaatcgcccggtgttagcattgaaaagaacctggcggatgtggacaaactgcggtcacaatgccgaactttgtaccagaatcttggcgaggaacttcagcaaaagctggagacatatatggtggacgataacaatgccatattcaattccattctcaaagaccatcccgaacttgtgcatgatccgatcgcccttcccattgtcaaggatttgcgactgctggtg

SEQ ID NO: 96638 - DNA, 491 bp, Heterodera glycines
  SCN-specific regions: Sequence locations=1-413,435-491
atttaagtttgcattttgattttaaaaatgaaaaaacacgtcacgttcactccgagtatcggagacgatgtccattccaccaatgtatcgtcggtagcggagtctgagttcagcgttaaagagcgtgccgaagtgccagaaatattcaagaaattggccgacgatgcctttcaaatattgcctttgcccgacatcgacccgaccgtcacttcgaccccggcggtcgtcaacaatttgatcgaggcggtcgagtcgctcgactcgcggatgcctttggcgttccaagagcagcagcaaatcctgaaaatgcaaggcgaaatgctgcaactcggcgtcagttgcaaggaacactacaagaagatacacgagcagtccgtgatgcgttacaatctcgagaagagtgtcaataaaaacatcgacgatctgaaggagggcgcagttgtcgcgcagaaattggtgaaggcgaagagtgcgtacgaggaaatggtagc

SEQ ID NO: 96639 - DNA, 1237 bp, Heterodera glycines
  SCN-specific regions: Sequence locations=1-325,350-643,666-946,968 -1237
cccactcgcttaaggcgcttcgcaatttgcgtcggcgttgacgaagaaaatgggacttgtctgatggtttatgagaacgacttaaacgccattgaagtgaggatggtgttttccggtgtgcaaattggcaaatggtaccggttcgacttggcaaaaggcacgagacgaaattgggaggtagcggaggaacgattgccgacgcggattatgccacggggggacgcggggagtggcggaacacgcggggatcgcattcagctttgccttcccattttctttgtccccaacttcaaatgttttggctgcacttggcgtgtcacttcaccaacttcttttaatgacaaaatgcacttcaatttcgtttcgcctcgattggaagcgccaggcaaaattaatttcagcgaagaacgactggccgaattgaacatccgtccgggggagcagtgttttgcatttttgacattggattgccaagggcccgggccgagcataaaaccgccgcaatggacactcgatgcagtggagcattttcacagggtcaatgttgacccattggccccctccgttctgtccgtttccctcggcgcttcgaaagaatggggcattctgctcgatttggtcattgaatctgaggacgaaagaaatggaatgggtttcattctgtgcttacgcgacggaaaattcgcttttggtcgaattttaaaaaccgaaggtcacaacgacagctgctggagggcaaatgtgggcgacactgtcggcttctctttgattgatgttgattgctttaattaccccgttcggttggctttgaatgttattgcctggcaatccccggcgttcacttctgttgactccgatgttctttccgaccaatttccccaagaatccttgcccgaatttccttcagttcgccttatttctaaaagtactggaaaaatggctcaacatttgttcgaactctgttttcctatcgatgactcccaaatgtcgtgtttgcgcatgggctccctcaaggtggaccgacttggtgttctgatcgacttgaatggtgatttgttgtccgcctggagcaacatgaagcgcaaagggactgacgccatttcttcactgttattggcccgagtgagggcccgtttttcatcattgcctgaccaacagcagccgctttggatggtggccgaaatgctcgaaattgccaaaatgcgagtcgacacggaaagcaaacgacaaacgctgg

SEQ ID NO: 96640 - DNA, 369 bp, Heterodera glycines
  SCN-specific regions: Sequence locations=24-369
cacaacagcaacaacaaaatgatggcattgccttccgacattccctcccatgtcagccgaactcggcgagcagttcatcgacggaggagaaaaggccccgcggcattgcacccggctcagtgcagaaactacaaatgcaaaccaaagaaaacgaccaacgatcggattcgtcggctgctccgcctgacccggagacggcacgacttttgcccggccaaatacatcacttgtagaacaacgacactacacattaccacactaatcactcattaaacataattatattatgcactttggccgagtcccttcccaaattcccattgctcattgtcttgtcgtcttaaattgtgataaatgacttaatgattt

SEQ ID NO: 96641 - DNA, 462 bp, Heterodera glycines
  SCN-specific regions: Sequence locations=1-462
ctgtcatgagcttatatttcaacgttcttcttgtactgcttgttctgctcgtccatttattcagaaggtactccgggcgtcttgtggccgcggtgttgcagcgactgttacacgcgcgcgccgcgcacatttacgggctcggctggttcgcgttgcgccatggcgagctgttgctggccaacggactgcacttggaggtgcgcgagttgcgcgtccattcgctgttcaattggtggtggacaacgacggcaccgacggtggacagcgcggccaacgacggcggtggtcaacgcatggcactgaacgtgcgtgtgtccgtcggcacaattcgtgttggcaaacagttggcggacgaagaaggcagcagaaatgctacgagtagcatttgtgatggtcaaaatccgctgattgaaaactgcggtgtgctcgactcggtgtccatccatttgtccaggcccgggc

SEQ ID NO: 96642 - DNA, 389 bp, Heterodera glycines
  SCN-specific regions: Sequence locations=1-389
acagaaattaacacgactcattgtcacttttgcagagattccctcattcgtccgtcccttctcacttcccaggacttggattggtttttacattacagaccatcgataagaaatacctaaaatatatgtttaatctactaaattgattgcatcatcctcttttacagaaatttacttctttttttagtagaatattaccacatatgttttggtcattcttttataaccaatggcttcgtttctcccagcaaaagtttcatttgcttttgcacgatgaaaggctttttctgtttttggccgattttatgttggcttctgcgctgattacatttgtgactttcacatttttggatgcgtgctcttacggaagatatgcacttgtctttctt

SEQ ID NO: 96643 - DNA, 225 bp, Heterodera glycines
  SCN-specific regions: Sequence locations=1-225
gaccacatcaaactcgaaattgttttcgaaatattcgaaaacattaaggaagacgtcgaatgggaattggttttcgtgggcactgatggccgagaagaacacgaccaagtgctcgactcagttctcatcggaccgattcaggagggacgacacaaatttttgtttgaggttttgtgcctttgaaatatttttattccaataaataaaaaaagcagtcgaaaaaag

SEQ ID NO: 96644 - DNA, 379 bp, Heterodera glycines
  SCN-specific regions: Sequence locations=1-326,348-379
gccgttcaattgcgagcgaaggcgaacgatcccttagagaaggcgacgctgttaacggcataaaaatactcgagaaggctcttcaatgtaacacgtttgatttgtctctccaatgttcactccattctcaattgggtaatgcgtattatgcccgtggtgactacaggaaggcgaggttcccttcaaccgttcggtctttttactccccgacccattaaagagaccatcacatggctgacctttgcgcttctagattgcaaaaggacgaattgcaacaagcgaagacattgtccaatttgtccgcaacttacattctgtaatggagattatttttgtttgtaattatttgtgtgaactattagtaaataagggctagcgg

SEQ ID NO: 96645 - DNA, 481 bp, Heterodera glycines
  SCN-specific regions: Sequence locations=1-481
ctggcattctccagcgctatgaaatgcaacagtttcggctgagttgcgccaatttcgagtcggaatcgagctgttgctcgacctcacaacagatggagataattgtcgactccgagtcggactccaatctgacgcggtgtccgtgttgtcgctgtgcccaagtgaatttgatctgtgccaactgtctgaacactaatgttgtccgaattggcaaagtgcgggaggacaaacggcgtctgttgaggagcaaaagtgccatttgccatctcatccagaacgcactcgccgacgaaatcaaattcgagggtgaatttcaccagctcagtcgctccattgaagaaattcgggcgaaaattgcgcacaaaaaggaccaagttggacgacttagacaacgcatttcgcacacggaaagtcaaagtgagcgcaatcgacagaatgtgctccttctcgagaagaaaatggtaagccattcggaccgaat

SEQ ID NO: 96646 - DNA, 393 bp, Heterodera glycines
  SCN-specific regions: Sequence locations=1-336,359-393
gaaaagatggcttcttcctcaaatgctcagcaagcggccgcgttgcagatggtcgcggatttggagatcgaaatgatgacggacatgtaccggcgtatgactaaaagctgtcaagaaaaatgcgttgatactcactacagggaggccgaccttaccaaaggggagtctgtgtgtttggatcgctgtgtttccaaatatttggaggtccatgatcggcttggcaaactcctaacgcagatgacgcagcaggacgatcgtgcagttcaacagcagcagcagaatttggcagcggctgctcaaaagatgcacatcaacaaatgattagattgtctcaccgttgatttttgtcattgtttgctcaattcccaaaattaaacaatgctaagcgaggtt

SEQ ID NO: 96647 - DNA, 188 bp, Heterodera glycines
  SCN-specific regions: Sequence locations=1-188
gcctgttcagcgggcaagggcgcgtgtgccggaacaaccggcagaaagcgtcggcgtagcgcctgcaccggccgaagtggcgtcaaacgccgccggtggccaaggcgaagcagaagcggcgaaaggatacaggaagaaaatgtgaaagatcggataattattaatgcagaataaagtgattgttgatg

SEQ ID NO: 96648 - DNA, 277 bp, Heterodera glycines
  SCN-specific regions: Sequence locations=1-239,261-277
ggcacaaacgcggatgggacagtgacgtattggcgctgcgtacgtacgaattcactgcaggagggcggctgccgtggctctgctcggactgatgaattggacaatatcatcggactgccaacgccacacaaccatccggccatacctgagtttttctaatgcaattgtgatgcaaaaaccaccacacaacgaaggactccgtgcgaagaagtgccatttgttattctgttgctattttatgtatttgaatccattttattgtataaatgcaaatttg

SEQ ID NO: 96649 - DNA, 481 bp, Heterodera glycines
  SCN-specific regions: Sequence locations=1-257,296-481
cggaacttttcatcatgggtatctctcgcgactctcgccacaagcgtgcgcacaccggtgccaagcgcgcccactaccgcaagaagagaaagttcgaactcggtcgccaagccgccaacaccaagctcggcgcgacccgtgtgcaccaagtgcgtgtgcgcggtggcaacatcaagttccgtgctttgcgtctcgacaccggcaacttctcgtggggctccgagtcgtgcacccgcaagacgcgtatcttgggcgtcgtgtacaacgcctccaacaacgagcttgtgcgcaccaacaccattgtcaagggcggtattgtcgagattgacgccaccccgttccgtcaatggtacgagtcgcactacgtccaagcccttggccgcaagcagaaggatgttgccgaggttgaggagctcaacaagaagcgctcgtcccgcgtcctccgcaaggttgaggcccgtcaagccaacgccaaggtcga

SEQ ID NO: 96650 - DNA, 449 bp, Heterodera glycines
  misc_feature (446)..(446): n is a, c, g, or t
  misc_feature (448)..(449): n is a, c, g, or t
  SCN-specific regions: Sequence locations=1-53,159-159,182-351,376-449
tccaaaatggcaaaaattacaatcattaaattgaacgggtttaaatttaaattaacaaaaatgattaaaaagtaaaaaattaattaacgaaaaaattaaactaaaaattgccaaaaaagggcaaaaaaataaatatataaaaaataaaaataatagtattttttaaacttaaaaattattgcaagaaatttctcaaacgccctccggccggagaaaaagggaaaagtgccatttttggagtggtgccatttcttgtggtgggaaaaatgccaacaaaaaatggcacaaacactcactcattctaacgactttaattgagggcttggtggtggtggaaaatggtgaaacaataggacaacaacaagaacaagaactggggacagagaagaagccccctgtatgggttggcacatttttaatttggcacaatttgtggcgaaatgacnann

SEQ ID NO: 96651 - DNA, 287 bp, Heterodera glycines
  misc_feature (287)..(287): n is a, c, g, or t
  SCN-specific regions: Sequence locations=1-228,250-287
tggctttaatgatgccacttgtcagttcagaggaatcggaaacaaaaatgaaatcgccgattagtgggtttgcgttctaataaaaaaaacaatcgcaatttcagtggaaaaacatggtaacggaggcgacagactaagcgattatctgttgaaactgtgaagattcacgccgtggattgtattgctttgaggatgacgaatccaaaacgatttatccgtttgatacaacaattattgaatgactttcatttgtaatcgattaaaagtaataaatgacttggaaaaan

SEQ ID NO: 96652 - DNA, 328 bp, Heterodera glycines
  SCN-specific regions: Sequence locations=1-129,151-328
attgtccgacgtcgacaaagacggacatttggactcggatgaatttgccctgtccaactatttgatcaatttaaaactcgaaggccacgaactccccacagagctgccaaaacatttggtgcctccctcaaagaaagcgatggctggcgatgcgtcgtcttccgacaaccaaatttaccctactttggatgagtgatggggcgagaattgacctacagatttctatgttttgtactttgtgactgtgaacaactccttcggcagtttcggcggcactatcccaatcggtttccctttttgtcataatatctaataaattaaccaattg

SEQ ID NO: 96653 - DNA, 484 bp, Heterodera glycines
  SCN-specific regions: Sequence locations=1-35,59-185,207-484
gtttgttaattaaattccgtatttctgtgttcttccaatacacaatgctccaagaaacagaggcaaagtccgattcgagcaaagctccaaacgaagtggctttatcttctgaaggtcgtatcagcaagctttatgtggaatgtttcaacgaacgcgagaagtgtttaacggtcatcggagggggcaaaatggctactgctttagtgcatggattagtttccgctggttttatcgacaagtccgaagtgaatatctgctcaagatccaaagaaacggcctttcgttggacgacacaaggttaccaaaatgcatatacaaatgatgaattttacagcaaagtgaaaaagccacgtggaattgtgattgtcgcagtaaaaccacagatctttcccgggtttctcgacgaactgcgtaaaaatggttggcttaactttgttgggcctgaagtgctttgtgtgtccataatggctgggattgcacttga

SEQ ID NO: 96654 - DNA, 418 bp, Heterodera glycines
  SCN-specific regions: Sequence locations=1-92,114-291,313-418
gtccatttaagtttttctcggccggctattcatatcatgaaaaaaaaaatcaacaaaaaggaagaagaacggcgaaagcggtaccgaccaggggagaaggcacttaaagagattcggaggtaccaaaaatccacagacaatttgatgccccggcagccgttccgtcgcttgatccgggaagtgataagcgaaataacatggaactctcaccggttggagacccaagcggccactgctcttcaggaggccgctgaaacttttctcacaaccttttttgaagccgctaacagatgtgccgtacacgcaaatcgagtcactattatgccgtccgattttgtccttattcgctggatccttcacacttttggcaataatattgtttgactaaaaactcacatttcttttttcattccatttg

SEQ ID NO: 96655 - DNA, 652 bp, Heterodera glycines
  SCN-specific regions: Sequence locations=1-603,625-652
atctttcaggtctcgttgtgagtgattcgtctgacaaggaccacttatatagacaaaagtggtcctttgttggtcgaacttctgcagaattcgcttttaatcagaagagggcaaaaagtgaccgttgcaaattacacaatagtgccggacgagaaaagcaaaatcgttgaatatctacgtgaatattccaccaaagttgactgcattttgaccagcggtggaacagggttctcaaaaagggatgtgacgcccgaagcgaccaaagaagtcattgagagggaatgcccaggaatcgctgtggcacttctgaagaaagggcttgacattacgccattcgctgctctcacccgtctcaccgcgggaattgctgccaattgtctgattatcaatttgccgggaagcccaaaagcagtgagagagggatttgaagtgattgagccgattctgagccatgcgattgccattgtgaagggggatgagagcgaaacttcagttttgcacaagagaacggctttataagacagaagagactgtctgtcgataagcatttgatatcctatgtatgtgagaggcaattttaaactttacttcattactatgtaccattttgaaaaataaatttttaaggtgactcgaataaatttttatatgt

SEQ ID NO: 96656 - DNA, 452 bp, Heterodera glycines
  misc_feature (451)..(452): n is a, c, g, or t
  SCN-specific regions: Sequence locations=1-452
catcaaatcaatctcatcttttccttatgggcgttgattctgctgatgatgactcagtgcctgacccaattgtgattaagcagggcgagtcattgagcctttctcagcttgtgcaaaaaattgaacaattacaaaaccgaactgttcaagagctgcttgttaccctacgtcgtcgcacgtacaaaatgcctgttgggcctcccgacccaaatggagatcgcttttcccaaaatgggcatctcctagtggaagatgttgtgtacaattgggtaagaaaaacgcgtaactccatccacggaattgtccagcttcatgtgttatatgaggggattgcaatgctcgatgaagtcaattatcacttttagtgattggttaaagaaaatcttgtaaaattatttgccttcatattttgtactatttgcgaatttgacaataaatttgttccaatgtnn

SEQ ID NO: 96657 - DNA, 449 bp, Heterodera glycines
  SCN-specific regions: Sequence locations=1-449
atcaatctcatcttttccttatgggcgttgcttctgctgatgatgactcagtgcctgatccaattgtgattaagttgggcgagtcattgagcctttctcagcttgtgcaaaaaattgaacaattacaaaaccgaaccgttcgagggctgcttgttaccctacgtcgtcgcacgtacgaaatgcctgttgggcctcccgacccaaatggagatcgctttttccaaaatgggcatctcctagtggaagatgttgtgtacaattgggtaagaaaaacgcgtaactccatccacggaattgtccagcttcatgtgttatatgaggggattgcaatgcttgatgaagtcaattatcatttttagcgattggttaaagaaaattttgcaaatttttttgccttaatatttctactctatgcgaatttgacaataaatttgttccaatgtgaaaaa

SEQ ID NO: 96658 - DNA, 297 bp, Heterodera glycines
  SCN-specific regions: Sequence locations=1-297
ctttggaacaattgcggaacgcactttcgacgcgaagtgtcctctaaacactttgtcggggagctcaattacaaatgcacaaatgtagggaaggaacagagagggacaaaggccaaagggactaaaaaagtccataaaagtaatcgcgttgttgcgggaaagggcccgttcgctggtgaagaaatgggcggagaacgaatgctcaaaggacagttctctttcgctggttgaaagtctttacagagatcttcgagaccaaggactgagctttgagctcgattcgacaaccaacaatca

SEQ ID NO: 96659 - DNA, 505 bp, Heterodera glycines
  SCN-specific regions: Sequence locations=1-505
gtttgagctaatttattctccaaaatgccgtgctctctcgctacacaatcttctgttctgaagcgcagagcacctgcgtctcctcagcaggcaaaaatgcatgacaaaaagagacactttgacgaatcggcaaacaatggacaagaaaaagcggacaaagtgccatccaaaggggacaaagtgtcaccgacaaatgaggaaaagaagaaaaatgttgcctttgccacattggcaatccatgcgggaaatgaacccgagaaatgggacatgaatcaggtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatg

SEQ ID NO: 96660 - DNA, 606 bp, Heterodera glycines
  SCN-specific regions: Sequence locations=1-4,33-606
attgaattgatttatttatttattttgctgctatattcttccaattgtttgctctcaaatggtgctcaccgactcggcccatgccgaccccaaaaatgccgtgcccttccgtctgcgcatcgacggccattgggtgcgcgtggacgagcggctgctgcgcgcgcacccgggcagcggcgcaatgctcgcctaccgggacagggaggcgagcactgtttttcattcgttccatgccggctcaaagcgtgcctaccgatggatgacggaacaccgtgaaaatggtggtgccaccgccgaaactgaggcgacaacagaggcaaacggaacggcagcaaaaaccaaaaaaagcaatggcacgggcgccggcgccgccctttggccggacaaaatcgacgccataaatatgggcaaatttgggaggagtgccgaggcaaatgaaaagatttgccgttcctttgatgttctccgctcccgcgtccgttcgctgggccttcttcgcgcggacgacgcctttttcgtgctcaaatttgtccaatgcgttgctctgattgcgttcgccgtgttcctccagtcgcgcgactttttcctcgcctccgccctttgcat

SEQ ID NO: 96661 - DNA, 327 bp, Heterodera glycines
  SCN-specific regions: Sequence locations=1-15,37-327
gcaatgcaaatcaaagtcaagaccctcaccggcaaggagatcgagattgacgtcaaccccgacgacaagatcacccgcgtcaaggagaaggtcgaggagaaagagggtattcctcccccgcaacagcgtctcattttcggtggtaagcaaatggccgacgagaagacgctcgcggatttcaatgttgctgccggctccgtactccaccttgtgcttgccctccgcggtggatccaactaaatccacgctcgtgtcgtttgccttttgccgtttgtcactcgagtccctcttcaccgacagtcacacaatacacttgtatttcccatc

SEQ ID NO: 96662 - DNA, 371 bp, Heterodera glycines
  SCN-specific regions: Sequence locations=1-169,191-371
gtcttttgcctatggaaagtccattcagcagaatggtggtcccaaccgtgtcacattcattctgcgaaaaggtgcaattttcttcactgggatggttgttggaacagtcgttgtttttaaggcatttaagccaacgcgtcccttcgacgaagcggcagaacgtggcaaaagggagctgttggagaaatacacggaggagtacaacgcgttgcaggaagagctgaggcaggcggaagagcatcttcggaacggagggatgtcgaagaggcggaagcgagaaaggcttagccgatgacaataataatgatcaatttgggtggaagggttgtaaatcctctgaagtaggatcacattgctaattaaacattttg

SEQ ID NO: 96663 - DNA, 318 bp, Heterodera glycines
  SCN-specific regions: Sequence locations=1-269,292-318
gtgacacaaattctccaatattagttgtttagcatggtcgaaatttctattagagcccggattttaaaattgccattacttagaaaatggacagggacttggtcccgagattcacgttttccgggactcccggtcccggtattttgtccaaaaaaaccgtggacctgaaccacgagtctcggcaaaatcccggtccctacaagcctaatttatctgcgttttttggattttctccggtatttatcggtcaatacgctttgtccaatctctaattaaaagaataaaacaatatccaaaaataatgggaaattgtaatta

SEQ ID NO: 96664 - DNA, 647 bp, Heterodera glycines
  misc_feature (573)..(573): n is a, c, g, or t
  SCN-specific regions: Sequence locations=1-2,25-288,311-647
tccaattaagatttgttaaaaagtccaattatcactgcattcttatgattctcgcttcttcgtcaaagcgattagcttgtcaattcctcatccgaaaagtgcctcattttgctgtgacttcctcgagaaaagagtccaattggtctgaagttcttgatgaagcggtccccgccagaaaatcataccgcgattttcagacactcaacggaaaccaacgcgatgctttggccgcatcactcttttttttattagtcaatggtcaccgcctatgggctcaccgggttcttgaaaacacctggtggcgagggaagaggtgcattcgaggggcgctcgacaacacgagaggaggaaaaaagaggcgcgggagaggatgatgcaaccaccaagcgacgacaatcccgaagcgggaaggcggaccagaacgcctcacgaaacagagtacaaaaaaggaggacaagagaagacgccccaaaacaaagacagccgcaccccagccgcggacaacgaagaatcgatcagcgggcgggccaacacgatcggaggcaagaccagaatcaacgccagcaaagtaanaagggcacaacacaccagaagacatgaggcccgggcgacagcgctaaagagggacttagagaaagcgaccgacg

SEQ ID NO: 96665 - DNA, 286 bp, Heterodera glycines
  SCN-specific regions: Sequence locations=1-20,228-286
cgattgaaataaatggaaaaaaagcaaagtcaaagacaaaactttaaagcactagccgaagcaaagtcaaagacaaaaccttaaagcactagccgattgaaataaatggaaaaaaaagcaaagtcaaagacaaaaccttaaagcactagccgaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattg

SEQ ID NO: 96666 - DNA, 214 bp, Heterodera glycines
  misc_feature (148)..(150): n is a, c, g, or t
  misc_feature (154)..(154): n is a, c, g, or t
  SCN-specific regions: Sequence locations=1-214
aaaaccgccgaattggcacatcggaggagagctgaaaactgcgcaagacaatcctcgacaacagcgaatttctctgcgaagccgtgcaaaggacctgaaggaaccaaatgaatatccccgaaatcggtggataatgaattttttgatnnnggcncccggaccggaagcgcaggcaccaagagaaataacgcaaaaagcaacaacaagcaagacg

SEQ ID NO: 96667 - DNA, 767 bp, Heterodera glycines
  SCN-specific regions: Sequence locations=1-277,300-301,323-767
caagtttgagctcagatattatgccatttttattcccttccattgttactacgaataatacggcgtttaatcggattaacgacaaatcagcaaatgttcgccaaaaattggatatgatggaaacagcgcttgtgcacctaacgactaacaaatgtcagcttaatttcagtgccgaaaagacaagatccgatattcgtcgggccactgacaagcacatttctatgttgcgtgaacgcgaattaaaactgtttgaagaggttgaccacattcatcagcgagaacaacagcttatagaggaacaaatggaacaactcaaccaagccattggcacttctaaatttgtggtggagaaaatggccgcatttgctgatgaaaagaatttagaagaactcatttctgtggaattggaccaaaaaatcaatttgcttgataaattggcaaattcgtccaaaggtaccaacatcgtattcagtgccgcttttcaacagaacatcccgcttggtcaaatttatgttggatttgccggtggttcggcttctcctcaggcgaatgccaacgacggcgtttcgtccgttgcttcagatcagcgactacactttgagaatggcagcgagatcagtttcgatcaatttgtcaacagtgcgctcagaggagagacatcggtcaaaggtggcactgatcaggccaataatcacttggccaattgtgcagcaaatggagtaaaaagagaaatgttggtgccggacgcgacatttatggacaaactt

SEQ ID NO: 96668 - DNA, 482 bp, Heterodera glycines
  SCN-specific regions: Sequence locations=1-482
aaaagaaggaaatcgctttaaaaagcacttcgacccattgactaccaaagaagcaaagtcttctgtcacttttcgatccaccgaaattactgcccatgaatatttggatttttcattgtttcgtttggtgccaccgcatttggtggaccctggcacaattgtggtaaaaactgtgcgacagccaaatgttcttgaatagcacaattatcacaagcggccaattatcaaaaccctggtcagaaaacggttgtattggctgcgttctccctccccaacttttgctgattctgatcactcgcaaaacaatgaatcgtcgatagaatcagcggcgaatttgcatgagaatacggcgacggaggagagaccgcgcgcagaaagcacatcacaaaatgttggcgccgatgccaccgcgtgtatgacgacgcgtccctctgacgataacgagtcatatttggatgaacagggcctccgttggcatcgac

SEQ ID NO: 96669 - DNA, 514 bp, Heterodera glycines
  SCN-specific regions: Sequence locations=1-451,473-514
gttagggtgggtattcatgggcccgtcccgtattcatcctaattggggagaggctgagttcacttgcgacggtgtcgcatgcaggactccccgctccctggttacggtgtaaaattttagcatataggaatttggagtgggtgctcggaacggatattttcggcctggaaatggccgtggactttaccggcacatcagcatccatttgcacaatggatgcgttggaaggaaagccggtcccaaaaaatcacctagattttttgcttggcaatcagcagtttcgccgatgtaaattagcaatttttggtcattaaataaaatcatatgtattttcagtggccgcccgattgaatgccaccacaactgaaaccgatcgtgacataatgtgggcttataaaattagcgcaggacaaaaaaatcggtgggtgtgtgtgtgtttttacatttatgctaattttttccaacttttaggcagaacggcaacttgacgcattaattactcattttatgcggt

SEQ ID NO: 96670 - DNA, 482 bp, Heterodera glycines
  SCN-specific regions: Sequence locations=1-482
ggtggggacgcagtgccccttccgagtgcagttgctgactccccttttctcgaggtcgatttgaataggacattaactccgcaatctcaatggacaaatgagtcgactggcactatgcatcctatcgttgacactgagccgaatccgatccgagacgcacatgagccaaatcacattttccactattcaccctcatcacactctcccgacgacgacgaaagcagtcaaaacggacagagttcgtcctctcagtcagcgcccatcagctcagctttagacgcttccttgactaatttatacaaggaaaaggaaaacgacgaatgtgatgatgaacggagcatgccgagaagggcgtcggagagaacgctggacagatttgaggacgtgagaacgattgcctccagtgacattgaagttattcgccaaatggacgattggtcggtcacgagcagttatccgaacagctcccaccagcagagcaa

SEQ ID NO: 96671 - DNA, 410 bp, Heterodera glycines
  SCN-specific regions: Sequence locations=1-144,166-410
attttggacgcaaacggagacaaacagccgatccatgttttcgaatcactccaccaacacccggtcattctcatgcagtacacagcggcatttgatgtagcaatttcctttgacgaaattggaatggttgaatattggtcaggcagcagaaatgagttttcatttcccaagacggtcaatttcgaatttaaaacggacacggatttatacgaattttgcaagataaaacaaatgcccaaagcattggccatcagtccggacggacggacattcgccgtttggtgttccaattcgtacatttacatttttgacttgagaagcggcaaaataatcaaaaaactcgacgaaactcttcaacgatacatcgaaatgggaaaggagactaagggcaacggactgccggcgatcga

SEQ ID NO: 96672 - DNA, 480 bp, Heterodera glycines
  SCN-specific regions: Sequence locations=1-272,304-480
ctgttgtcgctgtctgagcttgtgccgttgaatggccgcggagggagcggcggagttttttacaaaacgaaggacgacaaattcatcttgaagagtctgaacccggatcatgatgagcctgctaaaatagacgaggtgttggacaattattcgaagcatgtgcttggccagcagcccgagaagggcaagcagtccacggacagccgctccatgatgaacaccttcttcatgtacttcgaaatgaatgtttacgccaagctgaaggagggcaagggaaaagagaggaaaaagaaacttcggctgcacatgttacaatttgtggtactgaacaacgtatttgagggaatcgacgagcaaactctgctcaagttcgacatcaaaggcactttcgcgccgggcagtgccgtgcagcacgaccagaagcagaagtggtacacaggagagacgggttggcagaagagtttgtaccgcgagtacgac

SEQ ID NO: 96673 - DNA, 481 bp, Heterodera glycines
  SCN-specific regions: Sequence locations=1-481
catcgagtcttcgtctaggaagtcaacgaagtcatgccgtaaatgcagtccatccaaaacgagaaaagccgaactatgagagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagttgcgttgtgaagcagtgcaggaatggcgcaaaaagaacgccaaaagttggctcaagaaaaatgttggcaatgtccacatagtgacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggtagccctaaaatcaaagcctgtaaagaacaagc

SEQ ID NO: 96674 - DNA, 627 bp, Heterodera glycines
  SCN-specific regions: Sequence locations=1-408,443-467,491-575,600-627
aaaacaaaatgaaaaacgcgtagaaaatggacaacaaaaatgtgttgagaacaccaccgggaacagcagcaattgggtgttcaccaccaccaccgtcaacaatcggaaattgctgatgatgcggaggaggaggagaagccgacgatttggagcagggcggaggagggacaccaccaatgccaatgccaacaaaacaacactcacagaggcgcgactgctcctgggacatggcggcgaccacctcggtgacgagtcgcgggtgctccttgaccatctcggcccagccgtcggtctaaaaattttaaagaaatccatgggaaattggaaaggtgctaggtcgttatttaaaaaaccatcattatgatttttgggccccggggtcgtttgggccccaacccaaaaatagaaaaatgtacttttttaaaaattaagattctaaaaactaagcctgagggatccctcgccacttttcactttctgtcgtcttctccgcttgatgggaaggaagaattaagtgctcgacagaactcaattgacattcggatcagtgatggcggatacgacgacgggcgaacaattaaaaaatgcttaatcattttatgagtccaatcgtcgacaattttgctt

SEQ ID NO: 96675 - DNA, 368 bp, Heterodera glycines
  SCN-specific regions: Sequence locations=1-368
acatacggataaagtgaagtgaaatcaaagtacgagatcttctctccatctcgtgcttcatggtaaagcgttagcggtcccgtgcgcccgcccatgaatgcatctctgatcaacagtggtccatcatcaacgtattccgcaaacttttgccgcatctctttgcttctgctcagcatacactgaatttcgcattcccaatacacatccacgtgtgccacttgggagcgaatgaattccaggcgctttgcgtcccgctcgcgcacttctcctgccgactttccatttggtagcagcatgttatcacttggataacactttttgcacccgtgccacgcacaaccttatttttcaaatgaaacgcataatcc

SEQ ID NO: 96676 - DNA, 272 bp, Heterodera glycines
  SCN-specific regions: Sequence locations=1-126,150-272
gaattagcgcctaaattcgcttttggcattatgaatcattttgtctaacactggatttgatttgtctaacattgatttgaccaataattataccacctatgctttttaagattacgaattagaaaattaaatttgaaaattcttaaatatgtactaacattttcaaattttccatattactttctaaaaaattctctatagtgtcgaaattaccagccacgaaatttggtcattttttgacaaaaatctgttaacaaatggctttaaaaatc

SEQ ID NO: 96677 - DNA, 759 bp, Heterodera glycines
  SCN-specific regions: Sequence locations=1-49,71-759
attcgatgccatccaacgcacagaaagcggacaaaacaatggcaaacggaaaacaacaaacgatcggtgaaaagcaacccgaacacaaacggcgtgtgatgcgacatcggcacattcgcctcaaaccgaatattcttaactcttcggctgcagcgaacgcttccaagaaaagacacccgcagccaaacttcgacacaatcgaagtgctcgaggaggagcacgagttcgaggttccaatcaacgaggaggaaatgatgcgctttcccgggatggaggaaggctcacaaaagtcggataaaatcagcgtccacaggaggttttggcagctgaattggaagggcgtccacttctccggccttcccacttggctacaagacaatgaattcctccacttcggacatcgacccccacttccgagttttggttcttgctttaatagcatttttttcacttcataccgaaactgggaatattttgacacatatgtacggtgcaatagcattcattggcattttcatttggtttttggtccaagccgaagatgtcgtcagttggcccgacaaattgatattctcttctttctttgttggagccattctctgcatgggaatgtcttttgcctttcacacagtccaatatcatttcgaagatatcaacaaattagttacaaattagactattccacatgtgcctactatcattaactcatttatcccttaactctattacgcatacttctaccaatgtctcccgagacca

SEQ ID NO: 96678 - DNA, 476 bp, Heterodera glycines
  SCN-specific regions: Sequence locations=1-476
gggtccgggcagaggccatcatcgcagatcgattaagaaaattgggaccccatcgttcatgggccatttgttgtcgatggactcgcacattcgatggcccgaattcaagacgcctggcccacatttgcgaagtcaagaaatgaaattgcctagcaacattggacagaagaaattgtccaacattggactggttgtgacaactcgaaaaattgtctcaattggtcttgaatatccgcacgcttacgaagaaattgtgaagcagtacaacgactttcgttcccacattgttctcctgcaagatctgaagacggcactgcacaacactgagcttgaacttgaccaacttgccgcccaaatgccagccgataaagaatgtccaatcattgagccacgctttcgtgtgagcagcacattctacgaggaattggaacggagtccggtgagggtgctgaacacgccaatgactgagggaggca

SEQ ID NO: 96679 - DNA, 360 bp, Heterodera glycines
  SCN-specific regions: Sequence locations=1-297,319-360
cactttgcagccagcccaaggcgacacgggcaaaccttgcggagttgactatgaaattaaaacaatggtcggaggcgattcgacgcaagagaagcccaagaaacacaactccgtccgtcttgccattcgaaaactcacttactgtcctcaattggagcgaatccaaccgatggttgacgtgaccaaaaattttatcatcagccccggtggccttcatctcgaagcgtcactcgacaaagaaatgtattaccacggcgaatcaattgcagtgaatgtgcacatccaaaataacagcaacaaaactgtgaagaagataaaagttactgttcaacaaatggcagacatttgcattttcacaac

SEQ ID NO: 96680 - DNA, 479 bp, Heterodera glycines
  SCN-specific regions: Sequence locations=1-479
ccgtcgccaaaggcgcggcgcggcgtgccaaaacggcggcgcttttttggccagcaacaggcgcaacagttggcgatgcgcttgtgcgtgtgccaatcctgtcgctcagtgccgagacgtgcattggacgccatttctctgttcactccgctgaacacgccctcaaaatgggcgccaggtcatccacgacatgtggccgtttgccaacggcagttacgtttcgggccgggccgtcacaaagtcgcgggaagtccagcacaatgtccgtgtccaccatgagcaccgcaactgctgctcccgcgacttgccacagatgaggggagggcgacaggctggcggtgcaacacagacaggagaaggaatttgagcgcacaattcgcacttacaaaagcccatacatcagcttcacctatttccactcacagactttggccgaagaagcgaaacgcaacgcgcacacgctggtgctccattttgtg

SEQ ID NO: 96681 - DNA, 475 bp, Heterodera glycines
  SCN-specific regions: Sequence locations=1-152,175-475
gatcagtgagttggagatggtcgcgttcatttgccaggtggaccatgtcgctggggaaggagggacgaattttcggtatgcgaccggccgggatgtgatgggcagatgcagtcaggattgctgagcggaggcgtcgttcgccatgaacactacttcttccatcccaatgggccccgttcttccgtgcattggccaaaacaataaaaagtatgaagtgatgaaaaagaagaaggagaaaaatgacgagaaaatgaccttggaaacgaacaaaatggcgggtgaaaagcgaaaaaggccgccgagtttgtccgagaaaagttttccatacaacgccggactggaaaggaacaaattgtttgtgaagaaattggattggtcgtgtacgggcgaggaactcaaaaaatttttcgagaaattcggaactgtagtggacgcgcgaattgtcaccaaatgggacggtcgctccaagggttgt

SEQ ID NO: 96682 - DNA, 453 bp, Heterodera glycines
  misc_feature (100)..(100): n is a, c, g, or t
  misc_feature (281)..(285): n is a, c, g, or t
  misc_feature (299)..(301): n is a, c, g, or t
  SCN-specific regions: Sequence locations=1-160,192-192,227-324,350-453
gtccgtttcttcagggccttcttcttccatcggttgttgagcacgaacgcgaactcggcactgtgatcggagcgtaagcgcagcagaactcgaacagaancagcagagaatctgtagctcatccatctcttctcatcgtcatcctctacttttgtccttctccccatcgccatgtctgaagaggaatcgcaatattccgacgaagaggttgaggaggaaagcattgccgcggatgaagggagcgtgcaggaaccggcgcccgccaaagaagaggagccggnnnnnggggggtgtcattnnncccaaaaacctgggggacctccaccggccggggggggggggggccgggtttttcaccaaacaagggggggaaacccccccggggggggtgggagggggaatttcccgggaccccagggggggccccaaaaatttgagggggaatttttgggg

SEQ ID NO: 96683 - DNA, 479 bp, Heterodera glycines
  SCN-specific regions: Sequence locations=1-479
cattgcgtttccgcaaaatgtcaaatttgaattttgaagacaatttgcaacgcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgtgagttatggcagttctcatggcacttttcgtgccatcaattcatttgtctcgagaatcactcaattgagactcattgcttccatctcgtcccccacccaaaggttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagagt

SEQ ID NO: 96684 - DNA, 645 bp, Heterodera glycines
  SCN-specific regions: Sequence locations=1-610,632-645
attatttttaatggcaccgcccgtcaaaaaaaagaaaaagttttcctccgacaatcaccgcctcatttcttctacagaaattggtgaacatgaacaacaatcgatgggttcacttacgacatcgtttggaaaacggcaaagtctttttcgacatgcaaagaaaatgaacaaccgaattttgaggaaaatctggatttgcactgatatttggatggacactttcccgttctttgaccatgcccaactcggcctcaaattggcactgatttcgccacgtttcgatgttttagtagacaaacatttcaattgccaatctgaattgacaatttggagagaaataacaattgtcaaggacacaggatcagaattaaatctaactgtactgattggtggcaaatctgtgcaatttcctttgcccgaccgttcgctgcccaacaaaattcgctttgataatcttaatattgattacattgaccattccgtcctcgtgtttctccgtgccaataagcaaatttgggacaaaggcaccaatttgagtttgtatgtgtgctggtcacacaaccagaacgacaacaacaacaatttcctgccaatttgggatgtttttgtttgtaaaatttggcccatttttgcgccaaacattcg

SEQ ID NO: 96685 - DNA, 206 bp, Heterodera glycines
  SCN-specific regions: Sequence locations=1-20,42-206
ttgaacgctttatccgcaatttgagtgagtgatggatggaatgtgattttcgatggaataggatgggaggacggaattttaagtcaatttctaattttaagattttttttggtggggaggattacgttttcaaccccaaaagtttgccatatttttgaacagggctgcaaactcgaactttttttttaaaacaaaaactttttgta

SEQ ID NO: 96686 - DNA, 596 bp, Heterodera glycines
  SCN-specific regions: Sequence locations=22-46,70-596
gaaaatcctagaagtttaaaacaaatgaaaactgcgggggagaatcggtttgttgatcccataaatattgtaaaatgggccttcggcgattggaattgaaaaatgcctcaacaataattaccgccctcacaacaaattatggttgtcgacctgttcgctgttaacagtgcccggggtgtcgaagcaccaattgcccagtttgaaggtgaagtcgttgaggttcatgttgggccgctttttcggtccattgccctcaatttgggcaatttcgtcggcattttccaattgcccatcgaagtatttgatggttttgtccacggacacgggctgtttattctcttcccattccttggaaaatgaaagcaaaattgttggcaagtgatgttaggcgaacccgaaaagagctgccgatgatcccttggagcacaacgtatttcggatgtttggtggtactgaaggccgacctcagcattagggactcctaaatacaaaaataagatgtagtaattgccctcttggtcggttgtaactgtcaggtccaaggcggacttttcctcttggcatttatcacggtctctaaatgtttgatggactgt

SEQ ID NO: 96687 - DNA, 607 bp, Heterodera glycines
  SCN-specific regions: Sequence locations=1-151,178-352,374-607
cttttagcatttattactttaaataccgataaaaaattgcaagtaaatatatgaaatgtaaatgtgtaaaacacctattaattgctcattttccaatattgcccagttgcgtcttccactgtcagcacgacgtgactttttgccgatttgctccatttttctgtttctcctttcctccgtccaccgtgggacgacagttgtgaaaacgtcgatggatgcgcaaattggcggattgtgcgaattgtttatgacagaatggacactgaaaagggcgttcgccggtgtgcaccgtgcgaatgtgcgtcctaaaattgaagtccaacgaaaaacgctttccacagtcctcaaagtcacaaacgaaacgtttctcgcccgaatggaccaacaaatggcgcttcaatttggaacgctcaatgaatgagcgtgaacactgttggcaaatgtgctgacggggcccatggatttgcaagtgctttcgcattgcgctttgtttcacaaatgttttctgacatcctttgtaagaacaagggatcttctgtgtgaacagttgcgagctcaacattggctggtccatcttttgaacactttccgtccgattctttcgctt

SEQ ID NO: 96688 - DNA, 220 bp, Heterodera glycines
  SCN-specific regions: Sequence locations=22-220
atttctgtttttcaaataatccaacgaaaatccgcgtaaaatgtctaataagcaacaaaagaacgcaaactttggacagagatggcaacttgaatcgaatacgtccggaagtgattcgaagacctttctttgggggcagccacctgattttggatttactgccaagactcggaatgatttggtcgggcctcttccgccctcacaaggcgtcagtccgtcg

SEQ ID NO: 96689 - DNA, 850 bp, Heterodera glycines
  SCN-specific regions: Sequence locations=1-239,269-404,427-656,678-850
aagatttcttttagtacctaatttttttaaattttacggggaaatcgatgcagcgtggtgcacccggtaagattaagttagtttatcgcagaattaaatttttcactgcatgaactttcacctttcttagctgaattcattccaaagtcaatggcgccaattggttgcccaatcgtcttcacctctgcagttccaattggaaatgtccaacctgaactactcgcccattaagttcaacgctcgttttctcgttataaattcgtctgctaacaataagcgacaaacaaatgaaaaatttgcttttgacgaagaaatagccgacgggtttcaaattgcaactgccgatgactctcttctgatagaagttgtgctgtataatatttccaatgttccattgcgctttgaatattgttcattgactctggatgaaattttaaattcatccggtgccaaaaagtcgaaaacactgtccgaatggtctacggcgggaaattcgtcaaaaaattctacgttggtattggttcccaaaagaccaagccgcgttttctttatctacaaaactacatttgcaacatctcttaaacaattgatgcaattgccagcctcaaaggcaccgactagcagatgccaaagtccgttgatggatgaacagaatgccaaggaaattttaataacggtccgacacttttcattgcgtacattgtccggatcactcagctgggacatcgatcaccgatcgacgagtaatagacatcaccaaaattcaattgaggagatggacaagaacaactatgcagtgaagtgcgaccacaacggtgcaatgtgttactgacctgtccaattttggctg

SEQ ID NO: 96690 - DNA, 617 bp, Heterodera glycines
  SCN-specific regions: Sequence locations=1-7,49-49,71-525,547-617
actttccatcctcccaaatttcccaaaaatttctcaaattctaaatttgaccctttctttctttttctttgaatcggccgaatgtcgtcgcttgagcaattggcttcacctcacaacgatttttacgagagtctcttcagacagctgaatccctccggaagtgccgaagtcgatgccgcgtctatcgctgcttttttgaaaacggcacacggcgttagcgtcgcacaactctctcagatttgggaaattgcgagcgaattgagcggatacaaaaatcgaagcgcactgaacaaaattggcgtgtatatatgtttaaagttggtcgcgggcattcagcatggtaattaggcctaattaggataggggcgtggggcgaagagaggttccaaatttgtctttcattccccgtgtgtccaattgcttttccccactctgatcggtactgtctttctttcaccgtgaaggcttccctctcgcgccctccgatctcgacgtgccgttgtccgccgtgccccaatttgagtgtctgtccttccccacgccgcctcctctgccccccgtgccgcctccgccctccgcggactcaaaaagtccgtcagtctctgccgaattgggca

SEQ ID NO: 96691 - DNA, 160 bp, Heterodera glycines
  SCN-specific regions: Sequence locations=1-160
ccggccccctggtccccaaatcaccaacatttttgcctacggtatcagttcggtgccgactgtttcggcgccgccaactttgaaatgccacaacatttttctttgccagttcacgtagcaaatctgggcaccatttgatagcacaatttgtgctatttgt

SEQ ID NO: 96692 - DNA, 963 bp, Heterodera glycines
  SCN-specific regions: Sequence locations=1-136,159-184,219-963
accatgattacgccaagctctaatacttctcactatagggaaagctggtacgcctgtagctaccggtccggaattcccgggtcgacatcatcatcatcatcatcatggccgctaatacgactcactataggggataaatgttttttcttttgtcttttgctcgattttcctttactagctgtgattctgattttacagactttctttttctcgccatttcttcatggactccgaaaatgcgttgcaatcattcaaagaattcaccggtccaattttgtgttgaattgatcgttttccaatttaattctcttaggctgcactgacgatgacagcgcacgtcggctgttgtccaaatgcgcatggaatttggagagagccattgactttttcttctcgggacgaagggaagagggggatggggaagtgatgtgggacgagcagcagccgatgacgagccaaggaacacgacgacgaatttcgctaattactattaatgacttcaaattagcgttcttccatccttccattccctttgcaggtgtattactctctcttcacttcactgctttctgtttttctcgcaaagacgagcatcaacggattgttgcacaggggtcgcatgttcatcttctcccactcccatctgaaagtgttcctcgccattcccgacgattggtcccccatcggttgtcaattgctcgacattggggccggtgacggcgcagtgacggcgaagttcacttccatttgtgttgttgaagcatccaaagtgatggagtggcggttggccaggcgcggcttcaccgttctgccgatggacaagtggcaacggagtggaccatattcgttgataacggcactgaatctgctcgaccgacaccatgacccaaaaaaattgctgaattctttgcacgaattggccatcgagcacaattgtcccattttactttctgtcgtgctccc

SEQ ID NO: 96693 - DNA, 471 bp, Heterodera glycines
  SCN-specific regions: Sequence locations=1-471
caatatcgcaaaaacggctcaaccaccacactcacccacgccaaccaaccaacgcaaagcacatacgactaggaactttatacaaattttaaaaaagtaatattttgtatatgcatttaatcaaatttctactttctttataaatgttagtttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtacctccc

SEQ ID NO: 96694 - DNA, 214 bp, Heterodera glycines
  SCN-specific regions: Sequence locations=1-66,88-98,120-214
gtcgtattttttgaaaaaaaaaattttcaaacaaccaattattgatcctaatgaacaaaaagaccgtgttttcttaattttaatgctgattaggctatcagagtttgaaaaaattcaaatttgagtccgattttggacataggcgcaaatgtcggggctccctacagatgaccttttttgcttttgaaaccactttttggagtgccttcttttc

SEQ ID NO: 96695 - DNA, 615 bp, Heterodera glycines
  SCN-specific regions: Sequence locations=1-69,91-315,359-585,607-615
gaaacactttgtgtaaaatgctttcccattctgcgcttccattcacacggcggaagcgttttctcgtccaaccattttttcattttcttcggtgattggcaaaatgctttccacctatgccctcttttatccgaccatcatctgctacattttctgcttccgcatttgggttgctactgcttcgacagcttcctaccgtacggcgggaccgaaaacgaaagtgccagacaaaaacgaatggatgaagcgatgtgcggcggaatacgagcgaaagtactgcgttgagacggacaccaaactgaaacagcagacgacgaagaacaaggagaagaagaagcagcagcaacagcaagacgaatcgccggaggagtattacccgaccaattacgagcccgccttcaattatgacaaattgcatgtgtccgatataatccttccactgacaattcatcaaaaggataaatatcaagcccaaaatggaccgactaaatacgaaccgaaggcggaaggacagcacgtgacgagttcagtaacaaccgcagttttgattctgtggaattgtgtcgggattgaccttttttagttttataatatcaaaataattttcaaaatccc

SEQ ID NO: 96696 - DNA, 480 bp, Heterodera glycines
  SCN-specific regions: Sequence locations=1-15,37-219,247-317,345 -424,446-480
atttacaaaatgttcttctgtattgtctgttggtccacttatttgttaggaggttttttcggcaatcattaagaattggtgtcccgacgaaaaatttttttctaaatttgtcgagtttccttcacttactgtgttgtatgtctacatttattttgaaattttgcacttacaaatgtcaaatcctcaaacgtacgtccattctttgattcccccctcttcctgttgatgctgctgctgttgtgtttgctcctctccgtctttttcatagcgttttatcgacccttccccgtcctctcccccccccccggcgtccctttcctccccaaacaccacagccacaccaattcattctcttctaactttccaaaatgtcccaaacaccacagccaaccaattcattctcttctaactttccaaaatgtcccaaacaccacagccacaccaattcattctcttctaactttccaaaatgtgacggcg

SEQ ID NO: 96697 - DNA, 550 bp, Heterodera glycines
  SCN-specific regions: Sequence locations=1-217,239-501,523-550
tggagctccaccgcggtgggcggcccgctctacaactagtggatcccccgggctgcaggttgcgattgagtgacgcaatcattgcgaaagtgccatcttttgtccctccattaaaatgacgcatgatttcaccaggcagcaaatgcgtctccgtttctgcctctgttcatttcactaatgacattgcccccgtcgctctttgcctttgaccaaatgccaactttggacccggcaattccgactcaaagtccccacttggctccctcttccgattcgtgtgttggccaatgcgctttgattttcactgatcaaatgcgctcccaattgggctcggaacattcgacgggactgctgaatttgaattacaacgaattcttggctgccttttccaattcgtctttcttcgattccttttgcaatatttatcatcaattcaatttttgctacacaaaatgcccacaaggatttatgcaagaattgttgagcagaagtgccgaaatagtggaccatttttgtgtgtggaattacaaagaaataaagacaaaattcg

SEQ ID NO: 96698 - DNA, 265 bp, Heterodera glycines
  SCN-specific regions: Sequence locations=1-87,113-265
atttataagcatttgaagggttctcagcagtttccctgcaaaatttggtgagctttcgatcagtctagaacgttggggatcaaatgcaaaaaataatttaaaaaaaataatactggtgtggtaagtgtgaagaactgtgttcctccaggcaaaaaattctaagaaaatttataagcatttgaagggttctcagcagtttccctgcaaaatttggtgagcttctgatccgtctagaacgttgggtgataaatgaaaaaaataatct

SEQ ID NO: 96699 - DNA, 251 bp, Heterodera glycines
  SCN-specific regions: Sequence locations=1-111,133-251
tctctttcaacattttaccaacttctgaccacgaccctttgccaagtctctttttttgatataaaagttcaattggctttttgtcttcaaaattgatcagtgccatcggtttcattttctctatttctgatcgtccgcattggcaccattttttgctcaatctttcaccactttttggcaattcatttttttgagatgacaattttcggcttaattcgccaacttctttatgaattaatgaactttagagt

SEQ ID NO: 96700 - DNA, 270 bp, Heterodera glycines
  SCN-specific regions: Sequence locations=1-8,62-133,155-214,237-270
attctctcatataaaataaaaatgaaaaaaatattatgttcaaatttattaatattaaaaagcttaaaaactaatttggatatgaaaaaaaaaacaaaataattatttacagggttgagggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaat

SEQ ID NO: 96701 - DNA, 518 bp, Heterodera glycines
  SCN-specific regions: Sequence locations=1-238,260-518
aatttcaaaattttatgacgaattgcaaattcgatggaaaatgtttattatccattttcgttgacaggacggcatcccgccaaacgaatgccttttctgtgaactcaaatccgacacttgggaggcaaatttggcgcacatgaggaagcagcacggttttctggtcccggactcgccattctgcacggaatgtgcccgggttgctcacttatttggttgtggcactttgcttttccaatttctttttctaattacatttcaaggcttcaaagtcggggacggcctaacctgcgtccgatgccaatgcgcccgtttccgttcgattgacggactgctaaagcacatgcgacgactccaaccattgcaactttcgaatctattcacaacaggaggtgcttgctgttcgttgtgtaaatgaagagcccggagagggagaaatttaggggaactaagaaatggttatttatttgataagattgaaaatgatccttagggggatgtcagacatctaatatatc

SEQ ID NO: 96702 - DNA, 191 bp, Heterodera glycines
  SCN-specific regions: Sequence locations=1-191
gggaattccgcggacagcacaccgcagcaatacgcatatccgaacggaattaactcaaccggcacagtgacaaaaggggcgggggacggcactgtaaacatcgactcgttgagagtgtgccaacaatggaaggaccagggcaaattggtgggtggaaagagtcggacgctcaattagcaaagataaaaaaa

SEQ ID NO: 96703 - DNA, 490 bp, Heterodera glycines
  SCN-specific regions: Sequence locations=1-232,254-490
catcaccatcaccacaaatacgcgccgttggagcatctgctgaaccgcggggtgccaatgttcaagcagttgaacgaggcggaggtggcacgggcgatgatcagccgctactggcgcgacctgtacgagcgagcggaatgcgacgtggtcattgtcggggccggcagtgcggggctgagctgcgcgtactgcttggcaacgcggcatccgcacctgagcatcgcgatcattgaggccaacgtggcgcccggtggtggcgcatggcttggcggacagctgatgagtgccatggttgtggacaaggagatggagccgttcctggacgagctggcggtgccatatgaggagggtggccccaattttgtggttgttcctcatgccgcactgttcacagccacactgttggcaaaagtgcttgcgcagccaaatgtaaaactgttcaatgcaacggcggtggaagatttgattataaaacggcaacaacaatcag

SEQ ID NO: 96704 - DNA, 315 bp, Heterodera glycines
  SCN-specific regions: Sequence locations=1-167,189-195,219-315
gattactttcaacactcacatgtccaccaattttgtccagcaccgactcgggcccatttctgtgcacttcgtccatcagttgttgctggtcggcggcgaacagtttgttcagcgactgtttggccgcgttggatgaaagaccgtggagcagcgcgtcgatgagcacggacacagagttggaggaggagtcaactgagggggaaaattttaaaaaatccaaggggtgaccgaacaagcgccaaaaaccctaaatcacaggacatcgctagtagagaagtgaaattaacgcaaaaaagatttattgttttaaaaacc

SEQ ID NO: 96705 - DNA, 646 bp, Heterodera glycines
  SCN-specific regions: Sequence locations=1-16,40-646
ggtccttcaatttcttgtttgaaagtttaaattttttcaaattgatgcaatttcggaattttaggtctctccaacttaagaacataaaatatttgcctttcagtaaaatctttcccggaatgtctgcggataaaacgggcgcactttttgtgggcgatatcattttagccgtaagatttcgcaacaaaagggaagaagcgttccatcatttttgaggtcaatggcgagtcattagtcaatgcgcggcatgacgaggctgtccgtgcacttaaacaagccgggaaaatggtcaatttgcaagtgcaatatcgacgcgatttgcacctccgtcgggagaacatgctgcaccggctgagttgggaggagagtcgggtcggtgcgtcgtcggctgggccgacggtgaacggacaaagtgcgggagaagcgttgcgaagtttcggactcaaattggcatttgtcacgcgaaacccaatcgaggaggaggacccggagaatcggaccatcgaaatacgctcgcacagcgctcgacacattctgacgttgaggtgttcgtctgccactgaagcggacgcttggttcgaggccatccattcgtgtgccgacactctgctcactcaggcgttggcacaagtcaatttgatcctcg

SEQ ID NO: 96706 - DNA, 626 bp, Heterodera glycines
  SCN-specific regions: Sequence locations=1-96,118-626
atcacctgtgccaaaatgtcccgtcattagcggcagaaaatttttttcctccgatgcattcaatgttgaccgaaattgcacgcgccacggcggcgaattggtggccaatgtgctgaaggcccacgacgtgcgcgaagtgttcacattgtgcggtgggcacatttcgccaattttggtcgcctgtgaacagttgggcattaacattttcgacactcggcatgaggtgaacgcggtgtttgctgctgatgcagtttctcgccttcggcaaaacattggcgtggcggcagtcacttcggggccaggagtcaccaacacaattacggcattgaaaaatgcgcagatggccgagtcacccgtcattttgctatccggtgccgccccgactctgatgaaaggccgcggggcgctgcaggacattgaccaattgtccattgtcaaatcgatgtgcaaattcacggccaatgtgcaaaatgtcggagacatcgtcccaacacttcgcgaagcgattgccgccgcccgctcggacacgcccgggcccgccttcgtcgagttgccattggacgtgttgcaaccgtacggcaaagtgctggccgagaccaacttcgttgtgcacgcggacaccgcgg

SEQ ID NO: 96707 - DNA, 485 bp, Heterodera glycines
  SCN-specific regions: Sequence locations=1-144,166-485
ccacaatatggggtgtgagatgaacacaaacccaagaactgagctttcaattggcgttggaccagctggcggtggtgcggtgtccgcaaatattttctcaatttcccttagactagccaatttttcagaagtcgtcagttccaaattttcaaacaaattcaaaaaatcatcagaattttcgttatcctccgttctcattaattcatttccatttccggccatattttctgtttcttgcccgcaggctaaggggataggagaattgttggaattaatgcttcctgacatctaagagggagaaaaaaatgatagttaatgtgcaggatgggagacagaaaatgaaaaaggaatggttatgaggagaagaacttattgaccgattggaggaggaggcggggcaatgtacaagcgcctgctttaaactaaggggctgatgttagcataaatgagtataagggcaatgttagagaaacatgcagtgtaac

SEQ ID NO: 96708 - DNA, 488 bp, Heterodera glycines
  SCN-specific regions: Sequence locations=1-488
aaggggtaaacatcccccgtggcccttcttttgtttgatgggcacaaatttttgtccaaatcggagttgttgatgaatggaaaggccgtcttttgttgttggccggtcgtttttggaccaacaatttttgaataaattagtgaagtgaaaaaatgtgaaaattttggcgaaaatgttggccgaagtgaggaaatggtggggtgaattgacgaaatgtccgaatttgtgatgagacgggaattaaaacccgttccgactgcttctccttttccgatcagtgccacaaatgcgagagctgccagtgatcggtagagccgaaagtgggggttgaatttgatgaagacgaaaagcgcggccaaggcgatgatttccgaggccacggcgataagcagccattgtcccgtcgagagcaatcgaagaagtggaaaggggtcaaatccccaatttggcattgtcagggtgaacgtgctgcccggctcgatgtgacc

SEQ ID NO: 96709 - DNA, 866 bp, Heterodera glycines
  SCN-specific regions: Sequence locations=1-497,519-866
caccgagcgaaacgacgcccgaaatgcacgagacatttttcaaacaattggccaagacgcaccacccccacttggcagacgaccgtccccagtacaccatccaatatcagaccgattctccgatcaacatccgtgcactggtttatgtgcccacaaagcgcgtctcccacttggaatttgcagcagattcacagcgggacatcgccatttcgctgtacaatcaacgcgttttgattaagccaaatgccaaagagttggtgccgcactatttacgcttcctaattggggtcgtcgattctgaagatgtgccgttgaatttaagccgagaaatgctacagactgacctaattctcgaaaaaatcagaaaaacccttaccgaacgatgtgtgcgcttctttctctcacaattgtccaaagaccgagtcaaatacaacgacttttacatgggctattcaatgttcttcaaggaaggcgttgtcacggaacagtccaacaccaccaaggaagaaattgctcagcttctgttgttcgaatcgtccagttttcggtctggcactttgaccactctgtcggaatatgtcgaacgaatgcaatcggaccaaaagaacatttattacatttacgcaccaagccgtcaactcgccgaaacgtcgccttactttgaactgttcaaagacaaatacgaagtgttgtttttgtcggacccagcggatgaactcgtctttttgtcaatgccccaatttcgcatgaaatctttgcagtcgctggagaaatggacgaaggaggagggactgagcattgactctgacaaagaatcatcagctgaattgatgagggacagctccaaaaaggaatttctttggctg

SEQ ID NO: 96710 - DNA, 286 bp, Heterodera glycines
  SCN-specific regions: Sequence locations=1-135,157-212,251-286
ataaaagtcaacgtagaagcctcaaaccaagtggaaaatgcgttttttatgcttaatatatcgaaactagtgcgcagaaaaaaaggcatatgcctcaaaattcggtctctagctctgacgttactcaaaaaaccatcaaaataaaatatttttgatataaatttgctcaaaagcaatcaaatttttaattcttgatagaattcgatagcaataagtgttttctattagcatataaaatttcaaaaagtttcgttaagtttctagaaagttatgaccaaaaatgttc

SEQ ID NO: 96711 - DNA, 309 bp, Heterodera glycines
  SCN-specific regions: Sequence locations=1-8,35-70,144-239,305-309
tgaccatttcattagaaagaaaacaaaaaataaatttttttagctattttaaataaaagattttactattaaaatagaaagacagtgaaaaggaaaaaaaggttagaaaatgaaaaaaggaaagatgaaaaaaatggcagaaaatacttctgctttcataaagaaaataatgcaaaatggtacataataatttctttaatacataactgaaattaaaattaggcagtatttactatttgtatttataattattatcttatttaaattaataacttgtaaaaaaattgaattaatttaaaaaaatcattc

SEQ ID NO: 96712 - DNA, 569 bp, Heterodera glycines
  SCN-specific regions: Sequence locations=1-103,130-274,332-426,449-569
tgtctctaaaaccaaaaacacaattaaatattccttggttactgtttgaactttgaatatgctaaactctatgcagcattgtaccatttaaggaaagacgattttgcggcggcggtggtggtggaacgggctgacgaaatgagttaaaagatgataaagaagttggaccaactcctccattctgtcgttgttgtacagaaacaacatcgccaccattggtcaggttcatgtccatggcattcccatcaccaacctgaaaatatttggataaatcaaaaatttttttttctcataaatattatttttactttctaaatcaaatttattaattgctgttgctaaccaaccgtttcatactcattcccgatggttgaataatatgcgtcatcatggtcctgttgttccaactgttgaccccttaaaaaatgcaccaaaataatttatatgtccgttgattgaggctttagcccgttaaatgattcggaacaaattttaattaccccttatgccttaaaaaattctcgtgttttgattggtcgaagaggatgaggagggtccggcgctaccaa

SEQ ID NO: 96713 - DNA, 550 bp, Heterodera glycines
  SCN-specific regions: Sequence locations=1-550
tgacattgcaattaaaaactacgtgaataaaattttgttttatcttcttgggggagccttcaattagtaaaggtggatgattccgaatcatgatttaaaaatataccagctagtgccagtctctgggcattggggtcaaaaggcgtcagctgacacatttctcctgtgtctatctcattttgatgcgtcagctgtctagcatttgtccttaatttattagagaaaaagaggcattgagtatcgtaaaaagagaggtattgagtatcgaaacgattcattcataattttatggaaattactgctagtacggggtataaattcaaacatcctcaaaagtggaagcaacaacaacaacaacaatggcaaaagacgcaattttcggcactatgtacgcgcgctggacaccgacgtagcgttcaacaaaaaattcagactaatgaatgctaaaagtacattcatgatccagactctaccatcaaatcctgagtcgcttttgcgagtcatttttggacattgcatacaatcgtcattagatgaagctcagagacgt

SEQ ID NO: 96714 - DNA, 328 bp, Heterodera glycines
  misc_feature (325)..(325): n is a, c, g, or t
  misc_feature (327)..(327): n is a, c, g, or t
  SCN-specific regions: Sequence locations=1-245,267-328
gaactagttccagctgtatttggagcggaagaagcagctgaagcacgaacggaaacaggaagaggcgaagcgacggaaacggcggagaggggacgagcaccatcgcccgacgccgcccaagtgcaaagcgatgagcgattttctgcctttttcgtggacagtgcttttgccattgatcggacttcttcgcattacaaaggcggaaatttggcggacagacaagcgaaagaaaggcaaaagcgacgtcttcttaaaaacaatacagacgcagattagactctgttaacagatttgtcatcaattttcactgatttaaataaatacncng

SEQ ID NO: 96715 - DNA, 341 bp, Heterodera glycines
  SCN-specific regions: Sequence locations=1-196,218-341
ttcaaactagtggatcccccgggctgcagtgactcggcacgaggaaaaggccagcgcagagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaataatgaaattcattgattaaattaattttcgtttt

SEQ ID NO: 96716 - DNA, 391 bp, Heterodera glycines
  SCN-specific regions: Sequence locations=1-195,217-391
gagacaacgcatcaaaaaagtccacctctgactacccatacaccgctcttagtgaccaacttgcggcaatttcccaacaaatggacaacaacagtgtcgaccccatcactaaacaacttttgaaaatttgtgtcgaacttttacagcaggtccagcaacaacagaccgtcatctccgaacaagaccttcaactccaacatttcaaacaacagaaaatgatggaagaagccattcaagaccatgagcgtcggcgaagcgtcgtcgtaatgggtctccctgaatcgcataaacaaaagccgtccgagcgagtcgctgaggaccgaactgccatctcatgcgttctcgatgagcttggcatcgagagcccaatcactgtgtacagaatgggttc

SEQ ID NO: 96717 - DNA, 168 bp, Heterodera glycines
  SCN-specific regions: Sequence locations=1-168
acaggacagattgcttccaattgcaaatatttcacgcataatgagaagagatttgccaacggaaagaaaactttcaaaacacaacacaaaatgcgttcaagaatgtattactgaattcgttttgcttattacatcccaggttagcgaaagatgctcattgcaaaaacc

SEQ ID NO: 96718 - DNA, 512 bp, Heterodera glycines
  SCN-specific regions: Sequence locations=1-512
gggctgcaggatttccggcacgagggttttcctcaattgcattaccctgtaattactttgtacgatgatgatcatcggggaccagtacggtttctatcagttggtgttgcggaagcacgcgtgcagattgcgttacattctccaccagcttaatggcggtcagttgtcattggaagaccttaaacggaacatcgaatatgcggcgcttgtgctggagacggcgtacatggacgagacacggcggatttgcgacgaggacgacgacttggcggaggtcacgccagaggcggtgccggacgaagtgcgcgaatggctgacggcgacattcactcgccaaacggtgcaatcgcggaaggaaaagccaaaattcaaatcggtggccaatgccatacggacgggcatctttttcgaaaaaatttaccgtcggacgcagtccgttttggctcccattccccacgaatatttgccatttttgcggcaagtgaacaattggaacttcgactctttcgacc

SEQ ID NO: 96719 - DNA, 510 bp, Heterodera glycines
  SCN-specific regions: Sequence locations=1-174,196-510
tgccatttttactacgcattattttatttgttgatgaataatgtcttctcgaagaaatgaatatctcgatgcgaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagacgctgaagatgctgtgcgtgcactcgacggaacgaggatttgtggcgtcaaggcccgcgtagagctttctcatgggaacggaagagggggcggacgcggttttcaaggaaaaaggggacgttgtgacgaccgttatggtcgtgatcgttatgaccgggatcgcgaccgtcgttatcgttcaagcttttcttcatcaccatcccatcttgttgcccttctcctcaattctcccctcaactccatcttccaatctcaaccctcacataatgccatccaccccatctcttctcattg

SEQ ID NO: 96720 - DNA, 458 bp, Heterodera glycines
  SCN-specific regions: Sequence locations=1-149,171-303,335-458
ccataaaatgcacggggcaatccgactcaatgagcttattttggaacactcgcgctgcagtcaattggtgcttttttctcttccgaagccgcctttctttgaggacgaagtggacgactacattcagtatttggaggtgatttcggacaatttgcaaaaagtgctttttgtccgggggacgggcgcagaagtaatcacaaccagctcctgataaggggtctctgtgataattgttttagtttttgatttctcaaagtccgttcgttcctttcgcacttttccattttcaatttaattgactctcattttcctctttcctttccttttattttatacggatatttcgagttctgttattcttgacagttttctatgtgtatttctgtgatggaaagttttattctgtttgtcttttttacttctaactaaacaaataagtaaaatgcgatctgtcaaaa

SEQ ID NO: 96721 - DNA, 555 bp, Heterodera glycines
  SCN-specific regions: Sequence locations=1-26,48-69,146-147,206 -486,508-555
ccaagtttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacggtcaactgcccggacactgccagtgcgctggcctccaacagccaagctggtccccctggtccgcccggcccgtccggaccgcctggacagcccggacagcctggaggcgcaggacagcccggacagcctggacagcctggccaacccgctcctcctggcgcgcccggtcagcccggccagcctggaaactctggccagcctggacagcccggagcaccgggacagcccggcaaggacagcggctactgtccgtgcccgccccgctcttccgtgttggcagtcaaaa

SEQ ID NO: 96722 - DNA, 476 bp, Heterodera glycines
  SCN-specific regions: Sequence locations=1-476
atttgatcaatcttcctacatcacctggcccatcttttgctgatcgaaatgctaataacgaaccaagaaattgccgaaataagccaatggaaacgatgaaagcatcgagcagcagcctttgttataaaaacagctgttttttgtccgatttattgtcgagtacgaacagaagagggaatttgcggctgctcgaaagtgagccgtttgctgacgaagcggcaaccgaagcggaaacggagctacttttgttcgcggaattggagcagcaaatggacgaagacggaaacaaacagaaatacccggatgaagaaatgccgtgccattcagcttcatcttcggcattttctgctgacaactgtcacgcccaattgccaattttttgcggcgtttgttttgccgaatgcgccgcctttgattctttcgcattgcgccgctgtgaaccgttcggtgcgacacacactttctgcgacgactgc

SEQ ID NO: 96723 - DNA, 550 bp, Heterodera glycines
  SCN-specific regions: Sequence locations=1-550
ctggagctccccgcggtggcggccgctctagaactagtggatcccccgggctgcatgccaagatgaacggatcaacggcatttgtccacccggtgcattgctaatcatcataaaagatgtcaccgaggaaaaatatttgatcaatcttcctacatcacttggcccatcttttgctgatcgaaatgctaataacgagccaagaaattgccgaaataagccaatggaaacgatgaaagcatcgagcagcagcctttgttataaaaacagctgttttttgtccgatttattgtcgaatgcgagcagaagagggaatttgcggctgctcgaaagtgagccgtttgctaacgaagcggcaaccgacgcggaagcggagcgacttttgttcgcggaattggagcagcaaatggacgaagacggaaaccaacagaaacacccggatgaacaaatgccgtgctattcagcttcatcttcggcattttctgctgacaactatcccacccaattgccaatcttttgcggcgtttgttttgccgaatgcgccgcctttgat

SEQ ID NO: 96724 - DNA, 481 bp, Heterodera glycines
  SCN-specific regions: Sequence locations=1-243,296-335,357-481
gtccatttaagggcactgaagaggccgaattgcatgtagaagaagcaaaccccgagttttaattggcaaaacattcagcggacggtggtgcaaatggtcagaatggcggacgtttcgcaggacgacattttggtggtggagggtgccattgacaacgaccaaaccctgaaaaatttggtcgaacggacgtacaataaatttggccaaatcgatgttttggtgaacaacgccggcagcattcttcagcaccaacgatcgcggcagaacagcaacagcaataacagcaccagcagcaataattacggctacgactacacaaatgggcaaaacggagccgaggaggaggacggaggacgcgggaggtaccacggcttccgcggctttcgaaggacttcttcctcagcaacggcaatgaccagtcgccgcacttgctcaatttttggagctttggacaacgattttgactttttgtttaacataa

SEQ ID NO: 96725 - DNA, 634 bp, Heterodera glycines
  SCN-specific regions: Sequence locations=1-634
tacgaatcggaacaccaagtgaccacaaaccggtgctgagcacattcagagtccaagtgaagaaggtggacaggcacgagaatgagcgcaatttatgagcagttgttgtagggaagtggacaaacgtcaaaatgaacttttgccccaaattacattgtcgaacacagaattccatttcagcaccgtcctcttcgaccagccatcgttgggcgtgctgaccatcacaaacactggacaaacgcccacccatttcagcttcaaacccgctaggcccgaggctgacagattggaggaatggctgaccataacgccgctctcctctttcatcgacgttggtggtgccgtggaggtcactctgcaaatcctcgtcttcgatgagtcggcctgcaaagtgccaaaggatggcgccgaattgagttccattatcattgtgcatcttacgggtggaagagattatttcattgttgtggacgccaaatatcagcgagaagtgaaggatttgatcagcttcaactaattttaatttttgctttccaacccaaaatttaattcatttgtttgttctttttttgtgacataattccatatcccaaaagcactcaacctaatgatcaaccaattagcattattctaa

SEQ ID NO: 96726 - DNA, 592 bp, Heterodera glycines
  SCN-specific regions: Sequence locations=1-58,80-592
catggccagatgcctttcaacgtcgtgcaaccgatggcaatgactctgctcaatttgcctctcatcagcgtcatccaccgactcgcaaaaaagtttatctgaaatcttcgctcctgccttttctcaaccaccgacaacaattggccaccgatgctccgcctttacaaaatggcctttcgtcaattgctgccgcggttccgtcgtccattgaatctgtggcgaatgaacgcgactttatgtgcgaatggctgatgcagtcggagggggacgacgattggtcggacgaggagggcacagcagcggggccaattgagccgtgcgcgaggttttttgcttccgcctcacaaatggttttccacgtgtacaacgaacatttggtgccgcttgtccaacagcacagcgacggcgaaccgccgaggattcgctgtcgttggcccatttgcgacaacactccgcgcactctgtggtccatcacaactcatttgcaagatatccattgcactgaaaatgcgttggagtcggcgatgctccaacgggtggagatgggctaccacgagtacgtctatcacattcggcaacagttcgagcgcag

SEQ ID NO: 96727 - DNA, 536 bp, Heterodera glycines
  SCN-specific regions: Sequence locations=1-420,442-536
tgagaaatggcttcggttactgatcgttttctgatgaattggaaggggattccgctgggttttggcctcgtcacttcgacaacatttcatatttttaacaatcggtggcttcgaaatcgtttcaatgccaacgcttttgaatcaaaagaaacaaaaattgcagaacaaatgttacaacaacggcgccgtaatgaactgatgctgcactttaaaatggcttcttacggtgcgcccgtggcattgggcactttggctgccggcggaattttgtcttctttgccaaaaatccttcgtcttcccaattcgattggcttcactgtttgcgggtttggcctttccattggtgcatttattgtcggtgctcttcttttggacggaccgatgtacgcgtacaccgaatgggttcagcaacggacagacaaaggaacagaaaaacaaaaagtggaatgaacaaatgcaaagtccaaccaaccgactatgatttttttgttttgttttctttaaacggatttataaaatatgaaagaaaacaaaaa

SEQ ID NO: 96728 - DNA, 387 bp, Heterodera glycines
  misc_feature (386)..(387): n is a, c, g, or t
  SCN-specific regions: Sequence locations=1-289,312-312,334-352,374-387
ctcgttttcgcggcgctcatcagcacgtcgagtgagaagagaaaggagcttcagggcaagatcaatacggtggattactgttcggtgagttggcaccctctgtcggcatgttctgcaaagtgtaaaggagtcggcgatcgggtggaagactatcctacgcgctcttcttacatcgaccatgtgactggccaatgtcctgaatatttcaacaaagcgcctgaagaccttgagcagattaagtacagtgttccgtgcaatgtttgggcgtgtgaatgaacgacgaatgcttatattatacaatatttatcttaatgtttgtgttttctgtgttgctgtctaaatatctgtgttcgatatttacattgatagtaaatgttctgttgttnn

SEQ ID NO: 96729 - DNA, 972 bp, Heterodera glycines
  SCN-specific regions: Sequence locations=1-548,570-888,910-972
aacctttacatcgcaaccggtggagaggatgacctgctcaccgtctattccctagctgaaaatagggtcgtatgtcgtgggcaggcgcataagtcatggatttctgaagtcgccttcgattgttatgcacccgaatttatgttggaacaaactcaaattttcgacgaaaaacgctgttgtccgcctttgaagggtgagggcacctgttcatcgtttgcaactaatgaaggaaacgcctttcaaaatgggcaccatttcccttctggccatgaagaaagtgtttcttctgccccgcaaattggccatttgccttttgctaattgcgacgacctccgcacgaccaacacaaattcgcttcaattgcttcccaacggaaaagtaacgcacagaaacggctcatcggatgatgcaaatgacgtttctcactgtcagcctcagcttctctatagggttggcactgttggccacgactgtcagttgtgcctttgggacctttccgaagacattttggcttctccgcccctttcccaacatcacttcgacgaaatcaccgtttctccttcaccctcaaactttgcaaatgtttcccctcgaaataccacggtcattcccattggcttcgcaaatgcattgtccacaaccgaaactgatgtgagaacagctgacaaaccttctgacgcaaatagcaaaagcagcggacgcttcagaaaatttcataagcgtggcttcagtttcgggtcccgtttgacgggaaatgaacgaaaacagcacgggaattcttcgaacggggcaaattccaatgaaagtacattgaaaagaggcgaaaattatgcacaatttctcggaactgtgcaatgtccacgactcgaagacgtgccaatgattgagcctttgatgtgcaaaaagattgcacacgaaagactcggcgctttgctccttcgcgaagattgcatcgtgacctgcttgtcagga

SEQ ID NO: 96730 - DNA, 360 bp, Heterodera glycines
  misc_feature (271)..(271): n is a, c, g, or t
  SCN-specific regions: Sequence locations=1-1,23-46,68-172,194-238,260- 317,340-360
atttgtccgtccgtccgtttgagtgcaaatgaaaaaaaaacaattaaaaaggcggggagggggaaaagaattaatgaattgaccaaacactgatcattttttattttcacattcgttgctgttctgcttttgctgctgtccgatcacgctaacggtgcacagagataaataaaaagaaaggcatcgtcactcatatgaccaaagatgggacgagacatggagggtgagggtaattgaggggttaattggggtggggtaattagagggtgcnaagggcgatgggtaaagggcggagacgctaatcaacgtcaattaccccaaaaaggaaaactttgcaaagacaaaattagcaaatttttt

SEQ ID NO: 96731 - DNA, 504 bp, Heterodera glycines
  SCN-specific regions: Sequence locations=1-504
ggcagttcgaattttgtaattcttcagctaataaaagcagctgaccagctttattacaaggacaaaactttgtatacagccattaaacccgaattaatccgaagcgacacgaaccgaccaaaagacgctgaaaagcaccagcaaatacagaaaagtgggaagaaaacggcggacgataattctgggaaaaaggctgctgaaaatctgaaacaaaacaatgtccaacaggcgaaaaacggggagagcaaacgcagtaaattgcaagaaatgatcggccaagccaaaaaaactgttgaaaatgcgctcggttcttcgcacggatcgttggagagtcaccaaaattcgattgaccttcgtcaagaagtggcggaaatcaattcgaaatgcgcggatttggccaatttgctcaatgcgttggaacagaggctgagagccgtcgaagaactgacggaggggattgccaaaaagatcggctacagcagctgatgagtgtttgagtgagcg

SEQ ID NO: 96732 - DNA, 399 bp, Heterodera glycines
  SCN-specific regions: Sequence locations=1-399
caaagattggcactgggttcaaagacgaagacttgaaaagtcagtttaaagaattccaagagcttcggattgacaagccccgttcgtacttcgccttcgacccttcgttggcgcccgaccattggtttgaaccgtcggtggtgtgggaagtgaaggcggccgacatgtccatttcgccacgtcatttggctgcgcggggattggtcgacgctgagaagggtcattcttcgtcatttccagacacaaaaaattcgtttttaggcatttcacttcgctttccgcgtttcattcgaaaccgagcggacaaaaaacccgaaaatgcaacatcatcagaacaaattgcagagatgtaccgaaatcaggaccacattaagaaccaaaaggacggaaaagtggatt

SEQ ID NO: 96733 - DNA, 158 bp, Heterodera glycines
  SCN-specific regions: Sequence locations=1-158
attgtaataattcccatttttgacaatgctaaaattgggtgaacttttgtttcaattaaaatgcctttgtttcattcattctttttgattttgctctttttaaatttatttttccaatttattttcttaaaagcattgaaagtgccgcgtttcttagt

SEQ ID NO: 96734 - DNA, 476 bp, Heterodera glycines
  SCN-specific regions: Sequence locations=1-3,25-137,160-232,257-476
tcctaattaaaaataacatgtaaaaatggcagcaaaggaactgttccttgctcagcagcccgacctgttcaagccgattcaatccatcaatgccgtgctcatactgatctgtctcggctcctccaccgccgtgccgggcattggcgtcctttggttcatcggcctttgctctctgatcgtctcagtcaccgccacggaatttgtctattcgtctgtcctcacgctgctctgcggggtgggcttttggctttcattcggcttcgcctcccacgtgccggacaatggccattcggccggctatattttcgcggggattttcctggtggcccaagtggcctgctatgccatccctgtgctgatcatttacgatcggagccgaacggacggtccggcagccgccggacacgaacaaatcgccaacgtacatccgtttggggtcaccacggacggatgtgagcagcactaccagtcaatgc

SEQ ID NO: 96735 - DNA, 490 bp, Heterodera glycines
  SCN-specific regions: Sequence locations=1-13,36-84,106-490
caagttctcccccaatttgtcccaccttttttgctgcttattttgctctcctccgcctgccccttttcgctcgctttttcctctgatatattgccatctgtcaccaattccaccggcatcggcaatggcactgatgccaccactgatcctactgataccactggtaacagcgatttgatgacgagtgcaacgctcccagaagaaacgactgccaaggaggaggagggcacgaagccgggcacggacggcaccgcgagggatggccaagggacaggcgaaccgcaaaaagatggggaggggttgaagcaggacacgggcgtttccgcggcggatggcaatgggacagccgaaccgccgaaagagggggatgagagccctcaagagtcattcgcctgttcagtgctctgttggactctgatcattgtcggcggtgtcttcatttgtgccgtcggattgactgccttcgttttattgactgtgcactaccaaa

SEQ ID NO: 96736 - DNA, 482 bp, Heterodera glycines
  SCN-specific regions: Sequence locations=1-482
gtaaaagatggcaatcatttggggtgcccagctgatcaattgatcagtccatttgcgagtaattcgcctgcgaatgtttcccttccattctgctgctgttgtccatcactaattgattgtccttcaaccaaccagtgatcacttcctcttgcgatggtccgttctttgttcgacatttgtctggcctccgtttgccagcgcagtttggtgttcgatgccgacctttctcttctcccctgcgactgtaaacaacgtttgatggagtttttcgcatcccatgaccaattaaactccgaactgtgctttgggcttatgtcacggccaatgtttggtcggaatttgactcgcctctgcttttacctcagcgaccaattgaatgattcgattttggaagctttggccagttttaaccaaaaccttcgcattatttcgatcgtcgaatgcccccgggtcactgatacgggaattgtcagcgtcactct

SEQ ID NO: 96737 - DNA, 475 bp, Heterodera glycines
  SCN-specific regions: Sequence locations=1-250,272-475
caacaagttcaaaccgtacaccgaattgcctgaccatggcctattttatgtgctcgagcaaatgcccacaattgttctataccaggacatgacccagtggctaaaacagaatgggtattttgccagctacaacatcccattcttcaagaagaccagcctaattagtggctttgagcaaaaaggcaacgaattttattggttcagctggaaaagttgtccacgcgcaaaaatttttgccagggaccaacacaaagtggtggacttggacagtctgaccaaactgatgcgttataacgattacacccgcgacccgtacagccgttgcaattgcacgcctccgtacactgcagaggcggcaatttctgcccgaggcgatttgaacccggcaaatggcaccttcgaaatacccggcatgggacacgtcaaccacgcggcacttgattataaaggcaccggctacaaaatgttcaaaaaa

SEQ ID NO: 96738 - DNA, 467 bp, Heterodera glycines
  SCN-specific regions: Sequence locations=1-467
tgccaatattgtccggcaaaaaagtctcctgggacatggccaccgcctcgtgcaccgacactgatgaccaaccgcagcgcaaaaactccaaaggctcgtatgactacatcgatgcggacgaatgccatgatgtcgtgactcatcattcttcgactccattttactccattcgtaactcgaactcgacccgcccttcctcgtcccatcatgcacaaatgtcgtcatcatcgtcgccccagtcgcgctacgactacctggactttgctggcaaaccggaccaaccgcagcagcatcagttgcgacgacaacagcagcgagcagcgccgcaacaacgcgtcgctgtgccgccaccggcgctgcgacgtgctgctgcgtcagcagatgaaccgctctatgcgactgcgtcttcacaaatttactcgttgggcggcagcgaagacccgtacagttccattgtgagtattggt

SEQ ID NO: 96739 - DNA, 559 bp, Heterodera glycines
  SCN-specific regions: Sequence locations=1-559
tacaatccagatcctctcgtcaagctcttcaagcactgggtcccatcaaactcctttgcaaggtcaaatatcctccagcaccgatgacggatgtcccgtacaaatgaaaatcgccaaacctgacttgatggctgaggattctttggaatttgcccacaatgagtatcctgtcgtcttcaaatggcattccgatgctcaacctgccaaacatgtgtatttgactggttcatgggacaattggcgtaagaaaatccctcttgtgaaatccacccacgatttttctacgattatcaatctcaatccaggacgttacgaatacaaatttcttgtggacggtaaatggatggtcgatgatacaatcgcaaaaacagacaatcagatgggaagtcagaacaatgtgatgtccattgatgaagctgattttgcggttttcgatgccctcgacaaagatttggcctcctcaaatgctggcgaggcaatgcgttcgatgaattcgacgggtgcacagccatcgcaagacacgccaaacgatcgcgagttggaacgtcttcgcgaattc

SEQ ID NO: 96740 - DNA, 319 bp, Heterodera glycines
  SCN-specific regions: Sequence locations=1-319
ctgctgcacctgcggctgaggcggcagcgcctgcgccagctgagcaacccgcggccgagcaaccggcgccagcgccggcagccgagcccgctaagcagcaagcatctggctactgatcacttcgtcaatgatgggatgtgcccggctgatcacggcgctgatcagtttcttctattttgattgatcagcaccaactttcattcaaacacttttcaccaccatcttgccggtgtttttttctttcaaacttttgctgtcttccaaatgattttcattgtgtcagtgtgtcttagacaacataaaattttgatcaaacagg

SEQ ID NO: 96741 - DNA, 344 bp, Heterodera glycines
  SCN-specific regions: Sequence locations=1-344
aacctttggccgcatttattgcgcggattggcgacactttggcactgaccgaagagccggaaaattacgctttaatgttcgaagagaaacgacgatttgtgacggaatataacaaacccagcgtggcacaggtgaatggttttgtaaaaagtgccggattttgccggtgacattttgcgtggcttatccaccaatttgttgctttttctgccaatttgacataatttctgttttcagggctttttcctcttgctgaccgcttctccggcaattctccaaatttaattcggcccattctccgctttttcagtccaatttcgctaaacactttctggcccaacttg

SEQ ID NO: 96742 - DNA, 648 bp, Heterodera glycines
  SCN-specific regions: Sequence locations=1-45,72-194,216-648
tgtaaacaacatagttattttagtattttaatgtaaaaagggtacttaaatttataaaaaaaaaaaatattgctgacatttgctaataatgtaacggttttcacatcaattacggataatacggtcgtatcagcaagctttatgtggaatgtttcaacgaacgcgagaagtgtttaacggtcatcggagggggcaaaatggctactgctttagtgcatggattagtttccgctggttttatcgacaagtccgaagtgaatatctgctcaagatccaaagaaacggcctttcgttggacgacacaaggttaccaaaatgcatatacaaatgatgaattttacagcaaagtgaaaaaaccacgaggaattgtgattgtcgcagtaaaaccacagatcttccccgggtttctcgacgaactgcgtaaaaatggttggcttaactttgttgggcctgaagtgctttgtgtgtccataatggctgggattgcacttgacacctttaaacagcagttgaaattggttggtttcaatggccatgccgcccgttttatgccaaatgtgaattgtctcgtttctgctggtatcgttttggtctgtgccgatgactgtgttccgacggagatggtttagcagaaattgttctagttat

SEQ ID NO: 96743 - DNA, 650 bp, Heterodera glycines
  SCN-specific regions: Sequence locations=1-513,535-549,626-650
agaatgcccaccggcagcagagtgccgttaattgtggaaagacgaagtgatgagacggaggaggacacgtggacagtttatccgacggcgggcatttgcatcaaattcaaagaggcccatttctccgccgcttcgtccgtctccggcccctccacctctaaattcttcatcaatttggcccattgcactgagctgccgccgccccatcggcacgccgaattggacgaggacaaagtggcacaaatggtggaagaggacccggatgcttttcgcattccaatttgtgtgggcgaattggaccgatcggcggaggaccgcagcggcgaagcggtggcaaaagtcgatgtgctggtcaattcggagttcttccacaaacgcatcagtcaatccgagtttttccgtcagctgacacttcgaatcgttttccaggcaattgagattaaacattcgcttcgtgtggacattggcaagcaggtcattttgcgcaacaaaaaatgcattggcgaactgtgcgcccaaagaattcggaagagaccgatgacgacgaaagaagcaaacggagaagggaaagtgaaagaaacaacagacacaaaagaggaggaggacgaagaggaaaggacagaagtcgatcaaatgttggacattgagga

SEQ ID NO: 96744 - DNA, 650 bp, Heterodera glycines
  SCN-specific regions: Sequence locations=1-228,250-650
ctctgatcaactcatctgcctctctagccctttgatcagcccatttatccctcttccatgccaatttcggctctgatcagctcatttttaggcctttgatcagcccatttagccccattcggagtcaatttggccctgatcggttattggcattaccctatttcctttgcaatttcacccttggatcaatacgattcgtcactttcgtgctaattccaggtctgattacttcatttgctttcttcatttccgttccaatttcaccctttgatcagtccaatcaaccttccatgccgatttcggctctgattaaatcattttgttagccctttgatcagcccattccgatttcggttcagaacagctctttttcatcccctttcccaacccatttcgcccttttcgcgccaatttttcgggaccgatttcattaacttccgcttcccgcatcttaggaaatggcaatcgtgtatactgaattcactcgggaaggtatagatacgtggttgttttatgctaaattttgaaattcaagaaattgacgaagctattgaggaagcagttttgaaagtgaaaggaggaactgagagagatggcatgcgcgccgccttggaaacgattgtgagcagcccccatctgctgttgaacga

SEQ ID NO: 96745 - DNA, 460 bp, Heterodera glycines
  SCN-specific regions: Sequence locations=1-460
gtgatcaaaatgctccgtttgcgctgcccatcgcgccactttgcctcgtccgccgcttccgccatgaaagcgcgaccgactgttgagccggtccaacaaaaaatctcccgactgcccaccggtttctctgtttcttcggtggaacttcagatcgccaaacggactgcggaaatgcaaacattgaccaccgccaactgttcgtcatcgtttgctgctgaccaggcttgccaattgttggccaaaggcaccgcactgttgtctccccactttcaaattgggaacatcaccaacaagcgcactccacaaattgtcaactcgcgctggttgaccaaggaggcggcactgatcggcgtcaacatcgaacacgacttgcttttggactatgcgggcccaatttcccaattgatgtttgctttccgttccggcgctcgttttcaacaacatgacgaagccggactca

SEQ ID NO: 96746 - DNA, 581 bp, Heterodera glycines
  SCN-specific regions: Sequence locations=1-30,78-481,506-581
gagcaattcattttcgattgatgacaaatcttaataaaaaaattttagaatttaagtttaaaataattgtataaaaaccgtttttcatttctgtttctccgcttcctttgtctccaaattccaataatttgatattataaatttgaaagaataaaaataaatgacttacaaggagaagcccgtgatcaatgccgagacgaccgaaaaccttgaacaggaacgggggcacatcacccgtatcctgtcaaggatggaggtcgagctggacgcgtgggctgccatcatgaacggactgcaaggcccagcgagagaggcggaggaagcgcttttcactgcctttattcgagatgaccggcacttgacggaatggttggaagatgcgcgagaaatgctggctcacatagcagcagaactcgcagatgagcccaaccagccaatcgcggcgggaggacagcaaccagctgttgctgtgaatccacccgtgccagccgtgccattcgtcaacaatgccgcatttctcggcggtgccaatgttcaacagccagctgctgttgccaaccatgccaatcagccaccattgg

SEQ ID NO: 96747 - DNA, 581 bp, Heterodera glycines
  SCN-specific regions: Sequence locations=1-281,309-581
agggcactcgtggcattatagacaaaaggagcttaaaaaatcgaatttggataccctaaaaatagttttaaaaaaatcggaaattgaggcccacgcaaattcaatcttctgctgctgatcattgcaatgaagtgagaaataattaactaattaggaccaacagaagcccgaggtaataaataattcaattggttactgtaggatttttgaaagaacgttcagattgcttactgtatgcatgctgtatactgtagccttgcccatttaaatattttcgaaccattttttaatttaatttttattaattactccttttaatcatcaaagtctgccgcgaacataagtgttattttttcaaggcttttccaccgccgcccccgcaggggaatttcacagctaatttaatgacccccaccccgcggggttttcccgccggtcgccccccggggctctaattgccaacaacttccgccactttcctcgcccctacagtatgccccatcttagtgacttcattagcaacagcagcacagttcgcaaattagtttttttcaaatgtaattttctctccccgccacgaa

SEQ ID NO: 96748 - DNA, 486 bp, Heterodera glycines
  SCN-specific regions: Sequence locations=1-5,27-97,121-486
atttattatcaccatgaatcctgctgatggataaagaaaataaaaagcgaaaaggtacaaaaagatccaaaaatcccgaagaaacttcgaaacaaagagaggaaaaccaaaacaaggaaaatgacgatgaatttattcatcccccaaggagacgttcagcgaggttaattgcaatttcaaaacctgctttatcgagtgatttatcggcttcggctgaagattttgttcatggaaaagggacgaaaaccgcaaaatcggaggtgtttggaacggatgctcttttcggtgtctcttcggcttctttcacttcgcctttcaattcttatttgacttcatcagttgaacccatcaaattgtcttcagatgaagcgactgtttcttctaatcggtcccttacaaagagacttaacgcaacaaatattcaaaatgcccaatcgctcggtgaaggaacttcgaaggcgactttacctctttcttcggatgacg

SEQ ID NO: 96749 - DNA, 587 bp, Heterodera glycines
  SCN-specific regions: Sequence locations=1-587
aaaatttagtcgtggcttcttaagcctcgcatggaacatgcacatagaactaccaaaatcgatctgataaaattatcgcttttcttgtgcccgtttctttaattcagtgcactgctccatttatgctaagtcacgttccccgggttgttgcgagccaagttaagcattgagtaggctgactccatagttatctcacgatcaatttcgagaaaatcgggcaaacgcggctcaggatcaccaatagggcgcgtggtgtatgtctcgaggatcatcagctgttcttcattgtacatcaaagctggaggaagaggtgcaatgtaaatgtccaggttaaaatacacatttccgaagagaaaacacacacgtttcttgcgaattgcttgatagtctttgtcaagaagtttcaagtagatctgatactcatgccagtccaactgcttccgtgtttcaaccggttggggaagtttcttgccatcagcgtcttcaatggttcgggtcgtatgtgtgtacgtgtactttccattttggctacgcgagcgaagtcgaacctgactcgaaccctccatatggaggtaagcatcctcaat

SEQ ID NO: 96750 - DNA, 279 bp, Heterodera glycines
  SCN-specific regions: Sequence locations=1-23,45-279
gattcctgtgctaaacaaatggtaaaaacaacaaaactttcacatttgaaaaagtcgcgcaaacgactaaaacccttaactggtcaagcaacttcatcattagcatcttcatcatcgactatttctacaacttcagctcacaaacagccgtttgactgtgttgatgaagcgcgtgcaagtggcacgttgcccactcattctggacggactttactgcgaatcgacgaggatggaaactgcgttgagattccgatgcagcgtaaaccgacttcgcccgtc

SEQ ID NO: 96751 - DNA, 187 bp, Heterodera glycines
  SCN-specific regions: Sequence locations=1-187
atttctgtcaatttgattttgatttctcttggaaattctctgaaaatgccttcctccgattttccgatgccgtacacttcacggctcagtgagccttgcttggcaccaggccaatctttggtcttccaagggtccggtcggttttgacagggctaactattggatttgacttccgtcgatcgcttgg

SEQ ID NO: 96752 - DNA, 603 bp, Heterodera glycines
  SCN-specific regions: Sequence locations=1-82,104-603
gagagaacaaatatatttttacacaaaaatgttttcattcggtaagcaaaatggcatatgtttaaaccgatttaaaactcggtttaactgaattcttccaaaagccgaaataagtcaactgagatttcggttaaggtattttttgataccattatcgttaagattgaccgtcatttgacaaagttacggaataaaatggggatgtcaatttctagattaaaaaggtaaaaaatcggtcggggtcgttttcgcgtggccattttcgcgcggttgcatataagcgaattttttactttttttatagtttggaaaattttttcactcccgttttacttcgggtgcttaattcaatatatatttaagtgaattttataaactaaattaagctgacaaattattatacagtctaataattttttcacggtctaatgctctgctggtattagtgtaaactcaccatcccaaattcccatcctccgttcttcaagtctatccgagtatatataaagccgaccaaatccctttccagtcatattcttcatcccattaattccatccacatttttttgataattttttttcagttcacttcttcaattttct

SEQ ID NO: 96753 - DNA, 189 bp, Heterodera glycines
  SCN-specific regions: Sequence locations=1-189
ggtcgcatcttcgttccatcagaacgcgccgtgaggaggacagtaacccgcgctttttcatgtccggtgttcaggacagtaacggtctttgagcccttctcagcaacacatgtcccgccacccgggtcaagccaaaccgccgtttcgtccgccgcgtagacatgtgtgtagctgaaaattagtcgtttg

SEQ ID NO: 96754 - DNA, 631 bp, Heterodera glycines
  SCN-specific regions: Sequence locations=1-631
cactccaacaatcgtcaacaatgttagtctcgacccccaagtgagcgccaatttccttcacacagccatcgaagagaagcgagaggatgagattatccatttggtgggccccatttccaaccaagaccggctggaattggcgcgacaattcgaaccattgttcggagaagatgtgtcctccaaactgaagaatgcactctctggcgactctaatgaactgattttggctttgttggaaccgacatctgtataatatgcgcacccaatgcaccgcgcgatgtgcgggctccgcactctcaagggatcgggcctgattgagatgttgctctcacctcgaaagcgaccagttgatgaaatgacccgcgcgtgctagacactgtaccgccatccgctggaaaaggacatcttcggggacagctgcggcgcattcccaccactgctcccgtcggtgtgcaactatactcgcgacaagaggtggagctccgacccgatctgagcgaatatgacggcacgtgctcttgtcaaataaaaccaagtggaaagcgggggcaacgaaagtctgttcaaccagtggtggggcacgaaatttcattccgttgcgtttgatttcgaggagatcccaagggcagcg

SEQ ID NO: 96755 - DNA, 711 bp, Heterodera glycines
  SCN-specific regions: Sequence locations=1-224,246-711
attccccttttaatacacaacagcaaccacagcctaatgaagccgccgcgtccgaagaagccgacctgacaaatttggcatcacaggaagcttccgacaatgcgggtcaaatgactactgctgtttccaacaccaatgcacagcaacccaacgatgccaccgtgcccgaaggagtcgacccggcatttttggctgctctacccgaagatatgagacaagaggttatcagagatcatttacttcagcagcagatcagtcaggcggacaataccactgctcgggtggatgccgatgtgccaccagtggaacggatcgcagcaataatgggaatggagattcccgaaggaatggaccccgcatttttggctgcgctacccgacgacattttccacgaagttgttcgtgaccatcaacgacagcaggagctggcccgtcagcggagggcacagatccaagcacagcagcaagaagccaatcatgcaatggtccgtcaccctcacattcaccatcgacattttgcaatgcctcgtttcctgtctcggagtattcggcctcacactcatcgagagcttccgtccacttctgccgcagctgccacttcatccgtggaacgcactgtgccgctactggacaaggaatccataagcacacttctcgtcctgttcctgttggatcaggagaagttcgacacggtgcgtcttcagaaattgt

SEQ ID NO: 96756 - DNA, 481 bp, Heterodera glycines
  SCN-specific regions: Sequence locations=1-458
attagattcagtatttgagttgtcttaattttaaaatgacgaagaaacaagtcaccatcgttggttctggaaattggggcacggcaattgctcgaattgtgggcaaaacagtgcaaatgcataactcagaatttgatgactcggcggtcaaaatgtgggtctttgaagaggtggttgaaggacgcaaacttagcgaaattatcaacgagaaacacgaaaatgtgaaatatttgcccggaaagaaacttcccactaatgttatcgctgtcactgatgttgttgaggcttcaaaaaacgcggatgttctcattttcatcatccctcaccaattcttgcacaaagtttgcgaacagctcaaaggaaacatcaaaaagagcgcaatcgcaatttcgctgattaagggcttggccacttttcacgaaaaagacattgggctgcgactgatctctaatgaaatcgcgacctctcttggcattgacac

SEQ ID NO: 96757 - DNA, 677 bp, Heterodera glycines
  SCN-specific regions: Sequence locations=1-375,397-434,464-677
tttggtccgtcgacgattcggtcattcacacggattactccgcactccgttccattgtaatgtcaaaccgcgaggaaaccgtaaaaatgccgatcaacgagccggccaagtcacgcaaagcggtttcacagattcaggagtacgtggattactacggcggcgcgggtgttcagcacattgctctgaacccttcggacattgttcacgccatccaatcgctgcgcgcccccggcttggagtttctgagcatcccggacagttactacgcgtctctgaagcagcggctgagcgacgcgggcgtggagttgaaggaggacttggagaaactgagggagctgaagattctggtcgattttgacgagcagggctatttgctccaaatattttcaaagccatgccaagaccgccccacccttttcctggaaatcatccaacggcacaaccaccagggctttggcgccggcaacttcaaagcgttattcgaaagcatcgaggcggaacagaacgaacgtggcaatttgttctacaaagacgtggcggtgggaggggaaaaaatcgaagcgaaaaaaagcgaatgaaaacgggcgatagaaaagaaagaaagacagccctaattgaaaaccaatgagaataataagaaacaaaatatttatcaaaaaaatgcaaaaaagtgaacg

SEQ ID NO: 96758 - DNA, 770 bp, Heterodera glycines
  SCN-specific regions: Sequence locations=1-770
gtggtcattggtacggatgacagcggcaaaatgccgatgactgaaaaacaggagacggcaccaaaatgtgccacaaatgttgcggcacggagttgcgcatgttgtgagcatgtcaccgtgcgcaaaattcggctggacgacgaagtgtgcgtgaatgtgacttatttgcccaccaaaattggcgtccgattggccgtgtcggtagatggccatgtgtactattccaaggatttggcagtgttcaacccggagtcggcctgctttgaagtgcccgagatgcgcgagtacgcgagcatttgcatcaatttgtacaatatggaactcaaaaacaacaagctgaccggttgcgcaaagttggaggccatcctgctgcatttgagggtcgcccagcacaaaattggctgcttcagcataccgatttgagaggagctttgtttattacaaaaaaacagtacaaaaaagaataccgtatgccacccagctgataatacagtatggaatccaaaatacaaatagcactcttaacgtattgattcttctgtgatctttttaagcccccatcaattcgacatatgacgtcattgtacaaattcctcccccctctaattaattgttcaattattctaccatcttatgcagagcagtgctcgtaagtgtgctcattttttgagtgtgaaaaaaagccaaaagtgctgatttttgaggtttcgacataatttttgaaaaatataattttttgcaacaaatctcattaaaaaattttctttttt

SEQ ID NO: 96759 - DNA, 630 bp, Heterodera glycines; identical to SEQ ID NO: 88639
  SCN-specific regions: Sequence locations=1-478,501-630

SEQ ID NO: 96760 - DNA, 528 bp, Heterodera glycines
  SCN-specific regions: Sequence locations=1-219,251-528
aatgaatccctcaaaaatgtttgctgtacatttcgccggtgttctccttcccctcttcgctttggcatttcttctcaacgccggcggtgcttttgcctattacgcgcaacacttttatttgccgagcagcgaattcgccgacacttttggaaaaagaatcggtgcgcaatcattgccaatgggtgccaacgaatgggcggcacagccaaaaatggcaatggaaagagaggaagaggaagggacggaggagggacagcagcaggggggagccgaagtgatggcggagagtggggagggaaaagcgaaggtcgcgccgatggcgaggggaaatccaacgaaagcaccaatgattccccgccgtacacttcgccatttattcgacgactttggaagtggccaaatggggcgacaatacaaacgaatgaagccgtgcttttactctccaatccaatgtctgatgaagcgatcttcggcttaacccgaccgaacaatgccaaacaaagggaccattctcaaaatacccaattg

SEQ ID NO: 96761 - DNA, 718 bp, Heterodera glycines
  SCN-specific regions: Sequence locations=1-473,545-555,716-718
attttgccaatgcaagtcagtcaaatgagaacaatgtccttgtcggtggcaagtcttgttgcattgctcgttttacttgccatctccagccatccaacctttgccagtcctatttcttcaagagacttaaatgatgctgctgaagcaggtccactccaagcagttgaaaagcgtcggaatgcagaattcataaatggcttactgacaatggagcgtctgaatgcgatgggcaaaaggtctccagtcccagcatcatcagatgatggagtcgtgccgatgacactctggcgttcccagcacccgttcttctggacagagtgaaagcaaaaaatgaagcaaaactgcggattatttgtcggcttaaaaaacaattataatatgaatgacgcatcatttaatttgtgaataaataaagcgggggcgagagtgaaggggacggagattggggagagaagtgtggacatgtatgtgttggggacggagaggaggaaggagagagcggagaggaagagtggagtagggagaggcggagagagaggggaggtgcggagagtggagagaggtggagagagtagagagggagagagagaggtggagagtggagagtgagagagaagagtgagaaggagtggatggaggagaggagagagaggtgggggagagagaggtgagagagggagagggagagtgagagagagaagagtgagcgagagaggta

SEQ ID NO: 96762 - DNA, 336 bp, Heterodera glycines
  SCN-specific regions: Sequence locations=1-336
tccaactgtcttccgcttcatcaacacaatttgatatgagataagtcaatcgatgcagacattgcacgatgcgtcgctggtgaagtccctcctcaaaaaacgcgcaaatatcgtgccgtcgatgcgagaattctcgactcttacagggttacaataccatcaacaacatcaaccctgcttaccaaaatgatcaaaattaccatacaatgttaatcctgataatatcttcaattttctcgttgaatttctcaaaaattatgaaatacgcccgtagtcattcttcaatgttttgttattttttcgttgaaaacacactgataaatatgttatggtgtt

SEQ ID NO: 96763 - DNA, 465 bp, Heterodera glycines
  SCN-specific regions: Sequence locations=1-286,309-412,435-465
aaaaatggtcgataagggcgaaggctacaccggctatcaagagctgaaggacggagtgtaccacggctatcagccgttgaagccgcgcaaaacgcccaaattcaccgcagaatttggactgagctcgggcatgctgaacattgcggttgcccgcgacattgactcaattccgaagggggacaaccaggacggaagccaataccagtacttgtcggcacacaacgtggccagaggccagtacattcctccgaccaacccgaacctgccgaacttggacattcctgttcaacaacagcagcaggaagtggccgaagaataactggataattcagaatccaattggtgatgaagatggaaaagaatgttcaatttaatatgtttgaatggttaaaaaaattggattaaaattacgataaaattaaaatttaataaaacaaatcatctgaatgaacaaattttaatacc

SEQ ID NO: 96764 - DNA, 320 bp, Heterodera glycines
  SCN-specific regions: Sequence locations=1-167,193-207,231-320
ggtggacaaaggcgaaggtgacagccgctaccaagaattgaaggacggaatttaccatggctaccagccgttgcgtgctcgcaaaacgttcacttacacttacacacaaagtgaatagggccccaaagcccgaagatccgtacgcgtggctccaaccgcaggccccaaaacagcagcaacaacagcaggaggaagtgacggaagaagcatagaggaagaagaagaaagtcagcactaaagcactgattagaggtgataagtgataatgacaatgataaatgataatgctggcgatggtgataaagttaattgtcaaaaaa

SEQ ID NO: 96765 - DNA, 341 bp, Heterodera glycines
  misc_feature (274)..(274): n is a, c, g, or t
  SCN-specific regions: Sequence locations=1-341
atattcaaagttgttctcactggaggtccgtgttctggcaagacaacggggcaggctcgccttttaagtttctttgaaagcattgggtggaaggtgtacaccgttcctgagaccgcgtcatttttcctcggtcctggacgcattcgttttcccgacctgagtagtgagcaggctgctcaattccagacagatttgctcaaagcattgatacaaaatgaggatgtctttttcaaccaggccgaattcagtgaagcggaaaaaattatgatcattntagaccggggtaggtaacataaattagaaatttgagtaatactaccgattgtatcacaccttttttg

SEQ ID NO: 96766 - DNA, 495 bp, Heterodera glycines
  SCN-specific regions: Sequence locations=1-495
gacatggaggaattatggaaacaatcgcaaaaaatacaaacggacaatcacgaattgtccgaaagagtgtcttctttaactcgagagaacaacactcttcgcaccgaacatgaacgaattcttggcgatcacaacactcttcgcaccgaacatgaacgaattcttgtcgatcacaacactcttcgcaccgaacaggaacgaattcttgtcgatcacaacactcttcgcaccgagtatgaacgacttcttcagcgacagcttgacgatttccactattggattctttgtttcgccttctttatcccgccactgtcaatattagccaccgcgcgtaacaatgggctctcatttccggtaactgttctgtccgcactcgccgcgacaattttctgtgcctttctgtggatccccggcattctcttcgccttggcattttattttggtttgaggaagaacgcgaagaaagagtgatctgtacgaattggaattcccagc

SEQ ID NO: 96767 - DNA, 436 bp, Heterodera glycines
  SCN-specific regions: Sequence locations=1-436
gcaaaaacaaagcggtgaccgtcgttaaaggcctcaccacttgcggtcagtcgcccgggcgaacaaatcgatggacaattacaacaacggttttgatttgacaaaaggtgtcgacttgaaaaccgcctccaaattcttcgcaaatcgtttcgcctgcggctgttccgtcaccgttgactcagccgacgaattggtcattcagggcgactttaaggtgaaagtgtgcagcccttcccacacattgccattttgttgattgaaggacaaactcttcgtagaaatcccgaagaaatggggcgtcgatgaggaagtcattgaggatttggacgaccaaaagaagtgaccactcccctttcacactgcttgtttttactttaatttatatactaattcattgctttgttgtcgtgccgaaaagataaatttgaattcattt

SEQ ID NO: 96768 - DNA, 359 bp, Heterodera glycines
  SCN-specific regions: Sequence locations=1-359
cttcctttcctgtccgttcttttccaattgacaaatggcaaatgaaattcttgaatttccactgaaatatgacaacgatatacactatttaaaagtccgacgtactgatacggtgcgcgaattaaaatttgtcatcgaggcaaaattgaaaattcccccggaagaacagagattgatgattggcaactgtgtgcagccggatacccgccttttgagttcaatgaaagggctggatttggtgcgtgagacgggccctgctgctcctccctaaattggcaatgctgagtagtttgagaaagacgaatgattattggcttttgactttgtttgttgcgaataaaaattaaaaagcaaaaaaa

SEQ ID NO: 96769 - DNA, 376 bp, Heterodera glycines
  SCN-specific regions: Sequence locations=1-376
caagtgatgcacatcgaactccatcaaataagtccgcgtttcatagtgcaatttgtattttttctttgcaaattttgcgctcagcagccactggaaccatcgctggtatttggcttgtcgttgctcgctcccgtcgttgtagcagatgccaatgatgagtattgacgccgaaatggaaaagacaaagatggtgtagacaaaaaggcgcacttcctagcaacaaacggatgaaccaccaaattcacagcggacaacgcgcgacaatggaaaaagcgggagacaggcagaaaaacactgttcgaaacgaacattcttaaaattaaatgcagtgggaaaagtcacaaaaacgcagtaaacgaaattcaacagagaaaaa

SEQ ID NO: 96770 - DNA, 392 bp, Heterodera glycines
  SCN-specific regions: Sequence locations=1-319,341-360,382-392
aaaaatgaatcgcttcggaataatttgcattttgttgttggttgaaactctgatgcttccagcagtgatggtgggagctccagttgtaattcgtcaaaaacgcactgtgaccggcaaagagttggccaaaggtgccgccatcggagcggccgcgggcgttgccgccacaatggcggcggccggcatcaaaaaagctttggaccatcgtgccgagcaaaaagcggccaaagaaaaggcgaaaaatgagggccaaatccaataaagaaaaaaattggaaaatgaatgaattaatgctgatgatgatgatacatcacaatggaaattatggaatgaatatctgaatatgtttagtctttacggaaagaaaatgaataaaagttttacttgagaaa

SEQ ID NO: 96771 - DNA, 355 bp, Heterodera glycines
  SCN-specific regions: Sequence locations=1-226,249-255,277-355
tttttggctgggtcaattttcttcagtgcgctgacagtttcctgggtcctttgggacaacagaaatcagcagcacaaaaggacttcctccgtgcgctcaattttggcgtcggcacaacggcaaaagaatatggaggaaggagcggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgtt

SEQ ID NO: 96772 - DNA, 383 bp, Heterodera glycines
  SCN-specific regions: Sequence locations=1-383
agctaccaaattaaattatcccaaaaatgatttcttcccaaatgttctttttggccctgcttttcatttgtgcttcgcttctttgcttatttactgcttcatctgctgcttcagatgatgggcttgaaaatgaaaacccgagcaaaaatgtgcgcaattttttggccgaatttggagataatggtcattagaagattttaggaggtttttcttcagtctcagatgttggatgagaagatgttatggcttttgggcgatgatgcacattttatgccttttctgactgattacaacaaacatttccattttatcactttccgtagagaatagttattttttattgtcaattagttatactgtagttaaaaatccacatgaaaaaa

SEQ ID NO: 96773 - DNA, 349 bp, Heterodera glycines
  SCN-specific regions: Sequence locations=1-349
gaccaattgctgtcggagacggatgtccacctggacactctgttggcaccgccgctggggcgtggcctcttttacatgtccaaatttacgttggcgcgaaagcgatggaaacaatcgccggcggagaatgaaaaagttttggaccgttttgaagtggctcttcaacatgtgtacagcttcttcttgacctaaagaaactgcgatggcacaatttttaatatgtgatggagagacaacaaattaagagagattttttgtttgatttatatgtgcgactaaggaaaatgactctataaaaatagttcgaaaattgtatcttttttcttttttaaatataatcagtgtgaag

SEQ ID NO: 96774 - DNA, 271 bp, Heterodera glycines; identical to SEQ ID NO: 58443
  SCN-specific regions: Sequence locations=1-271

SEQ ID NO: 96775 - DNA, 350 bp, Heterodera glycines
  SCN-specific regions: Sequence locations=1-350
taaaaccctgttcttggtcgctttcatggcactgttcttcaccggatatcctgctgatgttgctggtgctgttagttcatcaggcaacagacgaaatgttaaatacattgattatgggccgcttattcgacaatcccggaaaaaccaaaaccgtaataaaaactcgagaccgataaagacacggccgtcgccgagacgaggcgattgatgaccagcacagaagaaagaataatcgagagaaagctgatgaaaaattgagaaactaaggatgattaaaactgagtcgaaagtatggaaaatggatgaatgcattgtttttttgggaataaatcatattaaagtaaaaaaaa

SEQ ID NO: 96776 - DNA, 747 bp, Heterodera glycines
  SCN-specific regions: Sequence locations=1-147,175-747
gacctaaaaacggcaaaattttttattttttgttgcaaaattccgtaaaaagaaagatgagttttcagggcggcactgcgtgtatgccggattccagagatcactacataaaaatagagcaccattcctaacctttcattttgatgattaaaataattattcatttatttagaagcgatttactagcaaatttgcgcaaatgaatggccaaattattaattcggacgaattaaagattgttttcacacataaggcgcttcatactttgattgcatattattcggacgtcgcagtaccaactggaacaacagttaacagggacggatgtgggctgacaaaacggcgattcttgtgcccgtcggtcaagaccaaagaacagatgatcttcgagatagatttccgaatttcggcgacaattggcgaaaaaattatgtttggtaaaaaacatgacggttcaaccgatgatcttcgcgaggcaacgaggatgatcttagacatggtaaacagcggaatgttttacgacgaattgggcctgcgcgaatttactgttgccccaccaggaccggcactgaaaaacaaattggacaaatttgtggaccggaaattgaatgaatgtgtggcacgagtggagaaattagtgaataacaaaaaggacgaagtgaaagacctggccgagcatttggaggcaagcgacgggtggcacttgaacgaggaacagatccatcaattcttcaaacgcagaaacgc

SEQ ID NO: 96777 - DNA, 515 bp, Heterodera glycines
  SCN-specific regions: Sequence locations=1-68,90-374,399-515
acaaatacagtgaaaattggtgtgatgaatgacgacattcgagatcagcccgggacgtgttcaagaattttctctctaattggcatcaaatatcagtattatttggacagactgacgccgtacactgcggtccgatggacaattgcaattacgcttattgtttttttcgtgtggaggattgtcgctatacaggggttttacattgtgacgtacgccttgttcatttactatttgaatctcttcttggcatttctcacacccaaaattgatccggcagttgagtatgacgaagatgacgatggtccggtcttgccaagttcaaccaacgaggagttccgaccgttcatgcgtcgtcttccggagtttaaattttggttgtccaccatgaagtccactcttgtcgcctttggctgcactttcttcgaaatgttcgacataccggtgttttggccaattttggtgacgtactttatcgtgctcaccactctgacgatgaagcgacagattatgcatat

SEQ ID NO: 96778 - DNA, 603 bp, Heterodera glycines
  SCN-specific regions: Sequence locations=1-85,107-357,379-442,472-603
aaataccctaaaattcaacaccctcaaaaactttgagagggaattcgaagcgcgataacgggaacaaataaaccaatgaaataagataatttgatgattttcaacaaatatttttaatttttgggaatttgtaagcctacatttaggccctattttccatattttatatcttaaaaatagagcaccctcccccgtcattattagtgccaaaatgcgttccaaatgtgtttttctcgtcatttttgccaccatttttttgctgttaaacggcggcacttcatccaaacacaaatcggcaaaatcaggagtgtcgttggtgcaaaaaagcgttactttggcttcacttcttcgccaaccgagtcagacggaggtggtcacccgcacaatgtcacaacagtgggaagtacagcatgatatgtatgattatgatcattaccctaaagacgatggaccaaaagaaaaaggctccaaaaactgctgcactataatgtaggaaatttggacaaatttcagacgctttttcgagtttggcgatcttagaaaattgtgtaatccgcttttttgaattgtcgaattgttgagtaaaatcttgttgttgctaaa

SEQ ID NO: 96779 - DNA, 213 bp, Heterodera glycines
  SCN-specific regions: Sequence locations=1-213
tgtatctgaatgcctaatccgagcactttctttttaagggttcgaatgaagacgggcaatcgaattcgttacaacgcaaaacgtcgtcattggcgcagaaccaaactgaagctgtaagcgcaaatgaacaggcggaagacggcgggcgatgatttgacttgttgctgttgattcatacatttttatggactgttgataaaggaaattgtcatc

SEQ ID NO: 96780 - DNA, 588 bp, Heterodera glycines
  SCN-specific regions: Sequence locations=1-438,474-515,544-588
aattctagaccggctcaaaaattgttgaaaaactaataactaattcgaatgtcaaccatcccaatgccaccaccaccaacacaagacgaaaaggaccaacaaaagaaatcccaatggaaaccgctggagataggaaatcggatgcgcacgacctcagaagattcggccgagtcttttgacgcctatggaccggagtgggaagggaagggacggggaattgggaacagaagggaattcagttcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttattttatttaacacttcttctgatttttcaataatgaaataaagacaaacccacca

SEQ ID NO: 96781 - DNA, 318 bp, Heterodera glycines
  SCN-specific regions: Sequence locations=1-119,142-318
ggattttcgacaaagccaataattattgacggaaaagatcatttgcttggacgtttggccgctgtcacttcgaaacagcttttgcttggccagaaaattgttattgtgcgatgcgaatccatcaacatttctggcaacttccaccgttccaagctcaaattcctcgcatttttgcgcaaacgctgcaatgtgaagccatctcgcggacccttccactaccgtgcaccatctcggattttctggcgcacggtttcttttcatatttaggctaggctaagcgtaggcttgtttgggcctaggcttaggcacaggctttgt

SEQ ID NO: 96782 - DNA, 443 bp, Heterodera glycines
  SCN-specific regions: Sequence locations=1-443
aaatacgacatttacggctgctttgattagcgatggacgtgctgaaaatcagttggagcaaaagaaacccagccaattgcattccctcccattttccatggattttaatgggccggcattggtctccaaattcttccagactgaggatggcgctaatgggctcaaagcagcactgttccgaggacatttgcttttgggcaaaacggtcagagcgccggagggttttgcgttttatgcagtcaaagagagtgaacattcacaatcagaagagggagagatgagcacgtacaatgttgtggactctgttccgtcgatggatgtttgggagtacgacgaaccaccagaaagtcgtaagaaatgcctgcagaatgcattggttgctctgcaagttgcgaatgatctcgccagctgaattgttgttaattgtataaattttcacaaaa

SEQ ID NO: 96783 - DNA, 192 bp, Heterodera glycines
  SCN-specific regions: Sequence locations=1-192
gccgaacagcgaaatttggtggtttggtcccgattgacaaaaaacggtgccgggacccaatggcccggctttcgtcgcggtgccgagccgttgccgaacggcgaaattgtgccattgtcaatcgcgtcactcttttggggctgaacaacttttggcgtgtgatttttaacgccgacaaaatacattttcaat

SEQ ID NO: 96784 - DNA, 509 bp, Heterodera glycines
  SCN-specific regions: Sequence locations=22-99,124-183,206-207,261-509
aaaatccagccctcagcaggagtcgtctaattcagtaaatacgcagcgaagagagcacaaacggcgcaatgatcagccaatcgccggcagtctcctggacggaagtgaacacacgcgcaacacaaccgccgaattgcatggagacggagatctatatgttatgttctcaataaattgacataaattggaaagaaaagaattttcttcaaaaaaaaaaaaaaaaaaaaaaaaaaactcgagactagttctctctcaagggcgaattccagcacactggcggccgttactagtggatccgagctcggtaccaagcttgatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctt

SEQ ID NO: 96785 - DNA, 428 bp, Heterodera glycines
  SCN-specific regions: Sequence locations=1-34,56-388,412-428
tactctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaaccggttcatctggcagtccgaaaaaaggaaaatcgccacatgccgatccgaaaaaagctgcttcacaccttgtgccagtaacaccagggaaagtatgatgagcaagccttaaaatggtgaagaaactgtgtggagcgatgatgccaaccatgaacaaacccaaagctgttgaagtagatgtag

SEQ ID NO: 96786 - DNA, 742 bp, Heterodera glycines
  SCN-specific regions: Sequence locations=1-115,142-742
aatgtccgcttgcatctgtccgctgtgtgatacgtcgcttgcggcgggcttggccaagtaggcaaagtgccaacacattggccatggcccgtgtccttctgcccatgtcagcaagcatggcttttgcccatttttcaattgcgcaatgccgacgacggaggacgaagtgttgctcattacgcacaccgagggaaaacaatccaacaattttgctggcctgaaagatgccaaaaatgtacgcgaagtgatcgatgtgatcctccaacatttgcccgggtctccggcaatgtgcggaagcgaaggacggcgaattggagaaaacggcggacatttttgaacgtttgaccgaaaatgcgccgccgggcgcaaatggtgccgaaatggccgcggcacgaaaaagcgcgtgggacgaattggtggcatttctatggaaggcatctccctacattctcttcgtcactttcgctttgatttgctggtgtttcgtgccttcgctcgtcgctggcagtacaatgctcgagggcgtaataatgtaaaatattttagaatagattggaaatgtcgtttttcttcttgtcggacctctgattaacctgtgccggggtatagcattcgctacaatgttcgagatctccttggttgactgcgatgagtttggaggctaagatgtgcgcgtatcagacatggccttacaaataaaatcgctcggaggtgctacgtatcgactgctgcgatcccagcg

SEQ ID NO: 96787 - DNA, 420 bp, Heterodera glycines
  SCN-specific regions: Sequence locations=1-369
cctaataatcatttttatcccttttcttattccaatatggcagtgacttttgcggatttctttaaagtcatttgtgccatcattttaccgccccttggcgtttttgtggagacgggctgctccatccaccttttgattaacatcattttgaccattctcggctacatccccggcattatccatgccctctacatcattttccagtactgatgaagatatcgcaattgtgaaaattcgatcagttaaaagaattatttttaatttgtcaatttgcttttcaacaatatcggatgttttttgtgatatgtaacagttctcgccaattctctcctccattttcacttctcatttcaggataaaattatggataaaaaaaaaaaaaaaaaaaaaaaactcgagactagttctctctcaagggcg

SEQ ID NO: 96788 - DNA, 503 bp, Heterodera glycines
  SCN-specific regions: Sequence locations=1-355,379-503
gctttatataaaactttgtgtaaattgggtgataatctcgtctatccgattctgccagcctttgccaaacccgcgtggaatcacccagcagggccaaaaacggtgttcttttggtcccccacaataaaatgggtcctcgtcggcgctggactctctgatctagctcggcctgcaaataagctgagcatttaccagaacaccgccctaatggccaccggaatgatttggacccgttactgttttgtgatagtgcctaagaattactacttggccagcgtcaacttctttgtcggatgtaccggactcgctcagatattgcggattgcgcactatcagtacattcattctgaggaaacaagcaaatgaatgatgagaatggatggacctcttaaatagattgtcttctcatgcgtgttttttgcgggttaacggctcaaaactcggtttttctgatcaaatagtattggttatttagtatgttgtgatcgtaaaatttgtattgg

SEQ ID NO: 96789 - DNA, 185 bp, Heterodera glycines
  SCN-specific regions: Sequence locations=1-111,134-185
acggggtaaaatgcgcaatttgcgtcaaaatatcattgaacacttcactagtcaacccgttcaaagagtgtagtcaaatgctaccgttatgttgcgtgtttttagtcgatgaactttgaggatgggtcttcttattcttatttgtgtgttttctacccttccttttatttaaaggttcaaagatt

SEQ ID NO: 96790 - DNA, 245 bp, Heterodera glycines
  SCN-specific regions: Sequence locations=1-162,205-245
tgccaaaagaaggaaatcgctttaaaaagcacttcgacccattgactaccaaagaagcaaagtcttccgtcacttttcgatccaccgaaattactggtgattattttgttctaccataacgatcaaaatgggctttggataatttttgaaaattttttaccgaaaaaattaaattttctattttattttgctttaaaaatatatgtcataatgtgcgaccaaattttaacaatggatttcttaca

SEQ ID NO: 96791 - DNA, 530 bp, Heterodera glycines
  SCN-specific regions: Sequence locations=1-13,35-173,195-530
atgcattctctcgcctttatttccttcgctttttgcctttcactaacggacgcttttcgtactcaatcgtccggcgtccgggggacacttctctgtggaggaaaagcactcgcggacacaaaagtgaccaattcctttgatttgtttattgttcggtaagaaagaaacaaaattggaatgaaggtgaaactttacgaccacgacaaagggccggacgcggacgatttgatggggacgacgacaacggacgagcagggacgattccaagtcagcggaaagaccaccgaactgaccaccatcgacgtccaactccgcatttaccacgactgcgatgatggcatgatgccttgccaacgcaaggtgaccttcaacatccccgattcgtacgtcacgtcgggtgcggtgccggcgaaattctttgacattggcacagtgaacatgcaaatcatattcgaccacgaagagcgatcatgcattcattaattgacagatctttatttttttattgaacaatgaatgatttgtgagtt

SEQ ID NO: 96792 - DNA, 528 bp, Heterodera glycines
  misc_feature (524)..(524): n is a, c, g, or t
  SCN-specific regions: Sequence locations=1-125,151-166,190-528
gcggacttacaaagaggagaactctttcgacaagcgccgcgcggaaggcgaaaagattcgccgaaagtacccggaccgaattcctgtgatcgtggagaagtcgccgaactcgcgtctgcgcgatttggacaagaagaagtatttggtgccagcggaactgaccatcggccagttttacttcctcatccgcaaaaggatccatcttcgccccgaagaatcgctctttttctttatcaacagcgttatcccccagacaatgacaaccatgggacagctctaccaggaccgccacgaggaggacttgttcatgtacatcgcttacagcgaggagaacgtttacggctgatcgtgagttgggtggtggagtgctactaatgcccatcgacatgcattgtgcatgtggccaacggattcacgttgaaatgctatgggaatagcgtctgcctttctcatccctttcattcatatttgtcaagtaatttgtgtgatcacgcatcgatgatgattatataaaatcgcttttntctg

SEQ ID NO: 96793 - DNA, 401 bp, Heterodera glycines
  SCN-specific regions: Sequence locations=1-401
cgtgcgcctatgaaataattaatggctttctcatctgctgcttctaccttttctatgccgtctttcgcgcgtctgttggcattttgccaagcgacaacagagacttaaggaataataaatttgctttttttcctttcgtctcctaaggcaacactaaatgagggcgacgaatggccgtcttggtaaccttgtccggtctccgctggcgcggaataaatatctgaataatggtgaagcaaaaatgcaacgccggcatagcagtgcgggtgaagaaatgccacgggctgtccagtttgatgagtcgtcggatcagtaccggtgtttgtgcggctgtttccatgttaaaactggcacttacctaatcgcaagtaatctgaaaatggcaccaaatttggttcccg

SEQ ID NO: 96794 - DNA, 531 bp, Heterodera glycines
  SCN-specific regions: Sequence locations=1-285,307-531
accccgcatatttcgggctgtttttcccactccgtcgccatgttctgtcgctgctttccccactcctttcttctgctgctgcctgtactgcttgcacttctctcgctgttcaaatgcatttcggcttcaaatcaccaaccgcaagcagagaatgtactgctcgaagaactcatccaagaaattcgaaaactcaacgaccgtatggaaccggcccttgggagagaagggaatgctgaggaggagcaaatgttagaaataaaacggtcccaaggaatggtgccttccgaactttggaacagagccggggacaaaagagcgcagctgcctttttccggtggcatttatggtaaacggtcgccactgccattctctggcggcatttacggaaaacggagcgcacgcaatctgtacagttcgtcactgatttttccgacgctcaatcggcaggcgcgtgcgatgcctttcaacgacggaatgtacggcaaatgaaacagaaagaaaaaaagaaagacgcacaacggagaaaaagat

SEQ ID NO: 96795 - DNA, 582 bp, Heterodera glycines
  SCN-specific regions: Sequence locations=1-582
taacaaccgaaattgtattattttgctggggttcgaggccgaggcgaatacattcgccaaattttaaaattcgccaaagtgccatttgaggaagtgagcataaacattgaagactggcccaaatataaagaagaaatgccccttggccaacttcccgttttggaggttaacggcgttaagttctcccaatccctggccatttcccgttaccttggagaaacttacggactatcgttcaatgatccgctggaacgtgctcttctcaatatgatcgtcgatcaaatttcagacactcagaacagcggtgccttcaaagaatggccaatggtccgtttggacttagtgccgtgcggagataaggcggcttttttccgagaaaagatacgcccgcagttggacggatgcgcgagtttagtcgagaaatatttggtggagaaaggcgacggcattttgcttggcaaagacaaaatcacttgggccgatatttatgccgctgaatttttcgcaaaatgcattcattttggagaaaaagactgcctcgaggcgtaccctcaaattaaatcactgatcgctcgcgttcaa

SEQ ID NO: 96796 - DNA, 541 bp, Heterodera glycines
  SCN-specific regions: Sequence locations=1-275,297-541
taaaaccatgcgccgcctccccctcactctcgcaggcacccctccctcccgcacgattcgactcgcattcgttacgcacgctctccagggatacccattcaacccttgcttgatgggaacgactgttcgcgcgagtgtgcatattcgacttccaaagatcagcgcaaatcacgacgacttcaagtccatctgtgaggagttgaaattgcagatccgcgggattcacggcgaacattccgagagcgctggcggcgtttatgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttcaaaccccccccggaggggaagaaaaaaa

SEQ ID NO: 96797 - DNA, 377 bp, Heterodera glycines
  SCN-specific regions: Sequence locations=1-13,35-244,267-271,293-377
ccaatattctgtctttattttgctgtgcctttttctgattgccgaatttggccacacttccgcagagtgccaaaaggacaaaaccgaagcgacaaaagaagcattattgcttcaatacttttttgctcgtggtttcccttttctgtccgactccgacgatttaccaacagcagcagcagatgaagtcaaacaaaaattgacaaataaatgtgattgatgatggtgatcggcagtgatcggttgagaaaatttaaaaagaaaattttaccaaaaatgtaatttcattaatgatttttaattggtgattggagtttgaaaatgagaatcgcagatcatctcttcatttttggttaatcaaatgaaataaaaattgaaaa

SEQ ID NO: 96798 - DNA, 304 bp, Heterodera glycines
  SCN-specific regions: Sequence locations=1-304
agcgatcattcgaacataatcaaaagtaacgaaaccacccgagcatattcattcctcagcagcaacaacagaaccgaattgttatttcaatcacatcgcattgttcgtcaatgagcaccagcaacaaattgcgtcgcaaaaacagcagcagcgcaacgccctcctccgcctcactgctgcacatcaatgatgcacggattgcgggactgtacgacttggagcacaccattggcaagggacactttgcggtggtcaaattggcacggcacgtgttcaccggggaaaaggccatgatccctcaaaa

SEQ ID NO: 96799 - DNA, 403 bp, Heterodera glycines
  SCN-specific regions: Sequence locations=1-403
aaacggatgattcttgccgaggcggaacagagagcatttgcgcccattccggagtgctttttcgagctgtccaacctgttgatgctcaacgtgcgggaggatgtcgagcagtatgagcagcacaatactgtgccgaaatggttgagacacttctcgggaaaatgtcggacaaggacgcgttccatttgcgcaaggagatgaatgatgttttgacgaaatacgcggccgccgccatcgacgacaaatgagaagagagggattgattgattgtctgccagtgatttattacgcttgcgcatattcatttgatcacaaattgtcactgcttttccgtttctgaccatttgttgagttagttattacccagaatattgaaaattacatttattcacggatcaaaaaa

SEQ ID NO: 96800 - DNA, 185 bp, Heterodera glycines
  SCN-specific regions: Sequence locations=1-25,107-185
ggtagtatcgttacagtacacgcaaattaccattgttattttcgtattattattattctcatcattctcagcatcatcatcgtcatcaattattattattcttttttcgcttcaattcctttgattttgccctcccttttcgtcacccatcaattaattaattgatccctaattagtattcaaag

SEQ ID NO: 96801 - DNA, 412 bp, Heterodera glycines
  SCN-specific regions: Sequence locations=1-131,153-329,351-412
cttcgcttctacaatttttctgttcatcgttttgcaattaacggatgctgaaatgtcaaacgaatacaaagaagcgtgcaatgacacatgtgctgctttaccaaagcagacttgcggtcgtggaaggccacaaagtaacagtaactcacagataacttgctactgtaaatggaagaccagcggatgctgtttcggagaagggtgtgtaccacgtgaacaaaccgcagatgaaattacgctttacggtcgcaccggaatatgaagaaaacaacagcagaagcaacaggcaaagaaacctgaacacttccactgaccaagatgatattttgacattttcggaatgcaaaatttgttgcgatgttatgccatttatgttacatttgttagcggataaaaattgttgtcttaaaaa

SEQ ID NO: 96802 - DNA, 447 bp, Heterodera glycines
  SCN-specific regions: Sequence locations=1-447
tgtcgtcaattgtttaatttttgatgactaattccatgccgaaaatcctcttcacaatcatcgctttcgtcaacatctcacaaattttattcgctactgctatgtataatggcgaagatatttgcggtaaaaccaaggaagattgtcaagcggcactgattgcttttatgaacggacgcggaaataaccagaactatcacccgagcgaaaacggtccaagaaaggttgataatgagtggtgtatttgggtgcaaagctatgtaacaagtggggccccaaagatcaaaatggtgaagccatgaaaattgaaggcggacgaaagaatgatgaatgctaattgaccccatttgcttgttgttgttgttgtttcttttccgtcgggtcaattgtttgtccgcacttttttgggattagatatgtagattgaactttttgctatccaaaaaa

SEQ ID NO: 96803 - DNA, 373 bp, Heterodera glycines
  SCN-specific regions: Sequence locations=1-154,177-296,318-373
attgtcgtcaattgtttaatttttgatgactaattccatgccgaaaatcctcttcacaatcatcgctttcgtcaacatctcacaaattttattcgctactgctatgtataagggcaaagaaatttgcggtaaaaccgtggaagagtgtcaagcggcactgattgcttttatgaaggatagcggaagtaatcagaactatcacgcgagcgaaaacggtccaatacagcttgctaatgataagtggtgtatttgggtgcaaagctatgtaacaagtggggccccaagatcaaaatggtgaagccatgaaagttgaaggcggacgaaagaatgatgaatgctaattgaccccatttgcttgttgttgttgttgttt

SEQ ID NO: 96804 - DNA, 487 bp, Heterodera glycines
  SCN-specific regions: Sequence locations=1-350,372-487
gtaatacgcagaaaaactgctccatttgataagaattcaaagaatttgtgattttatccgtttttgtctgccgttttcatccgattattccgtttttgtcttgaaatttaactgtttttaatcgttttctgccgatggtttgcgttccatgcataattctgcccgtcgtgttggccatttaccttcgatttgttcagccatacattttgcgttttatgcctcagcgatggcgtatttggtttgactcggtgctttacccgacatgtccagtgaacaaaatggaaacgacaaacaaatcgaaaacggagaagaacaaaacagacggagaaggagagacggggaaggaatgcgaaaaggacaaatgaaacagaaaacatcaacaaagttgtatttaagtgattatgaaaatcaaaattcactaaactgatttcctttgtgcatcaaaattcgttgtcttctgagaataataaagtcgcgattatcaaaa

SEQ ID NO: 96805 - DNA, 499 bp, Heterodera glycines
  SCN-specific regions: Sequence locations=1-83,108-156,178-499
cggcactccaaatttcaaacaccgtcttcatgctgattgtgttggccacttcgcttctgctgttgatgccgtccagcagcaatgccaaagtgatgccccaacttggcttcgcgaatgcagaacaactgatgaatgacaacagcagtccaatgggcgccggagttgagggtgaagtcatggacaaagtggaggcccgacttttgggtgcactggaacttcttcaaagctataaagaagtcccaattgtgcccaaattcacggaaaagcggaagaacaaattcgagttcatccgattcgggaagagaagacgatgatcaacaagagagagagagagtggaaggacagacagtcagacaaaaccatttgagtgatcagagagcggtgatcaatgatacatttttaacaaatacacgtacaattttggtaatattatcgctggcaatgggacattttttgcttttttgatgggcattgaataaagagaaacactgtgaaaaaa

SEQ ID NO: 96806 - DNA, 222 bp, Heterodera glycines
  SCN-specific regions: Sequence locations=1-222
ggcggggagacgttcgatatttattgtgtgtgttagaagaggaagggaagaagcaggaagagtggaagatgagcgcgaatacggaatgctatcgttgccacgaattcgggcacatttcgcgtgactgtcccaatgccggccgccgcatcagcgtcagttgctgatgactgagatgggggtgatggtgaagaaactgcgtggaacgatgatgccaaccatgaa

SEQ ID NO: 96807 - DNA, 343 bp, Heterodera glycines
  SCN-specific regions: Sequence locations=1-85,108-343
ttttcttagtttgattaatggctgatctgcaaaagttgagtggtgccgatcggctgctgctgtgccgtcgatatttccatgtgggcttcgtctgtctccctcttctctgggcggtgaatgccatttggttttttcgttacgcctttccttccggtgcaaatgccaccgccgagacggcacaaattcggcgctacgtttgttggtcggcgaccggcgctttgtgctgggggctccttttgacaggttggcttttcttctacaacatccagcgcagctacggactgttcgattggcccgagaaaatcaccgccgtttttcccctgggctatgtctgattcggatg

SEQ ID NO: 96808 - DNA, 457 bp, Heterodera glycines
  SCN-specific regions: Sequence locations=1-280,331-457
aatgaattttggaacaggcccaacaaaaaaattttgccaaatttgtagaacatggatcgatattttcgaagagaaggtccaagtggaaaaatttacgatgcacaaaagctgcttcatctgtgcaatctgtgactgtccgctgcagccgggcagctgttcccgcgacgacggattgatgtacatgcagttcatggccggccatcgcattccgatgtggttctgcagcgcgcacatgcacatggggtcgggcgagaaatacgaattgctgaaaaagaagtaccaacagtaccaacagtaccagcaacaacagcaacaacaacagcagcagcactgatcaacagaaagcagatcagcagcaaacaagtggaagcattgatcggaaagtcaaccaataaattagtggatttattgaccgattaaattaatttactgtgacataaaaaaggcaaattataaa

SEQ ID NO: 96809 - DNA, 282 bp, Heterodera glycines
  SCN-specific regions: Sequence locations=1-115,137-150,189-282
tttctttgtgtctctgagcaacaaaatggcaaaaaaaacgaaatatttgattgtaaggctcgcgagtgttatttcgggcactaaacaaatttgggttagggagagagcagcggccgaagcggcggccattctttacgacccggcgattggcaaaaatgtgctgttcaaagaagttgagcaggtgaaaggaaaggattcttttcccgacagagtgaagaaaatgtacaatatcagttgatcgaatttcaaatgcaaatggatttgataaatttgtccgttttt

SEQ ID NO: 96810 - DNA, 274 bp, Heterodera glycines
  SCN-specific regions: Sequence locations=1-111,133-142,181-274
tttgtgtctctgagcaacaaaatggcaaaaaaaacgaaatatttgattgtaaggctcgcgagtgttatttcgggcactaaacaaatttgggttagggagagagcagcagccgaagcggcggccattctttacgacccgttggcaaaaatgtgctgttcaaagaagttgagcaggtgaaaggaaaggattcttttcccgacagagtgaagaaaatgtacaatatcagttgatcgaatttcaaatgcaaatggatttgataaatttgtccgttttt

SEQ ID NO: 96811 - DNA, 438 bp, Heterodera glycines
  SCN-specific regions: Sequence locations=1-212,242-438
tctcttgaatattgtctttgttcatgcacggcattttgtgccatgagtgaaatcgctgctgaattcaatgcctccgcacaatccaaacgcgtgttatgccatcaacaatccgccaatcccaagagcaacaacttcgctgagtaacagcaccaatccgtcgaacatcaacaaccaaaacaatatcagcaacggaaacggaatggctggaggcgtacaacagcagcaacaacagcagcaaaaggaggcaaagctcaaagcgttgggcaagcaggtgagacagccgaagaagaagcagaactgatgagatgacctatcgatggaatgacattgatcagagggcgagtgatcggaaggccaaacggagacattggcatggaaaagtgatcagttcgagcagaaaatgtgcaatttcgaaattacacaataaaaaaactgatg

SEQ ID NO: 96812 - DNA, 449 bp, Heterodera glycines
  SCN-specific regions: Sequence locations=1-449
gcaatgcattttgggacggcgcaggattatgaaatgaaagattgtgccatttgcaacgagggagtgccattgggggagaaattggtggtggagaaagagacgatccacttgggctgcttcaaatgcgcttactgcggcacgcgtctgcaagtgggcaattgtgccatggaattgtccttttacaaccgatacggcccgtgctggtactgctcgctgatctgtgcccatctgccgaccggggaaaaggaggcaaagctcaaagcgttgggcaagcaggtgagacagccgaagaagaagcagaactgatgagatgacctatcgatggaatgacattgatcagagggcgagtgatcggaaggccaaacggagacattggcatggaaaagtgatcagttcgagcagaaaatgtgcaatttcgaaattacacaataaaaaactgatgaaaaaag

SEQ ID NO: 96813 - DNA, 451 bp, Heterodera glycines
  SCN-specific regions: Sequence locations=1-451
tgaatcaaattaaagtagatcaggaagaaagcaccaaactttgggattggccattgcaatcccatgacgaacttgtgtcaatctacgatggtcgtgacagatgggaagttggcttggacaccggatttttcacgcccaacgaaatcgaagtgaatcggatgggccaaaatttgttcatccactgcaaacatgaccagcgcgagggcatgctgggcacaacatcgcgtgaggttcagcgcaactataaattgccggatgatgtggacccgaaaagcatccgctccaacatcacacgtgccggcattttgcgcataacggcacaaaagaagcgttgaattggcgcaaatttggacaaaaatgccaaaattgatcaaaaaatggagtaataacatttggaagaacataataaatcaaatatattaatcattttatgacataaacacatgtaaaa

SEQ ID NO: 96814 - DNA, 226 bp, Heterodera glycines
  SCN-specific regions: Sequence locations=1-226
taatcgccgcgaacgtggacaacgttatcaaatttgcgacctgggacatgttttacgaagcgcgtcgcattttgatggcggacctggaaatcgtctctacaaccgtggttacgttttggtcagatgactcgcttaaattgaagacgcagccgtatcagttcttcgagttttaaaggatgatccattgttcattcatcattttttgttgcaaataaagacttattac

SEQ ID NO: 96815 - DNA, 622 bp, Heterodera glycines
  SCN-specific regions: Sequence locations=1-6,34-157,179-430,454-622
ttatcctttttaaatataattaaaaaataaaatgcggacaaattgtttggctctgagttcgctcgccattttttattctgccgttttttctgcaattggtgcgccagtcgaaccgagcacaaaagaaagggcaaagcatggtgttgctgctcactatttaaaggcggaagatgaaaaattggaaaagattaaacaaatgttggaagaacaatcgccaaaaatgtcgcccaagggaaaacaaatcgccacaaaatttgttgaaattttgctcaacaaaaaattgacatacgaagaatttcggaaggaaattttaaaacttgacaacgaaacggacgcgaaaacgaacgacgaatttgcaaaatcggaatttgcaaagcaaatgagtttaattgagaaacacagttaaaaatgatgaaaatgaattcaaaatcattaaatgtttatttaaaatttcattgtgattattagaagtccaggaaaattaaaaatattcgttaattttcataattttaatttggcatttacactgttgattgacctcagctcgactttacattatacaatattttaatccatgttcaatgtgcttacccattcatcatagattaccgtaatttgaaaa

SEQ ID NO: 96816 - DNA, 433 bp, Heterodera glycines
  SCN-specific regions: Sequence locations=1-367,391-433
gctctgagttcgctcgccattttttattctgccgtttttttctgcaattggtgcgccagtcgaaccgagcacaaaagaaagggaaaagcatggtgttgctgctcactatttgaaggcggaagatgaaaaattggaaaagattaaacaaatgttggaagaacaatcgccaaaaatgtcgcccaagggaaaacaaatcgccacaaaatttgttgaaattttgctcaacaaaaaattgacatacgaagaatttcggaaggaaattttaaaacttgacaacgaaacggacgcgaaaacgaacgacgaatttgcaaagcaaatgagtttaattgagaaacacagttaaaaatgatgaaaatgaattcaaaatcattaaatgtttatttaaaatttcattgtgattattagaagtccgggaaaattaaaaatattcgtt

SEQ ID NO: 96817 - DNA, 528 bp, Heterodera glycines
  misc_feature (482)..(482): n is a, c, g, or t
  SCN-specific regions: Sequence locations=1-112,134-397,419-495,518-528
tttttcatccatcgcttccccgattaaaatggtcgtcgttctgtcggcactttcctccggcacttttccccctcatttttcactgcgttggcattccctctcatttttgctggtgttcattctgcttacagttcgcttctccgccgacttcaccaattgtcattccgtgccgtctttaatggcatttgaccccacaaaattgcgacgacttctgccaattcgggaatttttgagcgacgatcaattggcattcgaacgcgcaattcggcaacccgcgggcggcgtcaaatggatgcgctttgggaaaaggacgccccagggcaaatggatgcgattcggaaagcggaaaatggcaatcgaagggggcaagtgggtacggtttgggaagagagcggaagagatgcagggagaggagtgaacggacaaaatgtaagaggaaaaaggaagagatgagagagtggaggggacgagacactgtgaanaaggagagaacggcagacgaacagacagacagaaaatcactgctga

SEQ ID NO: 96818 - DNA, 502 bp, Heterodera glycines
  misc_feature (466)..(466): n is a, c, g, or t
  SCN-specific regions: Sequence locations=1-1,23-82,104-377,400-502
tatgaagccaacttttctcatgctcatttcaacttgtattattgcgttggtttacgcatctgcggagtatgatgaatgtgaagtttgcactgatctgtttacggaggtgatgaaaaaggttgatgagtctggtgaaaagggagagccggcagtgaagaaaatgattattgagcattgcaagtctgtcaaaggtgtggatgataagaaagaaaaattgtgcttctttattggcgctcatcctgactcgtccacttcagtcctgggcgatattgcgaaaccattgagcttccataaaccgccgaataaagtatgctctcaactcaaggaaagggattctcagatctgcgcactgaaatatgataagccaattgattgggacagtttggtgctggagaaaatgcgtctcacacagctcaaggaacttttgcttaagattggcgattcctgcaaaggttgtacggacaangttgactacattacgcggatcaatgagctcagagcg

SEQ ID NO: 96819 - DNA, 468 bp, Heterodera glycines
  SCN-specific regions: Sequence locations=1-439,461-468
gatttccctgattgtgcttggcattctgctgaccaatttggaggcatttcgccaacaaactgttggcatcagaggccgtctgatgtgtggcaatcagccgttgaaggacgcgaacgtgaaattgtggaacaaaaacacgctcggttccgatgaccaactggcggctaacaggacagacaatcatggcaattatgagttgcaaggaggcgttggacagctcaccaagatgaatgtgcatttcaaggtgtaccatgactgtgacgacggaatcaagccatgccagcgcaaagtgaattttggcgttccggatcattacgttgaacgctcagggtccaccaagaaatggtttgaggctggcacaatgaacatggaattcaaatacccagatgaggagcgcagttgcatcaattgaattgaagattaactgaggcaatttgatgttgagaaaaacaaattttttgatagtaa

SEQ ID NO: 96820 - DNA, 524 bp, Heterodera glycines
  SCN-specific regions: Sequence locations=1-524
gaatttggcatcggtgaccgatttttgcttgtcctaattagctcagcaattgtttacaaaatcttcccattctccgtttttgttgcccttttctcttttatcgtcgcttcgtggatttactttcaataccgccaaaaacaacattggcataatgtcggagtgccgggaccaaatacaaacattttatttggcaacacattgaaacaatttcgcactggcgtaattgaggttgacgaagaaatgttcaaaaaatatgggaattcatatggctcgtttttatttgagcgacgcgaattttgcaccaaagacccgaaaatgttacgacaaattttcatcaaagaattctcgcactttcagaaccgttatgtaattttatggatgaaaatctaaaaatcgatttaagccaaataaaattttggatctctcaaaaatttcatcaaattaaaaaaatgacacagaatgccattcccgaacgcgaacacgcgccaaaatcactgatgcgcaatattctcactgtgctgcgc

SEQ ID NO: 96821 - DNA, 295 bp, Heterodera glycines
  SCN-specific regions: Sequence locations=1-295
tgtgcaaaaacattgaacttgttaaagaacaacagaaacgacaatctgttgctgatgatgatgttgaaaaacaatgattgagtggccttattaatcaaatgatgcatgatgatgagcgagggattttgacttttatctgatccagtttttttatcgataattcattcattatctcatcaggaaaatgatggcctaatttttcccgatcatccccccgggtatattccattcttttttttgaacacacacttttatttatacactcacttgctatttatattttttcattcttcag

SEQ ID NO: 96822 - DNA, 184 bp, Heterodera glycines
  SCN-specific regions: Sequence locations=1-81,103-118,151-184
cagggcctttgccgatttcatcttcgcccatgtaattctccatttggtggtcgtcaactttatcggataaaccaatgtgaaaggatgggaatataaaagtcattctaaatttaactgaccgtttattcgtttttctgttaatttattttcgtttaataatgttttgcataaatgggtttcgttg

SEQ ID NO: 96823 - DNA, 537 bp, Heterodera glycines
  SCN-specific regions: Sequence locations=1-280,306-320,344-537
tgaaatggtggacaaaggcgaaggtgacagccgctaccaagaattgaaggacggaatttaccatggctaccagccgttgcgtgctcgcaaaacgttcacttacacttacacacccgaatttgtgccgggagcattgaacattgcggttgcccgtgacctcgactccatcccatcggggccaaaggacgacggcgcacattaccaaatggtcacggcacacaaagtgaatagggccccaaagcccgaagatccgtacgcgtggctccaaccgcaggccccaaaacagcagcaacaacagcaggaggaagtgacggaagaagcatagaggaagaagaagaaagtcagcactaaagcactgattagaggtgataagtgataatgacaatgataaatgataatgctggcgatggtgataaagttaattgtcaaattaattgtctattaacgatggaattaacaaatattcacaaagaattgagtaaatgtgaatggtagtccaaatatgtagcaaatttttttctaattctcatcggaaaa

SEQ ID NO: 96824 - DNA, 267 bp, Heterodera glycines
  SCN-specific regions: Sequence locations=1-267
gcgcaaaaaattcttcgcttttacaatttttctgttcatcgttttgcaattaacggatgctaaaatgtcaaaaaacgattatgaaaatacgtgcggaaacacatgtggtcgtttcgcgaaaaaaggtgattgtgctggtaaaagtccgataaatacgtgtgtaacggaaggagattgctactgtaaatgggaaggatgcagagcagactacgaagagtatgttagtaatccctgatctgatgtcatttttgttacatttgttagcgg

SEQ ID NO: 96825 - DNA, 486 bp, Heterodera glycines
  SCN-specific regions: Sequence locations=1-42,65-88,110-432,455-486
gtttgccacactgaagacaacaagttcaagcagacatttgctgccaattctgttcatcttctgctgttgctaccgcgccttttcaaattttggtgatgcggccattgtgccattgtcagccctgggccgctacaaggtgtcacttggcgagctgaacgaattgctgacagaacaacaacgctcggctgacgcagtgccaagcactggcgacaaattgccaaattatgccaaaattccatacggagccaaacacgaagataagaggagagagtttgaacacggctgggagcaatgtgaattctcaccaatttcgtgcatgttgcgacgtcggaagcgataaatgtgcggacaacgcaaaaaaacgataatgataataacccatgatgattggttaattaataatggtgatgaaaggtgctggattcacttattaaatgatgaaaaacaaacacacgatttgtctctgtcgcttgttccagtaaaata

SEQ ID NO: 96826 - DNA, 456 bp, Heterodera glycines
  SCN-specific regions: Sequence locations=1-200,376-456
tctcccgcgctttccttctcttttgtcttatttttgtcgtcgcattaaactcttttaacgaagcgagtttaatcatcgacgaatgcaaaagtgtgtgcccaaagacgaacaataaatgcgcgacggattgtgtgaaatgcgcgagtggcaagtgcaaaaaagaatgcaaaaagccagcggcaccaaagtgcgcggagtgcggaaagaaagcggtgaatgaatgtaaagcgatgggaaagtgagggaaggaaaggaaaagcgaagggaaaaagtgaaagagagagtgaagaaatgggagagggagacagacggacaaagtcaaagagagagagagaagaaatgggagagggagacagacgaatgaaacgaaatgaatgaatggcatttgtacattttttaatgaaacgatataaccgaacattaccatttttatgtcaaattgataaatttgatggg

SEQ ID NO: 96827 - DNA, 449 bp, Heterodera glycines
  SCN-specific regions: Sequence locations=1-165,187-449
caatcaacaaaagtttcgacacgctcattatctcaacttcataatgctaacgacccgaatgatctgtttcctcgtcgtatttatgccgatgatcacccacttttccaacgctggccaatattattatcctgcctactattacaacccgtactacagttactacggtagcagcgcatctgacaataatccgtattacagctatgacgcgtcgagcgggagttggaagcttcgttcttcatcggatgattcgtcgtcagccacttacaatccgtcatactattatatgtattattacccatacacatacggagggaagaaataatttacgaattggacaagacaagattgatgagttatcgagtgcttgagtctttttaatcactattgattatctgttttcatttttggcatttagttgggcatcgataaatgtgcatttttcttaaaaa

SEQ ID NO: 96828 - DNA, 560 bp, Heterodera glycines
  misc_feature (555)..(555): n is a, c, g, or t
  SCN-specific regions: Sequence locations=1-294,369-423,445-560
ttgtcaattaatgaatcgattgccaacagattttgtttccgatttgcctatggaagttctgcctgccttttaccctctgccaactttttggatgcctcaaattgaaatcccaccattgagaaaatacgaagtttctaaaaaggaagtgttctaaaatgacatatctttcagtacacattcgaacatgaaaaggcagccatcttcagatgggaaaaagaaagacgaagcgaacgggtcgaagaagagacagagcaaactcagcagatgagaaaacaacggcaaaggcacatggaagagaaagggacgaaaaaggacggggagagggaaagagcggaggagggacagagacggacagaaaggcgaagggataacacattgaataaccctgagtatcgaaacggagaatgtttcaaaattgaatcgcactccttgccctcttccaatgtttcaaagcccaaccaaccgccacattttgcctcttcgtcacttctaaagccagtcccaatgtcgaagagttcgtccaattctttgcacgttggcatcgcatcaactcanaatgg

SEQ ID NO: 96829 - DNA, 329 bp, Heterodera glycines
  SCN-specific regions: Sequence locations=1-60,82-161,183-196,235-329
attttttctttgtgtctctgagcaacaaaatggcaaaaaaaacgaagtcgtaaagatataaatgttctttaaaagatatttatttaagatatttgattgtaaggctcgcgagtgttatttcgggcactaaacaaatttgggttagggagagagcagcagccgaagcggcggccattctttacgacccggcgattggcaaaaatgtgctgttcaaagaagttgagcaggtgaaaggaaaggattcttttcccgacagagtgaagaaaatgtacaatatcagttgatcgaatttcaaatgcaaatggatttgataaatttgtccgtttttg

SEQ ID NO: 96830 - DNA, 374 bp, Heterodera glycines
  SCN-specific regions: Sequence locations=1-75,97-374
ttttactaaaactataaattaaacgcaaatgacaactaattaaaaaaacacaacaataaatcactaatcacaaagattcataaaggcaatgaaagatgaagaggaatatcaaaacaatcgtgttcggcctttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagagtattgttgaaaatattaattttgttgcgttgttaaaaattagtatatgtt

SEQ ID NO: 96831 - DNA, 424 bp, Heterodera glycines
  SCN-specific regions: Sequence locations=1-207,229-424
tggcatattgccaaaacagctcggctatatgctcattcaggacggcgccattgcaaaatctgaaggtgatttagtgaatgccgaaagattggccaccgttgtgttgcgaatgatcgccgttggtccgttctttgctccatccgtcgcccaggccaatgcgcaaataaatgcaagtggcgatgagggcaacgagttcaatcggctcacagttttgttctccgatcaccagtatgacattgtaatcggaaatagcgccgggggtatttctatcggcggcggaaggcaaacgcaacaccaaaagcagacaattcatgtggtgaaacgaacgctgcccatatgcgaatagacagaccaatgaataaacaagatggaatttgtgcatttttcatttaaatttgaattgctaaaaaaacagagagtggaa

SEQ ID NO: 96832 - DNA, 391 bp, Heterodera glycines
  SCN-specific regions: Sequence locations=1-369
gtttgagttaaattatttcctgctaattactcgttttaaaatatcttgcggaaatggcagtcattgcaccgaaaatggcagcaattgaggaatttgaacacatctcctgcttacactacgaaaaggacactttcaaacccaacgactgttgtgcaaacccaagaagcatcactcaatcagcaaaagatgtggtcacttttgaatgggccaaagagaaagtgcaaatcgaagaacaccgttcgctcgagccttctaagaaggaacacaaatggacaaaaatggaacagaattgaaaagaaaagcaaaagaagaaaatgcatttcctttggattgataaagcgatcattcgatgattaatttgtaataccaataaacaatttatgcaaaaaac

SEQ ID NO: 96833 - DNA, 384 bp, Heterodera glycines
  SCN-specific regions: Sequence locations=1-61,83-384
gccacagtctttgtggaaattcgtgacaagaaggccgcctttgtgctgttcggaagcgcaatgaaacactttgacaaggacattgtgccaacatcggatggggcaaggaggaggaggaaaagcgaacagaagctcagactggagacggacgaacagagaatgaggctggagatggagaggcggacgaagacgcgcaagcaaataggagagaagaaacgcagaagattgagcaccgatgataattgggaataggaaaatgccaatttccgttttatttttattcattttaataatttcaaaaagcaaaaaaaaaatgacaaaaaaattgtttatatattgtgtatgatcagtgtgaataaattagcagcgataaaaaaaaaaaaa

SEQ ID NO: 96834 - DNA, 302 bp, Heterodera glycines
  SCN-specific regions: Sequence locations=1-259,281-302
gatgatccgatcaatctgtgcccacattgtgacactttatcgacaaaaaattgatgtggttgtggcgctagaagcccgaggatttttgtttggcccaattgtggcgcttgagatggacgtgccatttgttcctgttcgcaagcgtggaaaactgcccgggtccgttttctcggcgacttatgtgaaggaatatgggcaggcaattttgttaatgtattaagtgtaaccagaactttttacgcattttaaaggatgtttttgaaatccaaaagaatgcattgtcagagggacaacgtgtgctg

SEQ ID NO: 96835 - DNA, 550 bp, Heterodera glycines
  SCN-specific regions: Sequence locations=1-550
tctttgagcaaagggagcctcggagtggagggattggccggattactaatggacacggcgaaaaaaagtacaaaagtgccgtacgaagagaaaacggacgaatcgacgcaaaaagggcagacgcaaattgggacatcaaacgaaggcgacgaaggggcgaaggaaggcaaaacgaacggacgaagcataagtgggaagaagacgacagccaaggaacattatttgtccaaatcgagatacatgccagggctaagaagcaacggctcgtccagtctctcggcgggcatcaatcgaaaggcaatcgcacaaccgtcgcaacagagcggcgccaaacaaacgacgggcggcggaatcctttcgtcggttcaggttacgtcccttcttttggtgcgcctcgccaacaaccgccgaatgccaattcaaatgcgaactcactgggcaattcgtcgtcctcaatttcaatcggtggcggaccggcggacaatgccaaaacaaacaacgccttctcaaccatcggaggacggacgaattgggcggcaaaatatcagcg

SEQ ID NO: 96836 - DNA, 224 bp, Heterodera glycines
  SCN-specific regions: Sequence locations=1-224
gccgtcgatgctcagcaaataatcgaactcattctttgcctcattttgccgcctttggccatttttatccatgctaattccgactgtaatgtccacgttcttatttccatcgttctttggtatttttaaattattttggtcattaataatttaattttttggtttaattgcaattatatataagctcggagagcaaaacccaaaattttggtgaatgtttttgt

SEQ ID NO: 96837 - DNA, 419 bp, Heterodera glycines
  SCN-specific regions: Sequence locations=1-188,210-283,305-391,413-419
gataactctcctctacaaattacacacaacaaatatggttgttgacatttcaaagatggagcctttttcaccaccagtgagtcacgcgttgttcccccatttgaccactgttttgctttccatcgggctcatcttcaccgcgtggttttttgtgcatggggtgaccagtacgaagaaaacgcgaaaccttgtcaaggagttgttcatcggcacattggcgtccctttttcttggcttcggcaccctttttctgatgctttgggtcggcatttatgtttagagttgaaaggaggaagaacacagggatttttgtcttatttttggggactttttttttctaatttatttgtattttttttattcctctgctaattgttattgagtgagtctgcccttttttgtttgtttcttcccaattt

SEQ ID NO: 96838 - DNA, 302 bp, Heterodera glycines
  SCN-specific regions: Sequence locations=1-70,92-302
ttgcgaaatggttgtgctctcaaaacttggctcgccgcttcgtccgttttccaatgactatctcctttgccgcttccaggcattccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgcttt

SEQ ID NO: 96839 - DNA, 479 bp, Heterodera glycines
  SCN-specific regions: Sequence locations=1-151,174-253,275-479
attttcttatttattgttatgataaacgcacttggttgttcaaatgcccagcttaaatgcagaagggatacggtagggacaataaacggtgttggcttgaagatgaacttttccgaagaagaatgcgagtcgacatatttctggcaatcggcatacaaatattgttatgcttcgcattgtttaagaggaaatgaatggcttacgcattatgggtgtgccaaaagcccggagaaaggtgcatgtagcgacaatgttgagaaggagatgaaagatttgtatggccttgctgtgagctgttcattttgtacaattggacgcaaaatggacgacatgagcaacaagaatttcccgctgtacaatacgaccaatgttgtaatgccgccatcaggaggagcagatggagacgatttttcatttatgtcgacaacccaacaactaacaacatcatataatttatctgaaatcgctacgattgtgcc

SEQ ID NO: 96840 - DNA, 320 bp, Heterodera glycines
  SCN-specific regions: Sequence locations=1-192,232-284,313-320
aaattgctaattttgtcattttttattctttttgccttctttggcttcgctgatgttgtcggaacaccgatacaagaacaagaatttgcaaaattggtggcaaagcgtgccgatgggtttgatgagtgcttgttggcagcaggtgctacaaattgtgctggtcgtttagcttgttgtgaaaagtatggacaacaaagttgcatttgttgaaaagaaaagaaaatggaacaattttatcagcagattatgatgcttttggctttttagcaaaacatttcgatgcgattttaaaaaagaaaatataaaatttttgtccactt

SEQ ID NO: 96841 - DNA, 451 bp, Heterodera glycines
  SCN-specific regions: Sequence locations=1-156,178-410,432-451
tattctcttctgttcgcggttttctgcgtttttttggcaattttccccagggtgcgcaggcagcaaaaaagaaagtgtatttcgtttatggtactcgggtcacagttaaagctgtatataacggaggcgaaattaatcttggaaaaaccacgggagaaggtgttgaattgaaacaaatttggagattgatacagaataatggaccggaatgaatggcaatgatctgattactttccatgttcacacatcgtatggcgtgactaaatgtgacaaagctacagtacgcgaattacgtcaaactgatcaaccgaaagactttgctgatcaaacaatccgaacagtttaatgatgaagatgagtaggaagcaaaccagcagaagaacggctttatgtatttgacttcatcagatgtcattttcattgctttgttgatgccatttttggcttgttg

SEQ ID NO: 96842 - DNA, 562 bp, Heterodera glycines
  SCN-specific regions: Sequence locations=1-135,175-214,236-244,266-562
attttaacctattagactgaaaatggctactgcaaaaaagaagacgcgaaagcttcgaggacacgtttctcatggtcacggtcgggtgggcaagcaccgcaaacatccgggcggtcgtggtaacgccggtggacagcaccaccaccggatcaacttcgacaaataccaccctggctattttggcaaggtcggtatgcgaaactttcatgtgcgaaagaaccattactactctccaagcatcaatttggacaaactgtggactctgtgcacagaacggacgcgcaaacaatatgcagaagtgaaggacaaagcgccggtgatcgacgtggtccgggccggctatcacaaagtgttgggcaaagggttgttgccgaaacagccgctgattgtaaaggccaaatgcttctcgcactctgccgaggaaaagattcggaaagtgggcggcgcatgtgttctggtcacataaatggaagaaagggcttgagaagaatgatgatgatggcgccccttgacgaggaacacctttttatgttgttgtctttgttaaagttattcctttcga

SEQ ID NO: 96843 - DNA, 513 bp, Heterodera glycines
  SCN-specific regions: Sequence locations=1-1,23-179,201-513
ctgaaaatttattttttgacaatggcacaacaccaggaatcgttgatccgtcagaattttgcagctgaaactgaagccggcatcaacaaacagatcaatattgagctgtacgccagctacgtctacttgagcatgtccttttacttcgaccgtgaggacgttgctctccacaacattgcgaaatggttcaaaaaacagtccgacgaagagcgtggacacggcaccactttcatgaaataccaaaactctcgtggtggtcgtattgtgcttcagaacgttcagaagccggagaagggtgagtggggcagtgccttggaagcattccaagccgctttggctctcgagaagttcaacaatcagtcgctgttggagctgcacaacctcgcttcccaacaaggcgactctcagatgtgtgactgtcttgaggacaaatacctccgtgagcaggtcgaattaatggaggaaattgggaaaatcatcaccaatctcgagcgtggtgggaaggggttgggg

SEQ ID NO: 96844 - DNA, 362 bp, Heterodera glycines
  SCN-specific regions: Sequence locations=1-212,234-245,267-362
tctttttatcgcaacaatcagttgccattccgtcatcaaccggacaattccgacagcgcaaatcgaaaggattacgaaaacaattcgaacaaagagagaaatgacaacggaaacaaaaacagttacaaggaaaagcagcgaaagaatgaaagtgacggagaggaaaacgaagaagaacggacacgacgacgaattgaacagagacatttgggaaaagggaaggaagagggagaaaagagttggacaagggagggcgaaaagggcacggaaaggcgggaggaaatggccaaaagtgaaagcattttgaacgcattgatcgaacaagtgcggcacagaagcgaagtttgtcacggattctaagg

SEQ ID NO: 96845 - DNA, 399 bp, Heterodera glycines
  SCN-specific regions: Sequence locations=1-130,153-342,387-399
cttgtaatcagaataatctacagaaaacttttgtctcacattgtgccaaacccagtgtgtatggttctgcgacaaatattcctacggttttggtgataccgtaggaattggcgtcaataatgctaattgatttttatgtttaaataatcaaaatcccgcaactttttcacagatacttctgattttatggttgatccatcttttgctgatggctcattttatccattcgttactttgtttgtctctggtgacaaaattgaggcgaattttgggcccaatttcaaattcgatttggcaactctctgaaggaagaattaattattcactaatgttttcgatcaatttgctctttttaatcatttttgtgtctttcttcttcaattaaaatttggttttttg

SEQ ID NO: 96846 - DNA, 183 bp, Heterodera glycines
  SCN-specific regions: Sequence locations=1-183
aattgcattggtgcgaaacgcgagcgccgaaacacgagcgccgaaacgggagcgccgaaacgcgtgggtccccaattcttatgcttaatttttaaacgatgcaaataaccaaattaccaaatttgcaacaagagtatatgtaaattactgtaattcatgaataataaagatttgttaatggtc

SEQ ID NO: 96847 - DNA, 494 bp, Heterodera glycines
  SCN-specific regions: Sequence locations=1-427,449-494
atgaacacgacgtcccttattcgtcttctgttcgcggttttctgcgtttttttggccaatttcccccaaagtgcgcaggcagaaacaaagaaagtgtatttcgtttatggtactcaggtcacagttacagctgtacataacggacgcggaattaatcttggagcaaccacgggagaaggtgttgaatcgaaacaatatttggagattgatacaaatgtgtggaacggaatgaatgacaatgatcagattgttttccatgttcgcacaccgcatagcgtgacttcatacgacaaaactacagttggtaaattacgtaataccagtgaattagactttgctgatcaaacaatccgagcagtttaatgatgaagatgagtaggaagcaaaccagcagaagaacggctttatgtatttgacttcatcagatgtcattttcattgctttgttgatgccatttttggcttgttgaaaaaaacatttttttaaattaaaaa

SEQ ID NO: 96848 - DNA, 259 bp, Heterodera glycines
  SCN-specific regions: Sequence locations=1-259
agctgtatgaacagcgcaaattgattagcatgtttgtcgtgctgatcctttttgcttttttctgtggactttttttgggttctgtgttgaacagcgaaggatcgaaggaaaagtgcgagctcttatgcaaattacgcggacatgataaattcaagtgtgagatgttttgcaaagtgcgtgatgagcatgaattgtaaggaattaatcctgaaaaatatgttaatctgttgttggtaattcataaaggtctttgttgttt

SEQ ID NO: 96849 - DNA, 324 bp, Heterodera glycines
  SCN-specific regions: Sequence locations=1-194,216-324
gccttttcgtcagtcgaaaactgatgatggaatgtttgcggggtgccggactgattttagaaaggtcggcacaattcgaaatgaaaggggaaaaccccggaacaaaacagagaccaattggacaacgaattgttttatgaattggacggaatgtacattttggtagcgaggaaaatggccgagtgaaaggaatggaaaaggatttaatggattttaaaatttgttaatacatttattatttttgattgtttcacaacaattgttgaaacttttcaacagttaatttggcagtttttgaaaaatacaattattttttggcaaaaa

SEQ ID NO: 96850 - DNA, 480 bp, Heterodera glycines
  SCN-specific regions: Sequence locations=1-353,375-405,435-480
agtaatcccttctcttctgaactgtcccgcacgtaacttgtgcgaccgcttaaatcacccggatgagatacaaaaagtagaaaaatacctcaaaggaaaaactctacagacaacatacaaaaatcaactagatgaatacaaagattttgagtacggtggaattacaagagaaagtgcccgtaagcaaatggcttacaatggtttcaagaatgtgaccgtcgaccagcatttttatgtacggtaccgcatttgtcttcgctacgctaataatccttgcgtgattgagaagcatagaaatggacacgaacgattctacccacttgagcttgttaaattgaaatacgtagacaaaaacaatatttatttgggacaaaatttcccaaagtctatacctttacttgacgaaaataattcaaaatataatgacaattattatgattcttgtcgtttatggtgaatatttgaaattgcagataattt

SEQ ID NO: 96851 - DNA, 312 bp, Heterodera glycines
  SCN-specific regions: Sequence locations=1-184,206-312
ctacattgacaactacagatgttgaagagactatcaagagaattcaatcgcaaaaaggtgtcaccggagtgattataatggacaatataggccgtgccattcgttccacgtttgatgatgacaccaccgcgcaccatgccgcacttcttcaacagctctgcgaacggtccaaaaatgttgtgcgcgaaatggacacgagcaacgacctgagcttcatgcggttgcgcaccaaaaagaatgagatcatgatcgcaccagacaaagattatttgattgcagtgatttataagaagagccgctgaaagacaagac

SEQ ID NO: 96852 - DNA, 343 bp, Heterodera glycines
  SCN-specific regions: Sequence locations=1-242,278-343
taccgttcccgtccgtctgatcggaatccgagtacgatcaccacccgcctcgtcttctttgaatttccaaaattcgcgagaatccaccaggataatgttcggcacattgtacattcaattcgcagtgtttcgcccagccatcgattaacgctcatttccaactcattttgtctattgtttgcttcagtgtccgccattatccaacagtgacgtggaagaagattagaaatatacaagaaaaatttcaatgcaaaaatacattttatttagtgataatcgcaattggtgacaatttttattaaaatataagcgttttctttaaacaaattttcattggtcaaaa

SEQ ID NO: 96853 - DNA, 434 bp, Heterodera glycines
  SCN-specific regions: Sequence locations=1-434
atcatcaatctcatcttttccttatgggcgttgcttctgctgatgatgactcagtgcctgatccaattgtgattaagttgggcgagtcattgagcctttctcagcttgtgcaaaaaattgaacaattacaaaaccgaactgttcgagagctgcttgttaccctacgtcgtcgcacgtacgaaatgcctgttgggcctcccgacccaaatggagatcgctttttccaaaatgggcatctcctagtggaagatgttgtgtacaattgggtaagaaaaacgcgtaactccatccacggaattgtccagcttcatgtgatcagaaacttctaataccataataatcattgctttttaaaggtgttatatgaggggattgcaatgcttgatgaagtcaattatcatttttagcgattggttaaagaaaattttgcaaaa

SEQ ID NO: 96854 - DNA, 256 bp, Heterodera glycines
  SCN-specific regions: Sequence locations=1-256
aaccaatggctgtcaaggacgacccaccggaaattagggcactgaagctgtggaaggcggacgtcaagaactcacagttgattcgcggcatgattcgcggcaaaacgaaaagtacgcttcatgggcgagtcggatgattgcattctgcgcttggctcagagggatggaataattccgcaaaatttgtgaacgttgattcttcacagggatactgttgattttgttgcctgcagaatgataaacactgtttttcttc

SEQ ID NO: 96855 - DNA, 271 bp, Heterodera glycines
  SCN-specific regions: Sequence locations=1-271
taaattttgcaagcaagcgagaaagtgtggcatgcgcaattacatcgaacatttcgtgactaaaatttgcgacggagaacccatactgtgccatttacgttgtgccgggaaggaacgcgacgccagtgctaagggcggaatattcaaatgggcgactagtccacgtgaacgcaaaggctttcagcacggagcgagtttgtttgcatatgaacaaccttaggacgcgcagtggaattccaatttataaatttgaaaactcccatttttctca

SEQ ID NO: 96856 - DNA, 371 bp, Heterodera glycines
  SCN-specific regions: Sequence locations=1-371
cgctttccttctcttttgtcttatttttgtcgtcgcattaaactcttttaacgaagcgagtttaatcatcgacgaatgcaaaagtgtgtgcccaaagacgaacaataaatgcgcgacggattgtgtgaaatgcgcgagtggcaagtgcaaaaaagaatgcaaaaagccagcggcaccaaagtgcgcggagtgcggaaagaaagcggtgaatgaatgtaaagcgatgggaaagtgagggaaggaaaggaaaagcgaagggaaaaagtgaaagagagagtgaagaatgaatgaatgacatttgtacattttttaatgaaacgatataaccgaacattaccatttttatgtcaaattgataaatttgatgggag

SEQ ID NO: 96857 - DNA, 368 bp, Heterodera glycines
  SCN-specific regions: Sequence locations=1-368
ctaaaaggctcatcattttgcttttaatttacgcgtataaaatgaccttgcgcaatgatactccgatgcctccggacgaagaattgagagtgcctcatgagatttcgctgtcttcgccttggctaagggctgtggcggtttatatgggaatcgcctgcgagaaggaggccaaagagtttatgcttttgcgttccgaacgcgacaacgacccgaatcagttcaagaagtaccggaacaacttcgttttcgacgcgttcaacccgaccggctgatgctccgaactttgtgttgttttttcgtgcgttcctttgtaaattttcggaacgatttttagggaatattctgttttcgataaatgtctatgccac

SEQ ID NO: 96858 - DNA, 414 bp, Heterodera glycines
  SCN-specific regions: Sequence locations=1-90,112-154,177-414
atgccaaaaatggacatgaccttccacttccgtaccagtgagttcattctcctccgagaatggcttcctcagagtattttcgcttatctcttttctttgcttgctgtgctcgccctttcggtggcttatgaattgctgcgtgtgttcagagccatccttttccaatctctgctccatttcattcagttttttttgggtttctctctgatgcttgttgccatgacttacaatgtgcccatctttgtcgccctcctcttgggccattcgatcggttactttctcaccgcccctctctatcgccatggattggctgaagaaaatcggactggcggagattgctgctgttcataaacttcactttttgtttgcataaattcattagcaattaagttagagcgttttaatggtccaaaa

SEQ ID NO: 96859 - DNA, 439 bp, Heterodera glycines
  SCN-specific regions: Sequence locations=1-393,415-439
tgtaggagtgccgggaccaaatacaaacattttatttggcaacacattgaaacaatttcgcactggcgtaattgaggttgacgaagaaatgttcaaaaaatatgggaattcatatggctcgtttgtatttgaacgacgcgaattttgcaccaaagacccgaaaatgttacgacaaatgttcatcaaagaattctcgcactttcagaaccgttataatgccattcccgaacgcgaacacgcgccaaaatcactgatgcgcaatattctcactgtgctgcgcgacgacgattggagacgcgtgcgaaatcgcataacgccggcatttacgacgggataactgaaaaaattaattccgattttatgcgaaggcaccgaaaaactgtgtaaagtgttagaaacggaaaacgcactgaaggggaaggaagtgccgttgaaagag

SEQ ID NO: 96860 - DNA, 460 bp, Heterodera glycines
  SCN-specific regions: Sequence locations=1-193,215-344,371-425,454-460
tacccgaacaattcccctctcctttttcatggaaactgaaaacgctgaggaaacacagcaacaacgaccatttgcaattaagcgatggaatttggtgtctacatggagttgggacgtggagtgtgacacgtgcgccatttgtcgtgtccatttaatggaggcatgcctccgttgtcaggccgattcgaaggcgcaagaatgtgtggtcatttggggcgagtgcaaccactgtttccacctttgttgtatgtctctgtgggtgaagcagatcaaccggtgcccgctgtgccaatccgattgggctgtccaacgagttggaaagtgaagagtgaatgattggcatcacatttttcatttttaaaaatttaatccatccaatgattccaatttcaaagcgcataaatttgattatggtctccctatcaaacgcaatttttatttaataaatggatttgaggat

SEQ ID NO: 96861 - DNA, 525 bp, Heterodera glycines
  SCN-specific regions: Sequence locations=1-73,101-525
gtcctcccaattggttgctgctgatcatcatccgcttattcttccggcactgattaccttcgtcattttgctggtctcttctgtcttcttttttatttaccgcagattccgacagaagccaaatattattttgttcgttgggttgtcgggttcaggaaaaacgacactgttcaccaagttgataaactcgaagaattgttgggactcattcatttcgctgaaggaaaatcagttcgacagttacgcgacggacaatggccaaacgctcactttgctcgattttcccgggtccgattcattcaagaaaactttgtgtcgcaagtggctgaacgagaaacggaattctcttaagggcgtcgttttcgtcttggacagtgcgacgttcagcaaaaaagatgccgccgaattgctgtacgatgtgctgtttgagtcgggcaatgccgtcccggttctgatcgcatgcaacaaacaggacattggacacgccaaatcgcactctctcatcaaaaaggcattggaaaatga

SEQ ID NO: 96862 - DNA, 263 bp, Heterodera glycines
  SCN-specific regions: Sequence locations=1-235,257-263
atgttatgacaacaaacagaggcatggcgattggttggaagcttttgacccgagacaacagaaaaaaattgacgcagattacgctcttttcgttgccggtcatgatccaccgccaaagtgcaagaaatatcgcgaggcagatgaaagaattttgagactgacacaaaattttaacccactaaacattatggaatttttgattggtgtttctcgaaattaccagatggatgcttagaattttatgaataaatttttgggatgtt

SEQ ID NO: 96863 - DNA, 410 bp, Heterodera glycines
  SCN-specific regions: Sequence locations=1-410
gtcgttagaatggcttctgcggttaatccattaaaggcatttggacaaattggtgcgcggctcgggattcgcgagaagaagaaccaatttgtgcagaaggcgtggccatacattgaccctggcacgcattttggcaagaagaatttcggctatttggtcagtgctgtttcgtttttggttttctacaaagtctccagcaatatcaagtcgaagaaggcaatagaagcgaaacagaaattggaaatgaagccgtacgttgttcaggacgcgatgacgcgcagcggaatttaaagaaacaatgcgttctaataggcgggaggcaaagtgtcttcgaattcattagttttaaactcagaatggcgtatttgttgtaactgttcccaagagtaaagtaattctatgaaaaaaaa

SEQ ID NO: 96864 - DNA, 462 bp, Heterodera glycines
  SCN-specific regions: Sequence locations=1-59,83-462
tcttttggttatggctgactcaattcaaaaccttaacaagcctaaagatgcctttgaacaattggaggaggaggagggcactcgccagggattctgtcacatccgaattcagcagaggacgggtcgaaaaacgatcacaacggtgcagggaatagcgccggaatacgacttgaaaaagattgttcgttacctcaaaaaggaatacaattgcaacggcacaatcgtcgagcaccccgagtatggcgaagtgattcaactgacaggggaccaaaggcagcacatcaaggactttctgtgcaaggtcgggatcgtcaaggaggacaactgcaaaatccacggattttaagcaaaacttattccatttgtgtatcaatgagcattaaacaaaatgtgttgaccgtccctaattcgttgatatgtcaccgtaaataaacgaaaaaaataaaatgaatgttttaaaaa

SEQ ID NO: 96865 - DNA, 589 bp, Heterodera glycines
  misc_feature (524)..(524): n is a, c, g, or t
  SCN-specific regions: Sequence locations=1-316,339-489,512-526,553-589
cattcttttaaatgaatcaaattaaagtagatcaggaagaaagcaccaaactttgggattggccattgcaatcccatgacgaacttgtgtcaatctacgatggtcgtgacagatgggaagttggcttggacaccggatttttcacgcccaacgaaatcgaagtgaatgccaagtgcaatgtgttgacgatcctcgaacggcacttggttcacatcgtagctgcagttgtacaattgttgataccggtcggcatggaacagatacaaatccatgttgaaaaaattgtaaaaaaatagttttccctgaatttttaaaagtttttaaatatttacaaaaattcctacgaatcgaatccatccgagtcgtgaaatttactgtttttcccaaaccatggccttatgaccctttgtccttttcaattccccgacaattcatacttaatttttgggcactgaaattcatcaccgacttaggtactcagttattgtgaatctctgtatccattcccaaaccgaagaaatttntcgagatttttgtgaaaaatttttggtcttatgtacgaaaatgtcataaaacataatgtaacaga

SEQ ID NO: 96866 - DNA, 466 bp, Heterodera glycines
  misc_feature (281)..(281): n is a, c, g, or t
  SCN-specific regions: Sequence locations=1-256,278-466
aattcgcaaagggataccaactgcttaggagatgccatcgtccagcgggtcggaaaagggtaatggacgcaatggtgttcgtggcgagagacgtcgatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttncccattctcagatgattcgtgctgatgggaaaagctttttttttgatcctgaccacaattctcgcggggactttctgaaaatcaccgagttgaagtcgttcatgggagtgcgcaattgcggcgtactttcagtcagagcaattccggagtgcgctcaaaggctggtcgagctctacaatgactat

SEQ ID NO: 96867 - DNA, 560 bp, Heterodera glycines
  SCN-specific regions: Sequence locations=1-8,30-356,379-511,534-560
aattctcttttcgtcaaaatgctttctcccttctcctacgatccgttctatcgccgttcgttgtggcctatggccactcatgttggcaacgtcctttcgcccttccgccagttggagcgtgaactcgaccacttcttcgaggggatgcagcccatgcttcgtgaccatgtcgctcagctgaacgtctcggacaagggcgacctcacttacaaagtcgatgtcagcggcttccgccccgaggagatcaacgtggaggtgattggtaatgagatcatcgtcaacggggaacaccgcgagcagaacgacagcgaatcggtccaccgtcagttctcgcgccgtgtgctcatcccggagggcatccaaaaggagagcatcaagtgcgagttggacggcggtcgcctgttcatcagcggaatgaaaacggctgacaaaggcagcagtagaaaaggacggcggaagtgaagacggactgactgtcggtcgaccgaatgatccattgacattgatctttttattttgatacttttgcaaagtgatctataaattatttttccttcaaa

SEQ ID NO: 96868 - DNA, 529 bp, Heterodera glycines
  SCN-specific regions: Sequence locations=1-14,36-386,408-449,472-529
tttttttattcgtaaattactactaccaaagagaaaatgggccaagctctaagtgaaccgatcacaaccaaaaacagcgcctcttgttccaatgatcgttattttgtcggttcgtcttcgatgcaaggatggcgaataagcatggaagatgcccacacgcatttgctcgaactgcccgaagatccgagcacagcttttttcgccgtttttgatggacatggtggcgctcaaattgcgaaatacgccagtgaaaatttgcatacgcaaattgcccaatcgaatacattccgtgagggcagaatatccgatgcattagttgaggcatttttagaattggacgagcaaatgatggccagtgaacagatcagtgagcagggagggaatgacggagcagcaggaggatggaccagtgccgaagttggaggagaagcaacggaacggcaccgggcaaaaagttggtgtggaagatatcaccgaggatgtccatgtccctccttcacccgctggcgccgtggaatatacgcaacct

SEQ ID NO: 96869 - DNA, 531 bp, Heterodera glycines
  SCN-specific regions: Sequence locations=1-531
cgccccccgggtggaagtaagcaactgatagtctgctcaataaatggcagggaaaaacggacattgagcagctgaccaggctttttgtggtgatgggcacgccgacggagcagagttggcccggctgggaactgttgccggacgcgaacaaagtgatgttcgacgtggtggagccggccaatgattggaccaaaattgtcccatcagtcagtagtgaagggctccaactgatccgatcattgatccagctaaacccatgcatacgttcgtccgcactccgctgtctacagcatcccttcttcacacaccatccacagtatgaccaaataccgtaccagccaccgttgttggagcaaatgggaggacgaagaaaagtgccggaaattgtgttcaatgacagtcgaagaatggagaagatgaagccagcaacaaacaagaaacaagcgcaatggcacaaaggttaaataaatatctgttttcgactgaaaatgatcagtgatcacataatggtcgattattaaatcggaattt

SEQ ID NO: 96870 - DNA, 514 bp, Heterodera glycines
  SCN-specific regions: Sequence locations=1-379,401-514
cttgccaaattcacgccatttgttgggaaaagcattcgctatgaattgcataattttctacaaaattcttctctgttgtcaaagcgagtggactttttccacgtttacccaaaagcattctcagtgaatggttcttcttctggcgagcacagcaacagggtaattagccaatggcttgtcggaattgagcttcttcccgggaaaattgtggattccgagctcagaagcgaattgagtcaaatgttgggcaatttcgatgcaaaagttaaaaatgcttttaattatttccttttccatgctgtggaccttttctcagaatatgttgagaaaaatgaactcaaattacggcgatttgactaagaaatattttctgaatctcttttcacaaaaaaggggtgttcgtccggctattgcccaaatccaattcaatgtgatattttatttcttttttttaatgtaattcaatctgtttgtttaattaatgagcttgcaaaaggttaaaacgagcattttg

SEQ ID NO: 96871 - DNA, 490 bp, Heterodera glycines
  SCN-specific regions: Sequence locations=1-490
cttttcataatggctgcacgttctaatactaataaagaaactctaaagaaccatcaaacgagtaaaacaattgcaaccaagaagctggtggttcaagactacaaaaatcgattgaaggacggaataaaatcgttaaatgataattttgaatgtatattgggcgcttcgaaggtaaattgcgatgatgcgacacatcgatcaaacagtgccggaaaattaggagagcattatgcaatcagaaacgaagcaattgcgagggctgcgcttctcgtcaaggcaacaaatgagttaaaaatgctgacaaatgaaatccgagaatttctcactattcgcgacttcaattttataagcaactcaatttccaaagcagaagaagatttcaaaaagcgattgaaacaatatgaaaatgattacagtgcacttcggatgagcataagcacaatggcatcagagattgatcgagaattggtggaaaattctttgtatagat

SEQ ID NO: 96872 - DNA, 357 bp, Heterodera glycines
  SCN-specific regions: Sequence locations=1-327
cggcaaaaactggcgttttgcagatgttcgggcggcaatttcacattgtgatggctgacaattccgtggcagttttgaagtacaagagagtgccaaatcgacgaatattggacttttaccacactgaagtgccgcccgatttccgtggccaaggctttgctgaacaattggttcgggctggatttcgccattgtttggacacgcgtttctccgtgtacccgtcctgtacatatgtgcaaaaatacatcagagatttggccacggaagaagagaagaaaattgttgtagaaaaatattattaaatttgctgctgctgttttttttgaattttgctcattttgaaacaaatatttaaaa

SEQ ID NO: 96873 - DNA, 440 bp, Heterodera glycines
  SCN-specific regions: Sequence locations=1-34,57-310,340-440
aacatttctgacaaatcagaacagatcgcatccctggtttaatttaataaaaatgaatggcgaagttcgtagaccaaataaaattgtcaggtataagccaattgatccgatggtacagccagtgacagcggaagacagcattccggagtatatgaacgtgttggggatggtcttttcgatgatgggtcttatgatgagactcaaatggtgttcttgggtggctcttatttgctcttgcgttagttttgccaatatgcgcgcgtccgatgacactaaacaggtggtcagctcgttcatgctcagcatttcggccgtggtgatgtcctatctgcacaatccaacgccaattgtgccgccatgggcgtaaaaaataaatgcattgaattgttcagttcaaattatgttattctatcggtttcatttacatctcttattatttg

SEQ ID NO: 96874 - DNA, 164 bp, Heterodera glycines
  SCN-specific regions: Sequence locations=1-97,119-164
gtgtaacccaaaaaaggtctgctgatcgccctccccccattataaaaaatagatttcaaaccaaccaccaaataatcccctcaattcatactcattcgcatttaagtattattttgtatgctaaggttaccaaattacgtaattaaaatatttagtttcaaaaa

SEQ ID NO: 96875 - DNA, 434 bp, Heterodera glycines
  misc_feature (359)..(359): n is a, c, g, or t
  SCN-specific regions: Sequence locations=1-268,290-434
aacggggctcgcggcttgggccgttgtccaatgactatgtcctgtgccgggtccaggcattccgtaattatgcgatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcatcatctctggcgataggaattgtgttctatagccttggcaagatcgaagtttgggttgaccgaagcacgtgagctccnacgggggagtgagcgcgagtgggtgacaaatattgaaggtatccgacggttcacggggaacccagcggcatgact

SEQ ID NO: 96876 - DNA, 300 bp, Heterodera glycines
  SCN-specific regions: Sequence locations=1-264,286-300
gtccaataaagattgttccaattggaggaaatcgttttatttctgtggatagattcaaaggacgtattttgattgggataagagaatactatcaaaaggacggcaaatggctccctgggaagaaagggatcagtcttaatcaggaccagttcaatggcttattgaagattctccctgatgtgaagaagatgatcagttccgcctgaatgaagtgcacacgacacaatgatctttgtttagatttttagacaaatttgcttgttttgaaatatatttttatcacatcttgctggcattttc

SEQ ID NO: 96877 - DNA, 338 bp, Heterodera glycines
  SCN-specific regions: Sequence locations=1-268,290-338
gggccaacgaagaaattctgcgaggtctgtcggagctggattgacttatttgaggataaaattcaagtggaaaagttgatgatgcacaagcgttgcttcgtttgcgcaatttgcgactgtccgcttgagccgggcaactgttcccgagatgacgggatcatctactgccaattcatgtgcaacgaccgtgtgccagtgtggttttgttctgcccatatgatgttgggatcgggcgaaaaatgccaattgttgaaggaaaaatggatgaaggaaaatgaggaaaagcaggaaatatgacacaacaaatgattaatgcatttcattagtcatgtgatgac

SEQ ID NO: 96878 - DNA, 782 bp, Heterodera glycines
  SCN-specific regions: Sequence locations=1-782
cgtaatcacgcggtggcggcatccttttcatcgattacgacattcatttaccgtagcaatttatgtcaatgaactcgctgaatatgggcaaagaagtggccaaacggtggatgggcatcaacaacagaagaatggcgcccttttccctttcgcccgtcgaccgaatgcgtcaaagtgtgttccgagttcgaagtcgtcttgcggtcaatttgttgtcggaagggttggccacctttctgctgctgctggtcggcaatggcattggggcacaacacattttgggaggggggaagctggacaattacatgcaggtgtgcttcggctggggcatgctaatcgctcttttggtgttcgccacttaccacacatccggtggccatttgaacccggccgtgtccctcgccttcgttagccttggcaaattgccattcgcccattttttgctgtattccctcgtccaaactgtcggcgccttttttggctccgccctttgcttccatgtctacagagaatccttcgagaaattcgacgcgggcattcgaacggtgggagggcccagcggaacgggcgcaattttctgttcctttccggacgaacacatcggacatttaccagcttttgtggatgaaattgtcgggactgggctgctcctcctttttgccatgcgctgatcggtcccgcgaatcaaccgccaaaatgggtgcctccgatccggtttggggttgcaatcgttccgacaactccctccttcggctgaatgccgccctctccgaacaatgggg

SEQ ID NO: 96879 - DNA, 269 bp, Heterodera glycines
  SCN-specific regions: Sequence locations=1-163,185-248
gacaatcttcttcactttcaatgtctttgtggcgttcaattgggttgacttacacgcgttactcgcaggttgctgctgcgtcattgcgcgaatgcgtgaagaaaggcacttcgggcgaggcaaaaactgcggaaccgataaaaatcacttcatgggaaggaggcaaagcgaagaagcccgaataaggaagcattgaccttttaggaccaaattgtttttttgtagactccgttattgctattgtcagataaaaacgagattttaaaaaa

SEQ ID NO: 96880 - DNA, 483 bp, Heterodera glycines
  SCN-specific regions: Sequence locations=1-51,92-413,450-483
accattagttcatgcggctgggcattttactttttgtttttcgcatttcattaaatttaattgcaaaaacaaatgccacttatttttatgtacgcggtgaattgtggtgccaaggagagccttacgttggcgccaaaatcttcctgatggaggctgacacgcttgatccggatgatttgttgggcgaagaacgatcggcgcccgacgggcgctttgaagtgcgcggaggtgagagcgaaattggcgacgaagaaccgtatttgatggttgggcacacctgtccacagcgaggtgtcccacctgacccggcctgccattttttgactcgcgttgatttgccaaatttcctcactcacattgaagtgccgccaattcatttggacggacaatacgaatttcagcatatttgtggcgaggatgatgtttaaaaaatatgaatgatggatgaataagataataaacagttcatttgcccatcttttt

SEQ ID NO: 96881 - DNA, 798 bp, Heterodera glycines
  SCN-specific regions: Sequence locations=1-28,51-182,204-571,593-798
attttaaaggtggaaaattcatacaattcttcattttgttcctcatcaatatgcttgggttgttgaacgtgcgggaaaattccatcgcattcttgagccgggggtgcatatcgtataccctctcatcgacgagatacggtatcggcactgtttgaaggaaatgtgcattgaaattccacaacaagaagcaattaccaaggacaatgttcagctggatttggatgccatcctttacgtccaagtggtcgacccgtataaggcgtcttacggtgtgcaagaacctgaatatgcgatcagtcaacttgcacaaactgtaatgcgtgctgaggttggcaaactgatgttggacaacgttttccatgaacgggccaatctcaatagggcaattgtcggaggtataaaagaatcgtgtgctccgtggggcctcatttgccttcgctatgaaattcgcacaatgaatatgcctccggaaattcggcgcgccatgaagatgcaagtggaagcggaacggaaaaagcgtgccgcaattttggagtcggagggcatttgcgaggcggaaaagaaccgagcggagggcgagaagcaggcgcgaattctgcgctccgaagcacaaatgcaagagcagatgaacaaatcgatgggtttggcaaaagcggccgaagcagagaaaatccaacgcattttgcaatctgaggcggaaatgcaaatgaaagttaacatggccattggacttgccaagtcggccgaaagtgaaaaagagtcgcgcgtcatattagcggaagcggaggagcaggagca

SEQ ID NO: 96882 - DNA, 674 bp, Heterodera glycines
  SCN-specific regions: Sequence locations=1-173,195-204,227-348,383-674
aataaaaaatcgaaaaaatgaaaaatttccttacatttttggcttttttcttaatagtgccatgtttcaaggctgacaatgagaaaaacaaagcggcaccacgagtgtttgctgaacatccggggccaaaattggtggacgaaaccacgcgatggagcaaatgccaagcggaccaaaacctgaccatttatgacttcgaagtggaaacacttgacggcaaattcaccaacttggagaagtacaaaggacaaattgtactgctaattaatgtggcaacattttgcgcgtttacccaacaatatttggacttcaatccaatgctggagcgtaaccgtgccaacggcgtcccattgacaattttggcatttccatgcaaccaattccatttgcaagagccggccgagaaccatgaaattctcaacggggttatgcatgttcggcccggagacgggtggaaaccgcactccaacctgcacatccatggcaaattggaggtgaacggcgccaacgcacatccgttgttcgactttttgcgcgactcgtgccctcaaacggtccctgtgcttgggatcaaggaatcaatgttctataatccgatcacggtcagtgacatcacttgggatttttgaaagtttttgatcgacgctaacggggttcctcgttttcgtattcac

SEQ ID NO: 96883 - DNA, 338 bp, Heterodera glycines
  SCN-specific regions: Sequence locations=1-275,297-338
tttgtcgcgtccgtccatttctttgctcttcccatttctatggagtcccgcacctcaaatttgtcagcttccatccatcgccacggcgattatcagctgcgattggcccgctcttcggcctatgtgcgggcgaaagtggcgccaaatttgacgaaaaattttcaaaaatgtccaaaatgtctggtgatggtggacattcgactgcacgccaaatgcccagcggatgcaatttaccaaccgtaccaatgggttttggacccggaaagatggtatgtgtgaagaggaagcggacgaggcaaagccggacggacggaagagggaggtgaacagaaggggaa

SEQ ID NO: 96884 - DNA, 268 bp, Heterodera glycines
  SCN-specific regions: Sequence locations=1-268
ttttgtgctgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggaggtgggaaaattacaaaaaatataacggtcaaaatatactaacttaagccttcattg

SEQ ID NO: 96885 - DNA, 556 bp, Heterodera glycines
  SCN-specific regions: Sequence locations=1-556
cggtcgcattccttttccgatgggttcatcggcatttcctcctttttgtttattctataaatgttcaggccttcgtgttcaggagtttcttttgcggcgaatgactgatgacaaagcatttaatggccatttcctttgtcttttggagcatccgcccacttacaccgttggcattcgacaggacgaatattctgatgaatttgcccagcgattgcgccttctcggcgccgaatttcacagaataaagcggggcggccttgtaactttccatggaccaggccaacttatcgtttatccggttttcaatttacgcaaattgtctgcggatggtaaaatgaatgggattggtgtaaagcgatttgttgaattggtggaggagacggtgatccaaacattagaatgtgactttggaatgaacgggattggacgcactcaaaacccaggcgtttgggtgggtgagaatcggaaagtggcggccattggaatccaaatccgacacggaatcacttcgcatgggttggcactgaactgtgacacagatttgggctgataattc

SEQ ID NO: 96886 - DNA, 395 bp, Heterodera glycines
  SCN-specific regions: Sequence locations=1-321,343-395
agaaatgcactaagaaactatcaaagttagctactgtccatgtggagaaaagtgaccaaactgcgaaacgagtgacaaatgaaaacaaattgttgagttcgaaacaaaaattcaaacctgcaagtgaggaatttaagaaatgcagaatctgcaataagatgacacatcatatttcagcgtattattgtcaaaactgctcgtatcagaaaggcatttgtccgatgtgcgggagaaaacaaattgagacagcaaaatacagacaaagtctgacataaacttgtttctgatacctattcaaacgagatattttgtattcatttgaaatcgcaagttttcgtatttcctttgttagtagatcaatatttttgtcatattggtaaaaagtttggttgcgg

SEQ ID NO: 96887 - DNA, 259 bp, Heterodera glycines
  SCN-specific regions: Sequence locations=1-227,252-259
tcggtacaaaaaagcgactcggcctctttggcttttggattcatcgccggggcgggccttgagctgttcaaaatcaacttctcatgttttggcatttcattctacaaagtgttcaatgagaagcagttgtcccaagaactgacggaattcgaagagaaattggccaatcggaactcgatgttgcgcagccgaattgatcagtttcaggacccaaaatgatttttgtttataatttaaaaaggataaaattggaagaatt

SEQ ID NO: 96888 - DNA, 578 bp, Heterodera glycines
  SCN-specific regions: Sequence locations=1-523,545-578
aatacatcctttctggaacattggtgtactgcgaacctccgatgataaatcattaatgaatggacagttggcgttaaaggggtgtgaaatcatggcactttatttcggcgctcacatgtgtcagcgatgtcgtgaatttataccggtgctcaaacaattctacgatcagttgaaaaaatctcccgaaacaatgccttttgaaattgtttttgtgccctttgaccgttccgaggatgaattccgcaactctttgcgcgatttgcacgacgattggctgtacattccctatgggagtgttcacattaactcattggccgcgaggtttaacatcattaattggggagtcattccgacattggttgtgcttaaggaggacggcactttgataaccatggctggacaagcaaatgttcagcatttgtcggcatcagaagcaatggtccgctggcgctctattcctaatcccgaatccggattcaaagatttttcgaaattttaaatttccatatcttttttgttaatgttgctaaagcattggtttgatgtgtacaaccaacatgtgtgtcagggatggcacg

SEQ ID NO: 96889 - DNA, 480 bp, Heterodera glycines
  misc_feature (43)..(43): n is a, c, g, or t
  misc_feature (52)..(52): n is a, c, g, or t
  misc_feature (66)..(66): n is a, c, g, or t
  misc_feature (136)..(136): n is a, c, g, or t
  SCN-specific regions: Sequence locations=1-480
gcgctctagaatagtggatccccgggctgcaggaaaaaatggncctccttancctttattgtcggnggaaaagttttttggttgttgttgcccctatgaagcttttgctgtttctcatcacttttgtacagattgntgtttttccgtcaaagttgcatggcacagatgaacgcagccaagctgcaacaacagttgaccgccagtgggagcagcagcaaatgccgcagcagcagcaccagttgtgcgtgacaattccgtaccgcgaccgatggacggaattgcagcaaatgttgccacttttgcacaatttcttggtcaccatccaggccatcgccccaccgccccggtacattttggtcaaccaatcggaggaggacgcgctgcgcttcaactgcgccgcgttgataaacattggagcgttggaggcggaacgcgtcggttgcgattacatggcaatccacgacgtggacattgttccgc

SEQ ID NO: 96890 - DNA, 607 bp, Heterodera glycines
  SCN-specific regions: Sequence locations=1-607
ttccctcttctctctaattgccattattattatttctttatcttcctcggctctttccatggatggacgccaaaagaagctgaaaactgttgactttgaaattttgacgcgagaacagctgtgcgtactttgccaagcggtgctgaacaaatggaagggacaagcgaacaaaaatgagcaacactttagggaggaaattctcgactcctgctcgctgatagaaaacccttccgaagcgaaaaagtgccgtgatggagtgaccgatgccaaagtggcgagactgaggaaggaaggaacggaggaaatgtgcgtggcggagggattttgcggaaagggcgagatgaaagagttggagaagaagatggagcggatggagaagagaatcgacgacaggaagcaaaagttcgagaagggactgcgcataattccgcccgtcgacttgagcccggtaaagtcagtcccaggggacaaagcgacgaacacaacgaatcggacgatgggcggaggataaacgatcaaccgaccgactgaattgattgatcaatcaaaaagggagacgcacttattctgatcagtaatcacttgtccaatcacattgcctacgttt

SEQ ID NO: 96891 - DNA, 273 bp, Heterodera glycines
  misc_feature (263)..(263): n is a, c, g, or t
  SCN-specific regions: Sequence locations=1-220,243-273
ttaccgctttgctcggcgagggactcacttgggtgctcgtctacaggtccgacgagtacaaacggcagaatttgcaaaaattgctcggattcgccccgtcgcgctcattcaatcgtcagacgcagaatatgggcggcatttttggccaaaatgcgcaatccaatcagttcttccgttagcatttgaaagagcaataagccatgtgatgctttgtaatttgattttttgttttaaaaagttttgtcttcactcattaaacatcnactaaaaagt

SEQ ID NO: 96892 - DNA, 416 bp, Heterodera glycines
  SCN-specific regions: Sequence locations=1-200,222-416
ccactgactatttcgacctgttaaagtgcttggatttcatcattctgacgaggactaatttgaccgggctgaactcgcgggcaggccgatgtgctgtatgcgagatggacaaagtcagcctctcatgccaattggcgtgtcgaagtgcgcttttttctccgactctcagccgcaataaaaaacagaagcgcattgaaatggtttgccattggggacacggagacgaaatccgaggggacagaggagtgctgaactgtctgaagagtacgcaccattggttggcacaaaaacaccagcagctgaacaactaacagaacaaagggccgatctgtcgcaatttgaattttaatacggtagcggaaaataattgtgatatacggtagcaaattgccaaaccgaaaacgcattaaatgcag

SEQ ID NO: 96893 - DNA, 252 bp, Heterodera glycines
  SCN-specific regions: Sequence locations=1-252
gctgtcagacctgcaggggccatcagaccgggacctaaagcgccttcatatcgcccgccgcctgggaagtcctttgtgaaaagtgctcttggcttttgcgtgggaatttgtgctgctcgcattttgagtgaggaattgagttcagtataaatcatttgctcgcgcacattgttgatgtgtttctttgattgcatcgttaacaattgtgcctaatggctgttgatcacatcaaatttgaataaatacgattag

SEQ ID NO: 96894 - DNA, 213 bp, Heterodera glycines
  SCN-specific regions: Sequence locations=1-100,129-213
gtgatcacagatgacacaacagaggcggaagacatggaaaaggcaatgaaaattggccaaacttacttttggtgtaaactggtgacagaatggaaatgtcaaaataaaaattttaaaaaaaaaataatcacaataaaaaattgatcaaaatttgcgaaaattggaaagtgaaggcaattgcggcgaatgcctatgtgaaaagttgggtgtgcc

SEQ ID NO: 96895 - DNA, 510 bp, Heterodera glycines
  misc_feature (510)..(510): n is a, c, g, or t
  SCN-specific regions: Sequence locations=1-510
attcgcatgaaagccaacgactgtccgttggtcgctcttatccgattcggcggttgtgccacctcattcacttctgaatctttcgcgcggaaggccaaccttttgggcaacattgaccgttccaattgcgagacaatttatgtgccgatttttggaggtgccaaagtgcttggctgggctaacgatgttcaaattcgaattgatgagctggattatcaatttgtgtaccgtttgggggtgatggaggacaaacatttgccgatgtattgcaagaagaagttcgacatgcttattgcaaccgattgctgtttcaaaattggatttaccatcgattgtggcaaaaaagtggtctcccgcaagggcaaagtggtcaaaattttgaccgaggaacaaattcagagcgaaatggaggacacctattgaagaaatggaagaatgagtgaatgaatggaccaaagtgatcggagaaacagaaaaatcagcattgttcggcgcaattttgtggaatan

SEQ ID NO: 96896 - DNA, 365 bp, Heterodera glycines
  SCN-specific regions: Sequence locations=1-205,227-365
cttcgcttctgtcattggctggggttactctgctgtgcactcattcaatttgttgttctattggacggacttttggacgtgcgtcaactttcaagcggatcacacaattgtgccgttgatcacttttgtgctcagccttgtcttggcgtgttcgtccatcttcgagattgttcttcacaaattcgtgctgaatgatgtcgacacggaaagtgacaatatgggcattcatcagaagcagaagaacggatgtgcctttgtgtgaacaatgagcagagagacgagattgaaacgatgctggtgccaaaatatgattgatgatattatgataatcggattatatattgcttggtaaattgttttactcc

SEQ ID NO: 96897 - DNA, 510 bp, Heterodera glycines
  SCN-specific regions: Sequence locations=1-510
cttaaaaatggacgccaccaaatggcacacttttgtcaaccaagtggccgccacgggcccaatcacaaaggcggcgatttgtggccaagacggaaatatttgggccaaatctgacaatttcaatttggacccaatggaagcgaatgtggcagtgagcgcctttagaaatcccggcgttttggcaaaccgtggcttagcctgcgaaggagtgacgtatccaattacgcagcccccgtccacgaccaacaacacttgcctcagcggagagattgacggacagcacggcgttacgattgcaagaacgaacagagcatttctcgtcggagtgaccgaagggacggacacggacgtcggccgagtggaaacggtttcattggcccagcaattggccactcagtacggctggtgaacaacgcattgatgcggatgaatacaattgttctacactgatgagcatgggctataattgttctgacaccttgcaattatttgcgtcatttctattttcta

SEQ ID NO: 96898 - DNA, 508 bp, Heterodera glycines
  SCN-specific regions: Sequence locations=1-385,409-419,441-442,464-487
ccccccccccccatgagattgaatgcggtagatattcgctcatatcgtatcttaaactcaccatcaaattataatgagactgtttttgaaggggcgttattcttctcggcaccctgctgtgccagtgccattctgactcggtggctgttgaacggtcaaaggtggatgccgtcgatgttggagacgcgccgcacatgatgttgacgcgggcaaagcgtgccagcggcggccgatggaccacgcagcagatcatcgagtgcattttcgctgtgccatcagtgccttttgcaaatccttaaggctttttgcttactaaaaatcggagatttcttttttctcatttttgtttattttaaaataatttgccaatgttttggccgcccttttcagtcaaatcaaatcaaatcacaattcgattcttcacataagtcacatttattatgattctgttatttcttcgactgtgcaattgactttattattggaaaagaataaattctaaaatttt

SEQ ID NO: 96899 - DNA, 227 bp, Heterodera glycines
  SCN-specific regions: Sequence locations=1-227
tttcattcttgaatcgacgtggcagaagttcaagcagcaacacaaaacgagatttggcacgcaaagatcacttttttccacataaatttctgattttttgtggcgtaagcaatttggaggaccggatattttttataatttgtggacccaaatcgcggaattttacccaataagcacataaatcaccttctgtttgttacttaaagcaattctgataataaaaaaaa

SEQ ID NO: 96900 - DNA, 524 bp, Heterodera glycines
  SCN-specific regions: Sequence locations=1-524
aaaattccacgccattttcatcatcttggaattgctgttggattgagtgacggaaatgggaagtgttggcgtcatctttgtcaaaaatgtggccatggttttgatgctgcttttcggacggacgatgatggccccgtttgcgattgctggcatcgtgagcgacaacgttgaggtcggctactacccgtcacgcgaaaaggggaagggcatttatgaatggatccaagtcatcaaaccattggtacagggccgagtaatgttgacattgacgattgccaattcggttttgttcattgccacgtgcattctgctcatatacctcctcgtttttgcggtactgcttagcacgtcgaaccaccagttggaggaactgcgtggaaaaatcaatacggtggattactgttcggtgctgcaccctctgtcggctgctctccaaaatgccagggagtcggcgacgactcgacgatgtgactggcaaatgtcctgaagatttcaacaaggcgccggcgcagattaagtacagt

SEQ ID NO: 96901 - DNA, 354 bp, Heterodera glycines
  SCN-specific regions: Sequence locations=1-331,353-354
ttttgttacacacatgcaaaacagtggccttctgctcgaactgatgggcgccgaatgggcggcggttggccaagcaacgattagtaaattggtcaaatacgaagagaatgtcggcatcggtaaaccgtcggatgtgttgcaacaatttcggttggaatacgccagcggagtcacccatttgaccgaacgcaaagatttgcgcccgcgctgattttaaaccgaatgaatgcctttcggattgaggcatttgattgatgatgatgattgtggaaggtgaggctcaaaacgatgtgtaggaaatttgttattcttcagtttgttatcgtttcataggtattttggtataaacttttg

SEQ ID NO: 96902 - DNA, 583 bp, Heterodera glycines
  SCN-specific regions: Sequence locations=1-53,78-80,111-111,185-583
gtggatccccgggctgcaggaattcggcacgaggcgcgtagttgtttcggcaattatttgaagcaaagtcattcactcttcctatttgctgggatgcacaaagacgagacaggctctggtcatcgatccagtgatcgaaacggttgagagggatgcctcattagtccacgagttgggactcgaccttaaatatgtggtcaacacacacatccatgcagaccatgtgacgggttctggcgaactcaagcgcaacaaatactttccaaaagcaatttcgattttatctggaaaagcgggtggaagggctgatttgcttgtcaaacactccgatttaattcgttggggggatggactcgaattggaagtcagagaaacgcccggacacacaaatggctgtgttacttttgtatgccattccaaccaaatggcattcactggcgatgctcttttgatcagaggctgtggaaggactgactttcagcatggaaacgctcggactcttttccgatctgtgaaatcgcaaattttcactcttccccccgattatcttatctatccggcgcatggtaaactaaattaatgt

SEQ ID NO: 96903 - DNA, 582 bp, Heterodera glycines
  SCN-specific regions: Sequence locations=1-312,334-582
tattcattactaaaatgaacattttcacatttattttcatcgccttgctgtgccaataccaccgcagcaaacatcatataaatgctggaccattggacgctgaaaaatcgccttcaaatggtgaaggaatccacaaatatgaagcggagaaattgaaaattggagaagttgcaaaattgaatcatggtgaaacaaaaactgaaatggatgaagcagatggccatagacattcattgccaaaagatcgtggcgatattgtgcatccaaaatctcaggacggagtgtgcaagattcatgaggatgtgaagcttgatttcaatgatgacattttcggccaacatgttagtggagaagaacgtccgccagtggccgagccaatgccaatgtcagcttaaattggtggcattttgagaggacacagatgagagtgtgttgttgttttttttgggatttatttagttatttatcattgttagtctcttttttatgttagcttttgtagtcatttttttattagctttaccacaaccttttttaaatgtcatcatatatatacctcaggttctttatggatattactat

SEQ ID NO: 96904 - DNA, 308 bp, Heterodera glycines
  SCN-specific regions: Sequence locations=1-308
tttcttttattttcataaatgaaatcgtttattctcgctgttcttttctcatttctcttcatggctttaatgatgccacttgtcagttcagaggaatcggaaacaaaaatgaaatcgccgattatggaaaaacatggtaacggaggcgacagactaagcgattatctgttgaaactgtgaagattcacgccgtggattgtattgctttgaggatgacgaatccaaaacgatttatccgtttgatacaataattattgaatgactttcatttgtaatcgattaaaagtaataaatgacttggaaaaaaa

SEQ ID NO: 96905 - DNA, 436 bp, Heterodera glycines
  SCN-specific regions: Sequence locations=1-334,360-436
tttctaatcttcttccacgtcactgttggataatggcggacactgaagcaaacaatagacaaaatgagttggaaatgagcgttaatcgatggctgggcgaaacactgcgaattgaattgactgacggacgcgtcatctatggtcagttggtttgcactgacaatgtgccgaacattatcctggtggattctcgcgaattttggaaattcaaagaagacgaggcgggtggtgatcgtactcggattccgatcagacggacgggaacggttttgatcaaaggagagtatatcaaacgaatctttcaaattgtgttgccagaagaagaaatgaattcgattagaagaaaagaggaagaaacaaccgaaatgtgaactcaaatgtttgaattgtttttccacatttcatagatgaaaccacagcagacagaacattggcg

SEQ ID NO: 96906 - DNA, 108 bp, Heterodera glycines
  SCN-specific regions: Sequence locations=1-108
gtcccttattcgtcttctgttcgcggttttctgcgtttttttggccaattttccccaaggtgcgcaggcagcaaaaaaaaaaaaaaaaactcgagactagttctctct

SEQ ID NO: 96907 - DNA, 536 bp, Heterodera glycines
  SCN-specific regions: Sequence locations=1-536
aacatttccgaagcatttcccatgaccgattcaatcggcggcatttgccgaagtcacctgtgccgcagtcagtcggccacaaatgtgcccgaaagttgggccgaccgcccgtatccgaagatgacgcgggtccattccacgacggacatcgcacagcgatacgcggagatcaattcgcccacgagatactggcccaaaaacaagccctattactggccgatgaccagcaacttgtgcaacatcgtctccaattacaacttttacccattgttccgttcttattggccttcctatcgcagttatttgttggacaccaattggtacaatcgccgcttcgaccgtttccaatttttgccacccgattcttattatagctattggccaatgtcctgcagttatcactattggtaccattatccatatttcaaacgatggtatctcggaggcctcggtggagtttcgcagttccacaaacaatgaaagtgaaaatggatgtatagcacagaaacacaatgacgcgtaccgtaccctttacc

SEQ ID NO: 96908 - DNA, 520 bp, Heterodera glycines
  SCN-specific regions: Sequence locations=1-235,257-430,452-520
ctctcaggccggaaaaggaaaaaagccacgaggagggggagaatgattttattcgttttgctgcgacatccatgcaagggaagagttcgttgaaattggtccattcgcatttaaattggcaactatttaaggatggcgaacccatcaggaggatgcgcataattgtatcctcagttttggagatgagtgctctttttttgcagtttatgatgggcacggcggttctgacgttagctcctacctgaagaaaaacttccccgacttcttgaaagagcacaatttgttgctccacaccactgacggaaggtctcagcgcggcattgcacaaattatttgtgaaatttgacgagactctgcgccacgacgatacggtcaaagcaatggtagagctgaagacagcactttcaacaacatcggaccaacaacagcaggcagaagagcaaaaggcaaacgaaggctgtgacccgggggagaaggagcgcaaggaacgtgagagtttgatcggtgggtttaattgatc

SEQ ID NO: 96909 - DNA, 518 bp, Heterodera glycines
  SCN-specific regions: Sequence locations=1-518
ggttgtattatttttgttcggtattttgttggccgttcaattcaactcggaaatcgttatggccaagagtatcggcaagcaatcaaaagcatcgaattcaaaatcaacaccaaatcaatcaaaatcaaatcagccaccatcatcaccgtcttcatcatcttcatcatgcatgggctgtctgtcgaacaccaacacggccgggcccattgattcatacttgggcaagccggtcaagaacagcattttcactttctacggtgccggcggacgcggcgcgtgcggtctagacgccggagtgccaaaaatgtcagctgccggctccggccaattgttcaagtcggacgggcagtggaaagacgcatgccgagccgacaaacagtacatgttggacgacccgatttgcaagaacatttgtatcaaagttgattacaatgggaaaactttgaccgttccaatcaataacaaatgcccggagtgcccgcccaaccacgtggacttgtccattgatgcgtttaact

SEQ ID NO: 96910 - DNA, 510 bp, Heterodera glycines
  SCN-specific regions: Sequence locations=1-150,173-510
ttgtattctttttgttcggtattttgttggccgttcaattcaactcggaaatcgttatggccaagagtagcggcaagcaatcaaaagcatcgaattcaaaatcaaaaccaaaaccaaatcaatcaaaatcaaataagccaccatcatcaccgtcttcatcatcttcatcatgcatggggtgtctgtcgaacaccaaaacggccgggcccattgattcatacttgggcaagccggtcaagaacagcattttcactttctacggtgccggcggacgcggcgcgtgcggtctaaacgccggagtgccaaaaatgtcagctgccggctccggccaattgttcaagtcggacgggcagtggaaagacgcatgccgagccgacaaacagtacatgttggacgacccgatttgcaagaacatttgtatcaaagttgattacaatgggaaaactttgaccgtcccaatcaataacaaatgcccggagtgcccgcccaaccacgtggacttgtccattg

SEQ ID NO: 96911 - DNA, 529 bp, Heterodera glycines
  misc_feature (520)..(520): n is a, c, g, or t
  SCN-specific regions: Sequence locations=1-330,352-362,384-529
gtccaataaaggccattttgaagaatttatttgcgtatttggagaactatctaattgtggttgtgagtttggaaactctgtcctcacaaaatgcctctttgtcccaaatgtcagcggcctgtttattttgctgagcgcgtcacttccattggaaaagattggcaccgtccttgtctccagtgtcataattctgcctgtaagaagacgctcaccgttgggaagcattgcgaacacgacggaaagccatattgtgagcgatgctacggcgcattgtttggacctcgcggctacgggcatggcggagttgagtctcatgtgttcttggacgggactacctgagaaaatggtggtgcgagatgtttaagaatattatatatctcatatgatgtttgttcaattaccattcaactgaagttctaccttaatcattcattttctatccacatacgtatttcattccatgagttgtaagaaaaattcatatgtgtataatgtgccaacatctcagtatgtattgtangctatgatt

SEQ ID NO: 96912 - DNA, 456 bp, Heterodera glycines
  SCN-specific regions: Sequence locations=1-456
agcgcattcgcggctttcttgttgacataaatggcgtactctttgacacttctttggacggaggcaaggccattcctgggtcgattgaagcagttaaaagactttacgagctaagttgtgttcgttttgtaagcaatgaaagtagtgggacacgaggagcaatttgtcaaaaattacaccgtctcggattcgttgggcctcagcctgagcacattttcacaccggcaccggttgctgtcaaataccttcgacagcatggactacgaccaaaattgatagtgcacaaaggtttaaaagttggactttgagttgatataattatttggcgaaccaactgtaccgactaaaaccatgaaggacacttaatttaagactcctcgaacttcagatgtacttcccgattttgaagaatttctcaacgtcgaaaacccaaattgtgtggtgttaggcgacgca

SEQ ID NO: 96913 - DNA, 361 bp, Heterodera glycines
  SCN-specific regions: Sequence locations=1-15,55-61,83-211,233 -285,307-361
gagggccggcccatcataataaataaaaatattaaattgcaataattaattattgcgcatttttggctgcttttcctccatcattttttggcttccaaattgccgtcacaattgcgtcaccgcccaatggcactgtccaccggcggccttccgtctgatcaaaaatggacacattgtgcgcatcccgatcactgttgatcagcaccagcacatggaggcctgggaaaagaaataatttaaattggaatgattttacgatgaaaatgcaaattaatacgccaattaataaaatttacaatgaaaatgccatttattgtaaacgctaattaattaatttttacagttaaaatgccaattaaaa

SEQ ID NO: 96914 - DNA, 221 bp, Heterodera glycines
  SCN-specific regions: Sequence locations=1-221
acgggacttttattcaatcggagcaaaacgaggaatgcaaatggggacgatctcggcgaatcatgactcatcagttaaattcgaactgatcagttccgatttaagcctatttcccatcgaatttatctgttgtcccatccctatccttctcaattgtctggctcaactcccgctatcaaatatgaaaaaatccagttttggacaaagtgtaaattttggtg

SEQ ID NO: 96915 - DNA, 524 bp, Heterodera glycines
  SCN-specific regions: Sequence locations=1-295,317-524
taatagttttgcgttacattacacaaaaatgtcgtcaaatggcatcatcacaattgtggcgctattccttgtgttgtttggcactcacataacaacacaaattggggcaatgaatcgtcatcgccagcagcgctcacttggccatccgtttacggtggataagcagcagcatacggcacagaacgaaaatttggtcggcgcttatttgtctcggggaatgttcagctgtggcgccaaatatgttggcacattgcaaagactgaaaagaatcattgaggaagtgcatgccgactattcggaatgccaaaaatcgatgaagcaaatggacgagaacgagcaaatggcattcggaaaagggcacggcacagagcgatttgcggtgattgacgaactgattaattgagcccaggggggcaatttgtggcaaaatcacaaaattcgaagcataaccatttgaaaaacattgaaatgatttttcattgtttgtgataaagcgaaacagcaatttgttaataaaatgccaa

SEQ ID NO: 96916 - DNA, 265 bp, Heterodera glycines
  SCN-specific regions: Sequence locations=1-123,145-265
actgcacagaacgaaaatttgttcggcgcctatttgtctcggggaatgttcagctgcggcgccaaatatgttggcacattgcaaagactgaaaagaatcattgaggaagtgcatgccgactattcggaatgccaaaaatcgatgaagcaaatggacgaggacgagcaaatggcattcggaaaagggcacggcacagagcgatttgcgatgattgacgaactgatcaattgagcccagggggacaatttgtggcaaaatcacaaaa

SEQ ID NO: 96917 - DNA, 665 bp, Heterodera glycines
  SCN-specific regions: Sequence locations=1-665
caaaatattatttttccgagaagtatcttttgttcctcgtctattcgttgccctttggaaaagccttaactgaggagcaacttggaatacgcttacggaggaaagaggagcaaacgccgagacaactcaaagagaaaagtggcagggaaaggccgttgccttttctgagtgacagtcaaaaaactgaggaaatactaaatacagctccagtcaaaataaaggatcgattgacgggacgacgaccatgtcaaattgcttacttggacaacagagagggagcgtttgccctcaacgttctaactgaaactgcaacgaccaaactgacacttggcgaccacgttaagccattgggcaaaggcaaccctggaatttgtgcgccatttgagcctcggatttgctcggattatttggtctcctacacaaaccccggtccttttgcatcgttcgctccccactttgatttgacttgggcgacaatgtcaaagcgtgacagcgacttgctcctttcttgctacggtgacagagataatgtaactgatgcgactgcactccgacaaatggactcaaatgtcggaacaccaacttcagatgtgggcgagtccatggtaaatgacctcactgaccatgaacacttaggaactattacgtcgctaggaaacacgagt

SEQ ID NO: 96918 - DNA, 210 bp, Heterodera glycines
  SCN-specific regions: Sequence locations=1-210
gaacatgtcgttgagaaatgctaccgaggctggtgccgggattggatgttggagtgccattggttttgtgacgcaattcgagggttggacaattatggccgttgtacggaatgtttgaggccgagggggagcgcttgttttgaatgctttgacctttaatcactcaattttttttattccaaatgaaaatcaacaataaagtaaataacc

SEQ ID NO: 96919 - DNA, 348 bp, Heterodera glycines
  SCN-specific regions: Sequence locations=1-348
ctctcttccgttttcatgtggggaggttacggtggtggttactacgacggctatggctacggtgggtactacggttcacagatcattttggtcgtcgttctgctgatcgtcggctgtctctttctcacttgcgttgtcgccggcctttggctgctttattcaagacaacagaaagaaaggggcgaagtgcggcaacaacagcagtattacccccaatattacactcgcaacggcggaccatacgcaaccaaagaattgagcacagaatttccctaaaaatggcattgatcagtcgccacaattggcattttaatcggacaaatgaaggcgcaaaaaaattgaaaattc

SEQ ID NO: 96920 - DNA, 683 bp, Heterodera glycines
  SCN-specific regions: Sequence locations=1-182,206-224,269-370,406-683
aagggccaaaacggaggcgcagctgaactattggccgtattattcgtcgcccgtttattcccacgccgcttcttacgaccattacaaattgggctcaatgtaccaatggtttttacgttcggccgcccatcagaacagcccaaaccgaagggcacgttattactgctacagtccgtacacaaaacagcacgagcacagcttcttcccctactttaccaaccactgaaaaagagggaaaagcaaaggaaaggaaaagcaaaggaaagaatttagacgaaacgcgaagaattctgatgattgtgctgcatgaacgaaaatattagcgcaatctgtggttcagcaacaacagaaacatcaaaaattcacctttatttcactcacataataataattatattgtaattgaacaattaatttgtccggtggtcttccccccccgccccctattttcccatccccttcattcattcggtcgttcgtcaatttggccaattatccgtgccgttgttgcgtccatttggcgccctttccctctgctcattgtcagtttcggcactgtccatctctgtccccacggcacttccattgttttcggcttcactacccgaccgcacttcgatgatcacttcatctgcagtgcctcgtgctgttccatctccaattggcccattcgatggcccaac

SEQ ID NO: 96921 - DNA, 155 bp, Heterodera glycines
  SCN-specific regions: Sequence locations=1-4,26-155
aatgaatttttatattatattttttcttgtgattttttccacctttttttgtcagctgctgattgtaggagcaacagagaaaagtggtggtgtccaatgcgatgaagcaaatggcatggaaccatttgagtacattccggcactgtggagggagg

SEQ ID NO: 96922 - DNA, 252 bp, Heterodera glycines
  SCN-specific regions: Sequence locations=1-129
ttctccttctcgtaaatattttgctttgttcaattgtgttgctacatttattgtcaaatgaaaatggattggtcaatgccatgccggcattgaacggaggcgacgagttgttgttgagaaagaaacgccaagacgaaggtgatgaagcggaagaaaatgccggaggcgagaatgcggaaaatggaaatgaagaaaataacggagaaggacaaaatgaagaaaataacaatggggaagaaaataacgaagaag

SEQ ID NO: 96923 - DNA, 166 bp, Heterodera glycines
  SCN-specific regions: Sequence locations=1-166
ttatttaaaatgtcttcgcataatacttcagttattgatgaaaatcgacgatggagtgacttacgctgtttaacagatagggcgtctacatttgccaattcaggattcgtccctggaatcaaggtaaaattttgtgtaatagtttagatggtaaccatcctttttc

SEQ ID NO: 96924 - DNA, 354 bp, Heterodera glycines
  SCN-specific regions: Sequence locations=1-354
cgccatcgtcgctgacgatacacaacccaaacatcgaccaaataaacaaccgagcagagaatgagcgcggcgaaaattgtgccgatgagcaacggatccgtcgacggcacgacatgccattggagaagcaatgtttcatcactgtccatatgtagaaaattccgatgggaaatatgtgcaagaattgtcacatctgcacaaagcattaatccagcagaaaggagcgcataagttaatgactccttaattgataggaagagatttatggctaaacaaatggaatctttaaaacgaaatttgtcattagaccgggaattttgggctaaaccagaaccagaaaagccatgaattttc

SEQ ID NO: 96925 - DNA, 524 bp, Heterodera glycines
  SCN-specific regions: Sequence locations=1-11,67-160,183-247,276 -279,313-524
gttgacgttggggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattggcttgctatggctctgtgcttatggatggacaagaactgcaagcttatttcaatttcct

SEQ ID NO: 96926 - DNA, 517 bp, Heterodera glycines
  SCN-specific regions: Sequence locations=1-179,247-517
gccgctctaaactagtggatccccgggctgcaggaattcggcacgaggggttccattttccatccaaaatcaaatctttgacctttgaatttcaacccttcacccatgccatttgtaccttatcggctcaaaaccatggaggagcaacaacctctggcactgttctactaatgaccgggacaacatcagcaacaagcagcactaataacactattaatactaataataacaacaacaacggtaacagtacctgtgtgaaagggtcgtcaacaacgcatacggtaacggcgcctccatcggacatcagtttgacggagcggatgaagcatttgctgaacacgggcaatgacgcggatgtgcactttttggttggcagcgatgacaaaaaagagcttcttcctgcgcataaactgattttgaagacggcctccaatgtgttcgaggcaatgtttcgatttgacacggaaaacttgaaggcttcaggaaaggacccgcatagtgagataaagcctgtcga

SEQ ID NO: 96927 - DNA, 480 bp, Heterodera glycines
  misc_feature (417)..(417): n is a, c, g, or t
  SCN-specific regions: Sequence locations=1-480
tcattcgaacataatcaaaagtaacgaaaccacccgagcatattcattcctcaacccgccggacgagttcgatgagaagccgaagcacaacctgtaccgttggctgcacacaccgcgcaaggatggccgtccgaaaattgtgacaattcgcaagcggcgcaaactgcaatgggcttcgtttatgccaagcttgatcacgtttttcaacgcttcgagtactgtccctgtcaacttcctcgtcatttgtcacattgcatgccataccaacttccagaagtgaacgcgtgggagaaggaggcaaaccaaatgttggacaatttgctgtgcttcaccatcaaggacagtgacattgggcccgcactgctcgccgaactgatggccaacgaatgaggagggatgagaaggaagtgtgcgcantccaagcggaagatgaaaatattgtggatgaaataaatattcattgtaaatgtgccgatgggc

SEQ ID NO: 96928 - DNA, 261 bp, Heterodera glycines
  SCN-specific regions: Sequence locations=1-7,29-232,255-261
gaatgaattcctgacagaaaataaaaaacagagaatgacatcattggcattaggcggaattgggctcggaatgagtggcaatgagtgaatggcccgccacaaaaacattctccgcattcatttgattattctttccttcgctaatgctaatgcatcatttttgtccctaaaagtccattttttgcttatttgccctttcttttcctttttttgtcattattatttttttgagacaaaaaatttcaataaaatattaaatcg

SEQ ID NO: 96929 - DNA, 335 bp, Heterodera glycines
  SCN-specific regions: Sequence locations=1-144,168-209,257-335
tgattttttaaacatttttaattcccatcgttccttaaaatggcctgtgaatgttcctgctgcaaaaacaaccaatgttgtaccactaactgctgcggagattcttgttcatcatgccaatgccccaactgcgagtgccaaaagcaaaagggacagtgccaaccccaggggaagggatgctgtgcttagagaagcgaacggaaaggacggagagaggggagagggtgaagcagagagagagagagggagagagagaaaaaagggaccacagtgatcggaatgaccaatttgtgtgccaatgataagagcaaatgacaaacataattactaattgt

SEQ ID NO: 96930 - DNA, 547 bp, Heterodera glycines
  SCN-specific regions: Sequence locations=1-513,535-547
gtggattaagaccatagcatcttgctgcacgtccttttttctcctaattattacaaagttttacacacatttttttaatgagttttccttgcggagacggatggcggcagcaaatccatccggaggaacagctaccacaatacgagcagaaatgtgacattgaaatgcaactggacactctcaaacaaacggtgaaggcaaacacaaaagcatgtgcagagtcggcacaacgaatcgaagacttgcaaagttttcgtttttattacctcatcttggcattcttcgcattcttcatcctcatcatgtctgcaatgttcctttatacacgaattagcttactaagtgaccggatttatacccaaattggcaatgtcgacaacagaattcgagatcatcttgacaccaaatctgagcgtctttatgccaaaattgacgctttatctgcccaagttcaacgacttgggctggcaatggctacgctttcgaatggaagccacaccacaacttgatgaaagaggacaacgaacgacagaagaagagaaggcat

SEQ ID NO: 96931 - DNA, 530 bp, Heterodera glycines
  SCN-specific regions: Sequence locations=1-27,49-500,522-530
tccccacaaaaatgtccaatttgtttgtggcttcttctgctgttgtttttctccttctccaattgcatttcgtcgtcactttcgcatcatcctttgaaggggcgccgccaaaagcaaatgaagaagcaatgccaacgacgggggaacaagacggaggtgccgaatttggtggaagcaagcagaaaatggcacggaaaatgatgcgatacaatggcaacaattttgacaaggtgtccgtcctcttcattcgacgtgaaatggcactgcgaaaacttcagctccaaatcaacgttttggagcagcaattggccaatgctttgtcgtccgctttcgccgccggctgtcccccctccggcgtttcttccgtttccgatggcatttcgcaccgacgccatttgccaatgccccgcgagtgaaagtgcgacagagaaaggaacacaacccgatcagtgaacgcatcagatgagaaaatatcagaaaagagtctcccccccccatttttgatcatttgagtaatttataatgtatcc

SEQ ID NO: 96932 - DNA, 549 bp, Heterodera glycines
  SCN-specific regions: Sequence locations=1-252,278-291,313-415,441-549
cagttctgtagccgcatttcgcttttgtcagttttcttcgtccttattcaaagcacagtgtccgcagcgcattttttgcagagccgcatcgactgtcatgtcgacctctgaagaattcaaaaagcagaccattgtgccggatgtggtcacgaaggcgccggaaaagcgggcaaaagtggtgctcgacagcggagtcgaggctaatcttggcaacgtcctgacgcctacccaagtgcagaatccgccgaaagtcacctgggaggccgaggctggcaaactgtactcccttatcatgaccgaccccgacgcaccgagtcgcaaggagccgaaattccgcgaatggcaccactggctcgtcgtgaacattcctggcaccgaggtggacaagggcgatgtgctaagtgaatatggttagttattttatttatttttttaattttccgttttaagttggttcggggcctccccaggacacgggtctgcaccgttacgtctacctgatttaccaacaaaagaacacaattaaagacaccgaacacggccacctga

SEQ ID NO: 96933 - DNA, 374 bp, Heterodera glycines
  SCN-specific regions: Sequence locations=1-146,168-374
tgatcagctttatattgttcgtcaaagcatttggaggaggttcaccaaagaaaaacaaaaaaatcaacgatggattggcacaacgcatgagcaaattgttgagcacgggcgcttatgcagatgtacaatttgtagtggaagaaggcgacaaaaaagagcttctgctcgcccataaggcaattctttcgcatgcctccgaagagtttgctttaattctcggttttgacacacaaaattcatcacattcaaatggaaaaatatctgctgaaacaattaagactgtgctggtcacagatgttacaattggggcgttcaaagtgatgctgagctttatttatacggaagggttgaagggtgataaattgagtgtttgc

SEQ ID NO: 96934 - DNA, 536 bp, Heterodera glycines
  SCN-specific regions: Sequence locations=1-29,95-536
cagtttaacaattgtccgtttcccttttgtctttttgctccatgtcttcctcccgcttctttgtcctccttcctctcctctttttcctcctcctttcgttcgaatgcgttcttttggctcccaatttgttctcctccaaaatcgtcgcttttggtgagagtggcgatgcgtttgattcgccgtcattcgccgatggcacatcgacggaacgcttttcggcaacggaaagcgacggaagggcaatggccaaacggaacagtcggatggtcaacgcattgagcaccattctgaacaaacggaaagaattgggcaccaatgatgcttttcgagttcgaatccgatcattggaccaaatgggcaatacgaattgctacttttcgccggttcagtgttatttctttgaggaacggtagaaaaaagtgaaccgacgatggaagagaagaaaagaattggaacagacaaaatgaaatgattgttttgggaatgagaagcgatgccctttttgtgatttgccaattaaattgcgactcagcgaa

SEQ ID NO: 96935 - DNA, 302 bp, Heterodera glycines
  SCN-specific regions: Sequence locations=1-193,216-302
caccggagatgctgcaatttcggggtcatctgcacaacaggcaaaaacgggcaccgaatcgagcacgagcaagccaaaggcgtgctgcgtctgcaaggagacaaaagggaagcgggacgaatgtattattctgaacggtgaagagaattgtggtcaactgatcgaagcacacaaaaaatgcatgagagaatatggatttgaagtgtgatgagagaatatggatttgaagtgtgatagctgatatacgtttcttgttttaatgttttagtattattgtagtaatctagtataaatggttgact

SEQ ID NO: 96936 - DNA, 362 bp, Heterodera glycines
  SCN-specific regions: Sequence locations=1-66,88-362
catcgcacccgtgctatgcttgtcaattttaatgatcggccaaatgccatgccaaactgatgccgttgctgttcatcccgctgttcgaacagcggtgagacttgccaatacaaaaggcggacagattgcacttggaattgtggcgcctagtgccctcccagctgctcggatggccaagcattttgtgcgttagcgtacgctgaggcaatgtgccaccagtgactgatcagagaaaggcagcaaatggctcgagtgatgggaaggatcggaattttgttgtaacaattttttcccaaatttgtagttttttcatcatttttaattaattttcggctttttattaaagttgggttggacaaaaa

SEQ ID NO: 96937 - DNA, 191 bp, Heterodera glycines
  SCN-specific regions: Sequence locations=1-129,151-191
ctaaactctgccccttctccaatttcttttggctgttagcttttgctttccgagtgatccttccgatgaattcgccgtgccttttcttccgtcaatgactcatccccaaaaggcaattaattcattaatttttcttctcccttaaatatatttgtgccaattgaggagtttaataaatgttgtggtgtaat

SEQ ID NO: 96938 - DNA, 672 bp, Heterodera glycines
  SCN-specific regions: Sequence locations=1-208,230-672
ctctgggaccgattgatggtgttggcttcgaaggtgcaaaaagtcatcaatctgtcgtccaaaatttcatctgtccagaacacggaccacatgatgcaacagccaacggaggaacagcgccagcgaatttatcaaactgataaagcaaagtctgcactgcttcatcttctgctcactgattgtctagcgaaaaatgatgaaacaaccgtttttgaccgttttaaaatgttaaaagaggaaaacaattgtaaaattgctccagagatgttcagcaatttaccattggcacgattattagtcaatttggaagggaatgacaatgagacgaggactcgcgtcgaagaagtcagaaatttgctctttcgtgcattgcaagtgcttattgacgcggaaataacgccatctgatgaattactctatagcttcgagcagcaaaaaatgtacgaagaggcgaagctaagcggtttgagcacattacaatggttggaacgtcagagatcattgaacaagaggggtaaaaagcggaagcaggaagtggacacgaaggcatcgaaaggacgcaaaatccgttacgtggagatcccatagttagtcaatttctttccccgcacccccgaaagaattgcatggacacacgaaagacgggacgagctggttcagacgttgtttatt

SEQ ID NO: 96939 - DNA, 619 bp, Heterodera glycines
  SCN-specific regions: Sequence locations=1-565,587-619
ttttgcttatcaaattggcaatgactgatcagcagaattcaattgacgggggatggacagagcaaaatgtgaacgacgaaaaaatcaagtctctcgcttctcgctcagtggccaaaataaactccgagtcaaacgatcgcttcagtcttttccccttggaggtcggaaggtcgaactgttcgaagaatcagtcaaacttggctgaccacgcaaactgtgcaacggaggatggtcagacagcgcgaaagacttttttggtaacgatttgggagaaaccgtgggaacaattcgagcagatcacttacaaactcgaataagaggaaacccgaagaaagaaagcgagcaaacagaagggggcggggaagtgattgatcacatcgcaataatcctgttcaaacatttaattatttccaatcggtaaaaaatggcgaaattatcacaatgtcctccttcccagctgatctgtcaatcgatggacgaaagattttcttgtcccgcattgatcacttttattgtcttccactgctgatcagtctgttttccatgtccctttccgttgggtacattatgttcaaaaattacaatttcaagacttacacttgataaaaatgaaaaattc

SEQ ID NO: 96940 - DNA, 459 bp, Heterodera glycines
  SCN-specific regions: Sequence locations=1-2,24-181,203-459
cttttcgtcaaaatgctttctccattcacctacgatccgttcaatcgccgttcgttgtggcctatgaccactattgttggcaacgtcctttcgccattccgccaattggagcgcgaactcgaccacttcttcgatgggatgcagcccatgcttcgtgaccatgttgctcagttgaacgtctcgaacaagggagacttcacttacaaggtcgatgtcagcggcttccgccccgaggagatcaacgtggaggtggttggcaatgagtttattgtcaatggggagcaccgcgagcagaacgacagtgggttttgttacgttgccagggctttaaaatttgctgagacaaatatcggagcttggtgttaattttgaggatttttgcttactttagcggcggagttgatgaaatatgaaaaacttatacttcaatttcgaaaattgtgtcttccatttgtttgc

SEQ ID NO: 96941 - DNA, 359 bp, Heterodera glycines
  SCN-specific regions: Sequence locations=1-101,123-359
ttttctgtttttttcgtttctccatgtccatgtgttgggcagagccatggaattcggctccaatttggccaacactcgtccaatcttttccgtctcctctttcaacaatgactataaaatggacagagaacatccgttcgtgaacgatttgtggagtttctacagcccaccgggcggcaacggcgaactgagcgatgagaatttgtggagcagtgccctcagccgacacctccttttccatatgaacagaaaaccgaaaaaatggtgaaaaaatgaaatttccaacaattgttgcaatttgagaagcgaaaaatgtcctaattaattgctgttaaattaatgaaagaattgaaataata

SEQ ID NO: 96942 - DNA, 150 bp, Heterodera glycines
  SCN-specific regions: Sequence locations=1-37,62-150
aaatccaaatagtacaaaacggaagttgcgaattgatcagaaacaaaagaaaaacgaagaatcacgcctgcaggccgatcagccgaattaaaatgactttttcatttcgtgtaaaataaattcaactttcttcaaaaaaaaaaaaaaaaa

SEQ ID NO: 96943 - DNA, 417 bp, Heterodera glycines
  SCN-specific regions: Sequence locations=1-417
gaagatgtcaaaaacggggctatccgcggcaattgatgatgaattcgaccctgacattgatctttcacagaggtccaggtcggattgggttggttcatttgctggtaatccgtccacagctccgacggtttatgcgatgttcaacaacagcgtttggacttttatgcttgtttacggcgtgacaggccgatttatttccgcaagtgttgtaagtttactcacgatgccagccactgctgctctgtgggtttgggaggctgatcgcgactacgaacgctgggaagggtcgcgggtgttacgtgagcgccgagttccaaaatttgtgctcccgcgaacgattttcgattggtctgactttgattatgctcaacagatgagaaaggctcctaccggttaaggaaaaagactatttaccta

SEQ ID NO: 96944 - DNA, 450 bp, Heterodera glycines
  SCN-specific regions: Sequence locations=1-235,257-450
tttttaagatgacacttaatccgcctcatttaactttgcgaggttatgagggtcacgattacatgggagacactttcaagaaaacgaatgattacgcccaaacttggttcgttccgttgatgaggggacaatctatagacatcagacaaattcctggcgatgattgtggattcttcgaagatcaatcggaatgtgtttcgcgcacaaaaaagaataaacggttctggaagatcagagatgttcgcttcaaaaaatggctcagaggtgaaacgccacacattttccgaaccattggctgactatttgaaatcggttcatggtgctccgacttcctatccgactggtcatcgtgtgaagaaatgattagattagatatatcgtgagattctggtttttaataggagtcacatatgcatatgtatatttctgcgcgataaaatgcttttgttc

SEQ ID NO: 96945 - DNA, 517 bp, Heterodera glycines
  SCN-specific regions: Sequence locations=1-32,57-422,470-517
cttcaaaacagctcctctcatcgctgttgctcttctgatccattttggatgcttaatgtttttgatggaagtgaacggtgaagtccatgttcaaagctctctggcaccaagtcatcaagtggtaaagcgtcattgctcttgtggtggcagttggggcggttggggtggcggcggtggagcatgctgttcctgtggccaatgcggcaacatgggcggttacagcagtggcggatgttacggttgcatgtccggcatgggaggctgttactgtggaaagaaaaaatgaaaaatattttttttcattaaattagaagaaaaaaatcggaaaatatttttaccagaacgattaataatttgttataatgcatttcaatgtacttataatattctttctatggatacaaataaagaggtgtaattttaaaaaaaaaaaaaaaaaaaaactcgagactagttctctctcaagggcgaattccagcacactggcggccgttactagtggatccgagctcggtac

SEQ ID NO: 96946 - DNA, 384 bp, Heterodera glycines
  SCN-specific regions: Sequence locations=1-339,361-384
ctttttgcactcgaagtgcacccatcggctggcgatttgattttctttttccgtgagaaaaacggcgatcggaaaacgaacgccgacaaaaatgaaaatacgcaggaacgcgatgcgatctgtgaggtgtcgagcaattccttcgcggatgcatttcacgtcggaataattgtggagcggcgaacgcaaaatcagtgggcggaggaggacaaaacggagagaattgtgcacgcggcacgggacgaggcaagcagagaagcagaaaattaagctgaagacgcaaaaacacaccaaaacaacgaaaacacaaattaaccatttaaaatgaattccaaatttttgagtgtttattttaattttcaggctaaaacattattctagcac

SEQ ID NO: 96947 - DNA, 494 bp, Heterodera glycines
  SCN-specific regions: Sequence locations=1-436,459-494
taattgctgacaacgcaaattgttagaacaaatctctctcttcgactgccgtctcgtcaaaagaattttgggcccaattattacacagaaaaacaatggtggatcacgagaaaaataaagaagttattcatgcgatttcctatcttggaaaggacccttattttgggtattctgttcagcactttggccattccttttattactcagaggaaaaaactcctcaatatgcgcaacaatctttcggacgacgagtgggccgactttacgcaaaagcacaaagccacgatccttgcaagactcaaattcggccaaaatttgcacctcccattttacaacaaagacaaagcgttggaacaggacgagcaaacgcagaagacattcatggacagctgaacagaacggacgaaaattggcggaatgaaatttaaaagtcaaagcaatttttgttttattattttgtgttataattttggcccttttgagtaaaatgagat

SEQ ID NO: 96948 - DNA, 473 bp, Heterodera glycines
  SCN-specific regions: Sequence locations=1-325,347-473
ccattctttcttccgatggatccctccactgctgctcttccccctatgcgtttttcttcgacctctctcgtccccgacccctccgtccaatttttgctcgatttggaaaccaatgcgcgttccattgcctgtggcattgacatggcattgcgcgacttgcggggctctctccgtggaatgagtgatttgacttgtgagtctgcaaatgtttttggctctgtggtcaattcgacttgcgattcggtcgacgcgtccattcgatcgatgtatacgatgttagcgaagactgaggagcttgacgagtctttgcggagcattgagaagctgctgcagcagatcaaagacaccaaaagacttctggacaaattcgaagagcacattgtcgtaggaaatcagtgatcagaaatgatttggcattttgttttgaatttttatccatttttatcgaacaaatcaataaatggatgaaaggg

SEQ ID NO: 96949 - DNA, 563 bp, Heterodera glycines
  misc_feature (476)..(476): n is a, c, g, or t
  misc_feature (495)..(495): n is a, c, g, or t
  SCN-specific regions: Sequence locations=1-296,320-563
gctacggccagcagcagggccaagcctaccatccccggggggccaacccataccaactacagccgggttggaatgtgccgccaccgccccaaggacaacagccgtataatgcgcaacatttcgccacaatcaccaaaagggacctgaccagtatgcttggcattgtgttcatcgccacaatgtgtttggcattgttcggcttggttgtgatcattgtcggaatgttcaccaatgtgcgcattcttttcgttgtttacgccgcgattggggcatttctgttcatgatttggttggccattgacattcagatggttatgggcggtcgtacctacgaaatttccccggaagagcacattttcgcgtcgattactttgtttcttgacatcattcagattttctggtttcttcttgcaatttttggagatcgcagaaactgaccttggcatcgcgacatttgcaacacataaacaaatatntgttgatgcttttcagttntacattcttatccgatatttacgcaatttaattgtgatctgaaaatattaatcacttgagaaatatat

SEQ ID NO: 96950 - DNA, 521 bp, Heterodera glycines
  SCN-specific regions: Sequence locations=1-521
acaatggcgaagagccgggcttataaaagcgcttttgtgcggagaggaattgacgtggactatccccgacgaacgtgagcgcgagctcatggcttggcacgaggttggacacggagcattcgccgctaaagacaaagacgcgattccacttcgctacttgtccattttgccgatgtacgattccatcggacagacgtattgtatgcccaagtcagatgcacaaacaatgtcagtggcgcaagtgcgggcggaaatcagcggatttttggccggaacgatagctgaaagaatgagttatgggagtaataaagttacgacctcatgttcttcggacttgaaaagcgcctatcaggccgaacagcaggcccagcaaaaccaggacgaccaaaatcatggcggccaggaggccacggacgaagaatattgccgttaacagtaaaggaatggaaaaaaccaaccgaatgatcatcatacatttttatttattcgatctcaaaaaggataaaaattacatgtataaa

SEQ ID NO: 96951 - DNA, 234 bp, Heterodera glycines
  SCN-specific regions: Sequence locations=1-208,231-234
tgcgccgttctgtgctttttgcttctcatcgaagtcgcctttgtgccaattgtgaacagtgcgccacttgagcgggaaaagcaaatgctgcggcagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaaaa

SEQ ID NO: 96952 - DNA, 175 bp, Heterodera glycines
  SCN-specific regions: Sequence locations=1-114,136-175
ggtagcgagggcaaaattttgactggagaaacaaaggaattcggatgaaatgaattatttgcggcaagtgggtgagattttgagtcgcggaacggtgcgcactgacagaaccggcacaggaacaatttccatttttggcatgcaaacgcgctatagcctccggggaagtcaatcg

SEQ ID NO: 96953 - DNA, 205 bp, Heterodera glycines
  SCN-specific regions: Sequence locations=1-205
ccgtgatttttctcacgatgaccacattaacaacgctattgggaccaatggcgacagtaaagacgcatccaaaagaaaggacatctgccgtgattttctgaataatatttgcagcaggggggggggcaaagggatcattcgggaagccactcaattttttgtatgtttaatcaatcacctgcataaattcaattttttgaaaaaa

SEQ ID NO: 96954 - DNA, 174 bp, Heterodera glycines
  SCN-specific regions: Sequence locations=1-148,171-174
gatttgatgggccattcggaccgcgtgctgtgcgttgattggacagtgccgagccgtatttgcagcggttcggtggactcgacggtgaaagtgttctcacatgggaccgaagaaaatatctaattgtttatcgtgatatcatttgttgttttattatagttaaaatttctgtac

SEQ ID NO: 96955 - DNA, 382 bp, Heterodera glycines
  SCN-specific regions: Sequence locations=1-63,85-130,152-382
catttattaaacaaaaagaaataaaaaatactcaaataaaattgatgacatttttgcggggaattaattaatttattgcatttttaatttgtataccaaaatctgtagtaatttttgcgtccctttcattcagttggagaaggacctgtccaggaggtacaacgggcgcgaggtgtacatcatgggcgagatcaacgccgtgctgtacgggagctgaacgcactcgggcggcacgcgcgcctttcgcttctgtgccgtccgtcgttttgtgtagcgcgtgttttgtgttctgctcatttcccactctttcacaatatgtgtttttgttgcattttatcattgattggcggagggtcataacgaaaaaaatgtgatgcgattt

SEQ ID NO: 96956 - DNA, 175 bp, Heterodera glycines
  SCN-specific regions: Sequence locations=1-116,142-147,170-175
tttaatcgagagtcattgccccgttaatcatttgtaacggtacccactcgggcaaataaccttctcggctacaggtgtctaaattcaaatgaagccaaaagatttttcaatatttcacagcctttacaattaattttatgctcgttgattttgaaaaagatgaaaaaagactgac

SEQ ID NO: 96957 - DNA, 146 bp, Heterodera glycines
  SCN-specific regions: Sequence locations=1-146
tctttttgtgtcgtacttttccgtctttgagttttggtgcgcagttcaacaaaaatctgttcgccgcttcacaaaaaaatgctgctctaacgaaacatttgcacgtctctcctttccgttacgccgattcttcggacgatggcaaa

SEQ ID NO: 96958 - DNA, 177 bp, Heterodera glycines
  SCN-specific regions: Sequence locations=1-177
ggttgaaacacttctcgggaaaatgtcggacaaagacgcctttcatttgcgcaaggagatgaatgatgttttgacgaaatacgaggccagaccacaaatgagagggattattggggaaaaacccaactcgtactgccccaacaaaagtcgattgaacgcataaactgtatttgagcc

SEQ ID NO: 96959 - DNA, 153 bp, Heterodera glycines
  SCN-specific regions: Sequence locations=1-32,54-64,87-113,137-153
cctgacgacaacactcggaatggtccacttttgaggtggcgcagtcgaacgctttgctcagctgagcagacggacaatgggagccgagcaaagcgattagcagctgaaataacaaattatttttaaaaataaaaatgccattgctttttaaaa

SEQ ID NO: 96960 - DNA, 220 bp, Heterodera glycines
  SCN-specific regions: Sequence locations=1-220
aatttgcattcgagcagcccatttccagctttcattggttcgttcgtttccgtgactatgttaaggtgactgggagcgacagtggcgaaatcgctttgtgggacattagaagtggcaaaaacgagttgaattcatgaagatgcgtttagtgatgacgaagatcggtgacaattcgcaaatctgtttttttcttttttatacactaaactttcattaaaaa

SEQ ID NO: 96961 - DNA, 150 bp, Heterodera glycines
  SCN-specific regions: Sequence locations=1-150
ggaaagccggcacattgttatccctcagaaggcatttctctcaaaaccatccattacgatatttgctgcgactaattctcttattcgataaattctctaaaccattcgtagtttttccctggtttcttaatgatgaactttgttttccaa

SEQ ID NO: 96962 - DNA, 187 bp, Heterodera glycines
  SCN-specific regions: Sequence locations=1-187
gccatttggagaccattgacgcgttggatatttacccgaccggtgccacggaggagcaaaagtgccggtgccgtgagaagcgcaaatgcatggtggacactgtgcaaacgctgctcaacgaaaatgacaaatacacattccgactagaccaataccgcaaatcgttgttgtacaaataaattattat

SEQ ID NO: 96963 - DNA, 184 bp, Heterodera glycines
  SCN-specific regions: Sequence locations=1-15,37-184
gaatttgtcacctgaagttttgtgcttggggcgggggcggcgttcgctgtgttcgttctttggacatcgaagttcgttcgaggagcaactaattaaactacaaagtcaaattgtgctgattatgaccatttttgtctcgcatataaatgacgaaattagaatgctattaaagcggtcccttttt

SEQ ID NO: 96964 - DNA, 221 bp, Heterodera glycines
  SCN-specific regions: Sequence locations=1-221
agtaaaaaaacacaggaaagtccattgcaaaggcgttggaggaaaagtagctggaaaaatgtgctcaacactttgatcacgcccgaccacacaaagaaggcctacgttcgcttagccgcagattatgatgctttggacgtggccaacaaaattgacattatctaaacacattctttttttattccgcgctttgttgattttcgggaataaattgttgtttg

SEQ ID NO: 96965 - DNA, 188 bp, Heterodera glycines
  SCN-specific regions: Sequence locations=1-188
ttatttcttggttatgtcggtccatagtgaattggctcggtccaaaattttgacctgctcgaacaatacttctttttgtccacacttcgctgtctctgaaaattccttgcgattcgttcggaccaatggacggccaatggcccttttcattggtcgcaaaattggggtgactaaataaaaagaaattg

SEQ ID NO: 96966 - DNA, 156 bp, Heterodera glycines
  SCN-specific regions: Sequence locations=1-156
gagttatttcttctaagccattgtcggacgacaccgacagaagtgccgaagggagcagtaactctcaattggtgcagacatatgccaatgaaaacagcgaaggcggagctgacagtaagaaaaaaaaaaaaaaaaaactcgagactagttctctct

SEQ ID NO: 96967 - DNA, 214 bp, Heterodera glycines
  SCN-specific regions: Sequence locations=1-124,146-214
aacattctcaaacaaaatgactgagtttctatacattcgcatgaaagccaacgactgtccgttggtcgctcttatccgattcggcggtgggttttttatttgctgaaggagtgccggcgtggtcaaaattaaaaaatgacattctgtaacatgtggttggtatatactgtcggactcaactgtcactgtatgatggccaagcacgtagccaaaa

SEQ ID NO: 96968 - DNA, 276 bp, Heterodera glycines
  misc_feature (50)..(50): n is a, c, g, or t
  misc_feature (52)..(52): n is a, c, g, or t
  SCN-specific regions: Sequence locations=1-1,23-103,129-149,173-276
tcccccccccccccccccggggtgtgtgggaggtagacgacctcagaaancntcaaaaatttaaaacttgatgctttattcaaagttttggctccaccagacgaagaattcgaagaatggctcagagatcttaagcttctacacaccactcgtttttgtgactgtggcaacgaaatgcgctacaaatggattaaggaggaccggatattttttataatttgtggacccaaatcgcggaattgtacccaataagcacataaagctcgtttatttgaa

SEQ ID NO: 96969 - DNA, 192 bp, Heterodera glycines
  SCN-specific regions: Sequence locations=1-1,23-192
gacgaattcatcttttgatcaaatgatcggccataaaagtgaacgaattgacggacaaagcaaagcgaatgtgtgagaaaggcgagacgaactcggaaattagctgaaattgccggattgagaacggaagaaagcatcggaattgatacaaatttctccataattttttgactcaaaattcgaaataaatgc

SEQ ID NO: 96970 - DNA, 289 bp, Heterodera glycines
  SCN-specific regions: Sequence locations=1-2,25-221,243-289
aaggtggttctgatggtggtggtgcattgagtcaacaaagcacgtccacggcgcccaacagaagcagtgaggaggaaagcgacggtcgtgttgatgcatcatcatcggaggaaagcgacggtcgtgttggtgtatgatcatcggaggagcacaaataacttagttttccactctcatttggcgcctttgtttcactaattgaaattgttttatgcgcgggtgcttttcttttctcaaaaacctcattcatttcatgctttttcgatgaataaaccgagttagcacaaaa

SEQ ID NO: 96971 - DNA, 124 bp, Heterodera glycines
  SCN-specific regions: Sequence locations=1-54
tattattgtatttgcttagtgcgtaaagtgtagatataataaatttgaactgctaaaaaaaaaaaaaaaaaaaaaaaaaaaaaaaaaaaaaaaaaaaaaaaaacctcgaaactagttctctctc

SEQ ID NO: 96972 - DNA, 178 bp, Heterodera glycines
  SCN-specific regions: Sequence locations=1-178
atgtgcccaactttttctccacgttgcataacgccatgcgtctttccgcactgctcaacgttcatccgtcgctttgccagtgaaaggacgagaatgggatgagtcagacccatccgactttaattgattctcaatttgacttaaatgatctgtttatcttttactgttttgttgtttt

SEQ ID NO: 96973 - DNA, 192 bp, Heterodera glycines
  SCN-specific regions: Sequence locations=1-192
gaaaaggaacgtgatattttggtttcactcgcatcgaaacacagaacagttccgtatgacgttttgatgaatgctctcaaaattgcaaatgaaagggaatttgaagacttcatcattgaatcgatttatcaggatatcattcaggtaaatgatgggtttgagataatgatggagaatctgggctccaaccac

SEQ ID NO: 96974 - DNA, 520 bp, Heterodera glycines
  SCN-specific regions: Sequence locations=1-437,459-479
tcgggcacaaacgctacactggtgaagtgatgaacggaatgggcatggaccggcacctgttgggcatccgtttgttggctgccgaacatggcgtgccgttgcctgaactgctcggctccgacatttaccaacgattgctgcacttccgtctgagcacctctcaactgcccacgtcccatgttttgcccatgggttttggcccgtccgcgcccgactgttacggagtgtgctacaacccgcaggagaaccacatcttcttcatcatcacggcgttcaacgactgcgcagaaacgagcgccgaacgatttgccaatgcgttggaacgtgccctgctggacatgcgcgacttggtcgactgggccgggcgattgaagggacgggcaaagctttgatcggcaaagtctctccaccacgtcatctaactaaatctaaagccatttatttttgccttaatttctaccctcaaattgcccaattgctatataattataaaatgtaattttaaattatgtataaattt

SEQ ID NO: 96975 - DNA, 588 bp, Heterodera glycines
  SCN-specific regions: Sequence locations=1-46,68-255,277-461,505-505
tggcatttagaaaccagtaaacaaaatgcgaacccaaagcattttctcaattttcttccttctgcttatatttgaagtgatcaactcattcccatcaaagtcgagtgaaagcggcgaaccgcctgcaaatggagcagaagtggcgcaaagtcgcaagaaacgtcaggccgaagaagtgaccactgaagagccaccatcagaaacaaacgatgccgaaggtgccgaggatcaccaatctgcggcagcgggaaatggaaaagcaccaaaaaataagggcaaaaagaacaagagcgacagcagcgactcgtcaagttcgtcgagttcgtcgagcgaaagtgacgagaagaagaagctgaagaagaagaacaagcactgagcatcggtcgactcactaatgaggccgcttaattggattggggtcattagcgaagagtggactgtcacaattaatgttgtcaaaattgtaaagcttttattctttgatgggaataaattttattagtggaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 96976 - DNA, 535 bp, Heterodera glycines
  SCN-specific regions: Sequence locations=1-364,386-535
ggtggaatatgccatgttggagaacgaaataggtgtcaaaatggacgaactgcagggactgataatggcactttcgtattcccatcagattgtcaacatggcggtctcaatgcccgagcccgtgtaccaagcggacgaattggccaagcgagggaaaaataattttgccgcattaaaacggttcaaaccgaaccaagtgccgaaaaaggagcaccgacttttggcgaaaaaaggcgcaaagcgacagaccatttcgctggttgaccaccacgaattgaacagaattctttcatattggggcgacggaactttcgtattgtctaatcgtttcacggcttaaattctaacgacgagtaattaaaggaataattttaatatttctgtatttgttcattcattcataatttttgacagatcattttgttgtttttaattctcactaaaagagcgtatcataatgttctattattcattctcacattgctttaatccattgttttgcattttgacatccgaaataaaaattgtccaagaa

SEQ ID NO: 96977 - DNA, 400 bp, Heterodera glycines
  SCN-specific regions: Sequence locations=1-273,327-371,393-400
aaagaaaaatcctattgtgaattggcatttctctgtttaaaatgcgcttcgttctgtccctcgcccttttggcacttttcgtcgtccaatgctccgccgacgactcatcgccgtcctcagaggcagctgatgagaatccctctgctgcccttgccgctgctgaaccatcagcggcaggcgacggagtgccgccgccaccgccgtcggccgaaggggcggcagccgaacgaaagaagcgcagcggagggaaagtcgcaccggcactaatcctttgaagaagccgaagaagaagagaagaagaagcggaagaacggaaggaagaagaaactttgaaaatttggtagtgatttatgacattatgtgaaaaatcattttgcaataaactgtgaaaagaaagaat

SEQ ID NO: 96978 - DNA, 273 bp, Heterodera glycines
  misc_feature (135)..(135): n is a, c, g, or t
  SCN-specific regions: Sequence locations=1-273
aatcatagcgagttgcgactacgatgaggcagatagcgaatggagcgatcggagaagggtagcagccagcgagtggctagggccagcgattggtgactacaaggaagaggacatggcgatcgaagaaccaacagnagtgggcgatcactacgagtgctgggcggggcgaccagcgattaatttctctctctcacctcacatgcattttttgctttgatcagtcaatcaaccaatcccaatcaaaagtgcattttcgataaaaatttttccatt

SEQ ID NO: 96979 - DNA, 571 bp, Heterodera glycines
  misc_feature (562)..(562): n is a, c, g, or t
  SCN-specific regions: Sequence locations=1-249,272-409,432-440,480-571
ttaaagcccttttttaaatcggaaatgaatcccaacggttttttctttgttttagcggtgctctttcttgtcaaagtcgactttttacagtgcaaatacaatgaaccaatggcacggcaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagaaagagagaggaacagcaaaattctaatcactagtgatcactgataattgccgattgattgaccggtacgactcatttggctgattgaagttnttttatggc

SEQ ID NO: 96980 - DNA, 551 bp, Heterodera glycines
  SCN-specific regions: Sequence locations=1-245,268-405,428-436,476-551
agcccttttacaaatcggaaatgaatcccaacggttttttctttgttttagcggtactttttcttgtgaaagtcgactttttacatggcgtttacaatgaaccaatggcacgacaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgatt

SEQ ID NO: 96981 - DNA, 283 bp, Heterodera glycines
  SCN-specific regions: Sequence locations=1-49,123-182,204-216
ttttaccctaaaaaaaataaaaaaacaaatttctaaagacttctcttggtattataaaaaaaaataatttttaattttttaataaattattaaaaaaaataaaaaaaaaaaataaaaaaaaacattcatcctcgaatccattaaaaaaactaattaatttgctaccttagaccaatcacgctaaaggtgcctttaaaattaataatcaagaggcagtttaaaaaaattaaaaaaaaaattaccaattattctaaaaaaaaactttaagaaaaaaaaaattaat

SEQ ID NO: 96982 - DNA, 368 bp, Heterodera glycines
  SCN-specific regions: Sequence locations=1-347
gagagaattgggaaggcgttggacgagctatgccaagaaacggacaaaacgaatcttttgggggcgacagaataacgcaaacggaatgccataacaaagtgatgcacactttcaacaaaatttgttttaatttctcaaagagtccgtacgttatgaaatatgcaaaaacattggccaatttgtgcgagcgaagggcggacacggcacaaatcgtggccattttgaatgaacaatgtgctcaaatggaaaagatggaagttcattactcaaattaattaccaattgaagagataattggttcattgaaacggacgatgcgatgacgtcatccattcatttatcatttggataatttgttaaataaaata

SEQ ID NO: 96983 - DNA, 291 bp, Heterodera glycines
  SCN-specific regions: Sequence locations=1-210
cgtttccctaaaccatgatgccctcgtcgccatcctccgcccccctcggagcaaatgttttggtgaccggcgccaaccgcggcattggccttggcattgtcaaggaaattttaaaaactgacggcatcgtccatttgttagccggatgccgaaacccaagccaagcggaggtcttatgggaatttgtggattctttctgtttcgtagagctaaaatttaaaagattttatttcaattaattttctgtttaaaaatttatttttgcaattttttataaaaattagtaaattt

SEQ ID NO: 96984 - DNA, 513 bp, Heterodera glycines
  SCN-specific regions: Sequence locations=1-59,81-222,244-415,438-513
ccactgaaattcgaatcccttccaccgcaatgagttcattttcatttccgtgggcgacttttctgtttttctccctaatttcttgcctaatttcgctgacagaggccaacccgaagtttctcttgtcctgcaaagtaatcgacggcatttgccaaaatgacgaactttgcctggaagaaatgggcattcgtttccccgactgttatttggagcgcaaaattgattttctccaaccccaaaaaagcgcactaaatccacgccattcactgaaggggcaaatggaccacaacgatttctgaaaaggactccagcgatgaaactgatgaaggtgctaatgatgaaagatcggattccggtgggtcggagatgagcggagaatgccaaacgaataaaagtgaggatgagacgagcaaagacaaacaaataataatcagaaattgccacctcaaacagtccattcattctgtgcaaaaagacatttagaggcgaatgtttaataaatggaagaatcaa

SEQ ID NO: 96985 - DNA, 509 bp, Heterodera glycines
  SCN-specific regions: Sequence locations=1-346,368-433,478-509
gacgagtgctgcgagcagtgtgttcaacgacgcgtcctccgtcagcagcggagggattgtcgagcgtttgtggggcgacacggagactcccgaagagggggccgggacttcgtcgccagagactttggcgacgatggcgatggaattccgcagagacattgtcatgggtgccattgttcgtctgatacttcgcgctttttgcgattttgtgcgtgtgcagaaattttcacgacacggttttgagcagctccaagttgactttgcttatgtccgtcaaaagctttggtatttcgtggccgatgagcacatgttgaacacgtgcattgaggacattgtcacggctgcggtgaaccaatgtgcccagcccaaattgttggatccatcggtagttaggagaatttgtgaagaaatgcagtgatctatttgtatgtacaattaaaattaaattaattaattgttcactttgttttttattttgcttacattaaagttgacaaggattaaaaaaa

SEQ ID NO: 96986 - DNA, 829 bp, Heterodera glycines
  misc_feature (811)..(811): n is a, c, g, or t
  SCN-specific regions: Sequence locations=1-829
gcaaactatctgaaaaacccttacaaactctgcggagattattacttccagccttgcacgtttgttttccgttgtgatatttgttgggcaattgtgactaatttaggcaggacgttttggagccaactatgctgtcatacaaaatgagctggattttggacaaagttaagaagaaccgttcaaaaccaccgtctacgattttcatcattcgcgatggtgttagtgagggaatggttccgaacgttagttgggctggaagaatcacgacggattgtaaaagtgtgctttagaacattcacgacgaatttccttcctatgtgaaggcgtgtaagaaatatgacccgacttgggagcccaaattcgtctattgcatcgtcgacaagaatcacaacaaacgtttcttcgttaaggggcagcaacaagtcgagaatactgctccaggggcggttattgattcgaaagtggtacgcgtcgacatccacgagttttggatgcagtcacatgttccgctcaaggggacatcaaaaatgccacaatacatttttcccgtcaatgatcccaaggccaacaacaacgaattgcagggtttcttgcttgctctctgctgcagctggcaaattgttacgctggctccggctttgccaactcctgttcgtcaggctaaagaattggctaagcgtggtcgtgccaattttggggaattgaagcgcactccacaatatatcccgcgcgccgagaaccagcaaatcgactaccagcagttgaacagacgcctctgctacaatggacatattttcgcggacactcgctntaatgcatgaaggatggg

SEQ ID NO: 96987 - DNA, 290 bp, Heterodera glycines
  SCN-specific regions: Sequence locations=1-88,110-290
gctccattttttcctaactgaaaaaaaactaggtaaataattaaaattatgcttatatgaaaaacagaggaaaaagcaaccaaagattttaaatctctttgtattaaacaaattaaagaacaaaaaaaaagtccaataatagcaataaacaaaaaaaaaaagaattactaaataaaaaactaattaaaaatcgactaaaaccatgaaccccaaattttaataaaatcccagctaataatatactagcaacagtagaagcttcaacatgtattttaggtaatcaaaaatgt

SEQ ID NO: 96988 - DNA, 161 bp, Heterodera glycines
  SCN-specific regions: Sequence locations=1-161
cggcgaaaattgtgacgacgaagaaatgttagggaaaagacaaagcgcaaaatgggaggaaaagcatgagaaaatgaaagagtggagaaaaagaacaaagggaaggaaagacaaagaattaatgattatgataagagacaatgactgataaagtttagcat

SEQ ID NO: 96989 - DNA, 480 bp, Heterodera glycines
  SCN-specific regions: Sequence locations=1-64,86-88,112-318,385-480
ggaccaaacagaacgaacgaaccgaacactctcaaccccaccgcttctcttggcccatcctcacaaaatgtcttctcttcagcctctctttttcgccgctctctttttggcagtcttttgtctctgcgccattgcaatgccggcacagcccgaagggccaatgttcgaaggcgggcaacatcaagccgaggcggggcgtgccaaacgttggagtccgtattactacggcgcatacggcggatggggcggcgcttacccttacgcctcgtcgtactacggccacgcttacccgtactattcgggatattggtggtgaaagacggacggacggacgaacaaatcggaaggacgaaaagaaaggaatgaacgaaggacggatgaatgacgagaaaagcacaatttaatcttacaacgcaaagaaatgccaacgaacgttcgcgcgaaataaattcttttgcattaaaagaaaaagaagaacca

SEQ ID NO: 96990 - DNA, 362 bp, Heterodera glycines
  SCN-specific regions: Sequence locations=1-27,50-71,116-265,308 -322,344-362
ttcgttcattccttccattttcctgtgttctaaaccttcatcaattaaaaacaatgcctttcctccgctcgcttcttcttccttccgttttgcttcttcttcttcttctgcttctgtccgtgtctctttgctccgcgggggtcttcgctccgctgcgtatgaagcgccaattcgattggtttggcaattcgatgggtgccgcgtggcgccggcttcggaggcggatgggtgttcggcagaagatgaaccgttaaaggcgccaaccaattaataaaataataatgcacaataataataatatttatttcatttgcccccgattccccattttcaaatgaataaattatatattcaaaagaaaa

SEQ ID NO: 96991 - DNA, 177 bp, Heterodera glycines
  SCN-specific regions: Sequence locations=22-177
caacagaagaagaaaattgtcatcgatgaggacgacgaatgacaatggcacagaacagcgaagggagtgacaatcggcgatttccccaaatgggggagggttttttggcagaagtcgaaaaaatgtcaaaatatggttttttgtgctcaaaactttatgattaaaaaacgcggccag

SEQ ID NO: 96992 - DNA, 465 bp, Heterodera glycines
  SCN-specific regions: Sequence locations=1-221,255-255,285-317,339 -395,417-465
ttcggcactggatggcgcaagaatcgcgacgaggccaacaaaccgatcttttgggatgggaagaatgagggcgggaaagtgatgatgcacattcgccatgagctgaaggccaaacactcatggactggtccacaggaggaagaggagtccaatacgaaagttgcgcgagatgatgcggaacgtgtggcgccgcattgacccttcgaaacgtgccatgttcggcggtggccgctcggccggggtgctttcgcacgacggaggggcgcgtggcgggcgcggcggtggaaactttcattatcgcaaccattagacgaaacatttggcattccaaagaagagctttttattattggacattttcacattattcaacgaaaggatgagccaagttgtcaccacattatgttattttctggtcaaagactgactgttcaaaacgaaaactgctgaataaactgtgccaggg

SEQ ID NO: 96993 - DNA, 528 bp, Heterodera glycines
  SCN-specific regions: Sequence locations=1-30,52-183,206-484,508-528
ctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcgccagacagtacaaaccataaaaaagaccataaaaatgagcatccaaagtatgaagcagaacttatatatgagcaaggaaaaccgtcgccagacagtccaaagtatgattccccaattttagccggttcatctggcagtccgaaaaaaggaaaatcgccgaatgccgatccgaaaaaagctgcttcacaccttgtgccagtaacaccagggaaagtatgatgagcaaaggtaaccaacagaaccatgctaccggttgccaaattttgtaatcattagtcttaaaatggtgaagaaactgtgtggaacgatgatgccaaccatgaacaaacccaaagctgttgtagtagatgtagaaaa

SEQ ID NO: 96994 - DNA, 551 bp, Heterodera glycines
  SCN-specific regions: Sequence locations=1-400,434-551
ggagaggtccatgaaggcgttgattggcaccgtcgacgaactgaacaaagcggtgaatgcctacggcaaatacacggtggaaaagcaaaagtacgacacaatgtacaacaatctgatgcagaagagacaaacggagaacgaagcgcggcaatcgcgccggagaaccgccgctgacaatggaggacataaagcggcagctgaagcagccgcaaatgcagacaaagtacggaatgttggacttgctgctgaacgcgctggacaccgacgcattcacgacgtaccaaattcagacgaccaacgaaaacgtggccaaattgcacctttcccaagcggtctctgctcagcccgtcgtcgccgcctcttccgctgccattggcacttccgccgcaaatgcgcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtttcg

SEQ ID NO: 96995 - DNA, 155 bp, Heterodera glycines
  SCN-specific regions: Sequence locations=1-30,52-155
aggaccaatggaaccaattggaactgatcggaaggaaatgccaacatcgggcagagatcaattgcattttaacactttgataattcttctgattactttatgattttattttcctttaatttgataggtttaccaaatagaaaagcattgctaaa

SEQ ID NO: 96996 - DNA, 197 bp, Heterodera glycines
  SCN-specific regions: Sequence locations=1-197
aaatccccgtgaccgaccaaaacatccttttccccttccactgctctagtctgaacacttccgcacattccgaagttctgtccgattaaacattcctatttgagctattggatttgaatgtctacgctttggggggcttttcgataaacttgggcgcagtgttgtacagaaattgacgataaaatgttaattcattt

SEQ ID NO: 96997 - DNA, 502 bp, Heterodera glycines
  SCN-specific regions: Sequence locations=1-123,145-340,362-502
aattaattggaaatccaattcaatttttgagtataaaatgaactgctccttcttcctctgtctcttcactgttcagctgattctgctcaatttcgcagtcgaaggaagagaagatgatgaactgaagagaaagaaacgcaacacggacgtggacgtgctcggcctggtaaatattcacgcgccgtcgcgaaagaatgtgaacgtcgacgttggcggagaagaaagagaccgaaatgacaaattggtcaatgtgaatgtgcagggacacaggaaaaatgtgaacgtcgacgtgggaggagggcattataatgagggaaaagtcgtaaaatacgaaagggacggagagaggggaagggaagtgaacgtggacgtacgagtgccgaaagtgaaggtggatgtggaccgagaagacggatatccgaagaagaagcgagtccatctgaaggtgctggataaactgaggaagtacgacagcgaagaaagcggcgaacggaaacggcac

SEQ ID NO: 96998 - DNA, 631 bp, Heterodera glycines
  SCN-specific regions: Sequence locations=1-66,88-631
gactctttataccgcggaatccaataaaatttctcttaataaaaaaatactattcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaaattatttctacaattcataccatccacaaaaacaattgat

SEQ ID NO: 96999 - DNA, 489 bp, Heterodera glycines
  SCN-specific regions: Sequence locations=1-51,73-449,473-489
ggacttcattttcaaactactctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaaaaaaccgtcgccagacagtccaaagtatgattccccaattttagccggttcatctggcagtccgaaaaaaggaaaatcgccacatgccgatccgaaaaaagctgcttcacaccttgtgccagtaacaccagggaaagtatgatgagcaagccttaaaatggtgaagaaactgtgtggaacgatgatgccaaccatgaacaaacccaaagctgttgtagtagatgtag

SEQ ID NO: 97000 - DNA, 501 bp, Heterodera glycines
  SCN-specific regions: Sequence locations=1-53,75-207,230-461,485-501
ggacacttcattttcaaactactctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaacccgtcgccagacagtacaaaccataaaaaagaccataaaaatgagcatccaaagtatgaagcagaacttatatatgagcaaggaaaaccgtcgccagacagtccaaagtatgattccccaattttagccggttcatctggcagtccgaaaaaaaggaaaatcgccgaatgccgatccgaaaaaagctgcttcacaccttgtgccagtaacaccagggaaagtatgatgagcaaagtcttaaaatggtgaagaaactgtgtggaacgatgatgccaaccatgaacaaacccaaagctgttgtagtagatgtag

SEQ ID NO: 97001 - DNA, 513 bp, Heterodera glycines
  SCN-specific regions: Sequence locations=1-89,118-193,215-337,360 -445,501-513
atttacgcattaccggaggacatcgttgaggtggattgatgatggatcacgggtttggttgttattttaaacgatggcccaggtcaaatccaaaatggtgatgacggtgttcgcgtgtatgatggcccttgactttatgccgaatatgaaggaagtgaccaacggaaattgactgactgtgaggcacaattacaataataaattaatttattttccctgttattctgttttattacgttgttcattcccggcttttgaatcgttgctcttttccggatctttctttccgaattttcaaagatatcctttcccctcgcgtattaaattattcgcttttaatttgctttatttgttttgctctttcgtacgttgtttctctgaagcgctcaaagcgtacaattttccctcatcgtcagctattacatatgtattacgaataccgatgaaaatattattgaaaattatatttatttaaataacagaaatataaaaggaaaatgttattaaaaaaaa

SEQ ID NO: 97002 - DNA, 743 bp, Heterodera glycines
  SCN-specific regions: Sequence locations=1-743
attcccaggactgaattgttccgattggctcagcggtacattcttgccggacggaaagtcgcagtggttaaatatgcgctcgacacgcgttacgacgagtcgcacgcatgcacacacgacaaacgcaaaatggaggcgattagtgcgacgaaaatggaagacgcattcgaggaaatttggcatttccatttgtgttagttcaaagacatcgtcaaatacgcgcaagaattggcaaacactggcaaaacagtgatcattgctgcactgaatggcgattaccggcaggaggttcaccgaagacgcacttttgattttaccagcccttccaaaatgtggcgatgctcattcctttggctgagaaaattgagaaactaagcgcagtttgccgctgtggacagtccgcctcattcacatttcgaatgtcggaatgcacgagttagaaatgatcggaggtcaagaattgtacagagcgttgtgccgaacttgtgtcgttgagtataatcatgtgaagcaacaattgctgaatgggctgaagaagaacggcaacgtcagcctggccaagaagagaaaggcatccgatgcgaccgctcacccgaccctccgaattgacactgtttaacaaacattctttttgacctaacacggaatctgtcattgtgctgaatgttctgttaaaagccaaagagccacataagagtaaattaatgacttttattttcggattatgccaaacaaacgaatcc

SEQ ID NO: 97003 - DNA, 463 bp, Heterodera glycines
  SCN-specific regions: Sequence locations=1-242,264-443
caaaatatgctcaaaaaggcaatcaaaagcggattgccggtgtttgtcactgagagcggcgccggctcaggcggaagcaatgcgcccgttaatttgccagtaatgaaccaatggtggtcccttttggagcagctcaaaatatcccaaatcatttgggcagtgcgcggagagggaaatttacaaaatccgctgaataaaaacacggcacccgcaaacattggacagaattgggcactaacggaatacggaaaagtggtgaagaatgtgttcacgaagaacgcaaagccgattgggtgttaaggggagagaatgaaaggaaaggaaacgaattacgaaaaagggacgaaaggaaaagccaaaggtacgatggaaattaacagaaatgagctaattacaataacaaatgtcacattaacgcatcaagaaataaaaatagccaattgaaaaaaaaaaaaaaaaaaaa

SEQ ID NO: 97004 - DNA, 352 bp, Heterodera glycines
  SCN-specific regions: Sequence locations=1-255,278-321,343-352
ccaaattgcggagatcattgccaaaaagcccaaatattgtggtgaacgctttgccaaaatgcgggataaggtttgtcgctggcccggcgaacagcagccgtgtcttcaactgcaccacagcatcaaagagcgtgttcgtacgaagtgctgtgcggagggctgctccctggaggaaatgaaggaggaaatgtgctgcatgacggacgcatgcctacggaggtgctacccgggaaaaggctaccgactgggctccgtttactgaatttggcacaaagggccaacagataaaatgacaaagatgaaattcacggcactatccagaaatcatttcttaacaagaaaggctatatcc

SEQ ID NO: 97005 - DNA, 194 bp, Heterodera glycines
  SCN-specific regions: Sequence locations=1-194
aggaaggcgaagggtgactgcaacacattttaaactatacatagttttattgttgttaattcataataagtttaagaaagatatgtataatctataaaagagcataaagcttatcaagttgacttgctaaacaattaaaacttataaaattgctttttatctaggcattatttgtattaaatctgattctgagg

SEQ ID NO: 97006 - DNA, 717 bp, Heterodera glycines
  SCN-specific regions: Sequence locations=1-365,387-656
ccctaccgtcaattccctaccagccaattccctaccgccaattccctactaaggcatttgatttccataccaaaagtgttgaatattgataaacattgagattaaaacacacaagaaaatttattcactgccttttagacagctcgtcaagagctttcggatgataccaaatttatcaagattcgatcgttttaaaaaagttagaagtgtcaaatctctcaaaatacggatagaggaaataaagccggaatattttacagaaatgacttcgacttctgctgatatttcaagtgattttgatcagacgaatcaaaaacaaaaaccaacaaatccctcaaaaaacaaaaatgtctcctttccgcttcctgatgatgttgctggttgcgctggtcgctgccatggccatgggcagtggtgttgaggccgctgcgccagccaaaggaaaagcgccggcggcagcagcaaaagctgctccggccaagggagccaagaagccctaggcaggcaccagcagcaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattcaaaaaaaaaaaaaaaaaaaaaaaaaaaaaaaaaaaaaaaaaaaaaaaaaaaaaaaaaaaaa

SEQ ID NO: 97007 - DNA, 497 bp, Heterodera glycines
  SCN-specific regions: Sequence locations=1-202,226-234,256-258,288 -437,459-497
ttttaaattctgccgctgatcaccgccgaagacaaagaaagcaaaatgcgcttttcctttccgctgctggcaatttccttcctaatgcttctcctcgtggcaccaattcaaattcatggaatgtttggaagcaatgggagaggcagacaaatgagcgggggaaggggccaaatgggaagcaacggcatgggacccaggaatgggaggcggtggtggcagcattagaagaatgcaacaaggccaaggaatgggaggcaatggtggcggtggtggcggcatgttctgaccgcaattttgaaagacgacggaggacggcggagcgtagcagaagcaataattggtaaagactgactgatcagcaagcagatgaaccaaccaaaacggcacgacgattagtgaccgaccgtactgtgtagtcaatttacgctttaaaaaactcaaaaattgtctcatttctcaactcactcgtgctgataaagaaacattttgctaaaaaa

SEQ ID NO: 97008 - DNA, 449 bp, Heterodera glycines
  SCN-specific regions: Sequence locations=1-79,114-336,358-408,445-449
tgtgaaataaaatatgcgtcaccaatttccaattatttttgccctttttctcattttaccaattttaattggaaaggtaatttcaaattaattttaaatgttgaaaaatgcaattttgaaaatgtttctgccgataattgcatttgcttcagacggagtgccaaagtgacttttgggcctctctttcccagcctttggtttccgtgggcagtgatgcgaaaatgccactgaaggacttcggcatggacttcagcagactgaacgattacagctcattgtttggacgaagaaagaaaagggcgcactgattgtaagactaaaaggaaaggacgaaggaagacgaaacaaaacaaaacgggcccaattattacactaattagacaattaattaattacacatgttgtacgtaaataaaattattattgtaataaatttcattttttcaaaa

SEQ ID NO: 97009 - DNA, 526 bp, Heterodera glycines
  SCN-specific regions: Sequence locations=1-491,516-526
gcatctgatgacattttgttggatggaatgtctcacaaccaacgtggcaatgcgaatgctaacatgggacctcctcaaggggttggttctggctcttctgctgagaattccgactcatctgcggataatcaaccttcaaatgagcaatgggaagcagcattcaatagcatcggcgatttttcacattttgttcggcaagtttttcattcggtcgttcatgggatggctgtgaatgacagcagcatattcccgccgaattctgcacaggccagaaacggcttcaccgccaactcgcgagtcaccggttttaccccttcaattgttaatcctccgctgtcgcatgagtctgatgagttgttcatgaacatcggcgcagttcaaggcctaattgccatgccaattcctcccagggaaaatgcgccgcagaatcagcaccatccatagccacgaactgagccaatttcggacttgcccattgaattggtggccttaaactctcaaaatttgatttgtccttgtagcttat

SEQ ID NO: 97010 - DNA, 350 bp, Heterodera glycines
  SCN-specific regions: Sequence locations=1-40,62-350
tgtacggcacaacgcaacggcggctgttcccacggatgtgttaacacggaaggctctttttactgcgcttgtcccccgggaatggtcgttgatccggcacatccgcgccaatgccttcccatcgacggcggactgaaaagggcggccgatcttttttcgtactgggcaaaaatgtcaaaaaaagccggaaaggaggcgatgatgaacgtgtgtagagcgatggataaacgattgctcagacgtgtattgatcaaaacgaaaaattgatcagagtgatcagtcggccccattttatgtatttgcaaatcattactttacaacatttacgcaaaaataaaatttacagctgt

SEQ ID NO: 97011 - DNA, 1180 bp, Heterodera glycines
  misc_feature (742)..(742): n is a, c, g, or t
  SCN-specific regions: Sequence locations=1-1042,1069-1180
ttcggccgttttctgttggatgttattgggcgttgtgggttttcattggatttggacacttttgacgaggaaaacatttttgtgaagcaggcgcgaacaatttttgactttacgcggaagggacaaaaattgcgaatgattctcggggtgtttttcccatgcgtctcacttttatacgaaaatatcactggcaaatcattcgcttttgccatggatgaagagtttttcatggaaatgatgagcgacctttacgaaaagcgccgtgccgaccccgaggcaaaagaaaaatacgccgacattttccaacttttgatgaatgcggtggacgacgaggaatttacaatttcagcagacgacgccgaaataattcacagcgaattgagaagcaatgagcagcagcagaaacaacaggggaaagcatctgaccaggaaaccgaacttttcgcgcaaagtttcatcattttaattgccggtttcgaaaccactggcgccactctttcatttgccgcttatatgttggcgattgagtcagaaattcaagaaaaactcagagaggaagtgatcgacgtgctgggagagaatgaaatgatcacttacgagcatttgaaacgaatgaattacctccgcgcctttgtccaagaaacgctccgaatgtttccggtggcgcccaagatgaaccgcgtgtgcaactccgactgtgtcataaacggcgtgccattcgaaaggggcgatttgataactntgccaatttacgtcattcagcacgacgaaacctttttcccagaccccttcaaatttgaccccacgagattgttgccggagtgaaaagcggaaattgattcgttggcatttttaacttttgggcttggccctcgcaattgcattggcatgccgtgtgccgagttccaaatgcaagttgcgctggcactgattgttcgccgtcttcgcttctctcccggcccaaacacaccggactcagaaatatccgcccaaattgctctcttcggaaatgcttcgcaccgaacaaccacttgttgtgctagcagaaaaaatttgaatttgaaaaaacagtctccatcaacaattattttcttcaacatttaattcgcccattttctctgtttaaaagggattgatcagtttttttttgtccggcgattcaataaatttataaatttaa

SEQ ID NO: 97012 - DNA, 474 bp, Heterodera glycines
  SCN-specific regions: Sequence locations=1-325,347-408,431-474
caaatcacgtgatggatgtctcggtcataaactattgccctaaaaatgcgacgactatcgtattagcacataatccaagtgccgccaggaaaatttttgagttttcgcaatcaaatgaccatcctgttgatttgattttgtcaggacacactcacaatgcccagtatttggttctgatgcctttcgcttacttcatcctcccttatctctatggcctctatgtgttgtcggatggcgcgactaaattatttgtttcggccggcactctcttccaaaatgcgccgatgaaaattccgtttatgtcggaaatttggtctattgaaattgaacccagaaaacaatgatagatctctattttgcgaaatttacttcaaattagtttattttacaattcggtaaaaatgtatcaaatttatatttatttttttatctcattatcgatgtaaagaaacatgcaaataaacatgaattata

SEQ ID NO: 97013 - DNA, 379 bp, Heterodera glycines
  SCN-specific regions: Sequence locations=1-263,285-335,372-379
aactgtgaaataaaatatgcgtcaccaatttccaattatttttgccctttttctcattttaccaattttaattggaaagacggagtgccaaagtgacttttgggcctctctttcccagcctttggtttccgtgggcagtgatgcgaaaatgccactgaaggacttcggcatggacttcagcagactgaacgattacagctcattgtttggacgaagaaagaaaagggcgcactgattgtaagactaaaaggaaaggacgaaggaagacgaaacaaaacaaaacgggcccaattattacactaattagacaattaattaattacacatgttgtacgtaaataaaattattattgtaataaatttcattttttctgaaaaa

SEQ ID NO: 97014 - DNA, 352 bp, Heterodera glycines
  SCN-specific regions: Sequence locations=1-215,239-352
acggcaacctaacttcctgtccgatgtggatcgaattgcaattcccacggccattacaaatattggacagggcactgatggaaagtgccagcgaaatcggcatggaagaagtgcacagcttttcctgaccaaatcaattcgtgatcagtggtgccttcggcataccgaattattaaaacaaagacattagccgtgttacaatccaaccgatcatttttcatttttattgaacaaaattcacttttgactttcgacccaacaaagtttaagtttggtaacacgggttgactaacacaagctttgattaatttatttgattcatataatcagctaaataaacttgaattattgc

SEQ ID NO: 97015 - DNA, 455 bp, Heterodera glycines
  SCN-specific regions: Sequence locations=1-115,137-391,413-455
tgtccaaatgattcgcctgccctttctttcgttggcactcgccttttccgccgttctcctcgtcctctgcgacgatttgccatgtcccaccgatccgtcgtccgcgcctcttccgcccgggtgccctccgcccccggcggacggtaaaaaagcacccgccgacggaggaaaggatggcggaaacaaaggccgaaaaaaaacgagacaacattttacgtgccaaaagagaggacaaaagcaaggactctgaacaaaaagcggacgacgacgaagcggactgtgcgccacccaatggcacccctccgcccggcgcccctccgccgggaactcctccgccgggcacttcaccgccttgccgtcgtcagaggggtgggcccgccggaggaggagtaggagcagcgcagcacccgccgaacggtccgccgccgaccacgccgaagccatgagaaattggc

SEQ ID NO: 97016 - DNA, 449 bp, Heterodera glycines
  SCN-specific regions: Sequence locations=1-449
gacgaagaccaacatccaaaaaatgcaacccgtgctgacaatgagagcgaattggaggagtgcgtgcaccagcccaatgggaacatcatttgagatggtcgttagtgaatagaataagacggacgttcttccatagatgccgatgattgtttgacatgagttacctttcggcaaatgtccgtacactttgaccgaaaattgtaaattcacgaaaccgttgaccccatttgcctattctgttcgttttttgatacatttgctcgttatttgctcgttagctatctatttattacattgcaatttgtctttttcattttcctccgttacttccttatcgatcttcatcgctacagatatgtcataaacgaattcatccatttatccataatatcagccttatatgtttttccaacatatttatctttgataacgagaaaacgtattgaatg

SEQ ID NO: 97017 - DNA, 534 bp, Heterodera glycines
  SCN-specific regions: Sequence locations=1-534
ttcatgcctcgacgaagaccaacatccaaaaaatgcaacccgtgctgacaatgagagcgaattggaggagtgcgcgcaccagcccaatcggaacatcatttgagatggtcgttagggaatagaataagacggacgttcttgcatagatgccgatgattgtttgacatgagttacctttcggcaaatgtccgtacactttgaccgaaaattgtaaatttacgaaaccgttaaccccatttgcctattctgttcgttttttgatacatttgctcgttattttatcgttagctatctatttattacattgcaatttgtctttttcattttcctccgttacttccttatcgatcttcatcgctacagatatgtcataaacgaattcatccatttatccataatatcagccttctatgtttttccaacatatttatctttgacaacgaggaaacgtattgaatgtacaatcagagcaccccattactccaattagattaaacccagccattcgatcgcgggtcccctcaagttaaccaa

SEQ ID NO: 97018 - DNA, 171 bp, Heterodera glycines
  SCN-specific regions: Sequence locations=1-139,162-171
atcatttgcagcgcacctcacgtcgcaaattggctgatgaaatcgcggctgtaataaaacgggacagatcacgctcagccagccgggcgtccctcgaacggatcagtcgggaagttcggcacaaatttgctcattacacgccacagaagaagaaacaacaactgccaagat

SEQ ID NO: 97019 - DNA, 150 bp, Heterodera glycines
  SCN-specific regions: Sequence locations=1-150
gcgaagctgatcttctgtgtattcgtgatcgtatttatctgtatttgtatgtattgtcatgtattcatctcgctgttgtcatttcattcacttgtatatttcaaattaatataggtaaatattgaagttgataaatttacatgtaaaaaa

SEQ ID NO: 97020 - DNA, 360 bp, Heterodera glycines
  SCN-specific regions: Sequence locations=1-76,99-252,276-360
cgccttttctcccgccactcattcactcacttctcagttcattctcgtcaaaaatggcaacctccgcaaaaatttttgttctcctcttcgtccttcttacggtcgctttactcgtcgaacaagccacggcacagtgggggctactactacccgtactacggcaaacgcgaggccgggttcgccccccagggcaatgccaacggaaacgccgaagggcccgcggccggcggagagcacgcgatgttcagattctgaaaaagggaggaaggaagaaacgatcaaagagtgatcggattgactgatcagcaagcaaatggtccatttcaaaacatgcgataaataaacggaatgctttttcaa

SEQ ID NO: 97021 - DNA, 304 bp, Heterodera glycines
  SCN-specific regions: Sequence locations=1-304
tcggtgatgcaggatcccaggaagtgattggaggcatgatttcaatgaagttcttcgagagatttgagccatttacttgcttcagaatagtatatttcacatcactgggagtgtttttcattgtgcacttactgtgagccacggagcacctcctgtaagccttatattgttcattggcttgacaatatttgcctggctaaataactacaaattctttacaattcagtcgtaagtgttcatgcaaatggatattaaaaaatagagtttattcaatgagaacaaaaaccttcatagctttagatct

SEQ ID NO: 97022 - DNA, 411 bp, Heterodera glycines
  SCN-specific regions: Sequence locations=1-174,196-255,278-282,304-411
ccgctaatattactcctatagggactccattttttaccaaattattaaattaacaaaatgtcccctcttcgttttctcgccgttctgctgctgatctgtgccatgttcagcttcaacaatttggggctggccaatggcgaggaaagcaaagacagccaagtcgctctccgtcccgatgttgctgctgttcagcctggacctcgtcgttgttcgcgctcgccgtggttactatggaggtggtggaggctgttgcggtggcggttggggaaaaaagaaataagcagccaaagaagaaaggaaggatgccgacaaagattaattatctttaattagtaaatgatccattcgtccattttgtaattggccaaatttagtaaaagacaaaatacaatgataaattttgtatatttt

SEQ ID NO: 97023 - DNA, 337 bp, Heterodera glycines
  SCN-specific regions: Sequence locations=1-337
gatgagattatcaaagttctccgtgaagaaattgatgagcagcaccgagtgcacggaacgcgtgtcaaagtgtggcgtgaacgcattgacagcctcgagcaaatgctgatttcacagcaagagcgtgcggaggctgataagtggtcacaaaatgggcagatgaaggaggaaggaattaaaaacagagaaaagcaacagtccgaaaaagttctcttcatctgcgagaagtgtctgaatgccttcccccgatatggatatttatatgcgcattattcaaattgtaactgatcgttgcgtatcgcaaattctttgtcaaattataattattcacgtagag

SEQ ID NO: 97024 - DNA, 359 bp, Heterodera glycines
  SCN-specific regions: Sequence locations=1-359
caaacaaagatgagattatcaaagttctccgtgaagaaattgatgagcagcaccgagtgcacggaacgcgtgtcaaagtgtggcgtgaacgcattgacagcctcgagcaaatgctgatttcacagcaagagcgtgcggaggtcaataattgcggctgataagtggtcacaaaatgggcagatgaaggaggaaggaattaaaaacagagaaaagcaacagtccgaaaaagttctcttcatctgcgagaagtgtctgaatgccttcccccgatatggatatttatatgcgcattattcaaattgtaactgatcgttgcgtatcgcaaattctttgtcaaattataattattcacgtagagg

SEQ ID NO: 97025 - DNA, 424 bp, Heterodera glycines
  SCN-specific regions: Sequence locations=1-424
gccgtccctgtgccaatgtcggtccctgccaaactcattttgctgctggtagctgcttcgttagttgcggactttgtcttgggtatggacgaacaaaacggagctgccgctggaaaatcttcgaaaacaccgacagatccaaacgataaattgccgaaaaacgcagaaaaatcgaatgcaccgatgaagctcacaaatacaaagaagatagaccaagacaagcttaagggggtgagcaaagaaatcaaatttggcgacactccaccagcagcagccactggtgtaccatcgaaaaagccgaattcaaacaaaaatcagagaggagggagctgaagacaggcaaagaacaagcagtaccacaaccgattgactgatttgaaacggattttgatcaaaagcttttttggcgaaatttttgggaaaa

SEQ ID NO: 97026 - DNA, 251 bp, Heterodera glycines
  SCN-specific regions: Sequence locations=1-251
atgaagttggttaccctattgctattcttgaagattgtgtttgccgacaacgacaaagatgactgtgacgatgacaaggataagagtttgaaggatttggattatcgcgaccaaattggatttgttgactgcggatgttcaaccatcaacggcacggtagtttgtgcttatgctgatccattcccaccttaccaaatgaagggtggattcgactgtcaaagttaatccaataaaaataccattttagcgtt

SEQ ID NO: 97027 - DNA, 302 bp, Heterodera glycines
  SCN-specific regions: Sequence locations=1-45,67-85,107-229,251-282
gcaaagtcagcagcacaattgggaggaagagtccaaaggcgatggaaatgaaaggaaaaattggacgaagaaaaagcaaccgacgaaggaagagaaaaagaggaaatgatcagacagactcactctgctgtgatggcatttcctataaatatcctaattacccctccccgcttttctatggaatgccctcaaccgaccgacactttgtgcataattttttcactttcactatgaaatatacacatatacagtacatatgtattcaaaataaacagagaatcgaaaaaaaaaaaaaaaaaaaa

SEQ ID NO: 97028 - DNA, 681 bp, Heterodera glycines
  SCN-specific regions: Sequence locations=1-57,79-257,279-647,671-681
gttcattgagctgaaaacacagctcaaattcgtcggtttcggcaagtacttctctttcaaagcacttagttggtatttccaatcatttttgatcggcattgacactttggtcgtcggaattcgcagccgtaaaaaatgttcaacgaacgaccctcgacaatgagattggctttgaatattccgtcgagctcggggttcggatccacaggtgccgctgtgtcgggctcgcctccctcgggtccgtccgctgtattcttttcctttttattaaattgttttgttccaataaaaagtttattcattttcatgcggaaactaaaatttgcgggcgatgagtaattttaatgagcgaattgaaattgacgaaatcggatgccatcggcaaagaatgcaaaacaaaatggaaagtggcgaattgttcaccttcgcttttggcgcctttgccatcgctttgattgccctcgtcattatttattacaaatgcatcgaccgaccgccaaaaaaacgattttattaaatgggcacaaaagagagaaaattgaagaaaaagccgacgaacagaaaaaaggaaaagcgacgagcaaagaaagaaagaaaaagcaaagtgaaattggaaatcaaaagaatcaaatgccatttttgttaaaatattttgaatatgttattaaatactatttaatt

SEQ ID NO: 97029 - DNA, 529 bp, Heterodera glycines
  SCN-specific regions: Sequence locations=1-529
catttcgtccgtctcccaaaagcaccaccaatcattcacaagccaagcacaaacaacaacaatatggaaattccatcaagcaattaccccccgccacctccctatgactcatcggtgctcattcagcagcccaacaacccgtcgccgaacagtccgatgatggagaagggtccagctgccacaacagcaggcatatgcgccagccacaggttcaacaccaacaggccgagcggagaatggtcagggacctggtcaccatgttcttctgtttcgttataccgccgattgccatcgctttgcagaacgggccttcaatgaagctgcacatactgctcagcgttctgttgtgcattctgggctgggttccagcggttttgcatgccgtttggtactgtttctttgccatgagacactacaaccattgattaattgatccccccgatttgcgtgatctatgtgatctgcaaatatttgataaaacactaattgatgcatattaacacgcgaaagcattggactaatctcattt

SEQ ID NO: 97030 - DNA, 1224 bp, Heterodera glycines
  SCN-specific regions: Sequence locations=1-260,293-561,592-675,711 -714,740-775,797-807,854-867,901-1224
tccattcaacccatgcttgaccaaggagaattacgtcgagatggaatcaaaggtcaaagcggtcttcgagcagctgaagggcgatgccgagttgggaggcacctactatccgctccagggcatgaccaaggacgtccaaaatcagctgattgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacaactgttcacacaagtgtacatatccaacttccaaagatcagcacaaaacccaacttcaagtccagtgttgactcagaacaactaagctgatcgcacggtcttgtaccggcgacgtgtctttcaagtgtctgccttatcaactttcgatggtagtgtatctgactaccatggtgatgacgggtagcggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaagctaattctctcggaaaaaaatgccgacggcgaaactgtactatcactgtcagtcgcattgcttgaacagtcgggcaaacagttggcccacgattggagcggtctctgtgacggagtttctcttctcgaaatggttgaaggggcaatctctgcgctacaccaactcactaaagatggcacttccgcagcacaagttttcagtcgaag

SEQ ID NO: 97031 - DNA, 256 bp, Heterodera glycines
  SCN-specific regions: Sequence locations=1-256
agcggggttggtccgactatccacgaaatcgacgacgatgaagcggactcggcaaacccgaaacgtcgcaagggcgtgttcggcaaattcctcggctgattgtgagagccaattcgatttggcattggcagcgatgtaaacattaactgattgcttttaactgatcacgtagtacccgacaaacttttgtcgcccaatgggtgattggtatgaatcccaaacttgtatcacaaagggatttttataaatattttct

SEQ ID NO: 97032 - DNA, 204 bp, Heterodera glycines
  SCN-specific regions: Sequence locations=1-129,151-204
tcaaaagttggccttgtgccgataaattacataaaactgattggaaaatgcaacgacagaaatgcgcaaatcatatgaccagtccgaacattggattaacggacaattcaattctctttcattttgtcatttcatttaaatgtttccaaattttattactgtaaaactttgtatccgaatttaataaaaataaacgaaaatggc

SEQ ID NO: 97033 - DNA, 381 bp, Heterodera glycines
  SCN-specific regions: Sequence locations=1-381
ccggagcggaattgcatcgggtgggtcggcttaactggtcctctgtacttttccgcatagtcaattcggtttgcacgcgggtgaaaacattgccgtatctgtggcagtgaaagacaaacgatgttttgatcgcctcgtcgtgcaaattgagcgcaaatcgaccaccgaaaagttcgatgttctccaatgccgaaagtgtgtgttcaactcgtgttggcttggctcgcgcactttgcacgaccaacgcacttatctgaccaacctccgatcgtattgaccaaagaatatacggataacaaacaatgataacaactaaattattgacaattaaaatgtccaaaatgcattttgatcggatgaaaaaagactttccgccaaaaa

SEQ ID NO: 97034 - DNA, 684 bp, Heterodera glycines
  SCN-specific regions: Sequence locations=1-78,100-633,681-684
actaaacccgggcgaactcgactttaagggtacgaaacggaaaaaagggaaaacaacggacaaaggggacggggggtacaagaagaaactgagagtcattcattagagacgtaaattgtaatagagagagagagttttctttttgttgcccctttgtcattaagcactttttagagggccaaatcattcagctcgattcgcaaattgacgagcattggtttgagggcacagtggacggccggaccggctttttccccatcacttacgtggaggtgatcgtaccaatcccttcttcttccacgacggcacaacaataaactttgtagaacaccgaacagatgacacaaactgtgctttgggatggtcaacagaacaagtcaaacaaactcacctaaatttgctaataattccttaattttcactgtttgtttttcgacccgagattctcttcttacaatagaaaatggcaaatttctaaaccattaacttctcagataatttgttttatttcttttcctatttctgaaattatgtccgcggagattgttatagctaatcaatctaattgtaaagccatttattcgagcgaccgttacttataattcatcctatgacactttcatcaacattcacataatttcaattataaaatttaataaaaaaataaagaaaataaaattgcaa

SEQ ID NO: 97035 - DNA, 645 bp, Heterodera glycines
  misc_feature (561)..(561): n is a, c, g, or t
  misc_feature (635)..(635): n is a, c, g, or t
  SCN-specific regions: Sequence locations=1-94,116-266,289-595,617-645
ctgcctttcgacaactttttcttcctaacaatggtccaaatgtggtgcatggagacctacccgtgtggtgatccgcgtcttccgcaccactgtttcccaccaaaattggtgaatccggacgaattgaccaaacggacgggcgccctctattataagttggatttggaagaccaagtggcattatcaaaacgaattgcaattatgaaattggagcgcaacttcaccaaggaggacacgtacacattggacgcacagacaacgaacgattttaaggaaaagatcgcagaacttttcgaagagacggaaagtgacgaggatcaagcacggatggttttggaagggtcggcatattacgacgtcgaagccaaagacggagtttggatacgcatcttttgtgagtatggcgacttactcatcatccctaagggcatcgcacatcgaatgaccacaacgccgaagaattatgtgaaagtgcgccgctttttcaagtcgagcgatagcgacgaggactgaacaaaaggacgaagaacgaagtcgaagaacagcataagtaatcaccanctgaaaagcttgccctattcaaatggtttaaaatgttcaaatttgaatgacattttgtcaattgtaaacaaaanagaaaaaaaa

SEQ ID NO: 97036 - DNA, 389 bp, Heterodera glycines
  SCN-specific regions: Sequence locations=1-90,113-344,378-389
ttttcagaaatgcatttcaaattctctctcatttctctcgcctttttgtgcctaacattttgccttatcttccaaatgccatgccaaactgaggctgctgttgctggcgctcacactgtgctgaaagtggctggctcaaagccggggtcgatggcactaaacactgtggcacccggtctcggcacagctgcccgggtcgccaatcgtgtggtcaatcattagcctcgtcattgagcactgccgtaggagaccggtggaaagaaatgccaaacttgggaggagtggagaagtgccggaattttgttgcaaatccttttcatatttgtagtttgttctttttttaattctttttcagcttttgaatttgggctatatattttcttcaacac

SEQ ID NO: 97037 - DNA, 557 bp, Heterodera glycines
  misc_feature (488)..(488): n is a, c, g, or t
  SCN-specific regions: Sequence locations=1-72,100-198,220-426,451-557
tgtcgaagaataagctgttcgtcaacggacacttcaccaaggacctgagcgaggatgagcaggaggaattgaagcagtaccaggagcagctggatcagttcaagtccaaagtcaagacctacttggaggagcgccagaaacagttccgcaaccaggtggcgcgccagggcggcgccgaggccaaggagggcggaactcagctgaagaagccggagccgccaaagaagcccagcttctgctcggacaaagccaccacacagtacgtgttcgacggctgcagcgttcaaggcgacaacgtgtacattggggatacttttgtgcgcaagctgagcccggacgagcagaaggaattggcccagtttgaccagaaattcaccgcctaccagaaggcagtgacggccggcttccgcaagcaagttgaggagatgtttggccaacattttagcaccctgttcaacgcctccaatctaagcccatccactgctgangacaaacaacaagccgtaccatcctccaactctaagctaaccccaactaacgcagagaacaacagacac

SEQ ID NO: 97038 - DNA, 451 bp, Heterodera glycines
  misc_feature (146)..(147): n is a, c, g, or t
  misc_feature (237)..(237): n is a, c, g, or t
  misc_feature (294)..(294): n is a, c, g, or t
  misc_feature (301)..(301): n is a, c, g, or t
  misc_feature (323)..(323): n is a, c, g, or t
  SCN-specific regions: Sequence locations=1-451
gcgtgttcaagtgttgtggaacggaaaacaccacttttacaaatttagtgcttcattcgaacgaaaaagttacagcctcgagcatcgttcatgtgccagcttggggaagccgcttgagactctttgctttgtccattgtgccagcnntcaaaaatggccttttttaacaaacacttagttgggtttgtgttcactcagcccccttctctgagggagctttgcttttggacggtgcancgacaactcgcggaatggcgccctcgggggaaaatatggaggggcggaaggacccanaaagaantgcaagccatgttcaaaataantcaaaccattcaaattgttcattgaaaaagcatggatataccgacccataaatcaaagctataaactataaagttttaacatcaaagttcattattttttaatcaaaatctgttaataaattacacct

SEQ ID NO: 97039 - DNA, 508 bp, Heterodera glycines
  SCN-specific regions: Sequence locations=34-508
agaatttttcattttccaaaccaataaaagatggcaataattgcgaaagtgtttctccttctccttctgtttctcatgtcaatggcttctcttttattttgcgcgaattggccaaaaaataccgtccctttggagacttatgtggacgaatcgctccatctccattgcaaattgtgcaacaaaatcgccaattcagcttcggacggagccaaatggctacagaaatcggaggagggctatgtgtctctgctgaagttttgcatcgacgaactgcgcaacagcgacaaacgcagccaaacattgccggctgaggagggccatcaccaatttctgttcgcgtgccacggattcaccgcggacaaacgaaaattgagcgaaacgataggggcgatagcgaaaaaagaagccgacttctgcaaggagcagaaatattgccaaatgttttgatgtgttcagtgattttcatattttagtgcctttttaaatacaaatggacaaattgtcgggg

SEQ ID NO: 97040 - DNA, 318 bp, Heterodera glycines
  SCN-specific regions: Sequence locations=1-318
ctccggtttaattgtccaatactataacgcttttttgaaaaggaattacgtggtcagctggcagtgcttggacatcatccgcaaggacatggtcgacccgttgagcggcaagcggatggccgagtcggacatcatcgaactgcaacggggcggcacgggctacgcagctacaaacaagctggacgccaagctgatcagaccccaattggaactgcaataaatggatgattgttcatgttgctgacttgatcatggatttaccaaatatttgctataatttctgtgtttgtaccattttacaatttacaagatttgatg

SEQ ID NO: 97041 - DNA, 486 bp, Heterodera glycines
  SCN-specific regions: Sequence locations=1-329,353-377,399-486
acaatttcttctttctcgatatttttccgtctcaaatttggcaatgcaaaaaattcgagtcgccaatccggtggtggatttggatggagacgaaatgacgaggataatttgggctggcatcaaagagaagctgatcctgccctatctcgacatcgacatcaaatattacgacttgagcatcgaaaatcgagacgccactgacgatgaagtgacagtggacgcagcggaagccatcaaaaaaatacaatgtgggcataaaatgtgcgacaattacggcggacgaggcgcgcgtgaaagaatttggccttaaaaaaatgtggttgagtccgaacggaacaatccgaaacattctcggggggacagtgttccgtgagccgatcatttgcaagaacattccccgagttgtgcccgggtggaagaaggaaattgtgatcggacgccacgcatttggtgaccaatacaaagcgacggatattgtggtgccga

SEQ ID NO: 97042 - DNA, 446 bp, Heterodera glycines
  misc_feature (320)..(320): n is a, c, g, or t
  misc_feature (322)..(322): n is a, c, g, or t
  misc_feature (352)..(352): n is a, c, g, or t
  SCN-specific regions: Sequence locations=1-279,303-446
gagcattaaggtgggctcgacccaatgcattctttgccctccgctttttgcattttcactttcggcattctcttccccccccccccaaaggccccacgtctctccgctgtgtttaatatcggcccaaaaccaacaatgcgttgggtggattttgttattggcaacgatatttatgtgacaaaggcgttgaaaatgttatgtgcccgaaaaaaacggactcaaaataaatgcgacgccaaaaagggcgcgttttgactatcatttgttgcacgtgtcacaacttcagtggatgttttcaataacaggggacccctttttcnangaaacagccaaaccatgggagaaatatgcnaagggatgacaggaccgacagacattttcaaccaattgacaaaatatttaatagttctgctcaattccacagaaaaagaagtggtcaaaattgg

SEQ ID NO: 97043 - DNA, 556 bp, Heterodera glycines
  SCN-specific regions: Sequence locations=1-373,395-556
gcgggtagtgaacgccaagccaaaataaatgccactggcgaccgactaaaggaggcgtcgaagatcaatttgtccctctcgacgcttggcaatgtgattagtgcgttggcggacgcgaaagtccgcacgttccgtaccgaaattcgaagctgaatcgcattttgcaagaattgctgggcggcactgcaggcccaactgttggagcagagcaaccgttgggcaaagacgacaaaataaatgtgagcttgaacgcgttcgtcgggagttggcaatggagacgcgcttcagaacacagcaagcagaacagtgcgacattgaggagcagtacagcacactgcaggaggagtcccaggggatgggcaaatggttgagaaaggggggcaaattttaaaaaagaatataatttctccacattttcccgttaaacggtgcaatggatccaacggcaactactaacaataatcaaaggtgccgcaagatgaacagaaatataaaatatcagaaataaaagacactctttaacaatgcgagccatacatacgtcaattttgtttta

SEQ ID NO: 97044 - DNA, 483 bp, Heterodera glycines
  SCN-specific regions: Sequence locations=1-35,69-214,236-483
ggggcctcatttgccttcgctatgaaattcgtatgattaaaaaaaaaaaaattatttttcattttaatggtatgtcttttaaatatttccaggcacaatgaatatgcctccggaaattcagcgcgccatgaagatgcaagtggaagcggaacggaaaaagcgtgccgcaattttggagtcggagggcatttgcgaggcggaaaacaaccgagcggagggcgagaagcaggcgcgaattctgcgctccgaagcacaaatgcaagagcagatgaacaaatcgatgggtttggcaaaagcggccgaagcagagaaaatccaacgcattttgcaatctgaggcggaaatgcaaatgaaagttaacatggccattggacttgccaagtcggccgaaagtgaaaaagagtcgcgcgtcatattagcggaagcggaggagcaggagcaagtgattgtcagccgtgggttggcgtgtgccatcgaaacgga

SEQ ID NO: 97045 - DNA, 497 bp, Heterodera glycines
  SCN-specific regions: Sequence locations=1-48,70-171,194-234,256 -469,493-497
gctgaaaacacagctcaaattcgtcggtttcggcaagtacttctctttcaaagcacttagttggtatttccaatcatttttgatcggcattgacactttggtcgtcggaattcgagacgacaattttaagctgactcatgttgaatattacccacttgagaatttgcaaagttttttcaagaaaagtgggttcgacacgaacaaatgtctgctcttcctgcaccgttttctctctactgtcaaaaatgagctcaacggagtgccagaagggtcaattttagtgacggagcgtctcaaaaacaccgaccagttcgtgttcactaccatcgatgttgaagatgagatgggacaagcggagtatgcggtgatcagcaaagaattccgtgaccacaactggacccattgaaacttttttgcacttgaatcattgtattccatggttttcaaattcaaatttttttgcgattcgtaaaatgcttttttagttttcaataaac

SEQ ID NO: 97046 - DNA, 497 bp, Heterodera glycines
  SCN-specific regions: Sequence locations=1-228,261-497
acgtcgagatggaatcaaaggtcaaagcggtcttcgagcagctgaagagcgatgccgagttgggaggcacctactatccgctccagggcatgaccaaggacgtccaaaatcagctgattgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacgagtgctggagcgtctcataaagggagtcaaggccatcgaatcgaaagttccgttttcgcgtgacgaccgtcttggctggctgactttctgtcctaccaacttgggaacgactgttcgatggagattacgttgacattgatgccataatggagattaatcaaagcgaatacattaacaaatcaatgctcattagttcgaatgc

SEQ ID NO: 97047 - DNA, 178 bp, Heterodera glycines
  SCN-specific regions: Sequence locations=1-148,170-178
gcaatttcatttaagcaggttaaattgaaatgagtttttcattgagttcaaaagacatcaaaaacccgcagtgcgcatgttgtgaaaaggaagtgccatttggtgacaaatttagtgtcgatcgattgacgagttggcattttttgtcattaaacttcttttttaaaaatctataaac

SEQ ID NO: 97048 - DNA, 541 bp, Heterodera glycines
  SCN-specific regions: Sequence locations=1-76,99-541
cctgattcgccagctctatactctcctatagggaaagtggacgccttccgtaccggtccggaattcccgggtcgacatcatcatcatcatcatcatcacggccgctcatacgactcactatagggggattttaaaaaattcatctttcataagatacaaagcgaaggatggccaatgctgaagaggtttgcccaacgtattctgaggccttttcccatgggaatgacgacggttcgttttgcactatcactgagtttaaacggaataaactcgaaaccgaagctcgcaagaattgggatcgcttctacaaaagaaattcggacaatttcttcaaggaccgaaattggacaaagcgagagattgagcaaatgtgcgcaaaagacatggaactgagtgctcctttgactttgcttgacgccggttgcggctgtggcaacactttattcccattggccaaattcttccccaattggactttctgtggcgtcgatttttcctcaaatgccctctctttgcttcagcaaagggctgtacaaattgg

SEQ ID NO: 97049 - DNA, 162 bp, Heterodera glycines
  SCN-specific regions: Sequence locations=1-162
gattgtgacgctggccaaagaagcggcggtcgacgtgaaatttgaactgtcaatttgattaggctttatttgaccgactgacgacgtgtagaaagaaatggacacagagaaagaaagagatgtagaaattcgtaaatttgtaagataaaaaaaacgatattt

SEQ ID NO: 97050 - DNA, 344 bp, Heterodera glycines
  SCN-specific regions: Sequence locations=1-113,136-344
acccgaataaatttaccaagtgtatgacattgtgctcaaactcaaagaaaagcgacacgaagtcaactcgctgttttatggttgattgtcttagaggaagactgtcgagaaaaaggaagaaactgaagttcaacagtccgattgagcccaatctggaagtgattgtatgcacattagttgagcggactactagtggaagtgaaaatccaagcgagaaatttatcaagtcaagctgaagcaacagaatgaatgtgatagcgaaagaatggctgaaaacaataatttttttgctttaagcaaaaattttgaacacttttttggtttaataaatcattggatttttc

SEQ ID NO: 97051 - DNA, 462 bp, Heterodera glycines
  SCN-specific regions: Sequence locations=1-90,172-462
gaaaaacgcgttattggccatacgaggtaaacatttttccgaaaggagtttgcttttcccgtgaggtctgctcatctatgttttatttttataaaattaagttaataaatatatgattaaaaataaaataagctatagaaaaataaaaaaaacaaattataaagaggtaaatattttcagaaggctaaaggccgaaaagcttgccgaattgcttcgccaacaatgccaataccaaccgcagcacccgtctccttctgcacttggaatgaccactcaaactcagtattcgtctcaaggggtggcagcctcaatgtatcctgtccttggccaggcttatacgagcccagccaattttcggcattcttatatgagttaggagaacggttcaaccggagattacttggacacgcacttattattttctatcaactttttgccccgacaaataaacgttttataatg

SEQ ID NO: 97052 - DNA, 378 bp, Heterodera glycines
  SCN-specific regions: Sequence locations=1-378
attcaaaatcaataaaaatgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaaaaaagccgtggcattgcacggcctgtcaatgtactgtagccaatgcgtgccgaagttttgggtgaaacagaccgtcaacaaattaaaatgttcatgcaatgccaacgttgtacgcgcagcaatggcatccagctttggcggttacatttcaaacccaactgccgaatataaaaaaatgactgcaatcattgatggggcaattgaccaaggccttt

SEQ ID NO: 97053 - DNA, 545 bp, Heterodera glycines
  SCN-specific regions: Sequence locations=1-194,219-429,455-545
aatttgttaaagaattcaacagagatgaacccaaattggacattctgataaataacgcgggcataatgttttatccacgcttcaccaaaactgtcgatggccatgagctgacttggcagtccaactttttaggccattttctgttgaccgaattgctcctgccaaagttggagcgcagtgaggaaggcggtcgcattgtgaatgtgagcagcagtgtccatctccatgccgattcggtcgatccggaggtggtggagtcgcctcgtcgatttgggataatcgcgacatacgctcgctcgaagctagccaatgttatgcatgttgttgccctcaccaaacgcatccgtaccaatgacagcggttcaaaagtcagcgcaaacgcgtgccatcctggcagtgtcaacaccgaactcattcggaacaattttttcagaaaatacattaaaaaggcatttgctccaattatatggttcgttctgaaaactgatcgggacggagcacagacaccgttgtttttagcgctaagtagacaaattaacggcgtt

SEQ ID NO: 97054 - DNA, 545 bp, Heterodera glycines
  SCN-specific regions: Sequence locations=1-523
aattaaaacggttcaatgtttacggggggaaaaatcgtcttgatgtgaggccgaagccaagagtggatttgactcaatacacaatgaagaaggagtccatcatttacgatttgaatgggatcattgagcatatcggtggtgggattaattttggacattacatttgtgcaatgcgcggattcaaagggaattggttcaaatttgacgattctgagagaagacgcgtaagtctgaatgatgttgtgcaaaacatggacccttacattctcttctacacaaagatttctccctctcccatcaaccaacaacctcatcagcgacgatcctttggtggatttgctccttcgacacctaagcaagctcggctcaacagtttcccttcccacaacggagggacgtcccttcctaagcggttcaacaacacatttcatcgctcgttcattagttgacttagaagatctctcccccttcgttcctccactatctgtccatgttatttatcatttgttgtttcgaaaatgaactcctctttccatttttatacg

SEQ ID NO: 97055 - DNA, 564 bp, Heterodera glycines
  SCN-specific regions: Sequence locations=1-53,80-116,175-313,335-564
aagattttacaacaccaaagcgaacagtgtgggaccaatggaaggacactgacaaatgaagaagaaaagacgcaaaaaatgagcaaaatatgcaacagtgaaaactaattcagtgcataataataaatattataacaaataataattcatttaaaaatatttttataaattaaagtgaaaaaaagaagagtttaattattcgtggacactttcaaattgcaaatagacaaaaaagtgaagaagttaattgagaccatttaatcccttagaaaggttaaaatgactaaatgctctcctaattttcaattgccaaaagtgactaaattcaattattttgagtcaaatttttattttttgcccacctgataataggccacccttttctgtcccctcatttcgtgttcaattggaattgattcgtccgtacttaaaatttggaagcatctataaggaaaattacatggaaaattaccgcaggtaataagtgctttcgacaaggcaataatcgtgcgcatattgaacccatccggcacggaattcagctttggcaaaacaatttatggc

SEQ ID NO: 97056 - DNA, 151 bp, Heterodera glycines
  SCN-specific regions: Sequence locations=1-31
tccacatttattgttgattttgatgtttgttgataataaatgttttaatttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97057 - DNA, 249 bp, Heterodera glycines
  SCN-specific regions: Sequence locations=1-170,192-249
tcgctttattaaaggatttactcttccaagaaaagaacacccaccaattaaccaaattggctgattcaactgaacccgtctttgttgtcgccaaattcgaccaaagaatgctcttccattcattcgttggcattgtgtgaagaatggcatgcgcttgctgaccaacggaaatttatttaaacaatttatttgttttcgtgctgatgttcttttattttgtcttggaaagttaaataaagtataagtccc

SEQ ID NO: 97058 - DNA, 260 bp, Heterodera glycines
  SCN-specific regions: Sequence locations=1-89,111-260
tccatgtatttctacggatatatgctctattttgtgttgtggccagtacttttccactccgttttgcgtccgatgataaaaaagacggcctaatggaagaagggatcattcgtccgtttagtctttttgattcgattgaaaatctccctttaaacaattgaaatttcgtcgtaattgttcattattggtgttaatttcttaattaagcctcaaatttgtttcctttttatggtaataatcgtttaaagcactgtttggtc

SEQ ID NO: 97059 - DNA, 396 bp, Heterodera glycines
  SCN-specific regions: Sequence locations=1-396
tgggggtaataagtcgcgaatttggcaattggggagcatggatccgagtggacaaagattggaccaactcctcggcaaagagtcaaaaagcaatgagcagaaacaacgcatttcttccctcttcacttccgtccatcttttcatgccaaaacccgtcgtcgttctctacggcgaagagcttggcctgttaagtggaaaaccgacagccaacaaattggccaaccgaattgtctatccgtggagtaacgaaacattcggcaatcagtcgcaaggatttttcgttttcccccaacgtacaaaaaacggagacttcgagagccagaaaaatgacaaacattcgccgctggcgttgttcaaagaaatcgcaaagctacgcgagcattccgatttcttctc

SEQ ID NO: 97060 - DNA, 621 bp, Heterodera glycines
  SCN-specific regions: Sequence locations=1-100,216-621
tgaaggaaaatttaaaaaaaacgaagggaatttatagcaaatcaaaaaaagagaattatattattataaatgtgtaaattcgacaacgatttttaaagccaaatttaattttatttcaaaaaataatttaaaatataatgttggaaattttttaggaaatttaatttgaatcgataaaaaattataacttaaaaaataatctttaattaaaaaatgttttcttggctcaaattcatggataaaaatttcgacgacccatagtcgagagggccgttgcaatgaaactgatcactttcgtctggacggcaaaatgtggacgcgattatctacgacagaatcggcgaattggaaacacgtcaaaatgtgttcgtcgtggaaagggaagtgaagagcgccctgttcaagtcgccccgcacttcaccttctctgtcgcgagcaaattcactgtttcgcaacagtcaaagcccgacgatgccggtggaagagccaaggcggtcaccctccgccagaagaatgttggccaacggatttgcccggcaaatgacaattgccgacactgactttttcccgaccaaatgagtgaaaaatcttatgtttccttttccgaagaatatccaactg

SEQ ID NO: 97061 - DNA, 558 bp, Heterodera glycines
  SCN-specific regions: Sequence locations=1-23,45-138,257-268,347 -461,528-558
cccaattaaaaaaagtaaatcctctttaaaaatgaaactttcaataattttattgctttccttggccttttgtgcgttaatcatcgatgcatatccatcgggaaatggtaaagatcttgaagctgacaacgaaaaaacggaagtgaaggaagagaagatggaaaaaagagaggcggaagtggaggaagggaagaaggaaaagaaagcagcagaagaggaggtagggaagaaggaaaagagaggaagtggaggtggaacatggggcaacggaggaagaggaaacggaggaggaaacggaggaggaggacacggaggaggaggacatggaggaggacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaaataaaaataaatttttttgaattttcgtatttttaattaatttctttttacccgcataaaacaaaattagttca

SEQ ID NO: 97062 - DNA, 150 bp, Heterodera glycines
  SCN-specific regions: Sequence locations=1-82
attgaaaactaccttaattgatttagctctacaccttttttcatgtcgtgtaaatatctgaataaaatatcttaatgcttttaaaaaaaaaaaaaaaaaaaaaaaaaaaaaaaaaaaaaaaaaaaaaaaaaaaaaaaaaaaaaaaaaaaa

SEQ ID NO: 97063 - DNA, 332 bp, Heterodera glycines
  SCN-specific regions: Sequence locations=1-332
cttggttaggtggatagagcaccaatgggttcttaagaaaaatggttttattttctgccaaatgagcacgagtgccgagttattgtaaggattattagacgcatttccctcatttaattatttcccattggccattatcaattcaattacatttatccttttctcacctttttccttttctcattgtaatgtttctccgcccattctcttcgcattttctccttccccagtgatcagtcagtcagtagtggtgatggaacagacttcaattatttattccgatttctcgcttcgtataaatccaacaacgaatgaataaagacatctttaac

SEQ ID NO: 97064 - DNA, 829 bp, Heterodera glycines
  SCN-specific regions: Sequence locations=1-282,305-829
aatttatcggatggcttacgattatctggacagattgggtgagttgggaaggaaagcacggcgaaatcgccaaatttggtgtattcacgatatccgatggggacaagtttaacccgaattattaacagttgctaaacaacccaaacagtgcggacatttccaatttaaataattaaatcttttcataaaccctaaattaccatcaaatcacttgtgaaacaatccaattgtcatcaaaggtaattttcctcaaaagtccggcccagaatctgctgaagtccctctgaatttgagtcattttctttctcgaccctaaggcaaagtggacggcctcgactttgacgcgttcactaggcaattattcgaccgatggttcggcgcgtacacgcgctgcggcacatgcaaaaatggcaaatgcagcagacacgggggaccgttgggaagttcagggtgggagcacgtgttcagcggagagtggcgaggagaaattgtggacggacaccacagttgggtgaggttttacctgcaggagaaggcgggagacatcgaataccacggatattacgtgaaaccacggcacggccaattcatcggcaccattcagtacaaatggaagcagtacttgaaaaggatcggcggtttcatgataggcacgtcgccagcttttgacttttctctgctcaccgtttgcattttgactgaaccgggcgaccggaagtgcaaattccaactgaaagaaactcctatgttcgtctcctccttcctcgaggattgtgtcatcgacggatccttcagacacaacttttgcattgcgaccgcttatccgggc

SEQ ID NO: 97065 - DNA, 320 bp, Heterodera glycines
  SCN-specific regions: Sequence locations=1-253
attgctgctgttgcgcaagggtttaaggttttcgtcgacggagcgtccgtttgcgacttcacttttcgtgcttcagctccgccaccaacagaagcaaaccgactgacaattgttggtgatgttggggtacaaaaattcatttttcgtaaccaaaaaaattaattttctcagttcatacaattggaaaaacttttcactttcgaatttggttagatcatccaattccctgctttgttttatgcacattgtgacattttcgggtacttatttattaaagtgaatttgtaattagataaaaaggcagtgataaaatgcaaaaa

SEQ ID NO: 97066 - DNA, 389 bp, Heterodera glycines
  SCN-specific regions: Sequence locations=1-389
cggcggattcagcggacgattcgctgtggagccgataccatgatcaaaatgcaatggaagagttgttggagaaggtgcacagcaaatgccccaatgtcactcgtctgtacagcgtcggccgatcagtccaaggccgcgatttggcggtcattgaattttccctccatcccggacggcatcaaattttgaagcccgaaatggtcagcgatgcacgtaacggtgaaccaattgcaaatgccgtggtgtgggtgagaaatgtgaccgacggagacggacaaacggccatcaaacacccggtgaccacgtggatcactggcgattatttccgtccgttggtctccggctgttaccaaatcgcggtggaagcggacggttatgaaattggcatc

SEQ ID NO: 97067 - DNA, 590 bp, Heterodera glycines
  SCN-specific regions: Sequence locations=1-33,60-66,90-188,210 -536,559-590
gtggcattttccacaatgctaaaaagacctttttggtgtgggttaatgaagaggaccatttgcgcattatctccatgcagaaagggggcgatgttggcaacgttttgaaacgattgatccgcggtgtgaaaggtatcgagaagcaagttccatttgcgcgtgatgatcgactcggctatctgacgttttgcccctccaatctgggcacgaccatccgtgctagtgtgcacatccgtttgcctaaaataagcgcaaagcctgaattcaaaaagatctgcgaggacctcaagttgcaagttcgcggcattcacggagaacactcggaaagtgaaggcggggtttacgacgtgtcgaacaaggctcggcttggacttaccgaatttgaggcggtcaagcaaatgtatgacggtgttaagaaactcattgaacttgagaaggcgtcgaagtgaatgaattaaatatctatatccatttgacgcctcgtaattgcattgctttaatcacaatattgtatttttgtataggtctatagggtcagaaaatgtattgcattatgaaattgtatggacaagtaaaatggttaattgact

SEQ ID NO: 97068 - DNA, 586 bp, Heterodera glycines
  SCN-specific regions: Sequence locations=1-90,112-391,421-586
ttactatgaagacgcggacggactgaacggaaatttgagctacggagggacgaaagggcgcaaagaatgggaagaaaacgccgacccgcactcatccgatttgtctttgtataatattgccgacgggaacaagagcagttcgggcatctccagctgttgtacgacttcttcgagaagctgtgagccgccagagaccaatcgctttgtgttggccaaaaaacaaagacatttcaaagcgggggatgaagctgacccaaaaatgccaactcatcgggcacagttcccttttatgccgagacattccgaacagatcgaactgcaaaagggtgacgcaattcgcattttggagaagtacgaagaccactggtgccatggaatcaatttacggagcggaaaaaagggaattttccccgaggcccatgtcgtggagattgaccttgtggatgaaatttgccgaagtgttcttccggatggcactaatcatgccaacaaaatcgaacgggacaccttttacttgaccatgttggcctccattgaggtcgcccatcacaggggaaacgatgtggtaatgcaggcaattaacaag

SEQ ID NO: 97069 - DNA, 214 bp, Heterodera glycines
  misc_feature (214)..(214): n is a, c, g, or t
  SCN-specific regions: Sequence locations=1-175,202-214
tgataagatcaacaagggtcaattggatggcattgccatgtcatttagttcgattactctcggcaccaacggaccacatgcgaccgcctcgtcggattcgatgatggtcgactcgaactcatgaacgcgaaatcaaatttttgtttaatgaaaacccataattatttttgataccaactatattttatattttaatgaattatctaaaaacccn

SEQ ID NO: 97070 - DNA, 508 bp, Heterodera glycines
  SCN-specific regions: Sequence locations=1-445,467-508
gacaaatgctaaacgaatggcttcaaaaaaagggagtgccatcggatgaggcggctttttttcttgaaacttattttcatgaggtcacagaaaaactttctaaacaaatcacagcaatggaaatattttatcagaacgagaaacaaatattaaacaacttcggaagagcattcattgcttgtcatgaaacttatggaacaaattttacggaaaaattggcacaaattggcattactgagaaaaagttagtgcaaatttgtcagtttttagggtatgatgacaaaatatttgatatacaaccaatcgacagtgatgtgaactttgggcttccggattggaaagaattttgcccaaaattaatggccaataaaattccaaaaaattcagtggttgtaatggacaaattaaattcagtggaaaccgtcggcatgaacaaaggtcaaaatattttaccaaaacttttggcgaagcaaagccgtggcactggtgtttttttgccgaaaaatgc

SEQ ID NO: 97071 - DNA, 390 bp, Heterodera glycines
  SCN-specific regions: Sequence locations=1-390
ccccggcgctgtccaaaatatgccattgttcgtttgaccgaagggaccaatgtgcttcagttttaccaattattgcttgataatggtcaagaagaagtgtcttttgtcaacgaaatgcgtgaaaatgccttccaattatatgagaaaccaaacaatgacacgggaaaggatgaggcatcaatagcagctgatacaggtgccggaaagaaaaagctgcctgacgctgaacaaaaacagacgacggacacaaaggagcggaagagtccgataatggtcgacaaaggagtgcaagtgatccccgaaaggacaatcttcgcctcgccctctttcagttcatcttttcgcactcaattgccggcctctccaattttgcgtacggccaaaaaggaa

SEQ ID NO: 97072 - DNA, 535 bp, Heterodera glycines
  SCN-specific regions: Sequence locations=1-535
gcgattgtaataggagggccaatcgtagtcggacaaatagcttctgtagcggtacagctggttgtagttgatggtcccttgacgatactgtgccaatcccttcgacaggctgtcctccatactgtctagtagccaagagcggtaacggtaggtgcgcgaatacgaatcgtagtaggggtcgtacctttaccaataatagtaccagcgattgtaataggagggccaatcgtagtcggacaaatagcttctgtagcggccccaataggagtacgaagacgaccaatagtacgggttgctgatgtagtcgctgtaatagtatcgacggtaagggaacagcgaacggctcgtctcgatttggcgtggcggtggaggaggacgaataattaagtggatggaatgaatgaacggaatgaacgtggaaaagcaaaatgtgtgagccttaaatagcaaattttgcacaaaaaaattcatttggttgccattattttcatcattcattaattatcggcaattcatcttcatcaatcatcccttc

SEQ ID NO: 97073 - DNA, 301 bp, Heterodera glycines
  SCN-specific regions: Sequence locations=1-47,69-94,138-219,242 -245,274-301
gcaaattgcgcttcattctttccttattttttgtggccttttaaatctcattgcccaattctttctctgaatgattttataggcttgtgaggacttatttttagtttttttaatttctattcattatttttatcttttaacattccttcccatttaaaagtgcaatattttttcattttcattaattgtgattgttggaaaatgtgttaagttggagagataattttgttaattcaattttgctcattatttatctttaaatttaaaaaataacagaatggcataaaaatgcgtatttgtc

SEQ ID NO: 97074 - DNA, 533 bp, Heterodera glycines
  SCN-specific regions: Sequence locations=1-72,114-121,143-497,519-533
agcgaagagctgatcgtcatggaacactttgtagagctgaaggataaaacaatagcagtatacccataaaagtaaaattatgaaatttttaataaattttaatatgaataattgtgacaagtcttactttttgatgaatttcgaaattgtcggcccgaagaaggggagttaatggaaattcgatttggtggcaacagcgaagtcttgtgcctttcgttgcgtccaaaatatccattcgacgaaccattgtccgctcggtgtacagccaccgaatcgtccatggacactgacgccagcatttgagagtccggtgaccaggagattccggtcacatcaccgtcatgtcgtatcggacttcgaaacgcccttgcccaattctccttgttcggcggaatgtccatttcggggtcggcgtcacgttgtcggacagtcgccggctcttccagcatttgcacttcgcattccaaaacttcttgttccaatttccatacaaaaagaaagccgtccgcatccccagaagcgatataagttcc

SEQ ID NO: 97075 - DNA, 150 bp, Heterodera glycines
  SCN-specific regions: Sequence locations=1-122
aattgaaaaataggcattcttttggacattttgaaccccaaagaattttagtgccatacaatgaatctgaaaaaggtttttatttttataaaacttttaacattttcgaataaaaattatttaaaaaaaaaaaaaaaaaaaaaaaaaaaa

SEQ ID NO: 97076 - DNA, 284 bp, Heterodera glycines
  SCN-specific regions: Sequence locations=1-148,170-218,245-284
ttattttttcgtattcgaagaattttttacgaaaattacataaagtttattatggctgccgctaaagctgggataacaaaatatgaattgattggcgtctcatcactaagttttctcgccgtttttgtggcaattttgattttgcttgtacaaatgctttttcacaaagccaaaatgcaaacagaggaagctgaatgtgtgcacattgaccatcagttgcaacagaagaagaagaagaatgagagattttaaggaataaaaaaagcaaaaagaaaaaaattaat

SEQ ID NO: 97077 - DNA, 538 bp, Heterodera glycines
  SCN-specific regions: Sequence locations=1-370,392-514
aaggagaattacgtcgagatggaatcaaaggtcaaagcggtcttcgagcagctggagggcgatgccgagttgggaggcacctactatccgctccagggcaatgttggacaagtgctggagcgtctcatagagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccacctgcgacggcctgaaattgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataatgggaggaccgatcacacatttatcccttttcgcgcttctgataataaaaagcgatgtaaaaaaaaaaaaaaaaaaaaaaaa

SEQ ID NO: 97078 - DNA, 550 bp, Heterodera glycines
  SCN-specific regions: Sequence locations=1-245,267-550
accatgattacgccaagctctaatactactcactatagggaaagctggtacgcctgcaggtaccggtccggaattcccgggtcgacatcatcatcatcatggccgctaatacgactcactatagggggaatcagttgaaaattttttttataacaaaatgatgaacaaaatttatgccaccattcatttcttattgcttttgactgtcattgctaacaaatcgactaactgtgctacaaatggtcaaggaactcaaactgttaaaacagcagatgcaacccatgatgaagctggaaaaatttcgcgtgattcatcatcaagttccgatgaagatgactcaacaactgcagcctcaaaaatgctactgaatgaagcaaataacgctttctccaaagataatgatgagccgattaaccagcagcagaaaatgaggcctgaagctaattttagcgttaaatatcttcccccgagactgaacgctgcacaaattgacaacattgcacaacaagcatcatccatgatcacattacgcacattaaaacatgtgaaa

SEQ ID NO: 97079 - DNA, 127 bp, Heterodera glycines
  SCN-specific regions: Sequence locations=1-63,88-127
ggcggccggcagaaaagccaaccaaaccagtaacacacaaagtgtgcaccggacggctagcacagatccaactacgagcttcttaaccgcagcaataattctatgcattttgagagctggaattacc

SEQ ID NO: 97080 - DNA, 422 bp, Heterodera glycines
  SCN-specific regions: Sequence locations=1-28,50-181,204-293,375-422
ctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcgccagacagtacaaaccataaaaaagaccataaaaatgagcatccaaagtatgaagcagaacttatatatgagcaaggtaacctacagaaccatgctaccggtaacacatttattcagcaatcacaaaatttttatctaaaattaacatgaaaattagaaaattttataaatatatttaattattttatataacatatatatttatcagaatggcataacagtaaaatttctgttatttttttttgtttcgctc

SEQ ID NO: 97081 - DNA, 528 bp, Heterodera glycines
  SCN-specific regions: Sequence locations=1-30,52-313,397-528
ctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaagtttgttgtttttttatatgagcaaggtaacatacagaaccatgctaccggtaacacatttattcagcaatcataaaatttttatctaaaattaacatgaaaattagaaaattttataaatatatttaattattttatataacatatatatttatcagaatggcataacattttactcaaataaaagtaaaatttctgttatttttttttgtttcgctccaaatgtgtccatgaccaaaatggcggtgcataaatggcaccgaatcattaaaataaaatttttaacg

SEQ ID NO: 97082 - DNA, 231 bp, Heterodera glycines
  SCN-specific regions: Sequence locations=1-231
agtggtgagagaattaactttcccatcatccccaactcatcatcgctgaatgtattgactaactggtttttctacgtaaatcgttacagcgaatgtctcaacattatctccaactcagcatagagatcactaattgccgtgttcatctactatatccgatccatttgttttttcatttcattaaaacataaaatgtacataatttttgtttcaattaaaattgaggtttag

SEQ ID NO: 97083 - DNA, 251 bp, Heterodera glycines
  SCN-specific regions: Sequence locations=1-251
cagtgatgcagggcagtgagtcatcaccaagactaaagctgtacttttctcaacaattcagtgactgatggggttgtgatgacggctgatgaaactgaaatttcgcaacagacttggcgcccacagtagaaaagaatgattgacaaatgtgcaataattttaacatccataagttaatagtttccggattatgaactatggactgtctcgtaattattgtcgttttttgataaagtgaaaaattcaaaaaa

SEQ ID NO: 97084 - DNA, 402 bp, Heterodera glycines
  SCN-specific regions: Sequence locations=1-32,54-92,115-402
gagtttcgaagccccagagaaagagttcgacattttgaaaaaagcttggcctagacttggttccatgttggactggacaaaaatccagttcaggaaaaacccggccccccggggtccgggtccaaccaagcctgggacccaagtccaggtcgaaaactgtactaagaaccgtttgacaagattgtttgctttttcgaaaataattggtttgcatgcattatcacttttgtaatccaagtgcgcttaaggccttccaatgtttgtgactgagtacggttgctactcggctgacggcaatgaaaaagcaaatttggaagagttgaaaaagtggatggaacttttggacggctatggcatttcctacgccgcgtggcacgtggcagacattggcgaacagtcgtc

SEQ ID NO: 97085 - DNA, 383 bp, Heterodera glycines
  SCN-specific regions: Sequence locations=1-383
gtcgagctccgccgagacggaccctggcattgtcagttttgccgaaatttggacaccgatcctgcaaaatttgggcgcaacattagtcggcattggtcctggtgaaccgtttgcctccaaatcgagcgctaaccttgaggaaaagatggaattctgttccaaaattgagcctcccgttgatgtgctgctggcggagacggactgccaggccgaggtggccgagctggtcgaggaacggggcggtttggccgtgtccagcgaatgggtcattcaggccatcgtcactgtgttggctgaatgaacatccacagttttggtggtggatgacggcggcaatggactttgactctacttgaacacacctaacaatatcataaaccatt

SEQ ID NO: 97086 - DNA, 213 bp, Heterodera glycines
  SCN-specific regions: Sequence locations=1-129,151-154,180-213
ctggaaaaattttagtgatttttaatgcgatttgttaacagatttgtccacgaaaatggccaaatttagcgacttctagcatattttcaagaaaattaaggatttttaggtccggcggtgccgataggcgccgccgggaaatttttaaaaatttcaaggcaatttattaacagaaaattgtataaaaattgctatttttttgacaaaaaaatc

SEQ ID NO: 97087 - DNA, 526 bp, Heterodera glycines
  SCN-specific regions: Sequence locations=1-288,316-318,380-526
tacgccaagctctaatttcactcactatagggaaagctggtacgtctgcaggtaccggtccggaattcccgggtcgacatcatcatcatggccgctaatatgactcactataggggcaaatgcgattcggtggtgttgctgcgccgacaaaacattttgatgatgcaacttaggaaaatcagcagacaaaaccgggaaatgagggaggtcattgcgcaataccagcagattcccaacctcttgcaagcaataaagtcagtattttatttaccaacaaatttcataaacaaatttaaaattaaaataatttaaattcataaaaaaaaaaaaaaaaaaaaaaaaaaaaaaaaaaaaaaagtactctgcgttgttaccacttagtagtagtaggcggccgctctagaggatccaagcttacgtacgcgtgcatgcgacgtcatagctcttctatagtgtcacctaaattcaattcactggccgtcgttttacaacgtcgtgactgggaaaaccctggcgttacccaact

SEQ ID NO: 97088 - DNA, 547 bp, Heterodera glycines
  SCN-specific regions: Sequence locations=22-547
taaattctttctttttaaaaatgctttccgctgctttttttatgcctttgtttttcattgccattggccaattcctccaaatttctgatgccattgactgtttttcttgcgcatcgccggcacttcacaaccaatgggaggcaactggacttcccgaaattccgccgcccgaccgtttcgcgttccacgcgtgcgatgggacgggcactgactataaaccgtgtgccgatgtttgcatggaaatgcttgttgctgctggcaatgagtacggtgttgtgcgcgggtgcatgtccgacttttaccatggtcaaacaacgtcgacaaacactgacaagtgttactttggtggatacccacacaatgtgaccatttacgacccaaccaatggtgccaagacgtacagtcagctgtacgtgggcgtgcgctactgctccaccgtgaatggcgcgtgcaacaacaaattcatggcaaagaaagaagcggccgaaggaagcgggcttttgccgaaacattttgtcgtcagacccaacaaatgccaacaacggct

SEQ ID NO: 97089 - DNA, 541 bp, Heterodera glycines
  SCN-specific regions: Sequence locations=1-174,203-508,531-541
accatgattacgccaagctctaatactcctcactatagggaaagctggtacgcctgcaggtaccggtccggaattcccgggtcgacatcatcatcatcatcatggccgttaacacgactcactatagggcaattggaatcttttccatccattcatttctttttattttatcccaatttttagttttatttatttttaaatagcgcataaaaaatgacgacaaattgggagaaacttagaaaggaattaaacgaaacggaagaaaagggaaaaggaaattcgaagaaaagaaagcgaaaagtgagtgaaaattgtaacaacaaatggaagaaaatgcgagaagaaattgagaagaatgaccagcagaagccggaaaaggcaattgaaacgacaattagcgcaaagaaaattttgatggccatcgattgcgaatatgttggagttggactgaatggagcggagaatatgttggccagggtatcaattgtcgacgccgaaggaatcgctgtctatgacaaatacgtcaaaccgaccgaagaag

SEQ ID NO: 97090 - DNA, 383 bp, Heterodera glycines
  SCN-specific regions: Sequence locations=1-89,113-383
gttccattggaaagagcccaaaaaagcacatccctttcccgattctgttgtactaaagattcctggcccaaaatacaattctttggtggcacaaaatgggagggaagaacaaacggacaacgcaatggaagaagaaagctccgattatctgatcaaagcgcacaccaatgagattcttttctacaaaaactttccgcgcttcgacgcgtccctccgtctgcccaaattttacttcggttccgactacagtcccagccacaataatgggttgatcatcatggaggacctgagcagccgcgcttcgtcccttctcactttgccaggcttcgacgatgcccatgtgctggtggtcatcgacgaactctccaaaatccacgcaattt

SEQ ID NO: 97091 - DNA, 251 bp, Heterodera glycines
  SCN-specific regions: Sequence locations=1-160,183-251
caaagctgcgtgaagtcggcctgcaaaagcacttgcggcgacaatttgtcggaaccgaagtgcacggaatgttacgacaaaccgcacgaatgtgcgccaaaataacagaggacggaatgccaaaacttgaaatggaaacgaatgacaattaattgaggatgaggaaaaggaaaaggagcaaattaatcggaattaaatttaattatttttcgtattttaatttgtggaattcaaagaaaatgattaaacaa

SEQ ID NO: 97092 - DNA, 409 bp, Heterodera glycines
  SCN-specific regions: Sequence locations=1-266,288-409
caaagattattcccagaattgcaaactctctcaagactttctgatcctttcgaaagcgagttcagatcactgcgccagttctcgcaactgcctgccattgatgtaaacgaaaccaaggaagcgtttgtagtccatgccgatatcccaggcttcacacgtgaagaaatcgacatctccctcaacggtccagtcctagctttgaaaggaaacaaggaaaagaaggaagaaaagaaggatgaaacccagcacatccaagaaagaatccagagctcgttctacagaagcattacattgccagaaacttttgcacctgaaaatgtaaaggcttcattgaaggatggcatcttggaaatcacaattccaaagaacgctgtaaccaaaaagattaccatttcataaataaattatt

SEQ ID NO: 97093 - DNA, 330 bp, Heterodera glycines
  misc_feature (330)..(330): n is a, c, g, or t
  SCN-specific regions: Sequence locations=1-330
acaaatgctcgatatcgcgttatcaatgcgaccatggaatttagcgtcaaggagcctttgacgattaaaagaaaatcggcaaaatcacgggaatgcttctcgagatggaaaatgccgagattgtgttgttgcttggagacgaggaaatgttgcgtttgcgcgtggacgaagcagcaacagtgctttaccaggccacgtgtcataaggaggcgcagtaggataaatgaagtggatggattggatgaataaattgatgagtaaaaggagaaatcaaaaaaattgatatgttatttggcttctttgtctgagtaaatgcttatctgttaaaan

SEQ ID NO: 97094 - DNA, 855 bp, Heterodera glycines
  SCN-specific regions: Sequence locations=1-685,815-855
tgtgccgactccaagcaactcatctgctcgctcgactctttctgctttttgcgctttgcactgctttcgttagctctctcactgctgttgccccgccattcggccaattgtccgtttccgacaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtcggtgtttcgtcccgttggacatcctccggaaatatggttgcttcgtactacaagaaaaaatccaccggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcg

SEQ ID NO: 97095 - DNA, 456 bp, Heterodera glycines
  SCN-specific regions: Sequence locations=1-244,266-352,390-429,451-456
ctcctcatttaccaacaaattcacctattagcgaagccaacaattattcataccttccattgttattgctccaaaaagaagaccaaaaatggaagcacccgctgaaattgacgaaatatacaggccacatgaagccagaattcacgaagccttttttaatacgctttccaaaccaattcatagcaaaaacgaaagaaggaaccgagcagaaggaatcttcacaacatcggaaagtcaacaggacagggaaagaatacacgtcacatggcgccattttggtcaaaagaccaagttcttccttgaccgtaatgaacatgatttgtttgaggcgcttcaccggaaaattcgcagtgaattgccaaattttcggggcaccgcttggctctccgatatccgcggcagacagttcttctccgctgttgcggccggaagagagacaacgcgaagaaaatttcc

SEQ ID NO: 97096 - DNA, 513 bp, Heterodera glycines
  SCN-specific regions: Sequence locations=1-513
ccatccatcgggcggcgggtccacaattgttggaggaatgccgaacactgaaagggtgcgaagtcggcgaagcgaagatcacaaaagcgtataatttgatgccaaacatcaaagctatcattcacaccgtcgggcctcaaattgggactgaagtgtcggacgaacagtgccgacagttgcgcgactgctacgccaactcgctaagcctggctcgcgacaacaaattgagatccatcgcttttccatgcatttcgaccggagtttacaacttcccaaaaaaaggaagcctctgaaattgcgattaaaactgtgagagattggctgaccgaaggccaaaacaatgaaaagctcgacactgtgattttctgcgtgttcggcgatgatgaccttggattttacgaaaaaaacattcctcaatttatcctatgaagattcaattgaaagaagggatgaaaaactcagtaaaataatttattactagtaattttctaaaataaaattctgaatttctta

SEQ ID NO: 97097 - DNA, 786 bp, Heterodera glycines
  SCN-specific regions: Sequence locations=1-37,59-198,220-786
gtccttctactatgtgtgagaagcgttagccatcactttgaaatttaaaattgaaatttccatttttctccacccatccaattcgaatggattcgctcaatcgtgagatcaaagatcgggtgcgcgattcgcattggctcggttcgtacggcgacagtccgcacgcgacatttagcgacattgtgatgagaagttttgatgaggtgaaaaagtctgggagaaatgccagtgcctgtcgcttctatgacatgtatcacccggaaattggcattcttcgcaagtcgaagagttacagcgcattggcaccgacaaacgcaatgcgattgaaggaccgtttggtggcacccgacctaagaccttttcatccgtacaaaccgaagcggaatgaatggaagacggagcttgaaaaattgcaccatggaacacatgcaaaactgaacattgcgccgtcgccgttccttccgccattgcctcccacttcgcgccgtcccttccaagtgccggccgatgcgactcgttttgagaatttctgtatgtattggggaggtcgggcgcgtggactcgactattcggagccatttttgtacgaaccgcagagagataactacagtattatggaggacagacggtaccatcgactgtactgggctcagcatatgattcccagccaaccgtcggcacggcatggacgacaaattatgctgagtgcttattgaaagaattggagggaaaacaatgatgcgctatgcgtagatagaagacacatcaaacaccgagcactaattt

SEQ ID NO: 97098 - DNA, 542 bp, Heterodera glycines
  SCN-specific regions: Sequence locations=1-236,266-486,508-542
accatgattacgccaagctctaatactcctcactatagggaaagctggtacgccttccgtaccggtccggaattcccgggtcgacatcatcatcatcatggccgctaatacgactcactatagggggttgttgattacttacgaaagcaattaaattatcccttttcccgtccgacaaattgtgaaattaaaaaaacaaaaataaatgacgactcaacaacgaatatttgggaatcagctgctttttctttgcatttttcttattggagttgttttttttcctcttttctgctgctgttgcaaatggtgctcatttagttgactcaagcgttgatcaaattggtcgtgtacagcacaatcataacggcgacataaacatacgcagagggattgaacgcttcaacgacaatcggatggcacaaaatgaattggactttttgcacatctgacgagcgaaacgtcagcagcacacaaagattaagacgcattaaacactaattacaaaaattgattttttacttccgttatttatttttccttca

SEQ ID NO: 97099 - DNA, 388 bp, Heterodera glycines
  SCN-specific regions: Sequence locations=1-388
caacgaaaactgacgggaatggtgcgggacggagtcaattcggcctcgcgctattactactcacaaatatgcgacgcgaacaaacaaaacgtaatagacatccttttgggacaacagagaacagcggaataacgcagaaaggcacaacccacttcaaaatgttgtaattattccaattttttactattttgccctcattccaaagatattttcattctgtaagatacttgtgttaattatggcaaatgctttatctgtgcctgtgatactttcccgataaaccgtcattttgtggccagttgctatcagctttaacctttcatttaaaacatgttctctttgttttgtcttgcataattgccaaagtataaatggtggaaagaaaaaa

SEQ ID NO: 97100 - DNA, 393 bp, Heterodera glycines
  SCN-specific regions: Sequence locations=1-393
atgttacaaaaatcttgagttaaaattacgggattttgtataggctcaccctaaatcatctcgtcttttttacttcaagcggcaatgacccaatcgccccgtcctgcttatgtcagttctttgctgttgctcttccccatctttttgcttccctatgccgtcatatttttcatcgtcgtttccttctttttgttcctccattttcgtaaccttccttcacctgcgaacaatgtggccaatttcttccgcggttttcacctcggagggcatcgcggaagtcccacaaatgctcccgaaaatacaattgcttctttcaaacaggcactggcggagggcgtcgatttcgttgagttcgacatcggtctaacggctgacggagtgcctgttctaatg

SEQ ID NO: 97101 - DNA, 438 bp, Heterodera glycines
  SCN-specific regions: Sequence locations=1-352,376-438
tggagaaggctgctttgcgtatcgcagaagggaagtggttgaacagcggacagacttgcctggcgccggactacgtcatgaccacggccgagatgaaaccgaagctggtgaacgcactgcagaagagcagtattcgagaatggtcaatcaacttcatttcgaccgagtgaaggcgttgctggacaagactaatgggaaagtgctgtacaagaatggggagccggaccgagacgatgtgttcattccgccggtcttggtggatacggacttgaaggacgcactgatgcaggaagaagtgtttggacccgtgctgcccatcctcaccgtgaagggacttgacgaggcgatggacgtgatcaacgacggagaaaagccgcttggggcgtatttgttcacgaacgaccaacaaaaggtggacaaatttttgaacgaaacttc

SEQ ID NO: 97102 - DNA, 188 bp, Heterodera glycines
  SCN-specific regions: Sequence locations=1-115,140-188
ggcagtgagaacaagcggagaaatggggagatggacggagagtgctttgtggacaaaatgagtggcaaatgggatagtagccaacaataaattcttttgctgtgtaaaaggtgttcgttttcaaaatctgcctcattttatttgcctactgtatgtatttaccccttctttctgttgttacggtgtgt

SEQ ID NO: 97103 - DNA, 542 bp, Heterodera glycines
  SCN-specific regions: Sequence locations=1-542
accatgattacgccaagctctaatattcctcactatagggaaagctggtacgcctgcaggtaccggtccggaattcccgggtcgacatcatcatcatcatcatggccgctaatacgactcactataggggcatttttcttttctttcttttctcatttacattgcgtttccgcaaaatgtcaaatttgaattttgaagacaatttgcaacgcgtacaagtggaaattcaatggaagcaatgcctttgtaatccgatcgtcgctccgttcgccgacgtcggctcttacccaattttcactgacgaattcaaagggacgcgcaagtgcactttggatgtgtacgttcagggaaacttagagcatttggacgacaaagttgttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagacttcccctcc

SEQ ID NO: 97104 - DNA, 424 bp, Heterodera glycines
  SCN-specific regions: Sequence locations=1-424
accatgattacgccaagctctaatactactcactatagggaaagctggtacgcctgcaggtaccggtccggaattcccgggtcgacatcatcatcatcatggccgctaatacgactcactataggggtctcatttacattgcgtttccgcaaaatgtcaaatttgaattttgaagacaatttgcaacgcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgttttcctcaccgttcatgacgttggcaagacgtatttgtcttgcgtggaccttgccaacagtccgacgc

SEQ ID NO: 97105 - DNA, 226 bp, Heterodera glycines
  SCN-specific regions: Sequence locations=1-5,38-107,134-177,200-226
taagcattttaaatttaaatttatttaagaattaaatggatttaagagtgttttttaaatagttaatcgatttccaagagtttttttatatgctattttagaatatattaaactaaaataattcattttgaaagacggaaaatcaattagatcttattttacaaattccgataaaaacttactcaaaaatggaatgaaactgagaaagtgtgggttggcaaaaggc

SEQ ID NO: 97106 - DNA, 265 bp, Heterodera glycines
  SCN-specific regions: Sequence locations=1-265
ggactcggaagcggtgagaaatgttcacatttatattttaattacaaaaccagcggcaagaaaatgtgggagggaatgattggctattcatagtttgattctcttccacttttagtcagaagattctcacccgctgctgtggcgtcccgaaatactcaaaaaacagcgtttttaatcctgttgttttaattttgcattatacatgtttttaattataaatgaacaaacccaaaaatcacaaacgcacaaataaataaatatggac

SEQ ID NO: 97107 - DNA, 271 bp, Heterodera glycines
  misc_feature (271)..(271): n is a, c, g, or t
  SCN-specific regions: Sequence locations=1-271
catttgcgggctgcccgagctgtacgattgggttctgaccgcaacacatccaaatgaaatggaaaatgaccgaatcccccgttacatcgcttttctgatttggtacccgggtgtcatcacgcaaatcgtcctcttttcttttgccgacaccccatcgcagaaccgttacgaacttttggatcgacaaatttcgcacatttctcgctgattctttttcattttccaatcctatagacaaataatgcttttaaataaacatattaagttttan

SEQ ID NO: 97108 - DNA, 166 bp, Heterodera glycines
  SCN-specific regions: Sequence locations=1-166
gaatgtcagtgaactcggaatggtcacacagggcggcaaagtggtgtgggcaaaatacgctcaagtgactaaccatcccgagaacgacggatgcatcaacgctgtccttttgttgtagagcgaccttttttgttatttttttctttttaaaaagaatttgttaaaa

SEQ ID NO: 97109 - DNA, 540 bp, Heterodera glycines
  SCN-specific regions: Sequence locations=1-540
accatgattacgccaagctctaatacttctcactatagggaaagctggtacgcctgtacgtaccggtccggaattcccgggtcgacattatcatcatggccgctaatacgactcactataggggatttcactccgtcctatgagtcttcggacctccgtgaagggatggcccttcagaatgtccaggcccgtgctcggatggtcctcgcctatttgcacgcgcaactgacgctgaccaaagagcggcggaaagggtctttgttgatcttgggcgcctcaaatgtcgacgaaagtttggttggctatgtcaccaaatacgattgttcctctgccgacattaacccaattggtgctacctcaaaggatgatttacgtgagtttctgtgccatgcgaatgctaatcataaattcccacacttacaaagtgtcatccattcggtgccaaccgctgaattgcgtccactgaaggacggccaaattgtgcagacggacgaagccgaaatcgggctcacctatcgggaattgtccacttttggcaaa

SEQ ID NO: 97110 - DNA, 550 bp, Heterodera glycines
  SCN-specific regions: Sequence locations=1-332,354-359,381-550
tttccccaacctcatgtgcccagcgatcacattccgatcatgtcgcaatatgccgtcattccaccaaacttccagagatctttgccgcccattcaccattacggaggctccgcacattccggtggttttggtgcgatcggacggtaacgacggcaattttacaacacatgtgacagttttcatttttaaacgttgtcaattatgtaaattcatctcttatcactcataaaccaaaagacatgttttatgtatgtttgttgatgatgctcttccacacagactaatggtattgacacgttttgtgtacatactttttcttctttcctcgattctttctcctcaacagaataatatatataaaacagttaattaggagatggttgatgggttgggatttattgtaactccgagaaatttttgccatctcaaaagaatccgtttttcttatcccctcctcatcttcttctgctgctgatcgtactcaaagtccattcacctcatatgtgttccattcgtttgtgcttttccatgtaaaaaacggatgataatt

SEQ ID NO: 97111 - DNA, 394 bp, Heterodera glycines
  SCN-specific regions: Sequence locations=1-394
cctaatttgaaccgcagttttattgatggaaacaatttgcagcaattctcaagaagtgcttcttgtcaacaatttacaacattagcgaagactgtgtctccaaaagtagtcctccgcctaagcagcccccgtccgccccgactcgggcatgggcagtgacgaactgtcgggtggatgggtcgggagatttatgtgccaaacattggacaagtacataaactcgatgaccatgctaatgagtccattctcttctctcagcattgtgcccgttttgcctgcctccctcccggcctcttctgtctgcaaatgggtcgacttcaccaacaaacatgggttcggcgtcacttttcgtgatggcactcggtcgttgctattcaacgatcagtcgtccctt

SEQ ID NO: 97112 - DNA, 394 bp, Heterodera glycines
  SCN-specific regions: Sequence locations=1-394
tgaatccgcctaatttgaaccgcagttttattgatggaaacaatttgcagcaattctcaagaagtgcttcttgtcaacaatttacaacattagcgaagactgtgcctcaacaaccgacagtctccaaagatagtcctccgcctaagcagcccccgtccgcccacgactcgggcatgggcagtgacgaactgtcgggtggatgggtcgggagatttatgtgccaaacattggacaagtacataaacccgatgaccatgctaatgagtccattctcttctctcagcattgtgcccgttttgcctgcctctctcccggcctcttctgtctgcaaatgggtcgacttcaccaacaaacatgggttcggcgtcacttttcgtgatggcactcggtcgtt

SEQ ID NO: 97113 - DNA, 268 bp, Heterodera glycines
  misc_feature (266)..(267): n is a, c, g, or t
  SCN-specific regions: Sequence locations=1-268
ttattacagcttttcaatgaaatggcaaaagctcatgaagtttggagaccaatacatgaatttttatcggtttggccctcaacttggtctcggcctttgtttgttcacttttgttggtgttgtgtttcatggcgagcatatgaagctttattggaacggaaggatgaggaaatggtggtacaattggaaggaggactaacaaaccattaattaattataaatgatcgtttttattttttctttgaaatgcaataaacaagccatcnnc

SEQ ID NO: 97114 - DNA, 494 bp, Heterodera glycines
  SCN-specific regions: Sequence locations=1-494
tcccaacccagtagcttatagggtgaccgagcacaatcgcctcgcaacaaacctaccggcgccatccctcgggccaccctccaatcgtctgttccggtggtgggcccttcggtcacttgtcaggcgcgacggctttacgtcgggaacattccattcggttcaaatgaagacgcaatgctggactttttaaccaacagatgcatttgtgtggtttggcacaggctccaggaaatccggtcattgcgtgtcagataaatttggacaaaaacttcgcgttcattgaattccgttctatcgacgagacaactgctgggatggcatttgacggtataaattttatgggtcagcaattgaaaatacgacgacctcgcgactatgtggctccaaccgctaattacgaactgcttggcagaatgccagtctctaacattgttgtggacagtcctttcaaattatacattggggggactccctaaccatttgaactcggaaca

SEQ ID NO: 97115 - DNA, 809 bp, Heterodera glycines
  SCN-specific regions: Sequence locations=1-809
gcttttggacaaaagggaaaactgttggctgtcattggagatgaagacactgtggtgggctttctccttgggggaggcgaactattgaactcagagcgtgaaacccccttttggcgttgtcgaccccgacgcaagcgtcgccgaaattgaggacgcattccgcactttcatgtacccgcagagacattgcgattattctgatacaccaacacttggcggtagcatgatctcgataccaaagtggcaccagacacagtggctcaccatcccggtcgtgctcgaaatcccctccaaagaaatgccttatgacgcgtccaaagatagcattttgaaccgagcacgtggcctggtgaacactgacgacctcaagtcatagaagaagacattacaaaaaacaaattctcctttattagtcaatgaatgtgtttaattaattatgggaatgacgagaacctacatacaaatttgtacttttggtcttttcttggtactccaaaacccagacattatgcacaacaaaatttggttttgatgcatctatcagcgattgatcccttcagcacgttgaatagtaacatttattcccaaattcccgttttcagcaaaaaaattcgcatgatttgtgtcaaaagccaaacagtctgattgagaaattgcggcagcgaccccctcgtgaatacttcgtggactggcttcccagcaaagtcgacgccgattgttggataattccaatttgtaaacgaaattttcggcttcctttttggtcccaattagttgaacaactgcgtagaacatttggtagctttgac

SEQ ID NO: 97116 - DNA, 535 bp, Heterodera glycines
  SCN-specific regions: Sequence locations=1-535
aatgataaaatatcttatccaattatattattaatcttatttcaaataaatattgtcgctttagtcaagcggtggtcgcttgtactgccgaagacccgcaagcgcaactcgtcagtatttgggatgaggccgaaaatcggcttatttcacaaattattacccggccgcttgcacgttcacttcagacctataatttggcatcaccaattttcaacactttttggatcggtcttcgccgtgtccttgtcggaaatcgctaccaaagcacatggacaaacggttcggcagcaatatttggcaatgttcccgaaattacaactgctgcgtcaagaaacacatcgccatgggcagcaggacaaccctcgggcaccaacaaatacactgacccaaccggcgcaaaagaggagtgcgtgcacatgctaaatgcagaaggccgatggaacgacgcgcgctgcgaaattcaaatgacaggcgcgatttgcaaaaaatcaaatttttaaatacaattgatggacgaattttaatgggcataagc

SEQ ID NO: 97117 - DNA, 383 bp, Heterodera glycines
  SCN-specific regions: Sequence locations=1-101,124-383
tttttttagctctctggcaccaagtcatcaagtggtaaagcgtcattgctcctgtggtggcagttggggcggctggggtggcggcggtggagcatgtaaaacaaattttttatgaaactaaaactcaaattatggtctggaacagaccgggccgggattggatttgagaaatttagggtttcacaaaatccaattctaagggaataaaaaattgaaatggctaaattaggacgaaatctcattgtttttctacggcataaattatttcggggttttttaggatgcacttggcactcacaatttaaggacaccgagcatatgggttgttgctataatttcaggcggtgaattcggttctggaatagaccgtctgaagtatgcga

SEQ ID NO: 97118 - DNA, 283 bp, Heterodera glycines
  SCN-specific regions: Sequence locations=1-232,260-283
ccgttctttaggcaattgctaattatgccgggcacatgtcgttcaatttggtgacgcaaaaggtggacgagcggagaatggcaccgcaagcaccgctgtttaacaaattcaacggacacaatttgaaacagcaggacacaatgttttttgcatttgtttgcagttgtccctttgcgttgaaaagcatgcgtgacccaacgatgagttcttgcccatgaacacattcttaaagaattaattttaattttaaaattttattgggtaaataaatgcattaccaatc

SEQ ID NO: 97119 - DNA, 474 bp, Heterodera glycines
  SCN-specific regions: Sequence locations=1-45,67-433,456-474
ttcattttcaaactactctctctcactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacatatggacaaactccgcctggcagtccgaaaggtgggcacggcagcaacaaatcgccaacgacgccgcacagtgccggttcgccacacggcacgcagcatggtaaccaacagaaccatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaatcgccgccagacagtacaaaacgggaaacagaacttataattgagaaagtttca

SEQ ID NO: 97120 - DNA, 553 bp, Heterodera glycines
  SCN-specific regions: Sequence locations=1-29,51-553
tctctctcactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacaaagggacaaactccgcctggcagtccgaaaggtgggcacggcagcaacaaatcgccaacgacgccgcacagtgccggttcgccacacggcacgcagcatggtaaccaacagaaccatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggca

SEQ ID NO: 97121 - DNA, 298 bp, Heterodera glycines
  SCN-specific regions: Sequence locations=1-53,77-298
taggacaattaattgcaaatttttacattcatttcaggaatactttgtacgacagtgaaatttttcagttgcaattcagatttgacgaccaatacccattctcatcgccagaagttatgtttatgggtgaaaacattccggtgcatccccacgtgtactccaacgggcacatttgcctgtcaattctcagtgacgattggacacccgtaactttggcagttcacaaaatgaccgacaatcctcaaactgtttttttctttttaggctctcagcgtctcttccgtttgtttgtccattc

SEQ ID NO: 97122 - DNA, 390 bp, Heterodera glycines
  SCN-specific regions: Sequence locations=1-390
caccaaaaagaccctgaagtttcttggagaaatgacgcaactgagggtgtgctgggcaagctcaccacgacgatgggcccttgtttctgcaaaggaacagcttacttaatacattcgttcctcaacgcttcacacacgggaggtatcgcactgattcagtcgatatgtcgccaaattgaccaaaaaaagtctcccatcacaaccagcgagtgtgaaaaatttgaatcaaatcttttcggttccaccatcaaaatggctatcgaattaaccggggatgatgtcatgtgcgagctggttgctggaccatggtcaatgtctacttttttcctttttttaaagtagtgaccgacaaatggggttttggaatttttttaaattgaacggcgccga

SEQ ID NO: 97123 - DNA, 393 bp, Heterodera glycines
  SCN-specific regions: Sequence locations=1-393
caacaattacaacgtgatcaagtcgggaaacgtgaaaatgacgacaacaaatccaaattatgacaagccgctttgcttgaatgggctcagtcaatacgaggcgttgccctcctcgttgtgcaatctcaatttatgcaatttcatcggccgcaatttgtgcgaattgttgcaacagccaggcaatcacacggtgcgcgagatggagcagaaagcgggttggaatgccacagttgtcatgcccgattcaccaagaatattcggcatcccttttgtggacctttttgctggagagttcaattttgaatttctgttggaaacggagggcaaagagattgcgcatttggaagtgccgacgaatttggcatttgtgccaatcggaatgcaaaatgagga

SEQ ID NO: 97124 - DNA, 565 bp, Heterodera glycines
  SCN-specific regions: Sequence locations=1-238,261-565
tcgcttttcactaaaatttacaaattctgctgtaactcaaaaagctttattccttcctggatatagcatatattttgtatgagtgcgcctaacaacagtccttcgagcatttcttctacaggaacaaacggaattcgtataacacgacagaggagcagtgctcgcattaattggctgaccgaactcaccacgcgcgattcaactccagttacaaccacccaaacttcaaaggatttttctgaaatcagcaaacatttagcgctcgttgaggacgaagacaatattaaaaggattcaagcaaaacgagaaaaagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattcagaatggcaatggt

SEQ ID NO: 97125 - DNA, 389 bp, Heterodera glycines
  SCN-specific regions: Sequence locations=1-389
gtccagtcactttgttgatggacttggcaataagcttaagaccgccgtaaacaagggtaatcatttgatattgtatcgtccaaaaccattactgtttgcaaccgtactttaaggtcttccggtgttcgtcactgagtacggtacatgcgaagcgtctggcaacggtaatctgaactccggctcaatgtcaagttgtttgtagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtttgtctgaccaattaaac

SEQ ID NO: 97126 - DNA, 383 bp, Heterodera glycines
  SCN-specific regions: Sequence locations=1-71,93-383
aaaaccgacaaagggcggactattcggactgttgggcaagtcgagttcgatggaagtcagctcaatgtcggaaaagaatttgaaaactccaaaggcatttcgaaagggcgaacacgtgcccagtgaaaaaatgcccggttcaaacgaacggacccgcggaggcggcggcagtccttccccgtttccgtcgtcgtcgcttccgcgcggggggcgcaatccgttcaaagggatcagttcgcgcatcgtggaacgcgtgcgcaggtcgctgtcgcgcagtaaaaagaatttaagccgcgatggaggacaaagtcgggacggaacgccctcacagaacaccatcggcataaaagcaggtggggaagtaagagaagaagtggactgat

SEQ ID NO: 97127 - DNA, 493 bp, Heterodera glycines
  misc_feature (5)..(5): n is a, c, g, or t
  SCN-specific regions: Sequence locations=1-372,404-493
cctgnattacgccaagctctaatacttctcactatagggaaagctggtacgcctttccgtaccgggccggaattcccgggtcgacatcatcatcatggccgctaatacgactcactataggggcgtatttttttaggtcgattcttaggggtgtgttttttgtttttattgcatttttgttaaggaattttccaaaaaatctcgaaatagtgtcaaaacgccaaaatagtgatttttcactattttagtgacaaaaccccaaaatagtgatttctagtgacgaaaagtgacgtccaaatgaaaaaattttaacgcagagatgcgttttttgagctcctttcttcaaaacaattgttctataaaaaaaaaaaacgactctgcgttgttaccactgctttagtagtagtaggcgccgctctagaggatccaagcttacgtacgcgtgcatgcgacgtcatagctcttctatagggtcacctaaattcaattcact

SEQ ID NO: 97128 - DNA, 480 bp, Heterodera glycines
  SCN-specific regions: Sequence locations=1-83,106-480
agcaaagcttgcatcccgccccatggctttgtgcatttgtttagctccaaggtcgaatttctgtgcatataccttttcgagatggagaagagaaggggtttttccggaatgtttttatccggaatggttcccagtgcatgaaatgagaaaaagagacacacactcttctttttatagattccataagcctacccaaaattgggtcgctattcaaaaggaccccctccctcctccataaccttagccgaaattggttttgtatcagcaaatgaaagacgccacaatataatcagcaataattgttttgaagaaaggagctcaaaaaacgcatttctgcattaaaatttttcgattctgatgtcattatcagtcactagaaatcattattttggcgacttcgtcactaaaatagttaaaaatcactattttggcgtttcgtcgctattttttcactatttcgacattttttggaaaattctt

SEQ ID NO: 97129 - DNA, 344 bp, Heterodera glycines
  SCN-specific regions: Sequence locations=1-40,62-301,323-344
ggttggccctcgcacacaaaatgccccaaaaatgccggcactttgggcattttccaaagtcactgattgatttgccattcctttctccaaattatcccaacggaagtctaacacaacgaattattacgatgccaataacagaaaaaagagtgccgttgaggatgaaacgccgaaaatcgaaaatacattctcgaaatgtgctccgaacgccgctgataattcccgaattggaactgatgaaaaagtggcgaaacagtcgaagaaatgacgaaaagccaaggggagaattaccaagccaaggggaagatgaagcaataaaattattgctgctgaatgatattggg

SEQ ID NO: 97130 - DNA, 497 bp, Heterodera glycines
  SCN-specific regions: Sequence locations=1-38,60-354,377-449,471-497
tcaaactactctctctcactaactgttgcacatcccaattttatttcttccttagtaagtagtattggtgcacaatgcgcacttttctgttcatagctgtagtcgggttggtgttggctgtcatcatggagagagtaaatgcgactgggaataattcgccgacaaagggacaaactccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtacaaaacgggaaacagaacttataattgagaaaggaaaaccgtcgccagacagtccaaaccataaaaatgaccatgaaaatgagattagtaacctacagaaccgtgctaccggacaatcgccgccagacagtacaaaacgg

SEQ ID NO: 97131 - DNA, 205 bp, Heterodera glycines
  SCN-specific regions: Sequence locations=1-205
gaacgaagggaaaaaccaatggcggagaagaagaatgaagtgccgaaacaaactaacattaagcatcgaattgtaacttttaggtgcaagatgagaccaatccaaccgaaactcattgtcagtcatccaaaatgtcgcctcctttacttgaaatcgaaaatgaactcggacaaaacccaccaaataaagtgaagccttctccgca

SEQ ID NO: 97132 - DNA, 539 bp, Heterodera glycines
  SCN-specific regions: Sequence locations=1-539
gaggaaaatcaacgaaaatagtgaactccactcgaagttattcgacgttgaaaggcgttttgacgaagctgtgacggcattcactcgtcggattgatgaattggagaaggaaaatgacgccctgaaaagtctcgtttccattccattcgatgccgaacagcgaaaagaatttggcgaatcggaaaacactgccccggggcaaacacttcagcagacggaggcaaattcggaggagaaaaatgcgccgtcggcggttgtgccgaagaccgactcggccgatgaccttttgggctgttcctctgcttttgcgaatgaatccgccgatttatgcagcagaaaaccatcggcaattgcaaaagacgaagcggtggaggaaatggcagccgaaaaatattccacggagagaattgccgccctcggagaatcgctgcggcacgcaaaaggacgtgcgacctattacaagcaggaatgtgaggaattgctcagaaaggcaatctgtgaccagcagcgcatcgaagcattggagcagaacattttcg

SEQ ID NO: 97133 - DNA, 586 bp, Heterodera glycines
  SCN-specific regions: Sequence locations=1-171,194-421,443-508,530-586
accatgattacgccaagctctaatatttctaatatagggaaagctggtacgcctttacgtaacggtccggaattcccgggtcgacatcatcatcatcatggccgctaatacgactcactatagggaagcgccaccgaagggtcaatggaacgaaggccgaattccaaactgaaggtaaatttggaaaataaatgctgttccccatttataccgtttcaaatactcgcggtgccacaaaggaaaggtcggaccgccgtgggcggacggcattttgtcaatgccgctgtggagaaaggcgaagcgatcgtactcggagcagccgttgtacagatgcttcagtttcaagagagcggaatgctttaagggtggtaagaggttttgaaatttcacaattaaatttaattgcttacgaatcggtcccgttgctcatcactgagcattcggtattccatgcgcaatgccttcccataacttttcccattgattgagcactgagcaggcgaagaggaaattcctgaaattggaattgaattagaatttaaccattaattagcttagttaaacaattgtatttgtttattattac

SEQ ID NO: 97134 - DNA, 394 bp, Heterodera glycines
  SCN-specific regions: Sequence locations=1-207,229-302,324-394
gccaaaaaacgaattcaaagcgttggatgccttcgctttgtccgctcacttaaggccgggccgtcatcgatgcgattgtcaggcgcgtctccattctttggtgcgcaattgcattggctgtggacgcattgtttgtgcccaggagggaagcggacggtgcttttactgcggccgtttggtgtgcacgagggaggaaaagacgataattgagaggaaggacggtgagggtttgcgactgttgagatgccttttgaacgacttgcaagcggactacttcagtttggagcataatccatacttgacagcagccgaaagagaggcaattggcaatcggaaggaggaattgagacagctcagtttgagtgtcaaaaggaatattctcgtcgatttggac

SEQ ID NO: 97135 - DNA, 763 bp, Heterodera glycines
  SCN-specific regions: Sequence locations=1-160,182-343,365-451,474-763
agtggatcccccgggctgcaggaattcggcacgaggctcattacaaattcacaaaattctcctgcttattgtgtgcttgcctatgaccacggggatggtgtgttgcgcgagataattgaccatcttggtctcttggaaagtggcgggcttggagcccagcaaaagaaaattggttccgaaactttgccatgccacacgctccatttggacacaaagtattacacatgcgatgtgcctttgctcagttgtcactcatttgtgcgtctcaaatcaatttgtgcagctgaacgacgtagcaatttgtcagtgttcgctgtgctcttttgtgtcactcggcaacagttgacagaagactttctggcattggtatcacaatactcggccagtttggagaaggcggaagtgaaggcacttgttttgcgtgatgatcaaactgaagaagcaaccacctcaatgaataccaatgatgaagtgttgaacaaatttgctctgtcacgacgcatcgaaatcatcaaaatcggacggaaaacgacaaatgttgtggacgatgatgaggaggagggcttggttggcattccgcgaattgtggaatccattgaaactgtctgttggccgaacatgaaactgaagccgaacccggtgaagttttttgagcatcccactcctcttgaaaaatacatcaactccgaggcgtgcgctgatgacactgcggtttttgacatgttccccggttgtgctgatgattttgctccgggaattgcat

SEQ ID NO: 97136 - DNA, 394 bp, Heterodera glycines
  SCN-specific regions: Sequence locations=1-394
gcgaagagctgatcgtcatggaacactttgtagagctgaaggataaaacaatagcagtatacccataaaaatgaatttcgaaattgtcggcccgaagaaggggagttaatggaaattcgatttggtggcaacagcgaagtcttgtgcctttcgttgcgtccaaaatatccattcgacgaaccattgtccgctcggtgtacagccaccgaatcgtccatggacactgacgccagcatttgagagtccggtgaccaggagattccggtcacatcaccatcatgtcgtatcggacttcgaaacgcccttgcccaattctccttgttcggcggaatgtccatttcggggtcggcgtcacgttgtcggacagtcgccggctcttccagcatttgcactt

SEQ ID NO: 97137 - DNA, 207 bp, Heterodera glycines
  SCN-specific regions: Sequence locations=1-11,35-142,164-207
aagagcgccttttgccgccgcctccgccgccgacaatctcaaaactgcacagaagctgcactgaagaatcatcggctcaaaattcggtcattctctactgagaaaggaaaagcgtagcgaaacgcaccaaatgcattcattcattttaattgtttcattttgcacattttccaactgacttgctcaagaataaagcacacattattt

SEQ ID NO: 97138 - DNA, 387 bp, Heterodera glycines
  SCN-specific regions: Sequence locations=1-268,290-302,324-359,381-387
ccctccttgataatgctcggcattttcgttgccactttcttttcatcgatgagcaatttaatcggcgcctcgcgcgtactcactcgatttgcacaggacaaacttttcggcgctttgctcagaccggcgaccatcgaagtgggctccaaacggaatcccatcatttccgtcattatctcgtggatttgtgtcgtgatggttttgatgatcggagcgatgaatcgaatcgccaaattatcattcccaacaaacacaggaataattagcggaaaaatgtaaaagaaaagctgtgcgatgattaagggaattgtgaaagaaaaacgttttattccgtaatgagtcatttgggcgaaaaattgagtttatttttgtattgttttggatcaa

SEQ ID NO: 97139 - DNA, 198 bp, Heterodera glycines
  SCN-specific regions: Sequence locations=1-68,90-198
cgctcgtcctccgcctcgggcgattaatgtggtggcgaacaaagaatggatggatggaagggttttgattgctttggttgaaatgatcgcttatggaacgattaatttgttatttttcatcagttcaatcccttcaaaggtattgagtctcaaggcgcttttttgcctgcttttggttaataaatttcatttctgaaa

SEQ ID NO: 97140 - DNA, 386 bp, Heterodera glycines
  SCN-specific regions: Sequence locations=1-386
gcccaaagttggcacttttgtttgcgggaagaaatgctcaaaaataaggttggcccgttttcttctcaaatggtgtactgcttgaagttgttgctgctgcgcgctttctgagtcctgccggatgccaaactccgcgtcaaagtcgggaaatttagggaatatgggcttcgccgttgccattggccgatggttttctgccccgctgggccgacggagttgatcctctgtttccgcttgcctccttgggccaattgcggtggggccaaatagcggaagcaaatgtgcgtgctgttgctgacgttgaactcgttgcagcactgcacttcgccatcggaaggagcctgccaaaaaatgttcatcgaattactcaattcgctcgcaaatgg

SEQ ID NO: 97141 - DNA, 244 bp, Heterodera glycines
  SCN-specific regions: Sequence locations=1-244
actaaacccgggcgaactcgactttaaggagggccaaatcattcagctcgattcgcaaattgacgagcattggtttgagggcacagtggacggccggaccggctttttccccatcacttacgtggaggtgatcgtaccaatcccttcttcttccacgactgcacaacaataaactttgtagaacaccgaacagatgtttccccctccccccccggatgggcaacagaacaagtcaaacaaactc

SEQ ID NO: 97142 - DNA, 296 bp, Heterodera glycines
  misc_feature (295)..(296): n is a, c, g, or t
  SCN-specific regions: Sequence locations=1-194,217-262,295-296
ggaccattcaatttaattatacccaattaaaaaaagtaaatcctctttaaaaatgaaattttcaataattttattgctttccttggccttttgtgcgttaatcatcgatgcatatccatcgggaaatggtaaagatcttgaagctgacaacgaaaaaacggaagtggccgctatggaaatgacggtcgtcgatgaacgaaaagaaacgaaacgatagattaattaccgtatcattaattcccactaattacaaaacatttactattttttaaataaaatgtttttttttttaaann

SEQ ID NO: 97143 - DNA, 541 bp, Heterodera glycines
  SCN-specific regions: Sequence locations=1-288,310-487,510-541
gattacgccaagctctaatttcgtaactatagggaaagctggtacgtttccaggagacggtccggaattcccgggtcgacatcatcatcatcatggccgctaatacgactcactatagggctgtcatgccaccgaagggaatccgttcggtcccttttggcgttacgcaggcacacattttgtgggcgaagaatattttggggtgaagacgggcggattcgacacgcaaagggagacaatcagagaaaaatgggcgacggaattccccgcccattcttcgcctgtcctcgctttttcttctgcccccgccgcttttcccgtccgccccgaccaccgtttcatccagcgattcgtccagtggaatgatcgaattaagcaaaaagcgattgaatttgcctcccgcaactttggccacggaaaggcattcgttggcattcatttgagaaatggcagagattgggaaaatgtgtgccaatttctccgggaagaaaatgtaatgggaaaacgacaactgtttgccagtggccaatgcacggggccg

SEQ ID NO: 97144 - DNA, 369 bp, Heterodera glycines
  SCN-specific regions: Sequence locations=1-127,150-223,255-267,314 -328,350-369
aaccctttgccacattgatggtccaaatggagcaaacgccctgacgcttgcgcacctgcgtcgccggaggtgcgggcggaggagcgaactcgccaatattgccccgttcagctcgcatcggcggtggtccgccgcgctgctgctgctccggcgggtaataatcgccacctccgatgtcgggcgacgaccgttcacggtgagccgagtcctggaactgtggacgaccgccaccgcctcctccaccgccgcctccgtaagcgcgaggcgctcctccgcttccccctcctccatatcctccacctccccatcctccattccaaatcaattaataattgtaaacaatgcttttgtgttaaatgtgttttttct

SEQ ID NO: 97145 - DNA, 384 bp, Heterodera glycines
  SCN-specific regions: Sequence locations=1-1,44-61,89-384
tatcaaaaatgaaactattctcaatgtttcttctcctgactttggcattcgccgcttttgctgagagcagcagcagtagcagcagcgaatcgtccgaatcatcggaggaatgttcttcagaagaaggcaatcccggtacagaaccggagacgacaactgttgttgattcagacgaaaattgcaacgcgacatcagatagtccaaatgatgagtcatctcctgtgccatcgtcggacagtccaaatgacgagtcatctcctgtgccatcgtcggacagtccaaatgacgagtcatctcctgtgccatcgtcggacagtccaaatgatgagtcatcgcctgtgccatcgtcggacagtccaaatgatgattcatcgtctgtgccat

SEQ ID NO: 97146 - DNA, 400 bp, Heterodera glycines
  SCN-specific regions: Sequence locations=1-29,51-68,96-400
atataattatcaaaaatgaaactgttctcaatgtttcttctcctgactttggcattcgccgcttttgctgagagcagcagcagtagcagcagcgaatcgtccgaatcatcggaggaatgttcttcagaagaaggcaatcccggcacagaaccggagacgacaactgttgttgattcggacgaaaattgcaacgcgacatcagatagtccaaacgacgagtcatctcctgtgccatcgtcggacagtccaaatgacgagtcatctcctgtgccatcgtcggacagtccaaatgatgagtcatcgcctgtgccatcgtcggacagtccaaatgatgagtcatcgcctgtgccatcgtcggacagtccaaatgatgagtcatcgcctgtgccatcgtcggaca

SEQ ID NO: 97147 - DNA, 443 bp, Heterodera glycines
  SCN-specific regions: Sequence locations=1-73,128-263,285-331,409-443
gacggaagaagtctttgaggtggattgaatccggtgatcttttcattccccaattttgtgctatatgttggttttaaaaaccagtgttgttatttattattttttgtctgtttgtctctctcttaaatcccaaatgctttttgtcatggaatgaaattgttgatcaccaccaataaattattacttctttccaattttgtggtggagatcaaaagtggtggaccaaagtaattgtacctcgatcccactcgcccccaaatttcttttccattttggccctttttaccgtatgattcatttatgtttagttttcttgctcaagtcaaactgattctcggttccattttcgctttgttttcactgttgtgccaatttttgttgttgttttgtgtcttcgtttttgccttttatcaaaagccagccatggacagtaaaaaagtata

SEQ ID NO: 97148 - DNA, 276 bp, Heterodera glycines
  misc_feature (274)..(274): n is a, c, g, or t
  misc_feature (276)..(276): n is a, c, g, or t
  SCN-specific regions: Sequence locations=1-276
aggctgtaagaaaaatgctggattcaaaggatttttctaaagcgaatttttgaacggggaaaactgactgattttcagaagattctgctatctcacttttcttctgtatatactgatacaaattaataataaccgaacaaaagttggaaagctttgtcctgtcggatgaggacatggtacattactcagttctcctacgagatttccacttaataataaaaaatgtatttttttggggcttcttataagttcttgattgtattcattgataacntn

SEQ ID NO: 97149 - DNA, 165 bp, Heterodera glycines
  SCN-specific regions: Sequence locations=1-121,162-165
caaatgcaaaataacacaaacatcaaatagaaataactaactcatggtcctttcttttttaatataattttaatgccttttcattttgcaagtattttcctgtgataaattttttatgttcaaaaaaaaaaaaaaaaaaaaaaaaaaaaaaaaaaaaaaaatatt

SEQ ID NO: 97150 - DNA, 453 bp, Heterodera glycines
  SCN-specific regions: Sequence locations=1-453
gcattgttgtgatcggcttcaaaccgttgcatttgctgaaggattcgcatcggatgggcgccgccgtttttgtctatcccatcgaatcggtaatctccggcagttccgccctttaccgtgcccttctgaagcgctgtatggacaaacaattgtttgtcctcgtccgttatacgcataaaacgaacactcctccaaagctttgtgcgctcgtcccccaatcggccgaccgaattccgagtggttgtgtgagcagttccatccgaatggatggtcactctcatcagatgcattttttagacactcgcgcgcgaatatttctacgacggctttcatttggttgaaattcccttcgcggaaaagtcgcgatcgatggaaaagcgccttctaccgccagatggcggaattgggacatggcaattggccaatccggaccaagtggaggcggccaagcag

SEQ ID NO: 97151 - DNA, 150 bp, Heterodera glycines
  SCN-specific regions: Sequence locations=1-54,76-129
ggttcaatgtttacggagggaatctccgaaggggtgataatccgaaagatattcataaatgaattaaaaataaattaacaaggaaatacgaaataacgttcaatgaaataataaaattcacttttatttaaaaaaaaaaaaaaaaaaaaa

SEQ ID NO: 97152 - DNA, 541 bp, Heterodera glycines
  SCN-specific regions: Sequence locations=1-380,402-541
tttcaacactttttggatcggtcttcgccgtgtccttgtcggaaatcgctaccaaagcacatggacaaacggttcggcagcaatatttggcaatgttcccgaaattacaactgctgcgtcaagaaacacatcgccatgggcagcaggacaaccctcgggcaccaacaaatacactgacccaaccggcgcaaaagaggagtgcgtgcacatgctaaatgcagaaggccgatggaacgacgcgcgctgcgaaattcaaatgacaggcgcgatttgcaaaaaagcagctcagtcggttggaagcagcggcacggtcgtgtcgagtgccgtcgttttcccgtcttcggccttcgatttgtgcaatccgagtgtttcgcaatgcaatggttttggatggaccatttccagtggcaaatgctacaaagtgatcgagggactgatgaatgggactcaagcggtggtcgcttgtactgccgaagacccgcaagcgcaactcgtcagtatttgggatgagggcgaaaatcggcttatttcacaaattatt

SEQ ID NO: 97153 - DNA, 384 bp, Heterodera glycines
  SCN-specific regions: Sequence locations=1-67,89-134,156-384
cctcgttttcttcaattttacactcgacctgtaattttcaattttgaaatgttcacgaagcttttcttcgctgttctgcttcttctttccgtgctcctctcatttgagcatccttcccaaattgccgtggtcaatgcttttccttcggaagtcaacggccgaatgaatgagcacaggcgaatcaaacgcctcagctgcaccaacgacaaatgtttcaagaattgtgcaacggaaccgggctcgcagaaggaatgcgcgagtatttgcgaatgcaattttagcagcgggtcgattaaggcaaaacaaaatgattgaaacaaatgatggagaaagaaaagtgaaatggggagaaaaaggagcgaaaagtggtaggaaaaggaacga

SEQ ID NO: 97154 - DNA, 391 bp, Heterodera glycines
  SCN-specific regions: Sequence locations=1-30,53-120,146-301,323-391
tattttcagcattactctcacaatggcgtcaaaaattaaaccattaatttgtccgtcgatattaaatactgatctgtcagatttggctgatgaggtgaagctgttctaatagcatattataatattcattatgtgaaattcaaatgctttgctttagtgtcgaagacttatggccgctggtgcggattatttgcatttggatattatggacggtaaacggacaaaagcaacaaaaagactcgaaaattaactccctattaaagggcaaacaattgcgacttatttgagtcctttgccatcatttcccttccctcgcattctttcgttttgctttaggccatttcgtgccgaatttgacgttcggacatccgctcattgaatgtctgaggaa

SEQ ID NO: 97155 - DNA, 535 bp, Heterodera glycines
  SCN-specific regions: Sequence locations=1-471,494-535
tacgtcgagttggacgaactgaacaaaaatggggcggacggaacgcgcgcgaaattggaatattcgatgcgcgacgcattcggcggattggacgcgcaaacattggacgcgcacattcaaaaggcgaaacggaacggcacagtgttcgacgcattgatacggcacaaccacgtgatgtacgaggcgaacaacaattggcgactgaacgccacgcaacgtgctgttcacctttgtgccttggaatttgttgactacaaaatgtttgagcagtgtttggccaacgacgccaacaccaatgaccaaattcccgcggcaattccgttggccatcggcggtttcgctgtcccatttttggtcacattgtcttcaattctaaccttacttttgccattttgacttggtttctgatcggctattcctttttaaatattattgtttaatgagattaatttcactaattgctcaaagaagaaattaggacaaaaataaataggaattatttaacccataaattttatttataaatgctaatatt

SEQ ID NO: 97156 - DNA, 481 bp, Heterodera glycines
  SCN-specific regions: Sequence locations=1-481
gaaaatgaaattacattcggccactctttccaaaaggctctttttggccggtggtccttcgcccttctcgtcctccttttgctcgttttgttgtcgaattcgcttccgacccgtccactcattcccgccactctcagaatcggccgtttcttgcccaccgtcgtctgcctttttctgttgtttctctgctgccgtgctcttcttctcgtcctccaaaatggtcagcacggcatcgggcaatctgaaaagtgagaaacaattggactagtcactcttgtaaccttttcttaattccgataaatgtttaatcgatgagaattcatactttatggccatgtgtcgaacatttcgccacgggtccgtctcaaatggctcttcctttggtgccgtcgttggtgtcgtccctccgccgccgtttgcgcttgtgccgttgtgtggaggtgccaatgtgctcagtttcttcgctatgctgaacagatga

SEQ ID NO: 97157 - DNA, 606 bp, Heterodera glycines
  SCN-specific regions: Sequence locations=1-24,46-103,170-284,307 -408,439-506,529-606
tttatgagtcgtttttcggcatttgggatagaatttttatttcatgaaaaaaaaaattcttgaaatttttttcagcaataaaaattctgttactaatttatcatgaaatttttgagaaaatcgcttaaaaattttcaaaaatatttatcttgaaattttattataaaaagtgctatatccattccttttaccgtagcccataccgtaacccgtgattacggtgctgttgcactcataacctatgttctctatatcctgtaaattttgtccaggctggttcctctccctgtcctccatgctttgcattccaatctatgccatttatttgtgggtggtcaccgatggcaccgtgtcggagaaattcaaaaaactgtttcgacccgacgtgaatttggtgccaaaatcggacaaagaccgggaggaggagaaggaactgaaaagggcggcaaaattggccggcgttggcaccgccaaatgaacggcacggcacgaaaccgggcaaccataagataaatgatgatgatgatctcggcaaatgcatagaatggaggggcatagatgaatttgtggttaaattttgtaaattcccggatttccaacccccac

SEQ ID NO: 97158 - DNA, 486 bp, Heterodera glycines
  SCN-specific regions: Sequence locations=1-486
aattccgtgtttaatcgttctttgaaagtcacaaaatgtccttccaacaaattttctccacctccgccgttcttttcggcttagtttttattacgtcgacgctttcggccccagcaccaaaaccgcaaaaccaacaacaacacccagcagaaaagcagccattcaatgcttatctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggctatggcttcaacggatttgagaagcgatcgttcgattcgttcatggggcccggcttcaccgggatggacaagaaaaagagggcgttcgattctttcacggggcccggctttacgggaatggacagaaaatgaacac

SEQ ID NO: 97159 - DNA, 400 bp, Heterodera glycines
  SCN-specific regions: Sequence locations=1-400
tttcttataattgggggttttctttctattggctattttgaggcttcaacatcgaaacacttgagttcatgggttggaaattgaactgttgggatgttggcggtcaaaaaagtctccgtacgtattggcgtaattattttgaacgaactgacgctgtgatttgggtggttgatgcttgcgatgtctgtcggttggatgactgtttcaatgaattgcattcactgatcaacgaggaatgtctgcatggagttactctcttagtactcgcaaacaaacgcgatttacccggctcgataaatgctcatgaaatagaaaagattctccggttggaaaagataaaacaccactggcgcgtatatgaagcgagcgcttacactggccacggactgctcgaatctct

SEQ ID NO: 97160 - DNA, 234 bp, Heterodera glycines
  SCN-specific regions: Sequence locations=1-169,192-234
tgtgtgtttggatcgctgtgtttccaaatatttggaggtccatgatcggcttggcaaactcctaacgcagatgacgcagcaggacgatcgtgcagttcaacagcagcagcagaatttggcagcggctgctcaaaagatgcacatcaacaaatgattagattgtctcaccgttgatttttgtcattgtttgctcaattcccaaaattaaacaatgctaagcgaaaaagaaaaaaa

SEQ ID NO: 97161 - DNA, 398 bp, Heterodera glycines
  SCN-specific regions: Sequence locations=1-221,243-398
cttcagctcacttacttcaggaaccaaggttctttttcgctgacttacgaggcgtccatcacgcgtttattccgtgagggtcgcacggaaacgattcgctcgtgtactaacgaatcgtgtgattttgtcagggcgatgttggacccccagcagaagaatgaggaacgtttgcgcttacttcgactcgcggcagaacgccaccagaatttgacacgggatgcgatgtgtgggaagggcgtggacaggcatcttttcgccttgtacgttgtcatgcgccatttggaagagagttcaccgttcttcgacaagattttcccgcctcaatatttgctgtcaacttcacaaaccccactcaaccaattcgattccgagcaggaaggcatttccatggcacagaa

SEQ ID NO: 97162 - DNA, 420 bp, Heterodera glycines
  SCN-specific regions: Sequence locations=1-70,96-420
gacagtgccgtcaatgtcttctggcacagtgtctccccttcgtgacgttcctctgcgtctctctgataagccctcccttccctttccctcccctcgccgtttgaccaatgactgtccttcttccccttctcccgctccgatcactttgtatctccgattggtcagttgggtctgctcaatgggtggccttctgttcggctacgcttcttcctccattaatgatttgctccctttcatcgtccgtgagatgcgtcttggccctgctgaggttggcgtggtcatctcctgctttatggtcggcgcgggcatcggcggttttgttggcggaaggctggcggaccgaattgggcgcaagcgcagtttggtgctgttcgacgcgctgttcattgtgttcagtgtgtgcacttcattggctccaac

SEQ ID NO: 97163 - DNA, 395 bp, Heterodera glycines
  SCN-specific regions: Sequence locations=1-95,117-395
tttgtacgctttgttcgatgggcatgccgggcgacgtgcggctgattattgtgccgagcatttcgctcgattgttcgttgctgttttcaagaaatgtgggaaaatttctatgaaacattattttttatatatacagatgtgcccccaaagagtgctatgtcagtattcgagaaatccattcgtaaagtatttgtcgatacttataagggtatcgatgatggtttccttgttgaagcaagacgacagaaaccaacgctgaaagatggtacaacggcgacaaccatttttttattggataaaacgctttactgtgctagtattggcgactcgaaggctattgtttgtcgacacaaatctgaaaagagcacaaatattccgctgcaaatcactgtgga

SEQ ID NO: 97164 - DNA, 220 bp, Heterodera glycines
  misc_feature (139)..(139): n is a, c, g, or t
  SCN-specific regions: Sequence locations=1-78,106-139
aaaaaaaagtggcggcgccagcgttggcccatcaaccgaatgaccgattgaagcagccgatggaagggacgaatgatctatttattcattcattcttttttgtgttttattattgtgctgttataaaaatctgaacacnaaaaaaaaaaaaaaaaaaaaaaaaaaaaaaaaaaaaaaaaaaaaagaaaaaaaaaaaaaaaaaaaaaaaaaaaaaaaaaaa

SEQ ID NO: 97165 - DNA, 394 bp, Heterodera glycines
  SCN-specific regions: Sequence locations=1-394
acgactgctccgcctgccgtcgcttatcagcgcgttgctggcgttctcgccgtccttgctgaactgctgcaaccaattaaggtcaaagacacacacattgagggcatcacaacggagcccaacccgaatttgaacgcattggaagggggcggggacagcgacgggggaggcgactcgaacggagccgaaggcaatggcgaagaagccggaggaccaatgaaaggcagctcttccggtggtttcaaatccgctggcgctccgcatgttcgtggcggatcgtttatgcgtggcggtcgtggaggaagcgggccgcctggaggtcgtggtggaatggccaatcgtggcggttttggaagcggccgtggacgtgggacgcctggcggaagtcgcggtg

SEQ ID NO: 97166 - DNA, 340 bp, Heterodera glycines
  SCN-specific regions: Sequence locations=1-104,126-340
aggggcgtacggcgcagtaggaaaagcgacggatgacgcggcatttacaaccggcgcattgcgacggacctttccgatgttttgccaatttcaattttaaaatcgcttacattcccttttcctttcaaatgatttgtttatcttttttgattctaattttttgctttctctcttcctgaaaagcttttttcctttacggatttttgattttttttttacctgatgaaaagtttattttgtgctggcaaacaaacagatggatattattgtaaatttaatgctacttttaagcattgcattcgttcaggtcttttctttaattaaaaatgaattggataaa

SEQ ID NO: 97167 - DNA, 114 bp, Heterodera glycines
  SCN-specific regions: Sequence locations=1-114
attgctctccgatccgtcatccctgaaaagggccgttgcaatgaaactgatcactttcgtctggacggcaaaatgtggacgcgattatctacgacagaatcggcgaattggaaa

SEQ ID NO: 97168 - DNA, 152 bp, Heterodera glycines
  SCN-specific regions: Sequence locations=1-90,112-152
gggggcgtggctgtcggtgcagcagttattgacacaccttttcttttttgaccagcatttatcaaaatattctaatctaatggcactttttcacttaatcattttcattttttcttattgtaattggtagatttaaaaaaaaatttttgtgg

SEQ ID NO: 97169 - DNA, 364 bp, Heterodera glycines
  SCN-specific regions: Sequence locations=1-99,129-364
attcaaactcatcaaattcactcaacatcatcaccaaccgtgaacattatgctgaggattgctctactgatctccattttggcactgtttggtgattgcatggacaagggaaaaagaaaattaggaggaataagtattaatgagccaagtgaatatagaaccaaagaaaaagaagccatcgcaacaagcagaaaaggcaaagaaaaagtcggcgaaaaaataagcgttatgaacacagctgaacgcattgaaaaaatggacattgcccaaggcaaagctaaaatggatatagacaccaatgtcaaacccaaacaaaatgaggaaagtgctcctccaaaatatgttttcatttggagcggtaaca

SEQ ID NO: 97170 - DNA, 532 bp, Heterodera glycines
  SCN-specific regions: Sequence locations=1-168,191-532
ccgatgaacgcgaaagttcgaaaccaaagcggacgaacgctgcgcgggttggagctcagactgagcaaagacgtggtgtacaagtgggccattcattcattcctttgcccaaaaagttaaattcaacactttttaagggacgacggcatataaaagcgaatttcatattattattttgaattttactgcaactttttgatatttaattcgttcatttcacagatcgaaaacatttgcgggtgccgaacagcgacggaccaccaaaaatgtggtggagagagtgcggctgaaaaaggtgcccagcgggagcgaattcgaaagtggcgcattgcctttggcggtgccttcggttccgccgcgactcgccccaaagtgtcgcctaatcgacatttcgtattctgttgagctgagttgtcagtcgccccctttttgcgtgtcccttcccgtggtcatcggaacgatccctttgttgcctcccaatctccgatcaaacgaccaaaatgtggcacagaacaacggcactaatggagtc

SEQ ID NO: 97171 - DNA, 414 bp, Heterodera glycines
  SCN-specific regions: Sequence locations=1-414
tccttggaccgacaaaaatggcaaaattcgttgccattgctcttctctcgctgaccattgtttcgatggcacctgcaaaaactggcaaaagtcaaacggcagacgaagttgagggatttcgcaatatgaacatcggcgacaacaataaggttgacgccggaaaggagcccgcggctgctaaaggaacgaccaattgatgggcatgagcgttgagaaatttaacgaggagcttgctgtgttgttgccaaaagccaacacttttatggaaaatgctttgagcttcatcaatgaacaaatggaaaaaaatggcattgcaactggcgctgccggggactcgtgctcgaccgggatcccggccaactaggagaccaatgccacaggacggcaccggaggagggaagaaaggatgacgag

SEQ ID NO: 97172 - DNA, 362 bp, Heterodera glycines
  SCN-specific regions: Sequence locations=1-21,43-227,249-362
aaaccaccaaatgttaagaggaaaatggccgaacaattggtcaccaaagttttgtgttgggaaagcattggaagggtcgacggttggtatttttggaatggggcgcattggacgaagcattgccgataaactaagcgcatttcgcccgtttgaaatcatttatcacaaccgtaaagccaattctgaatatggtcggattgatggaagattaaacgattttgctaattaaatgaattatgttaattaatcagagggtcgcttccgttatgtgccatttgaagaactcatcgaaagaagcgactttttgattctgtcggcgagtgtcaatgatcagacgaagggactgttcgacaaagaaaagt

SEQ ID NO: 97173 - DNA, 353 bp, Heterodera glycines
  misc_feature (284)..(284): n is a, c, g, or t
  SCN-specific regions: Sequence locations=1-103,140-193,215-353
ttaccatcgatcggactgattatgcatatgtcttgcatcaataacaataatttttcttaaatagggccgggagtccgatggaaaacggcggcggtcaatttggttttaattaataaacaaaattattatttaattaatactcgcattattatggaagtatttttatttttcgtttacctttccagcggtatccattcaaattttgctgaactaaattggaattaaatggaaagcaaagaatgcggcgattgttttgctttgtctttggtcggtcggtggtccgntaatttgtgttttctttttgcattatcattgccattaatcgcactttttgccgggggaatctcagcaga

SEQ ID NO: 97174 - DNA, 276 bp, Heterodera glycines
  SCN-specific regions: Sequence locations=1-276
ttttgtattcaccgatcttcagagtaagaggctaatgcccttctgtagatattttattgactgaataaataaaaataaatggtgtacggacatttcgcctactaagccaagaagccctaggcaggcaccagcagcaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattc

SEQ ID NO: 97175 - DNA, 394 bp, Heterodera glycines
  SCN-specific regions: Sequence locations=32-51,73-140,173-394
tgagacaggttagttttaccctactgatgacctcaccgcaatggtaattgagcttagtacgagaggaaccgctcattcacataattggtttttgcggctgtccgaccgggcagtgccgcgaagctaccatgtgctggataatggctgaacgcctctaagtcagaatccatgccagaacgcggtgataccacccgcacgtatagatggactttttggaggctgttaaggacaagtttaacaaactgctcactgcttgaagaacaaattgggaaccatttacggcaatctcttatttaattcgatatttttttttgaacattttccgtctcataatcagattttgtccgttttgtctgttccttgcccatttctcatcaatttattgtgcattatt

SEQ ID NO: 97176 - DNA, 241 bp, Heterodera glycines
  SCN-specific regions: Sequence locations=1-241
cgctggaccaagtgaacggactgccggacatggtcttcgcctgcaacagcggccttttctaccgcaataagctttacctttcccactttcgccacgctcaacgaatcggagagcagcggcacttcgccgacttttacaaagggctcggcttggagctgtacggcgccgattgcgcggaagtattcgaaggcggcggcgatgcgtttttctccgacgagcgaacgctttgggccggctgggg

SEQ ID NO: 97177 - DNA, 405 bp, Heterodera glycines
  SCN-specific regions: Sequence locations=1-24,46-181,204-271,293 -343,403-405
cactttcatcggcaattcaacagccattcaggagctttttaaaagggtcactgagcagtttaacgcaatgttccgccgaaaggcttttctccattggtacacgggggaaggcatggaggagatcgaattcacagaagcggagtcgaacattggcgatctgatcagcgaatatcagcagtatcaggacgccactgctgacgaagacgtaatggaagaagaaaaaagcgaaacggaaggagaaaaagcggacgaagcgaattgagggaggacaattcatttcatttgtcaatttaacattggacaaaatgccaatgaaaactgtgccgatcatttcgtcactgagaattaattttaaaataatataatggaaatcttgattttatattttttaatatatttttacca

SEQ ID NO: 97178 - DNA, 394 bp, Heterodera glycines
  SCN-specific regions: Sequence locations=1-13,35-394
ttttgcctttgttctttgctccttttccttctcccctcggctcttttcgctgatggcttttcgtcgtctggccaaagagttgttttggcccgggtgatcattttcaaagcatccgaaaagcaggggacgattgcttctcaacagtgtggtcgggagggcattggtcgtacatgagaaggcggacgacatgggcaaggggggcaatgaggagagtgggaagacgggcaatgcgggaaaacggatcgcatgcggagtggtgggagtgatcagagaggaaccaatgaaagtgaccactgatcagaccaacggaatgtgaaaacagcgatcagcagaggaattcatggacaatgaagaaatgcaatgcattgagtgttctattatttacgtcttttaa

SEQ ID NO: 97179 - DNA, 488 bp, Heterodera glycines
  SCN-specific regions: Sequence locations=1-488
ccaaacatgccaaacagcggcgtacaaaatcactacagaaaacgcgtcgcatattactacgattccaatgttggcaactattattacggccaaggccatgtgatgaaaccgcaccgaattcggatgacccatcacttgttacttaattatggtgtttatcgtcacttggatgtttatcgtcccttccccgcctcccttgaggacatgacccgctttcacagcgaagagtacatggacttcctccgttctgcaactcctgagactttgaagcagttcaacaagcaaatgttaaaatttaatgttggtgaagattgccctgtctttgacggactcttcgagttttgccaactttccagtggcggctctttggcggctgcggtaaagcttaacaaacaaaaggctgaaattgccatcaattggatgggcgggttgcaccacgccaaaaaatcagaggcgtccggcttctgctacaccaatgacattgtgct

SEQ ID NO: 97180 - DNA, 429 bp, Heterodera glycines
  misc_feature (355)..(355): n is a, c, g, or t
  SCN-specific regions: Sequence locations=1-12,34-280,303-429
tgcacatcccaattttatttcttccttagtaagtagtattggtgcacaatgcgcacttttctgttcatagctgtagtcgggttggtgttggctgtcatcatggagagtgtaaatgcgactgggaataattcgccgacaaaggggcaaactccgcctggcagtccgaaaggtgggcacggcagcaacaaatcgccaacgacgccgcacagtgccggttcgccacacggcacgcagcatggtaaccaacagaaccatgctaccggacaatcgccgccagacagtacaaaacgggaaacagaacttataattgagaaagtttcaaatgtggtgcagaacgttgacaacaaacctcggncatctgctgctgcttcacacctcgtgccaccaacaccagggaacagccctactgcgcatgacagtcgccacaca

SEQ ID NO: 97181 - DNA, 388 bp, Heterodera glycines
  SCN-specific regions: Sequence locations=1-32,60-319,341-388
ttttctgtgtcaaattttcttaaaatgccatctttttcgtctgtttttgtcctttttgccatcgtcgttatttcgctgggaaaggaacagcaaaagggggacgaactgagggcgaaacgacaaatttgccaaggcttttccgcccaatacggcgcatgcattgcacagaaatactcacagtgtgtttggtgtaacgatgcggattacagagggccacaccgatgcgatgagaaatcatcgatgaaaggctgtgttcaaattgtgcagtgaaatcggcacaattaatgacggaacggaggaaatggaacaattaattagtgaaaggaaaaacacaaaagcatcatttattgtttctcgacacgtattggcatagattattgtctgtcca

SEQ ID NO: 97182 - DNA, 257 bp, Heterodera glycines
  SCN-specific regions: Sequence locations=1-257
ttaataaaaataaacaatcgtttatttttaccgtcacccggcggtgatcgaggcgaatggatgatggaatgtgaccgactgctgcgcatcaatgccgtcgatgcgtctgagaaggaagcggcattcgcaggaaaacggctcacacgtctcatcaggccgcggatggaccagcgtcgccggctcttccgctgctccggcgtcgtcgcttccgcgagtggcgtcgtctcctcgtctttgcgcttcacaatgcgcgttgg

SEQ ID NO: 97183 - DNA, 267 bp, Heterodera glycines
  SCN-specific regions: Sequence locations=1-37,60-226
gaaaatgcagtaagtagaaaaccttaagggctattgaatgaaaccaaaaatgtttaatttactaaaaaattaattaacgatttttttgttttagaggcacttcgcgaacgtgaagaagaacaaatccgtttattggaatcggaacgcgacaattttattttgttccaaacgttctatttcgattttacgctcctcaatttcaattcgacggctttcaattcgcgtctaaattttaaattaaatatttataataaatgaatatttatt

SEQ ID NO: 97184 - DNA, 432 bp, Heterodera glycines
  SCN-specific regions: Sequence locations=1-432
agtgcggaagaaatcgcacgaaaaattggaaaagtaagggcgaaaaggggatggaggagaagccatttaccaaataaagcacaatcacaaaaaacacatttcaataatcagaaccgtcgaccctccggcgacgtcgtcgtcctttcgcttcattggggcggcaattggggctacgaaatatcgaagacggagagagactttgctcatcagctgatcgacagtgggacggtggacattttgtacggtcactcatcacatcacccgaaagcgattgaggtgatcagccgacaataaattcaaaagggcggcaaaaaaatcaaagagattggtaattaattctaatcggaggtgtgatttaaaaaccaattaattagactttaccgatcaaacaaacgaccactcaaatagctgcttttacgagtgccgctttca

SEQ ID NO: 97185 - DNA, 156 bp, Heterodera glycines
  misc_feature (76)..(76): n is a, c, g, or t
  SCN-specific regions: Sequence locations=1-7,29-76
cggacaaatgatgaaaatgattaaatatccattcaattgtttcccaacgaagagtaaccaaaagactaaaatcgcnaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97186 - DNA, 374 bp, Heterodera glycines
  SCN-specific regions: Sequence locations=1-99,121-247,272-290,316-374
aacaacaacttacatcccgaaattcaattaattccattctaaaatggcttcatcattgattaaattgctttcactgtttctgctcgtcctttgcattggcatggccattgagcagacccaagcttattatggctggggtggctacggctatggctatccctacgggttttatggcaaacggcaagccggttttggtccatccggaaatgttggaatttttggtggcggtggagaaggaaatgctaacggaggaggagaaggaagaggagggccatcgtcaccaaacaatttttgagagagaaaaacaattacaaagaatggagatattcctgatttccaaaaacggatttttgattaatatgataaatcttggc

SEQ ID NO: 97187 - DNA, 411 bp, Heterodera glycines
  SCN-specific regions: Sequence locations=1-22,44-133,155-194,229-411
ttgtctcctccgccgtcctccgacatatttatttgttattttaatttgtcttcaataaatatttatttgttcgtccattcgacatttcggggaccgaacagtcatcgatttttaccatgctcaaattttagcgacaataaatcgaaaaacaaaagcataaacaatcaatcaattagcaagaatgctaatttggtaataaatcttgtttttgtttttgcaggattggtggcgatgaggacgtcgtattggccgttcgaaatgccctcatcgccggcgagacaatgttcgactcgaacattgcgctgctcgtgcaaaatgccgtacaaaatgttcacttccaaaagccaccagctgatgataatgccgatggtggcgcagaacaaatgccaatggaaaccacataaaaattga

SEQ ID NO: 97188 - DNA, 451 bp, Heterodera glycines
  SCN-specific regions: Sequence locations=1-375,402-451
accaaagagaaaatgggccaagctctaagtgaaccgatcacaaccaaaaacagcgcctcttgttccaatgatcgttattttgtcggttcgtcttcgatgcaaggatggcgaataagcatggaagatgcccacacgcatttgctcgaactgcccgaagatccgagcacagcttttttcgccgtttttgatggacatggtggcgctcaaattgcgaaatacgccagtgaaaatttgcatacgcaaattgcccaatcgaatacattccgtgagggcagaatatccgatgcattagttgaggcatttttagaattggacgagcaaatgatggccagtgaacagatcagagaggaaatgtccgggagtacggctgttgcggtgctaatcaaagacaattttatttattgcgcaaatgctggtgattcgagggctgtcgcttctgttgatggcaggg

SEQ ID NO: 97189 - DNA, 487 bp, Heterodera glycines
  SCN-specific regions: Sequence locations=1-439,471-487
ccggcagtggcttcaaccaatgccatcatagcgggaagctgtgctcttgaggcattgaaactggcatcaaacatctcatgttctctgaacaattacttgaactttgctaacgtggaaggtatctgtttcaacgttgttgcattggaacgtgatcccgaatgtttggtctgcggtcagaaatctgtccaaatgtattccgtgcgcgaggactgtacactctcaggctttttagatgacttgaaagacaaatacccacttcagaatccttccattcgagcgggtagcactttcctgtatgaaatcaacactcttatgccagaaatggagacagcaagtcggaagaatttgtgtaagacgctcaaggaacttcatgtcaccgaggatagcgaactgcttgtagcggatgaagcattaacgagatctattgtttttcggatcgaatattccaaataaattttattcgaatgtccgataaaatatctctgaa

SEQ ID NO: 97190 - DNA, 387 bp, Heterodera glycines
  SCN-specific regions: Sequence locations=1-125,154-293,315-387
caagttttttacaaccacttattgccaatttaatttcttgcagatttaaagccatccattgcctgccggttctcggcacagcaaagcactaatacggtgtttgactcacttcaaaaaaataattcattacccaaaagttttttacaaccacttattgccaatataatttcttgcagatttaaagctatccattgcctgccggtctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataatt

SEQ ID NO: 97191 - DNA, 394 bp, Heterodera glycines
  SCN-specific regions: Sequence locations=1-302,324-394
attttccttttcagccctttgactttctgtgtccctccctattccattttctgtgccgtcggctgtcagtgctgccaattcaaccacgcggatgaccacctcttctcaatgccagtgctcgagtttctgctatgaaaattgaatgctttcctattgggttcgacgatggcgtttcaaaattcctgagataaagaaaccaaaatgcgaacgaattagcaaagaacggcgtcaaacaatcaaatgtatcagtccgaacacaaaagtcagcttatatgagcggacaggactattcattgaatttggtttaccaacaatttttgtttgaagaagcacaacgatttcaaggacattttcctactccttgtcatttcccgcaatgtaatcggaagcccag

SEQ ID NO: 97192 - DNA, 348 bp, Heterodera glycines
  SCN-specific regions: Sequence locations=1-105,127-348
tctgataaattttgagaatggagaaaaacaccgaaagcctttccaagttggatcctagcgaaactttgggaaccgatgccctcttacaattgaaggaactgcgtgaaaaagggaaattggaaagttacggacgaatcactgatgaaaagggggaggagaaagattcttggggccatgcgcttcagaaggaattggacgaaaaggtgcgaaaattcagagagctcaaccgaaagaaatgaacgagaatttaattgattttaccggcattttcactttttcacaatgttagaaatttatagcattattcattttgtttgattcgttcattcggcacaacaactcaaaacc

SEQ ID NO: 97193 - DNA, 726 bp, Heterodera glycines
  SCN-specific regions: Sequence locations=1-33,55-726
tcttaataaaaaaatactcttcaaataaataatcattcctagctgcttttggtttgatcacaaatgttcgtccaactcgtcctccttgccatcgttggcattacttttgtcgatgctgccgcaccgccgttcggccaattgtacgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaggttatttctgcaattcgtgccatcgacaaaaagaatgtgatcattctcggcactcccaaatggtctcaagatgttgacgtggcggcccaaaatcccgatcaaggattcagtaatttgatgtacactctccacttctatgcgtccagtcactttggtgatggacttgcc

SEQ ID NO: 97194 - DNA, 179 bp, Heterodera glycines
  SCN-specific regions: Sequence locations=1-179
aatgtggaaagaggactcggaagcgtcagaagattctcacccgctgctgtggcgtcccgaaatactcaaaaaacagcgtttttaatcctgttgttttaattttgcattatacatgtttttaattataaatgaacaaacccaaaaattacaaacgcacaaataaataaatatggacaaag

SEQ ID NO: 97195 - DNA, 388 bp, Heterodera glycines
  SCN-specific regions: Sequence locations=1-59,95-288,373-388
ttgttaaataccacgagggttggcaaaaatctggatataaaatcgcaaaaatgtggccataaaatcctttaaatttaaaaccaagataaaaactatttttttatttcgtgcctttcacaccctcccagtgtccaggaaaaaaataatggattgctgccatataattaattgccaaccatataaatcacatttttttaaagaggaaatggaccgcgacgatgataagacagtggaacgcgcggtccgcgagtcaccaatcgttgtttcggaatccagcgccacggatggtaaaattttcaaatcttttaaatttttgaaaattttcaaaaattatacaaaaaatgtttgaaaatttctaacattaattttatacaaacagaggatgatt

SEQ ID NO: 97196 - DNA, 174 bp, Heterodera glycines
  SCN-specific regions: Sequence locations=1-80,102-174
tgtctaaacgcattcgctttcttcgtttgggaatacaaaccgtcgatgttggattttggagagaaaaaaatccaaatgataatttatattttggataattaagctttcattttatactctgctttcattgttaattcctgttttttgtacattgataaagttttcataaacatg

SEQ ID NO: 97197 - DNA, 376 bp, Heterodera glycines
  misc_feature (326)..(326): n is a, c, g, or t
  SCN-specific regions: Sequence locations=1-142,165-294,324-326
accatgattacgccaagctctaatcttctcactatagggaaagctggtacgccttcccgtaccggtccggaattcccgggtcgacatcatcatcatcatggccgctaatacgactcactatagggcacggcgtttaatgaggaccacagggcgggggagtctccggccggcggttttcaagaggcttttgagcccggcgttggcccattcaaaccggcgggacgaaggcgacgagcgacggcacaattagcgagacaaatcaattgaaaaattgggatattaaaacccgaattgtaaaatacaataataaaaattaaaaaattgtnaaaaaaaaaaaaaaaaaaaaaaaaaaaaaaaaaattgtaaaaaaaaaaaa

SEQ ID NO: 97198 - DNA, 542 bp, Heterodera glycines
  SCN-specific regions: Sequence locations=1-312,380-542
accatgattacgccaagctctaatacttctcactatagggaaagctggtacgcctgtccgtaccggtccggaattcccgggtcgcatcatcatcatggccgctaatacgactcactacagggcacggcgtttaatgaggaccacggggcgggggagtctccggccggcggttttcaagaggcttttgagcccggcgttggcccattcaaaccggcgggacgaaggcgacgagcgacggcacaattagcgagacaaatcaattgaaaaattgggatattaaaacccgaattgtaaaattcaataataaaaattaaaaaatataaaaaaaaaaaaaaaaaaaaaaaaaaagtactctgcgttgttaccactgctttagtagtagtaggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacatcc

SEQ ID NO: 97199 - DNA, 401 bp, Heterodera glycines
  SCN-specific regions: Sequence locations=1-401
gtctttgcaattgctttccacaatttcccaaacgtggcccaggaaggggccaaagaattcgtattttggcactgggcccaactccaattcaagaaccctcacgttcaattcgtgaaactcgcggatgtttgtgtgacgccatttgtgcaagctttcttatgcgatggcagagaagttgtttttgatttggagtgccgtacgagggagcaaataagcgaagcattaatcgggacattgggcatgacagagactgtacggaagcgaatgaaaatggacagttacaaaagggagaaaagagtgtgagagcacattttcgactgacaatgccaacggaagagaaaaaaacaactaaaaagacaatacaagtgaggaagcaaaagagtggggcagagagaacgatg

SEQ ID NO: 97200 - DNA, 420 bp, Heterodera glycines
  SCN-specific regions: Sequence locations=1-420
gtttgagacctgtcaaccccaactccgtcaaacatccacaaattaaccctaagtgaactaatggccgccgaatcgcaatacccaattccttaccgaagcaaactcaccgaaccttttgagccgggacaaacgctaattgttaaaggaaaaacagcggaagactcagtccgtttcaccattaatctccaccatacgtcggccgacttcagtggtaacgatgttcccctgcacatttctgtgcgatttgatgaaggaaagattgtgttcaacactttctcgaagggcgaatggggcaaggaggagcgcaagagcaatccatataaaaagggggacgacatcgatctccgaattcgtgcccacgacagcaaattcactgtttatgcggaccaaaaagaattgaaggagtttgagcatcgcgtt

SEQ ID NO: 97201 - DNA, 415 bp, Heterodera glycines
  SCN-specific regions: Sequence locations=1-134,252-366
attaaaaaaagtaaatcctctttaaaaatgaaattttcaataattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaagaaggaaaagagagacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaaataaaaataaatttttgtatttttta

SEQ ID NO: 97202 - DNA, 383 bp, Heterodera glycines
  SCN-specific regions: Sequence locations=1-308,333-383
ccctttaaatttcttatggtcctttcggatcgaatggctcttcgtattgtcaatgttttgctgttcgccgtcacttattttgcttggttttgtgcatttatcgcagcctttcacaattccaatgcttttttgagtgcttctcaaagtgattagtccgtccgttcgttgttcgatggctccgctggtcgtcgttcacactgaacctctcctcgaagaattccgtgctcccttttgttccgccgctaatttctggcgctttttgtcgatttttttctcgatttccttatcacttttgctatgttttgcaagccaggccagaaaaaatgaaatctctaaggattttaagcttttagggtctttggcgtcggtccaacacttttctt

SEQ ID NO: 97203 - DNA, 277 bp, Heterodera glycines
  SCN-specific regions: Sequence locations=1-125,149-178,201-277
gtgaacattctgttgaagtgaccgatttgttttgaagcgctttcttttcggactgtcatgaacaaacccattttaccgttgaaaattgtggtgacgtgttaaattccatttattattagtttattattaaacattttacaattagcaggaaatgattcctaaaattggtgttaaattgatgttattcactgttctgatttggttgcttcttatttttccggcatttgtaattcgcttgaaggcatttttctcattgtaccataaataccatctcata

SEQ ID NO: 97204 - DNA, 401 bp, Heterodera glycines
  SCN-specific regions: Sequence locations=1-48,79-91,113-162,198 -201,227-401
acaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaaaaaaacccacaacggctattggctatacgaagattttggagttgctttctgacgattggtctgacaaacgaaaacaatgcttggaagggcttgactggcttcagattctcggcgtgtttatttggtaccattc

SEQ ID NO: 97205 - DNA, 160 bp, Heterodera glycines
  SCN-specific regions: Sequence locations=1-13,45-117
aattagagatacggccacattccttattatttattttttgatttcattataccctctatcactttactctgtgagaaaaatttaattgtttgctaaatttttggcaagacttccttgaaaaaataaataaaacaaacgaaaaaaaaaaaaaaaaaaaaaa

SEQ ID NO: 97206 - DNA, 174 bp, Heterodera glycines
  misc_feature (145)..(145): n is a, c, g, or t
  misc_feature (152)..(152): n is a, c, g, or t
  misc_feature (156)..(156): n is a, c, g, or t
  SCN-specific regions: Sequence locations=1-147
gcacccctgcccaaggggtcgctctcttcgcttccttcacccccaaccattcttttattcgttttgctggacttttcgatcaatttttttcaccattttacgcatttttaattcgtcgatcgcttctttaataaattttgtgtcnggaaaanaaanaaaaaatttttttttttt

SEQ ID NO: 97207 - DNA, 406 bp, Heterodera glycines
  SCN-specific regions: Sequence locations=1-129,195-266,342-349,377 -379,401-406
agtagatgactcgcccctacaaggaattcctcgttcacggacaataattgcaatgtccgatcccaatcacggcaaatcttcaccggtttaccaacccctttcggggaaggacaagcacgctgattttgccagtgtagcgcgcgtgaagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagttcgtggat

SEQ ID NO: 97208 - DNA, 362 bp, Heterodera glycines
  SCN-specific regions: Sequence locations=1-362
ggcattggctgtgtgccgttgtacaatttgatggaggacgcggccaccgccgagaacagccgcacccaattgtggcaatgggcgcgccatgaagcgcgccttgaggatggacgtacagttgatcctcagctggtcaaaatgacaatcgcttctgaaactgagcggcgcctcgtccgtgccggctctgtggtcaatcgcatcccggaggcctcggaactgctcgagaaattcgtgttggagcccgagttgagcgactttctcacattggatgcttacgacaagctcgtctcggaaggcaagtgaacaacgaacgggggacggacacttctgtaaaatctaagtgaaacagcgtcaaaatacct

SEQ ID NO: 97209 - DNA, 150 bp, Heterodera glycines
  misc_feature (116)..(116): n is a, c, g, or t
  SCN-specific regions: Sequence locations=1-65,108-116
gacgacagcacacacagccgaaaagcgcttcttctcatcgccttcgccaccccccaccaccatctgttttttgctgaaaattatgcaaaaatatttttgaataaaatctatgaacnaaaaaaaaaaaaaaaaaaaaaaaaaaaaaaaaaa

SEQ ID NO: 97210 - DNA, 242 bp, Heterodera glycines
  SCN-specific regions: Sequence locations=123-242
gagagagagaaagtagagggagatgagagggggagagagagtagaggaagatgagagggagagagagagtagagggagatgatagggagagagagagaagaggagagagtagaaagagagaggaacagcaaaattctaatcactagtgatcactgataattgccgattgattgaccggtacgactcatttggctgatttttttttttttatggcataaagagttgcggcaaatttttttttt

SEQ ID NO: 97211 - DNA, 163 bp, Heterodera glycines
  SCN-specific regions: Sequence locations=1-163
aaaaaccgaaacgggtcaactccgtctggccaactccgtcttggggccaactccgtctcgccaactccgtcttggggccaactccgtctgagccaactccgtctcgccaactccgtctggccaactccgtcttagtgcctaaggggccaactccgtctcagat

SEQ ID NO: 97212 - DNA, 399 bp, Heterodera glycines
  SCN-specific regions: Sequence locations=1-399
caaaaatatttgccatttttattgaaagaaatttcaagagaggaggggaggcgacaatttttgttccttcatgcgttgaaagaggtgattaacagcgaatgcggagaatgtggcactgtcggagacgctgacgaaatattcaaaaagggcgttgaacaaatttgggagcttttgatgaaatactgcgactcggctgaggagagcatcagaaatgtcgtcgccgagtgcatcggtcggcttatcatggtcaacccgcaaaaatacgtcgaagaacttttgcgacattctgccgattcacaagcaaatgttcgtgccactgttgtcacagctttgcgttttattatcgttgagcagcctcggcccgtcgatgattttcttcgtccggttattggcaaattt

SEQ ID NO: 97213 - DNA, 403 bp, Heterodera glycines
  SCN-specific regions: Sequence locations=1-403
gttgtggcacaaataatcttgatgttgtggaagagaagacattttcgctcataccagttcgccactttggtcggtctttggctaatcccttttatggtgtcacttaaaaatggctggtggcgattcattctttcctggactgtgttcacttcttcaatattttacgtttggcggagggtcaatcagccggcaatttccggatcaactcccaggctcgtctacaaatactttttgttcatgcataaactcagttacatttttggtattgtcggttacttttcactcgtctttactgtcattggaataaattcggtgttcggaattagcagtaatctgagcttggattttggcgtgcatttgttgttttatggcctttattacggtgtgcttggacgtgatttgg

SEQ ID NO: 97214 - DNA, 394 bp, Heterodera glycines
  SCN-specific regions: Sequence locations=1-394
agttttgtttaacaaggaccaattgctggcccaaatggaatatttccttgtgtgaaccgaccgggtatcaagtgcgacatggacgccgcatacattgcagcggaggcgatagtttgtttcatcgaagacgccggccaaacctacgtggaattttccttcgaaagacggtgccccgttcaacagagaaaatgggctcaaccggatgccgaacaagctgaatgccgacggtactttgcctatttacttcatggcccgcaaaaaatggagactccaaaaactgggaagtgaacccttaatgatttcagttttgatttctagtctttttaagacaattatattgtctcattttgtgtcatattaatgttatatgtccattccatgctgtaatgttgtt

SEQ ID NO: 97215 - DNA, 328 bp, Heterodera glycines
  SCN-specific regions: Sequence locations=1-328
gaattcactcacatgaaaaagaagtgggaatggtgcggacgaggtgcaggcgtgttgacaatcaatgcaagcgcatgagtggtcgaatttatccggcacttcgttgcatttgatggctgtcattgagcatcaccacgttgatggtgaacggcacatgggtgaccttgctgtacgtgccaatgtattggaagaacttcttcggtgtgcacagttcaattgaagtgccgcaaagaatgcttaacacaaaggccgtggacgaagtgcgcacctttaaaaagagaaaatttgaatttgtacgaaacaaaagttggaaatggcacaaattgcc

SEQ ID NO: 97216 - DNA, 440 bp, Heterodera glycines
  SCN-specific regions: Sequence locations=1-19,64-440
gagggttatttgtcgggaatttcttattctttctacaaaatatttccatttcaaatgttgccaccgaaggaaatttgggaaaacgatgcctacgatcggtggaatgattttaatgtggctctgatcattgtgatttgtgtcattggctttgcactgatcgctatgcaccacagctgccatttggtttacagtggcgcaacgcaataaaaaggcacggatcccacggcatttgtcttcctctgatcgcccttacatcggacgtccggtggaatctatggttatggaagagggccatttggtgaaagacaaatccaagcaggacaaggcatacagagaactgacaaagcccgatggactcgttatcaccagtgtttaaaataattatttacttatggaaaagccattaatcctatattttcaaattgaacatgtaaattagt

SEQ ID NO: 97217 - DNA, 407 bp, Heterodera glycines
  SCN-specific regions: Sequence locations=1-407
tcacacacgcattacttcagttgtacgctgctttacctgttcttgggtgccaattccaagcacattcaggagcagatcactcggtaaagagtggcttttataagacctaaaagtcagtcctcacagtcccgatttaaatgtgatttaaattgtctcacaatttgttgtggtaatctctccccccaccctcttcgtattttccgtccctgtagatagataacttttacacatttaaaacaatatagaagggggttttaccatgcaagacgaatttttaattttttgtttttccatagtattctttttgaacgtttggttgctctccgtccgcacccgtggggtttgttgatcacattcatcgaactgatccgcaaccagcgttacggcttttggaagcacgaatttgt

SEQ ID NO: 97218 - DNA, 399 bp, Heterodera glycines
  SCN-specific regions: Sequence locations=1-399
attggaagtgctttcgcttgacaaatgcgacttaaaagagttggaggaggacatttttgagaatttaacatctctccgtgccctgtccctctctggcaatcccttggaccgaatccccgctgctctctctccgctccattcgctgacgcacctcgccatgtcgtccaccaatctcaaggagttaaaggagggcgactttcaaaagacagtgcctgggctggagaaactttacatgcgaaaaatgaaatatttgtggaaaattggagaaaacactttcaacggactggtaaatttgaagttcatcgatttttccacctcggccaaattgcgtttattggagccaaatgttttcgggaaggacccgccacagaatttaagcgaattgcacttacagcagtg

SEQ ID NO: 97219 - DNA, 495 bp, Heterodera glycines
  SCN-specific regions: Sequence locations=1-28,50-495
ctctctcactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacaaagggacaaactccgcctggcagtccgaaaggtgggcacggcagcaacaaatcgccaacgacgccgcacagtgccggttcgccacacggcacgcagcatggtagccaacagaaccatgctaccggacaaacgccgcctggcagtccgaaaggtgggcacggcaacaacaaatcgccaacgacgccgcacagtgccggttcgccacacggcacgcagcatggtaaccaacagaaaggtgggcacggcaacaacaaatcgccaacgacgccgcacagtgccggttcgccacacggcacgcagcatggtaaccaacagaaaaatgctaccggacaaacgccgcc

SEQ ID NO: 97220 - DNA, 398 bp, Heterodera glycines
  SCN-specific regions: Sequence locations=1-28,51-73,102-107,147 -197,220-226,260-398
gccgggacggaacgggccaaaccaagccaagtgccagtgcgacggtttcgctcgatactaatcagctaattgttcactaattaccccaaataacaaaactgtctgcttctcccaacaatggccaccaaatgccttccgctcgaactgttgttcgaaattgtgcctttcatccctgccgaaaatgccgtcccgaatgtgctctcgtcctgtcggctgctgtacaactttttgctgccacgtgtcatcaaatggaaagagacaatgaaaaaaatgataaaagagcttcgagatgaagtacgggaccgcttcgcacttatcgaaggggagatacacgcaatgaaaaaccaattttaggttcgaatgaagaatctcgaaggagaagtaaagagtctcaaagg

SEQ ID NO: 97221 - DNA, 355 bp, Heterodera glycines
  SCN-specific regions: Sequence locations=1-355
ttttcttataattgggggttttctttctattggctattttgaggcttcaacatcgaaacacttgagttcatgggttggaaattgaactgttgggatgttggcggtcaaaaaagtctccgtacgtattggcgtaattattttgaacgaactgacgctgtgatttgggtggttgatgcttgcgatgtctgtcggttggatgactgtttcaatgaattgcattcactgatcaacgaggaatgtctgcatggagttactctcttagtactcgcaaacaaacgcgatttacccggctcgataaatgctcatgaaatagaaaaggtcggtggtaaatgtgaattcggcgtgggagagatat

SEQ ID NO: 97222 - DNA, 357 bp, Heterodera glycines
  SCN-specific regions: Sequence locations=1-11,63-357
acaaatgcctgaagcgcttctcccactccggctcttactcgcagcacatgaaccatcgctacgcgtactgtaagccattcatgcagcagagacaaagggccgaggagagaacgccgtcaaaggatgaaaacacagagtgaagcaaagaaagaacagcaagcacagtgcaaaaagagcgtgtgagaaattaaaaacgtcgcaaatccctcaaaagccaatcgaataaataacctctccgtcccttcaatgatctttagtatttaatttggtcgctttccctttttgcaaaaccttattaaccactttgacccactaaatgtgacttttggtgctatgcattcataaattaacataacc

SEQ ID NO: 97223 - DNA, 424 bp, Heterodera glycines
  SCN-specific regions: Sequence locations=1-31,53-156,178-184,207 -384,408-424
tctctctcattaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcttcagacagtacaaaccataaaaaagaccataaaaatgagcatccaaagtatgattccccaattttagccggttcatctggcagtccgaaaaaaggaaaatcgccgaatgccgatccgaaaaaaagctgcttcacaccatgtgccagtaacaccagggaaagtatgatgagcaaagtcttaaaatggtgaagaaactgtgtggaacgatgatgccaaccatgaacaaacccaaagctgttgtagtagatgtag

SEQ ID NO: 97224 - DNA, 542 bp, Heterodera glycines
  SCN-specific regions: Sequence locations=1-542
accatgattacgccaagctctaatacttctcactatagggaaagctggtacgcctgtcacgtaccggtccggaattcccgggtcgacatcatcatcatcatggccgctaatacgactcactataggggtcccgtggtggtcactacttcgttgttcgtcaattcaattagtgcagttagcgaacggaatatggagtatgtggtgcagttccgcttccaacaagaatggcttgacgatcggttggcctacagcagactcggtgacgagcgcagctttgcccacctttttgtggcacgtgatcagacaatttggatcccggatagcttttttcaaaacgaacgaagtggccattatcatatgcttgaccaggaaaatcgttttgttaaaattcgtgcggatggtcgagtcacttacaaccggcggctgacactgaccttggcctgcaacatgaacttgctcagatatccgatggacgtgcagtcgtgtctgatcgatttcgccagctatgcctacacaaccaatgacatcatttacaagtggga

SEQ ID NO: 97225 - DNA, 393 bp, Heterodera glycines
  SCN-specific regions: Sequence locations=1-40,80-393
cgggtgaatgcacaccaaatgcacaatctgtgcatggcaaacgacagagaggggaggaggaggaagaagaggtggaagtgatctcggcaaaaagtttagttcgaagttcggctttaacgcagaggacattggcggaggtcgagagtatccccgaagagctttcaatggcttcacattcggcgaaatccttgccaaactcctccgtttccaccatgtcatctgggaaggggatggtggtcgccgtggaacccgtcgctgaacaccagcaacaacaacagacggacgattcgattgcggaagaagtgttttcggaggacatcgtttccaccttcaaaccgtcggagaagtcgctgcactccattctgtcattgcgtagcaattcgatgagcacca

SEQ ID NO: 97226 - DNA, 338 bp, Heterodera glycines
  SCN-specific regions: Sequence locations=1-134,197-215,237-338
tatgtggcctattgtcggaattcggatgacctcgattggtacgagtttgacgatgcgaatgtcacccgagtgaacagcttggaagtgctttcccaagaggcgtacattctgttctacaggcagaaggagactttggaagacgaggaagcgatggaggaggacgaagtgttggaggaggaggaggaatgggtggaggcaaattcatccgacgaaatggaaactgagggcggcaacggcacgtgaaagcactgcggcccccccccccttattgtgattattcattatctttattacatgtagtaattatttgccgatttcgccaataaacaaatggacgg

SEQ ID NO: 97227 - DNA, 362 bp, Heterodera glycines
  SCN-specific regions: Sequence locations=1-105,133-147,277-277,352-362
caggaaacggagaaacagctgaaagttgccagggattttatcaacaacgaaatgggccaagaggcgcgaatgcaatgggtttcagatgttccgctgaatctgaccaaggaggaaatgcaaatggccaaagaacgttttaaccagttggaaaaggacaaaacaaagcccgtgttggatgtggtcaggtccggtggaggattttgagcttttcaccctcgtgataacctcggatggatgttttttctcgtgcattttatttgtacgcccataggactgcccacttaatcctttaaaattattgtttcatttaagcccatcaattaattaattacagtatttttgtgcttcttatttgtcctgtt

SEQ ID NO: 97228 - DNA, 256 bp, Heterodera glycines
  SCN-specific regions: Sequence locations=1-7,184-256
gaggaggaagaaaagtgatcaaaagaaaagcggaggagaaaagtgatcaaaggaaaagcggaggaaaaagtgatcagagaggaaaaacggaggagaaaagtgattggaggaacggaggaggaagaaaagtgatcaaaagaaaagcggaggagaaaagtgatcaaaggaaaagcggaggaaaaagtgatcagataggaaaaacggaggagaaaagtgatcagagggaaaaaatgtgatctgaggaaaagcggaaaag

SEQ ID NO: 97229 - DNA, 150 bp, Heterodera glycines
  SCN-specific regions: Sequence locations=1-5,27-40,67-83
acagctttattctttcaacatttcttcttttttgggaaacaaatttataaattttttaataaaattccgtgctttcatttatgaaagaaaaaaaatagacaaaaaaaaaaaaaaaaaaaaaaaaaaaaaaaaaaaaaaaaaaaaaaaaaa

SEQ ID NO: 97230 - DNA, 394 bp, Heterodera glycines
  SCN-specific regions: Sequence locations=1-182,206-394
tgaggtttgatttgagcatgatcttagtaactgccacgctagcaagtgatagtacacccggtactcacgtcttagacaattcagacgtagggttcctcagtaacggcaacgccaattgtacactgtttgaaagatgggctagttacgtgggtaacatgaacagcgtgtctattatggattgtgtggccgcagctaggcagggagatatgggacaagacattcccaatacggcccttggtctattcaagtggtgtacggcgtgtttcggcaagagcgtcggacctggccacagtgcgggaacagctacggcaggcaggaagttagcagacgccgcgtacgctgatgaagcagccatcaatgagcatcgcgtcggcaaacacttattgaagcgcgt

SEQ ID NO: 97231 - DNA, 400 bp, Heterodera glycines
  SCN-specific regions: Sequence locations=1-400
gtactattccaaaacaacacacattgggcccagcaccgaaatggagaaaaggaaacgtgtcgaacggctattcgccacttccggcggcagcaatatcgtttttgaggatggggcgctgcagacgcaagtttaagaggaatgtcgaccaccaaccgaacgaaggcattcaaattccattcacttttgcttgttcaaacaaaagctttaataaatggaggacgttgggtttcggttttaatgttttaaatttaagtcctccattcgatgtccatttattttttgtattcagcagaaattcctctcctactgctatttcacttttcatattatatgtatgagcaattttgtctgttttggcccccaaacactcgtttccttcagaaagtcactttgtcagtct

SEQ ID NO: 97232 - DNA, 507 bp, Heterodera glycines
  SCN-specific regions: Sequence locations=1-373,395-507
atcatgtcagattcggcagcaaatatgaaaagggctttcgtcgagagggatgaaaatgaaaatcgcattttgccaatcccgaacgggccttgcgctgctcatttattgaatttggctgtacaggaggcgttcaagagagatgaatcaatcagcagtttattggccaaaactcgtcatattgttggccgtttcaaacacagtaacactgccttcagcgaattgaaaaaaattcaaaaattactcgatgccccttctcatactcttttgcagatggtatatgtccggtggaacagtgcgcttacaatgtgtgagaggctgacagaacaaaggacggcaatcacacaatatgcagtcgagaacaacgaattcgaactagttggggttttgaaatgtgctgaagaggcaacaaaaaggttcacggaggagccaatttcgtttgtccttcctcaagcaagatcactacacgatgagttgcacgaaatgaaaattgtccacaggactgtggag

SEQ ID NO: 97233 - DNA, 558 bp, Heterodera glycines
  SCN-specific regions: Sequence locations=1-154,176-317,342-384,406 -430,452-558
gcaccggacggacagcgcatttgcacgtcgaccacagcgccaagactcaggacagacaacggatttaaactttggacatatcggggcgattttgtttatgaacaaaaatacgatcgagaggaactttgggagatcaaatggcgaccgtgcgcagcgtataacaaattcaaaattgaggagcccaacagagagcaaagtacatcaaattccagccgaataaacgacggaaatgccaaaacgcccttcgacaatttgccgaagggatcgctgacgcaaacggcgcgttacgtcccaccgcatctgagaggaaaaccgcagaaaaaggaagaaaaagggaagaacgagacaaattcggaagagacggacgtggggaagaaaattcggacattgcagaagaaattggacgatatttcgaagctgaagacgaaaagggccgcgggccatcagttggagttgaaccaaatggacaaaatacgcaacgaagatcgattgctggaggaaatggaacgactgacggccacggccaactgctgaaagaattagcatttaatgtcattg

SEQ ID NO: 97234 - DNA, 150 bp, Heterodera glycines
  misc_feature (120)..(120): n is a, c, g, or t
  SCN-specific regions: Sequence locations=1-122
ctgatcttctgtgtattcgtgatcgtatttgtgatctgtatttgtatgtattgtcatgtattcatctcgctgttgtcatttcattcacttgtatatttcaaactaatatgaacaacttcnttaaaaaaaaaaaaaaaaaaaaaaaaaaaa

SEQ ID NO: 97235 - DNA, 386 bp, Heterodera glycines
  SCN-specific regions: Sequence locations=1-24,57-162,187-195,217 -345,367-386
gcagaaaaagcggatcagcaaaactggggagggggaggaagaggagggcgaggaactgatccagcaggaggacgacttgcaaagtgtggaaagtcagaatgagaattgtcgcgctgacttttgccttgatcgtcatgatcatcagcagaatgggaatgcagctgatgatgatgatgatgatgatgaatgttgtgatcaggaaaaactcaaactgattgaacagcaggagacaatgacgacggcagaggcccccctcgaagcaaagggtcgtccccgtccagcaatgttacaaattcacaccgttcagccttatcagtcggcggagaaagtgaagagtccagcacccaatgctgctgctgacgaagcctttcttggccaaatgcgcg

SEQ ID NO: 97236 - DNA, 235 bp, Heterodera glycines
  misc_feature (234)..(235): n is a, c, g, or t
  SCN-specific regions: Sequence locations=1-49,71-78,100-124,147-235
gacactttgctgccactgatcccggcacggaaaatggagtggacaagttgaacagaaagaaaggggaaaggtgcgacaatctcttgttgttgatgttctggctttacacgcgcatctcttctattttctcaaattgtcaaataaaagcgggtctttttcacacaatcatttccctctgttaatattttatttcccttgtttttttatttgcaataaatttgtttatttttttann

SEQ ID NO: 97237 - DNA, 393 bp, Heterodera glycines
  SCN-specific regions: Sequence locations=1-393
ttgcgaccgacgaatttgtctgttgcctttgatcaccaaattcgtgagggaacactcagcgaaatgaagcagcagtcggtggattcgttcattccctcgagcaattcgctgcaaatttgcgggggctgtgaaatgcgaattgaggaaaggcattcgctttgtgtgcatcgcccgcgacattttgcaaatttcgacagagaaacggaggccgaatattggcacgagaattgcctaaaatgttgccaatgcgagcggcgattgggcacgggggagaaatgttttgtaagggacggacgcgtttattgtcgcgaagaccattcgaaatctttcggcacttcgtcgtgccagcctaactgcgcccgctgtgccattccaatcgaaccggccgaactc

SEQ ID NO: 97238 - DNA, 474 bp, Heterodera glycines
  SCN-specific regions: Sequence locations=1-268,293-474
tttcctccgcaattccaaaggattgtctgaggaactcgtccattggtgccacggcgcctccggcgttttgcatttgctcatcgtcgcctctttggagtttaaggaggacaaatatttggagtcggctgaacgatgtgtcaatctcatctgggcccgaggaattctgcgaaaaggacccggcatttgtcacggagtggccggtgaattgtgagagaatttagagagagagagaaagagtgagaaatcgggcgggtgaataatagcactgaataattattaatttaattaaaaagcaaaggcatttccaatgtttgtgttgtcttttcaggcaatggctacgcttttcttctcctcttccgactcaccaaaaatgacaaattcctgcaaatggcccattggttcgccttcgtaatgatggccccctcttttgaggcgtccgcccgtgtccccgactgtccgtcgagtcttttcgaa

SEQ ID NO: 97239 - DNA, 399 bp, Heterodera glycines
  SCN-specific regions: Sequence locations=1-399
tgtcggcaccgcttatgtgacgcggggcggcacagtgatacgaccggacgaattggagcgggcgatgcgcaagtcgggggtggagtcgtcggcggacactttgtcgcccgcttcatcaagtgccgaattgtcttcgcgtttgctcaatgcgaaccccgtttggtcggtgtattcgtcctccaacccgtattcctactggccctaccgctaccttaccgatccgaattcgcacgaggtgttttggcacgacgtgcacagccaattctcggcattgcgccgcctcgatttgttcggcaagcacaaacccccagtggattacatggccaacaaccatttctggacttacccctacccgtattgggctcgtcaccggggatatctcttcgactatgcaaatcc

SEQ ID NO: 97240 - DNA, 163 bp, Heterodera glycines
  SCN-specific regions: Sequence locations=1-54,88-104
tctttgacccggatgtgaagtaaatgcggctactttttgtgcggaaataagcaaaatgtaatgttgttgtttttgatttttgagacataaaattgtgtatgaggaaaaaaaaaaaaaaaaaaaaaaaaaaaaaaaaaaaaaaaaaaaaaaaaaaaaaaaaaaa

SEQ ID NO: 97241 - DNA, 515 bp, Heterodera glycines
  misc_feature (499)..(499): n is a, c, g, or t
  SCN-specific regions: Sequence locations=1-515
catggccaattactgttcatttaaaaaattttcccgatgaactcattcgatgtcggacgaaagaaacgctaaaattttgctttttgcaatctctgaaagaggcgtgccaactcaaacttggttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgagtcatcatattcatttcgtcaattgcttttacattccaaaaaacaacttgacgatggcaatatgggtgaagtgttgttgattgacgcgctgcacaaagtgtttcccgattatgccattgaaacagactttgaagcggtgacccatggcattctgttgcccctcaacactccgctcatttggctggctagaaaccttgtgtaccctgacaattntgctcacattgtaata

SEQ ID NO: 97242 - DNA, 394 bp, Heterodera glycines
  SCN-specific regions: Sequence locations=1-394
cctgcattgctacgtacgaaacggacggacaagcccaattggcccgtgaacggcttcacaacgtcgtatggcccgtggcgagcgatttggcactttgtgtggaattttcaactgaggaaaagctgaaccgacgaaaggcggaagaagagcaggaagcatcggcgaacaattcggcactcggcggaggattgggattgacaattgtggtggataacaggggccgtgggcctgaaactgtgcccaactcgggtcccacggtgctcattcagcacgacaaaaagcgacaaaaggacgcggaaaatagaaaaagaaaagttgaggaattggaaaagtcacagaaaactctcgacgaagtgttcaagaagacaaagactctgccggccatttacttttt

SEQ ID NO: 97243 - DNA, 398 bp, Heterodera glycines
  SCN-specific regions: Sequence locations=1-54,78-398
ttaggacaattaattgcaaatttttacattcatttcaggaatactttgtacgacagtgaaatttttcagttgcaattcagatttgacgaccaatacccattctcatcgccagaagtatgtgcgatttgaagaaccaattatttataaattttcaaatcactcacaataagtccttttttgccctttaggttatgtttatgggtgaaaacattccggtgcatccccacgtgtactccaacgggcacatttgcctgtcaattctcagtgacgattggacactcgtaactttggcatttcacaaaatgaccgacaatcctcaaactggcactctttttaggctctcagcgtctcttccgtttgtttgtccattcagtcgatgctgtccagttgcaaagaga

SEQ ID NO: 97244 - DNA, 398 bp, Heterodera glycines
  SCN-specific regions: Sequence locations=1-271,293-398
ttctgcaggaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaaatgcaaatggcaccccaaatcaaccgaattcacagactcttcccgtgaacaatgcgaaaggctcagcgaatccttatggaagaattcccagtgtttcgtcgttgtccagccaagatgatgccaccgccggcggagggactccggcgacagcgggcgcagcctccgctgctcaagactcacaattaacttgcgaaacggtggtgaaaggcccaacacaattaacttgcgaaccga

SEQ ID NO: 97245 - DNA, 365 bp, Heterodera glycines
  SCN-specific regions: Sequence locations=1-103,125-249,278-365
agcaaattccatctcgaaaattcaattaattccattctaaaatggcttcatcatcgattaaattggtttcggtttcaatgtttctgctcgtcctttgcattggcatggccattgagcagacccaagcttattatggctggggtggctacggctatgtctatccttacggattttatggcaaacggcaagccggttttggtccatccgaaaatgctggcacttttggtggcggtggagaaggaaattccaacggaggaggaagaagaggaggaggaccatcatcaccaaacaatttttgagagaaaaaaggaattacaaaaccaaaattgagcttttcccattttgtaattgatgatcaatcggat

SEQ ID NO: 97246 - DNA, 150 bp, Heterodera glycines
  SCN-specific regions: Sequence locations=1-39,75-83
attagcgaagaacggacttcacaattaatattgtcagggtttttattctttggaaattttatgtaaataaatttgatgaatggaaaaaaaaaaaaaaaaaaaaaaaaaaaaaaaaaaaaaaaaaaaaaaaaaaaaaaaaaaaaaaaaaaa

SEQ ID NO: 97247 - DNA, 500 bp, Heterodera glycines
  SCN-specific regions: Sequence locations=1-49,77-96,118-286,316 -316,496-500
aagagaggcgcgaatgcaatcggtttcagatgttccgctgaatctgaccaaggaggaaatgcaaatggccaaagaacgttttaaccagttggacaaggacaaaaagggacacattacggtcaatgacatccgccgacactttcgggaacacaacaacaaaattgacgagcgtttgctgcacgagttgttgaacgaggtcgacctgaacaagaacggcgagttggagttggctgagttcttccagctttatagcggactgaaaagtggtcaaatcactcagaatcgtttggtccgttatttggacgaattgggcggcgaaaaggacaaaacaaagcccgtgttggatgtggtcaggtccggtggaggattttgagcttttcaccctcgtgataacctcggatggatgttttttctcgtgcattttatttgtacgcccataggactgtccacttaatcctttaaaattattgtttcatttaagcccatcaattaatttaatt

SEQ ID NO: 97248 - DNA, 466 bp, Heterodera glycines
  SCN-specific regions: Sequence locations=1-466
tgaatatctgctcaagatccaaagaaacggcctttcgttggacggtttttaaagactgcgactgactgggaacggtttttaatttcagacacaaggttaccaaaatgcatatacaaatgatgaattttacagcaaagtgaaaaagccacgtggtaacaactttttgcttatttttgaagacttggtcaatttttaggaattgtgattgtcgcagtaaaaccacagatctttcccgggtttctcgacgaactgcgtaaaaatggttggcttaactttgttgggcctgaagtgctttgtgtgtccataatggctgggattgcacttgacacctttaaacagcagttgaaattggttggtttcaatggccatgccgcccgttttatgccaaatgtgaattgtctcgtttctgctggtatcgttttggtctgtgccgatgactgtgttccgacggagatggtttagcaga

SEQ ID NO: 97249 - DNA, 511 bp, Heterodera glycines
  SCN-specific regions: Sequence locations=1-511
acaccaattttgagcctaacagaacatacacattgactggaatatatgaacaaagcacaaaaattgacccgccacagtccgaaacaaactttgtgattatgcacaaatccgagcaaacgcggcaaataatgaaatgggctttgctttgtgccgccgagcccgactgtatggtgccaattggacagacgaaggcgtgcatttacacggcaactgctccaaatttgacttgccatcgacaggatcagagtctgatggaaattctccgctacaacatggaatatcgacaagaaattgagaacccatcatttttgacccaactgaaccctgcccacccgcgcagttcaaacagaccgttgcaatcgtcgggaatcagcggattttttgatttgctccgtggtaagcattttggcggttctcaaagtgaatggcttcaaagagttcaatgttgctgatgaacatcatcattatcttttgttttttattcatttcgtataaatttgggcataaatgg

SEQ ID NO: 97250 - DNA, 176 bp, Heterodera glycines
  misc_feature (10)..(10): n is a, c, g, or t
  SCN-specific regions: Sequence locations=1-22,44-56,120-176
attacagganaaacaaggcaagcaagaaaaccaaacccccacccgggccatttgggaattttaaaaattaaaaaaatttatttttaaaacctttttaatggttttttaaaaaaatttttgggaataaaaattttaagcttaattggaaaaaaattttttttggcccagggtttaaa

SEQ ID NO: 97251 - DNA, 181 bp, Heterodera glycines
  misc_feature (181)..(181): n is a, c, g, or t
  SCN-specific regions: Sequence locations=1-181
cgagttagccaagcggaaaccggtccaaatgatccgccaaaaagtgcggggacgaaaccgccagcgatccttccgagaccgacagaaatcgctgagggcatatttgctacgtcaacaggggaaaaaagtaaaatgattttgttgttattttttttctttcgaataatgggaaagtgattan

SEQ ID NO: 97252 - DNA, 164 bp, Heterodera glycines
  SCN-specific regions: Sequence locations=1-52,74-164
ttgctgagaatgccaaatagcgaattggcgtaattttacgcgctatttcaaaaaatacactggtaatgccttttttgtatggtttattatgagcctccataactcgcatgcatttccaactaatccgaacattttgttatctaaaaaaagattttgaaaaggag

SEQ ID NO: 97253 - DNA, 307 bp, Heterodera glycines
  SCN-specific regions: Sequence locations=1-249,280-307
caaatcacttggcactgctccaccaacgacattggccatgtgtttgtgttggaagagcaaaccctttaaagcgaaagacgacaattgcattttaaaaagcgatgggcggagatcaaacggagacggccaaaattaattttcaattcccatttcaatgcattcattcatttctattttctttaatattttgcaacaaaagttcaaattagcaaaattgtttgcccattccttttcttctttttaatggcgtaatttattaattttcaaatatttatttttggccaaataataagcgatcgatggtttc

SEQ ID NO: 97254 - DNA, 120 bp, Heterodera glycines
  SCN-specific regions: Sequence locations=1-63
caaaagatgattagtaaacatttttgaaaaaaacccaaactagcgaagaggcaataaaattttaaaaagaaaaaaaaaaaaaaaaaaaaaaaaaaaaaaaaaaaaaaaaaaaaaaaaaaa

SEQ ID NO: 97255 - DNA, 401 bp, Heterodera glycines
  SCN-specific regions: Sequence locations=1-5,27-401
ccaatcaggggatgaatcaattagcactcccacgaaaagctaaaaaaacgaacaaaacaaatgccattgtgccagttcaaaatgcggcctcatttggcgaccgaggatatataccatcgagtgaaatcatactaaaaacaaaacaaaaacgaagaccagaagcatcagctgaggaatacatcaaattcgtaaaaaatgccgtaaattcgctcaacaaaagtgacaatgtacatttcttaacaaatggcttctcattggtaggaaaaaatgctcagcaggaactacaaagatatcatatttatccaaggaatagactaatgattggaggacttatggaattaattgcgaacagaaaaatgaaaagcgccgatgaactggaatatatggtgcttgaaaaagtg

SEQ ID NO: 97256 - DNA, 136 bp, Heterodera glycines
  SCN-specific regions: Sequence locations=31-35
gttgattttattaaaattgttaaatttctacatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 97257 - DNA, 394 bp, Heterodera glycines
  SCN-specific regions: Sequence locations=1-185,207-394
aaggcacaagttgccatttttactacgtattattttatttgttgatgaataatgtcttctcgaagaaatgaatatctcgatgcgaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagacgctgaagatgctgtgcgtgcactcgacggaacgaggatttgtggcgtcaaggcccgcgtagagctttctcatgggagcggaagagggggcggacgcggttttcgaggcggagggggacgttatgacgaccgttatggtcgtgatcgttatgaccgtgatcgcgacc

SEQ ID NO: 97258 - DNA, 150 bp, Heterodera glycines
  SCN-specific regions: Sequence locations=1-84
aactgacaaacggacgaattacaaaatgtaattggacagcgaatagatttcttaatcgttcgattttgaaggccacaaattccgaaaataaaaaaaaaaaaaaaaaaaaaaaaaaaaaaaaaaaaaaaaaaaaaaaaaaaaaaaaaaaaa

SEQ ID NO: 97259 - DNA, 133 bp, Heterodera glycines
  SCN-specific regions: Sequence locations=1-1,23-61,88-133
gaaaaagaggagaggaaagaagtggaaaaagcagcatggattaatgaaagcaaggctaagcaatatttattaaatattttattttttggtaaaatatttccaatttttcatttccaataaatatttttgcttt

SEQ ID NO: 97260 - DNA, 158 bp, Heterodera glycines
  SCN-specific regions: Sequence locations=1-90
cataatgcaatccaagcaaaagccaaccctttcccccccccccggtgattacgatgcattcattgcttttagtcgcttattttttgctgcatttaaaatgttaaattttaaaaataaaaataaatttttttgaattttcaaaaaaaagaaaaaaaaaa

SEQ ID NO: 97261 - DNA, 394 bp, Heterodera glycines
  SCN-specific regions: Sequence locations=1-394
gaatttcgagttgccattgaaaagggcgacgcggcaaagtttgacggattgttgcgcgagagtccacgctttctcgtcaacacatccaacgatttgcccacaattttgcacattggcatgcgctgcaatgccatgcacatcgcctgccgttcctcaaatgttcacgctgtccgacaaatgttggcccttgttcaaagtggcgaatggttgcgcgatgcgtatgggacggatgcatgtgttaaggaacgcagtgataatttgctggacgctctgctgaatacgccagacaaaattgagaacaacacgccgttgcactacgcatgtcgacaattgtgcgagcccatctttagagaattgattggacacgaacagtgccatcgaagtccggtgaaca

SEQ ID NO: 97262 - DNA, 156 bp, Heterodera glycines
  SCN-specific regions: Sequence locations=1-6,28-156
tgagaaggaagggaaaaacgttttgggaggggcaaaacgtttgctgaacaggcacagcatttgctcgactttctcctcagaattcgccattttccgttcatcgacgacgaaagttccgaaggatttccatttaaaaagaaatcgaaggacgaaacg

SEQ ID NO: 97263 - DNA, 207 bp, Heterodera glycines
  misc_feature (203)..(203): n is a, c, g, or t
  misc_feature (207)..(207): n is a, c, g, or t
  SCN-specific regions: Sequence locations=1-74,96-207
cttgaccattgataaaagaataggctggagaatttggcacatgacagataaaaacgaatataccaaaatataataaaatttctatttatttcccacataattccccatcggtttgcttgttatgtttgtcgttctattctctctttttccccaaattcgcttaaatggaagatttataagaaacttaataaaggattgattcnttan

SEQ ID NO: 97264 - DNA, 466 bp, Heterodera glycines
  SCN-specific regions: Sequence locations=1-466
gcaattgcgtgggaattctctccgattgttttttgcccattggcggtgatctccgcacttttctttggtgtcggatgcaccgccaaccatctctattccggtaaggaatgctttaattgtttgatttgtccctttttcagagggtggctctttccccgtcctttcctccgacaattcgccgcccattccaaatgatccgccgacttttgattccccagccgaccttcttgacaatgaattgcagcagcccaaccaacagtaccaaactgagtttgccccttccatggaacaaatggtcgacgaacaaaggcgcaatcggctggccaaaattattgaacaaatgagggataatgaacagtttagccagcaggaaattgccgatgggcccggactctttttggaagaaggagaagcgaatgttcccattgaacgaccatcggaaacggagacttattgggacggacta

SEQ ID NO: 97265 - DNA, 214 bp, Heterodera glycines
  misc_feature (210)..(211): n is a, c, g, or t
  SCN-specific regions: Sequence locations=1-129,159-214
aggcgactctttcataggaaggattggattattaatccgctttgcgcggagagtgaactgactgatcgacacgcgatgctccgattttatcaccccacccattcattttcggttattttcgccagtgcggtctctttccctttttgttgtttattttgcgatggatttaattgatttcattccccgtgttgttgaaatagggttttttannttt

SEQ ID NO: 97266 - DNA, 394 bp, Heterodera glycines
  SCN-specific regions: Sequence locations=1-394
ccgatttgctggcggatccgcgcagcaaattggctgattggtttcgcccgggcactaatcgcccgcgtgggttttgcgttatttggcaaatcaagtgttaattgatatgctaattttcctttctgttaagcaattcctaccgacaaaggggggaatctctttttggacagagaccccaaaatgttccgtcatatcattggttatctccgcctgaaaaaggagcgatgcgccgcctctttggcacttccagcaaagccagacgatttggccaaactaatcggcgaatgtgaggcgcttaatttggtcgaattgcgcgaattggcgttggaaatgcttcaaaaatacgtcagaacggaggaacagcattatgtcacttcgtacgttcaaatggcac

SEQ ID NO: 97267 - DNA, 591 bp, Heterodera glycines
  SCN-specific regions: Sequence locations=1-178,211-505,527-591
ttgaccaaggagaattacgtcgagatggaatcaaaggtcaaagcggtcttcgagcagctgaagggcgatgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgcgacggcctgaaattgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataa

SEQ ID NO: 97268 - DNA, 154 bp, Heterodera glycines
  SCN-specific regions: Sequence locations=1-55
tgacggaagaagtctttgaggtggattgaatccggtgatcttttcattccccaattttgtgttatatgttggttttaaaaaccagtgttgttattaaaaaaaaaaaaaaaaaaaaaaaaaaaaaaaaaaaaaaaaaaaaaaaaaaaaaaaaaag

SEQ ID NO: 97269 - DNA, 307 bp, Heterodera glycines
  SCN-specific regions: Sequence locations=1-307
accatgattacgccaagctctaatactactcactatagggaaagctggtacgccttcacgtaccggtccggaattcccgggtcgacatcatcatcatcatggccgctaatactactcactatagggggggggggggatggcattgcccaacattggcacgcactcatttcacttaaccgaccggtagcaataattcacaccccgggatttcgataacaatcacaaaaaatagaaaaaaacaacaaataatttaggttaatttatgtaaaaaaaattaacttttgcgaagataaaaaaaagtttaatg

SEQ ID NO: 97270 - DNA, 508 bp, Heterodera glycines
  SCN-specific regions: Sequence locations=1-508
tgccgagggcgacgttttccgaggcttacaggtggtcgaattcgcatgcaatgcggcgagtttgctgttgggcgaacatttgccaaacatagccaaagacatggaaacgtacagcttgcgactgccattgggcgtaacggccggcatttgcccgttcaatttccccgcaatgattcctctttggatgttccctttggcactggtttctggcaacacgatgcttatgaagccgtctgagcaagaccctggcgcgacaatgatgctaatggagttggccaaggaggccggcattccggacggctgtgtcaacgtcatccacggcacacgatccgctgtcactttcatttgcgaacagcccgacatcaaagcaatttcttttgttggcagcgaccaggccggcaaatacatttacgagcacgggtctaagtttgataaacaaaaatccctacggaaatggcactgcccttttcactcggtcgggaattgccgcgcaccgtttcgtctcgga

SEQ ID NO: 97271 - DNA, 478 bp, Heterodera glycines
  SCN-specific regions: Sequence locations=1-42,64-478
acgcaaatattatttacactatgcacttttacgccggccaacacaaagatgacatccgaaacaaagtcaaaacggcttataaattgggccttccaatgtttgtgactgagtacggttgctactcggctgacggcaatgaaaaagcaaatttggaagagttgaaaaagtggatggaacttttggacggctatggcatttcctacgccgcgtggcacgtggcagacattggcgaacagtcgtccatactgacaaagtcttccgaagtgaacaacatctgtgacccggcccatttgaccaactacggagaagccatcattaacaaattgaaatcgcaaaacaatggtgtgaaatgcagtggttaaccaaccaattccaatgaatcggcggatgttatcgaaaatgtattcaaaagttgaatattcaaaaaagtttactaacccaattattgttagtaatttcggtgtcaataattgtaatt

SEQ ID NO: 97272 - DNA, 453 bp, Heterodera glycines
  SCN-specific regions: Sequence locations=1-30,52-399,421-453
ctccatggccaattactgttcatttaaaagattttcaaaatcaatagaattcatattcgcgatcagaagccacgaaaaccttcagaattttcccgatgaactcattcgatgtcggacgaaagaaacgctaaaattttgctttttgcaatctctgaaagaggcgtgccaactcaaacttggttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgaggtgctaatttattgagccaaatttacttggaatgatcttttggaccgatactcatgatatacaatttatcttttcgtctagtcattaattttttacatcaacttttc

SEQ ID NO: 97273 - DNA, 323 bp, Heterodera glycines
  SCN-specific regions: Sequence locations=1-323
ttttatggaggcggtatgcaaaatttacgaggaacatctgaagaagctgaaccccgacgtcccctgcatacagtacgacatatccgcactgttcaagttcatcgaccgattggctgatttgagctgcatggtgttggacaaaagtgtatatgtgccaaagggcgaggatttcatcaaagagcagattttcattttgctccgtggccaagcggcgtcgaacgcggcgaagaagtgcccggctgaaggatcgctctgatttttgatcgcattccttttatttgtaattaactttcatacaaataaaagtacaattctttaaaaaa

SEQ ID NO: 97274 - DNA, 181 bp, Heterodera glycines
  SCN-specific regions: Sequence locations=1-42,64-64,101-181
gtttatatggttccacatttattgttgattttgatgtttgttgataataaatgttttaatttgtaaaaaaaaaaaaaaaaaaaaaaaaaaaaaaaaaaaactcaaaagaagttaccactgcttaaaaaagcaaaaggaggccgcatcaagaggaaccaagattacacaactcttgtgttgt

SEQ ID NO: 97275 - DNA, 158 bp, Heterodera glycines
  SCN-specific regions: Sequence locations=1-158
ggggagaaggacaaaagtagaggatgaagatgagaagagatggatgagctacagattctaaagtgcaaaattgggtaacaaatttaggcgaataaaactgatttgtgagtggctttagaggagggaggaaaggctcttttaaggggaaaaaggaacac

SEQ ID NO: 97276 - DNA, 161 bp, Heterodera glycines
  misc_feature (68)..(68): n is a, c, g, or t
  SCN-specific regions: Sequence locations=1-24,60-68
aaagtcatttagtggactaattacctaattaattgcctttataaattttaaattaaagaacaaattcnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97277 - DNA, 165 bp, Heterodera glycines
  SCN-specific regions: Sequence locations=1-53,89-131,163-165
tccacatatactcgtcacaataacttagcaataattctcggcttgtcccggatattgctttgaacttcatttttaagttcttccaaaagcattcaacgtgatttgtgtgggcgcctatgatcgtgttatactaaaaatacaaaataaaaatgaaaacaaaaaaat

SEQ ID NO: 97278 - DNA, 237 bp, Heterodera glycines
  SCN-specific regions: Sequence locations=1-15,37-237
accagagaatatggtagacagacagagaagaggaaggacgagagatacgcttctggtggagaaccaacgcggaggagtgggagaaagacacgggaaaagtgaaggccatagcaaacaaaaagaatgatgaattgatgacaacaccgtcactttcaaacataaaatggaaggaaaaacaaagagcaacgattcatcctattctcttatttatcacagcgattaaagcgaacaattacc

SEQ ID NO: 97279 - DNA, 490 bp, Heterodera glycines
  SCN-specific regions: Sequence locations=1-340,374-490
ccatgaaggcgttgattggcaccgtcgacgaactgaacaaagcggtgaatgcctacggcaaatacacggtggaaaagcaaaagtacgacacaatgtacaacaatctgatgcagaagagacaaacggagaacgaagcgcggcaatcgcgcggagaaccgccgctgacaatggaggacataaagcggcagctgaagcagccgcaaatgcagacaaagtacggaatgttggacttgctgctgaacgcgctggacaccgacgcattcacgacgtaccaaattcagacgaccaacgaaaacgtggccaaattgcacctttcccaagcggtctctgctcagcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtctc

SEQ ID NO: 97280 - DNA, 354 bp, Heterodera glycines
  SCN-specific regions: Sequence locations=1-208,231-279,304-354
ttcctttctgcgccaacgccccccgtcccttccggcgacgattctctccaagtctctccacaccaaaccgtttcttctcactccgactgtcaccaaattcagcaaacgcaattggaagaacattcgactaataaggagcaattggcgcattttggagcatttgaggagatgcaagacctttctctctccggcgatgacttcaccgatgaatttggcttgtttttcagtgccttttgtccaaattcgtcgtctaattggacacaaaattgtaacaaacaataatttattttctttcattcattttcgaaaattgttttcactgtaaattacgatatgattaacaatgttaaaaaa

SEQ ID NO: 97281 - DNA, 383 bp, Heterodera glycines
  SCN-specific regions: Sequence locations=1-361
cagatagttgagcatctaacaaaaagcaaaatccatttagaaaggctgcaataagtatagtatatgcacacccctacaaaaaaattaaaaatttttagtcgaaaataataggaaaaaataaaataaaaacctctttttaaaccaaaagttaataaaattcttaataaaatttacagtgtttttccctaaaagtgacaaacgtaccgcatatttttggttgatgaccaaacgctgtaaaaaaatgcacaacaatttggacgtgtccttcactgtgtcagaaatttggttggtttgtccatcggcaacataaaaacgcgaataatactcgtggattgggtgcagcacagtcagaatgtcaacctaaaaagaaaacttttgtttac

SEQ ID NO: 97282 - DNA, 345 bp, Heterodera glycines
  SCN-specific regions: Sequence locations=1-79,101-176,259-283,333-345
aagccggcggattcagcggacgattcgctgtggagccgataccatgatcaaaatgcaatggaagagttgttgacctgttttattttctgaaatatttctacggaaaatgcgcgtttggtcgaagaatgtgctcatatgtacatctccgaagacagaaaagatgctcaatttccgtcttatttaaaattttaaaaaaattataaaattattatggaaaaaaacatttttttagatagattaaatttttaatttataattgcttcttcttaacatacgattcatctttttaaaatattttaattaacagttatttatttgtaataaatattaatctctgaataaatt

SEQ ID NO: 97283 - DNA, 150 bp, Heterodera glycines
  SCN-specific regions: Sequence locations=1-71,118-150
aaattgaaaataaaaattgaaacaaacaaaaaagaaggataaaacaaaaatgtgaaagcatggcgatgatgggagaagagaaaggaagaaaatgaaaaatgggatagataatacaaataatgcaacggaatggataaaaaaaaaaaaaaa

SEQ ID NO: 97284 - DNA, 470 bp, Heterodera glycines
  SCN-specific regions: Sequence locations=1-202,226-470
ccgcgtgttggacagttctgaggccgactgcatatttttggttggcggtgatggcactttgagtagggcactcgtcggattgagccaaaacagtgcgccattgccaattggtttattccctggtggtcgaaaaaacattgcattttggagaatttttcaatcaaaaaaccagagcagaggtatattactatacatacaaagcgaatttcatttttgttttcttttcttgattcgatggatttgaatgaccaagactcaaaatcagtgcgaatgttttgcgaaagtgcaatggcactgattgagggtgaaaatcgactcgtttatccagtcaaatgctcaataactgaagaaatgaatgactcgccttccgaccatcaaacggtcaacactcccaacactttttggctgctttccgacctttgtgcgggatggttcgaacattgtgaacaaaaggcacccaaactttggtg

SEQ ID NO: 97285 - DNA, 381 bp, Heterodera glycines
  SCN-specific regions: Sequence locations=43-381
ttaattatttatcaaaattataataataattattatttttttgcatattattgcataggttgccattatggcggaaggaaagcagcacgcaatgggaattggacaaatgaagctttcgtcggcgaatgtgcggtcacaaaatgttggcattgccattgacaatgtccacttcatgaacgacgggttgtggcgattaaccactgttcaatgagcacagaacaattttttttaaaattattgtttaattgactctataattaatcgctttttcaattttaaattgttgatgtatgaggaatcatattttttcgtgctttatttgcaaaatgaaatacacaaaattttcattcgaatgtttacattaataaatgtgaggtgatt

SEQ ID NO: 97286 - DNA, 150 bp, Heterodera glycines
  SCN-specific regions: Sequence locations=1-79
cggagaaatggcgaatttttgaagcgacgatttttttaattgttgtaaaaaactcttgataaaacacatataaatgctcaaaaaaaaaaaaaaaaaaaaaaaaaaaaaaaaaaaaaaaaaaaaaaaaaaaaaaaaaaaaaaaaaaaaaaa

SEQ ID NO: 97287 - DNA, 150 bp, Heterodera glycines
  misc_feature (69)..(69): n is a, c, g, or t
  SCN-specific regions: Sequence locations=1-69
ccgtgtccatcgattgaccactccatcagcgagcaatctgatgattttcttgaaaaaaacagttatacnaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97288 - DNA, 401 bp, Heterodera glycines
  SCN-specific regions: Sequence locations=1-241,275-306,328-350,383-401
cgtgtgaataaagccgaggctcattcaaaccaattaggtaattagctgacaattagccatcaacaaattggggccaaaaaacgaggatgccatccaaacgcatcactgtgccgctgtttctgctgttgactgtgctcgtcttggcactccgtgcctcggagacaaagattaaggcgatggaggagaaagtgatggaggaacaggacaagaaagaaaatgctgagatgaaaaaatttttgagagaacagaaaaaggaggagcagaaggggacaaacataatcggacaaaaagttggaccaaaacgtaattttggaggttttttgttttgagaactttaagcttttcacatataccaattctgtttttattttacaaaattttgtctacaaaactcacaaaat

SEQ ID NO: 97289 - DNA, 363 bp, Heterodera glycines
  SCN-specific regions: Sequence locations=1-340
cccgaccacatccaggtcaaagagccaccgattgacgtcgcgccgaccacgccgtactcggagcaccgcgaaaccgatgaccactggcatgccgccccagacacaaatgccgcccgcccatcgcaacagcaacttgcgaatggttggccagttgccgccccccgaacgtttttatttgtaagagaaaacccttgctgatggccctaatggataaatgggaaaatttccattaaatttgtgatttgggggggcaccggccccaaaccccctttttttgccggaaaaaaatttttgggggggtttttgtttaaaaaattttttgtttgtcgtgaaaaaacctcttttaaaatatttggggaaaat

SEQ ID NO: 97290 - DNA, 184 bp, Heterodera glycines
  SCN-specific regions: Sequence locations=1-184
ccgtgaaagtgatcagctgaaacagcattctcagctgaaggaactgatcggacaaaatcattgaattgcgaaattggccactctttcgttattttgatatttcattttttttacctttggccattctcagaaaatacccaaaatttaattgatttaatcaaaaagtaaaattaaaaactaaaat

SEQ ID NO: 97291 - DNA, 394 bp, Heterodera glycines
  SCN-specific regions: Sequence locations=1-394
aaataaaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaggctcagaaagccggaacgaaaccggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggag

SEQ ID NO: 97292 - DNA, 541 bp, Heterodera glycines
  SCN-specific regions: Sequence locations=1-541
acctgattacgccaagctctaatactcatcactatagggaaagctggtacgcctttcggtaccggtccggaattcccgggtcgacatcatcatcatcatcatggccgctaataccactcactataggggacaataaaaatttcttaaactcgggtttttgtggggttgatgaccttgagtgtctaaatttattgtcggcctttgttcgttatgttaggtgtggtggcatttgcattatcgacccaacggatctgttacccattgagcggtacattcgccttcccagtggcgtttttcggcctgtaaaagtgccaacaaatgcaattacccctcttcttacgagtgaagttaatgataattcagcagcagttgctacacttaccgatggacgacttgctctttttacgactgaccactttgattcgattgccgatgattcggctacatttctgccgttttccacgactttatccggtggaatgatgttagattgtgcagtgaaatcggatgggcgactgctatgttctgacaatttgggcaa

SEQ ID NO: 97293 - DNA, 555 bp, Heterodera glycines
  SCN-specific regions: Sequence locations=1-555
accatgattacgccaagctctaatactcctcactatagggaaagctggtacgcctgccgtaccggtccggaattcccgggtcgacatcatcatcatcatcatcatcatggccgctaatacgactcactatagggcgcttgaccagcaatgcaccatttcacgttcgggcatttcaatgattgcttccggaattgccaccgaactgttggcttctgtccttcaacacgaattgggcgcagaagcgcccgcccttttggccgaagtggacgaaaacgcgagtcaattgggcgccactccgcaccaaatccgcggttttatgtcacgctttcatctgatgatgcccaccgtacgacggtacgaccgatgcacagcgtgtgggcatacggtcaaacagttctaccggactgagggatttgaatttttgaaccgaatcttccaatgtcctgccgagttggagcaaatcaccggattagccgagttacagagacaagcggacgcatttcaatcggaagttatcgaaatggacgacagtgaaagcatttaaacaagtgcatt

SEQ ID NO: 97294 - DNA, 500 bp, Heterodera glycines
  SCN-specific regions: Sequence locations=1-500
actctccacttctatgcgtccagtcactttgttgatggacttggcaataagcttaagaccgccgtaaataagggtaatcatatgatactgtatcgtccaaaaccattactgtttgcaaccgtactttaaggtcttccggtgttcgtcactgagtacggtacatgcgaagcgtctggcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgtgagtgattttgggggccactgataggaagtgccgtccgagaatttcacgccacaaaaaagcgaatatttctcgagtcgaacactaaatctctcgaattcagccatttctcctacaaatttgctcatttcaggttggcacttcctcccgctggacgcagtctggcaatatggtagcttcgcaac

SEQ ID NO: 97295 - DNA, 504 bp, Heterodera glycines
  SCN-specific regions: Sequence locations=1-100,122-181,206-246,275-504
aaatttattatggctgccgctaaagctgggataacaaaatatgaattggcaagtagttttaatctttttttattaatcgaatttctaccaaatattttctcatttacaacttatttttaaagacaaaattatgtgtacgctgctactaaaagattttttaatgcttctggaaaatatttccgttttttcatattttaaataaattgtcatttcaatggagtgattattatccatttaccaaattaggaaaaacttttaatttgaataaatatttgtcccagttttgacaatagttggacaaaacatatttggcccatccccaatttccacaaaatccctaaattgccgtattcccacagatcgcgagagggcattttactttttacattactaattacaaaaaataccgtagtccattggaatttaaattattaattttcttagattggcgtctcatcactaagttttctcgccgtttttgtggcaattttgattttgcttgta

SEQ ID NO: 97296 - DNA, 394 bp, Heterodera glycines
  SCN-specific regions: Sequence locations=1-263,285-394
cggcgacaatgggatgtacctgaacatcattttgggctccaacctgaacatcaccttgcccagtccggacgagcgttaccgctacaaaaaggagtacgagtcgttcaagctgtccgtcgcttttgtcattctcgcagtgtttttcgtcgtcatttggctgcctccgattctacgcccattggacgccctttgcaactttctgttggtttggtactactgcactttgaccattcgcgagtccattcttcgcctgaacgggtcgcgcatcaaaggatggtgttgcaccattacatcacctgcgttctgtgctgcatcactttgacgtggagcggcggcgactgctacgagcacatgcgtccgacctttgttgtgctcgtgtgctatgtgagcagtg

SEQ ID NO: 97297 - DNA, 394 bp, Heterodera glycines
  SCN-specific regions: Sequence locations=1-394
cggcgacaatgggatgtacctgaacatcattttgggctccaacctgaacatcaccttgcccagtccggacgagcgttaccgctacaaaaaggagtacgagtcgttcaagctgtccgtcgcttttgtcattctcgcagtgtttttcgtcgtcatttggctgcctccgactctacgcccattggacgccctttgcaactttctgttggtttggtactactgcactttgaccattcgcgagtccattcttcgcctgaacgggtcgcgcatcaaaggatggtgggtgttgcaccattacatcacctgcgttctgtgctgcatcactttgacgtggagcggcggcgactgctacgagcacatgcgtccgacctttgttgtgctcgtgtgctatgtgagc

SEQ ID NO: 97298 - DNA, 392 bp, Heterodera glycines
  SCN-specific regions: Sequence locations=1-392
aggaataagtattaatgagccaagtgaatatagaaccaaagaaaaagaagccatcgcaacaagcagggcatggcaaagaaaatagcaaaaatctcgattgagtgcaaattggaactggacgaggaaaagtacgtggagtcgttctgtcccgcgatgatgaccgttgtctccaagtggtgttcgggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgttttctcagcgtcactttatctctaatttgc

SEQ ID NO: 97299 - DNA, 657 bp, Heterodera glycines
  SCN-specific regions: Sequence locations=1-609,631-657
gcccacccgatggcgaacagtcagtgcgtcaacttatgttgctcaacatctcctgtcttccaatcaattatgggaccaatccgcgctcgactcattacaaaagggtgacacgaaatcgactagcggaaaaaggccctgacaatggggacgaatgcgacacgagcttttggaccatgatggcctatcgtcaccatttcaatgatcaaaatggcactgattgtgaggaagacgcctccatgcttgtgggtgccatcaccgtgtccaaccgaaacagcaactgttcctgttgcagttccaataaaaccgatggggtcgtccagccacaaaaacaaatgttttctgtccaaattcagacattggctgttttgcccacttttcgtcgtcatggcgttgccactcgtctgttgaattcgctgataaaccaatgtgaaaaatgggctaacgtcgaaaatatctttttgcactgtcagacgacaaatgaagcggcactttgtctatatcgggcccatggttttgaggtcgttcagcaaattcatggccattatcagtgcagggcaattgacggcgaatcggcggatgcttttctactcgagcgacggtttaccaatgaaaatgatgaggagagaaaagttcgacaaaatgcggcatttcactaga

SEQ ID NO: 97300 - DNA, 296 bp, Heterodera glycines
  SCN-specific regions: Sequence locations=1-296
agcaggtcaccggtgccacaatgacggtgaacggaacgcgcgaaaacttccaagcacagctgagggacggcgacggtccgatgggagagcccaaattcgaacaatttgaacaacatccagattttgctttatggtgacaacaattgcatggggcctttgtgtccactagcagaggatcaaatcaacgcaaaagattgtctgccaatgaatcccgggcccaacggtcagcggaaggaaaggtgaaagaatgaattgagaaatgatatcgatcattctgaataaatttaaaggttacc

SEQ ID NO: 97301 - DNA, 238 bp, Heterodera glycines
  SCN-specific regions: Sequence locations=1-238
acgcagcgagatcagctcgaatttcgtgcacaacatgcgagttttggggatcaaacatacaatgatgatgaaaaaattcgtaagctaatgacggctcttagtctccagttcgtgggaaacgcaataaagtaaaggaatatgaaatttggaagaacgaccattctttccattagaattgttcattccatgttttttttaaacttgttattcgttcaattttataaatgttcattgtttt

SEQ ID NO: 97302 - DNA, 535 bp, Heterodera glycines
  SCN-specific regions: Sequence locations=1-317,339-535
ttgacatgattacgccaagctctaatactcctcactatagggaaagctggtacgcctgcaggtaacggtccggaattcccgggtcgacatcatcatcatcatggccgctaatacgactcactatagggcgagatggagcttcggcacagcaattacgaattggcaactgctttgcttcgtcgtgccactacgcctccaccagtgcgtcgtgacagttactttgatgattcggccaaagtgcaaaaccgcgtgttccgatccctgaagttgtggtcgttgtacgccgacattgaagagtcgatgggctcactggaaagttgcaaggcaatttatgagcggatgttggagttgcgaattgcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatggtggcaaaaagctggaaa

SEQ ID NO: 97303 - DNA, 491 bp, Heterodera glycines
  SCN-specific regions: Sequence locations=1-491
agtgaacgccaagccaaaataaatgccactggcgaccgactaaaggaggcgtcgaagatcaatttgtccctctcgacgcttggcaatgtgattagtgcgttggcggacgcgaaagtccgcacattccgtaccgaaattcgaagctgaatcgcattttgcaagaattgctgggcggcactgcaggcccaactgttggagcagagcaaccgttgggcaaagacgacaaaataaatgtgagcttgaacgcgttcgtcgggagttggcaatggagacgcgcttcagaacacagcaagcagaacagtgcgacattgaggagcagtacagcacactgcaggaggagtcccaggggatgggcaaatgacggtgcaatggatccaacggcaactactaacaataatcaaaggtgccgcaagatgaacagaaatataaaatatcagaaataaaagacactctttaacaatgcgagccatacatacgtcaattttgtttta

SEQ ID NO: 97304 - DNA, 276 bp, Heterodera glycines
  SCN-specific regions: Sequence locations=1-276
tgtacaacagcaaaaaccaatgcgtggacagtgtggtgctaatggacgaagtcaactcgagggaccaatttgaggaggtcgaacggcaccagctgagcttcatggaacaggttctgcaactgaaagtgcttttcaacttgttgccaaaagatgcgcgttttcgtgagaggaatttgatggtggaagtgttcacacggctcaaacctttcctttgattttattttcgttttccatttcaaaattttttgtttttctttgttcgtcattaaaaagaaa

SEQ ID NO: 97305 - DNA, 292 bp, Heterodera glycines
  SCN-specific regions: Sequence locations=1-137,159-216,238-239
gattacgccaagctctaatatcctcactatagggaaagctggtacgcctgcaggaaccgggccggaattcccgggtcgacatcatcatcatcaggccgctaatacgactcactataggggggggcaatttggcgaaaggaaaactacattaagaaataattaattaataatctacgacggcattcttttaactgtgagtgttttatcggtttttactttgcataaatacataatgtatcaaaaaaaaaaaaaaaaaaaaaaaaaaaaaaaaaaaaaaaaaaaaaaaaaaaaa

SEQ ID NO: 97306 - DNA, 398 bp, Heterodera glycines
  SCN-specific regions: Sequence locations=1-106,128-158,184-268,291 -321,370-398
taacctatgcgtttggactcagcgacaattatcaggtcacgtttcagatcaaacatgtgaagttgtggtagtgcttctcgttctttccgtcaacctgtcaagcgaaagcaaataaaatattgtaaaattgggtagcgccgatgcatatattgaaattcattaaaaatccaattattaaatttgtccatcaaaattttggcgaaacaatataagccctgaattttacacattttcctgtggcggtatcaattttaacaattgcaaaatctgatgctcgacgttcatttttattttcctaactctttattaattctattttcttctctctcactctcttgctttctctctctctcctctcacttctttctcgttgatctcagtctttctctttctctttg

SEQ ID NO: 97307 - DNA, 398 bp, Heterodera glycines
  SCN-specific regions: Sequence locations=1-29,53-209,231-398
ttttcaactgttgttgtattggtaattgacccctctccgcccccgtccccttaagagaggtcagcggcaacaagaagtgcacttgcactaaaaattgctaatcaattgtttgcggtgtttttaaaaaaatgagcagcggtgccgatagaatttttcgacatatcgttaatcgattttcaccaaaaattgctattttatgggcgttcgcaaaaatttcgcgttattttttggaatttttgtgagattggatgtggaggggtatcaacaacaacaaaaaaaccgagatttttagctgctatttctctttaaaatttcgagtgcggataggtcttggggttgatagtcttgttggtctaactaacaatgaatgttatgggaaagtcaaaacgggtggaaag

SEQ ID NO: 97308 - DNA, 395 bp, Heterodera glycines
  SCN-specific regions: Sequence locations=1-395
gtttcatctccgccgattgttggctttcggtgttcgatttgctcccaccttctcaacttggcctcggaattgcgctgatcagccaccgatttgacttttacatcgacgaacacttcaagactcgcaaatggacattgaaatctataccgcaacatttgtgccttggaattgtacgccaaatttttccgccgtttgcgtaaattcgtcccgtcaattctcaacgatttccatcaattcactttctctttttctatgccgacaatttcttgatcgaatttccggccgatgacaatgccatggcatcggatggacaagcggtggcaaaatggcttttcactccacgtccggacaatgtgccgaagctgttcaaatgctggttgtgtaaagatgatcca

SEQ ID NO: 97309 - DNA, 394 bp, Heterodera glycines
  SCN-specific regions: Sequence locations=1-394
catactcagccgaatgaattgccgcaactgtcgccgcaggacataacaatgcattcgaaaatcattcaccagaaccagtgggatggtgagaggagtgtgatcatcacctgcagttttacgcctggctctgtctctctgacttcttaccgtctgacgcctagcggctatgaatgggggcgaaataacactgacaaaggcaataaccctaaaggttatttgccgtcccattacgaaaaagtgcaaatgcttctttccgaccgctttttgggctactttatggttccgtcggcgggtgtttggaattacaatttcatgggtgttcgacatgatgcaaatatgcagtatgatgtttgtttatcggctccaaaggagttttaccatgaggatcatcgcc

SEQ ID NO: 97310 - DNA, 397 bp, Heterodera glycines
  SCN-specific regions: Sequence locations=1-121,189-397
tgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgccattttttattctgccgttttttctgcaattggtgcgccagtcgaaccgagcacaaaagaaagggaaaagcatggtgttgctgctcactatttgaaggcggaagatgaaaaattggaaaagat

SEQ ID NO: 97311 - DNA, 378 bp, Heterodera glycines
  SCN-specific regions: Sequence locations=1-302,324-351,373-378
tcaggtgtcgccagagacaatgaatcagtgtccgacaaagaaggagagcagcatttagacaatcaacagaacgaacgatgcccatggagcagtgatcattcatctccagccttgcaatgcgggcggacgagcgctgttggcgaatttcctgaatcgtttggatggacaaacagtcacacaattcattttgtccctgttcgatatgtaccgtcctcactgattgtacaaatttctcgccatttgtcacgtctgtatcatttttgtgccaaatgttcccatttgacttttgtgtagttcgtttccccatttgtgtcaatttaattccacttatgaaacttgtacggcaaatggcattttaagaaaaaattttttgaaccc

SEQ ID NO: 97312 - DNA, 394 bp, Heterodera glycines
  SCN-specific regions: Sequence locations=1-222,246-334,389-394
aattaatttaattggcttttttctctcttaaatgcgctcccttctgttcctcgctttcgtggcacttttcgtcgtcaaatgttcggccgatgagtcaatgcaaaatgatgaaaatgatgagcaattccctcccggaccaccgccaagcaatgaaatgtcggaagaatcaaacgatcgccgcaagcgaagccctttcttcaactttttcgggggcttcaaaaagggaggacgaggaggacggcaaaaaggggaaaagccgaacggagtgccgcccacgggaagtccacccgcggagcgggagaagcgtagcctgagcagaggaaatgccaaaatgggaggacgaggaccaatggggggacgaggaggacaaaagggaggaagaggaggacaaaag

SEQ ID NO: 97313 - DNA, 583 bp, Heterodera glycines
  SCN-specific regions: Sequence locations=1-137,159-583
caaagagccacggccattgtcaaaggtccgcgggagggcgcggcacagcgcaaacactcgcggcatttgcttttcactctcggaaatattcactttcctttccaatcgcttgtctcatttcgattcaaagtttctttttgggatgaaattgctgaaatccctcccttaatttaaagaaagagtcggtactgaaaaagacattttcagttgaagcgggcgacagtttgaccaatgccattctgggcattttgccccaacaatcggccgacgacgccgaggctgacagcactgggaacggaccaatgcattcagcggaacatcaccagcacgagacggaccagcaacagcagatgatctcttcagggacgggtgccgcgtcggtggaaggaaatgccatcgccgcgggggttcggcgccattctctgctgggaccgattccaatacgttcacagcaacagcaatccgtcgaaggccaacagtcgaccattggccagccgatggtgcgcaatttgccacctgcgactgttcgcactgcgaattttgcgcaaaatcatccgcaatcgctcgtcaattcgcagcatcc

SEQ ID NO: 97314 - DNA, 464 bp, Heterodera glycines
  SCN-specific regions: Sequence locations=1-412,434-464
tttagcctttttctccgctgatcgctgtaaaatgagtcaacaaaatgaagaagcacctggcaaggatcaaaaggaacttcgagcagttcaacacgacatggaacgccttttcaaagcacgagacgcgaaaggactttccgagctgtacactgtcgacgccatcttcgcgagcaatgcccatccgccgatcaaaagtcgtgcagagattgaaaagctatggatcaaattccttgacacagactctgccgaattgcatgtaacttttgacgaagtttacttttgcggcgatttgggcgtcgaaaatggcacttataaatttacgaacaacgacggcacagtgacacagaacggacttttcatccaaacttttaagcgcggttcggacggaaaatggcttatccacaacgatttttacacatgttgaaaaagaatgaatcacaatgaaggcatcagaagaaaaagaa

SEQ ID NO: 97315 - DNA, 207 bp, Heterodera glycines
  misc_feature (206)..(207): n is a, c, g, or t
  SCN-specific regions: Sequence locations=1-207
aaattaatgaaaatcaactatcaaattgagatgaatctgacgaatgcggggagtttgaagaagaatacaacggaagttctgatgccgttttttgctcggacgaagcacaaaatgcagaaacacaaatcaagcagcaaaacccgatcgaaaaaattcacaatatgtgtcaaacttatttttctttcgtacaataaaacaaaagctann

SEQ ID NO: 97316 - DNA, 164 bp, Heterodera glycines
  SCN-specific regions: Sequence locations=1-50,72-164
acggggacaacgacggacggagggggaggaggaacaacgacaatcagttcagaagcggaagagggagggacagcaccagcggagacggagacggaactgtacgacgcagaattggtggaacggaaagtcagagagatcgaaggcaaatggaaggtggaggtgga

SEQ ID NO: 97317 - DNA, 482 bp, Heterodera glycines
  SCN-specific regions: Sequence locations=1-7,30-54,76-326,350-482
cccatcattttaaaatattccccaaaatgcgtgttctcccccttctcttttctgccctcctcctcctctctgttggcctttgttttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacggtagcaatggatactatcgacgaaaacccggcattttagaacgggcgctgggaaaaattacgcggagctattaacggacgagcagaagaagagaagcaaaaagccaaacaatgggcgtaacacttttagttgatcaaacgatattacagtatccaacaccaaaattacagtaaccaaacatccaatggaacgaatgactcatttaattcagcaaatttgctggaattgccgataaa

SEQ ID NO: 97318 - DNA, 554 bp, Heterodera glycines
  SCN-specific regions: Sequence locations=1-328,350-554
tccaattccgtccccaaaacgatgggtttttctcggaagatgaacagcaaaaatgggtcaaagaacatattggagaggctgagataatttacacgatgggaccaataaaagtggacgcatcgcttttggtagttgccaaagcgttaaaagcagtggtgaccatatctgcgggccatgaaaacatcgacaccgtggaatgtgccagaaggggcatccgaatgggctttggcggtgccattctcactgaagcaactgccgaaacggcgatggcacttttacttacggtttcacgccgccttgtcgaagcagtacaaatagccaaagaaggaaaatggccgaacaattggtcaccaaagttttgtgttgggaaagcattggaagggtcgacggttggtatttttggaatggggcgcattggacgaagcattgccgataaactaagcgcatttcgcccgcttgaaatcatttatcacaaccgtaaagccaattctgaatatgagggtcgcttccgttatgtgccatttgaagaactcatcgaaagaagcgactttttg

SEQ ID NO: 97319 - DNA, 394 bp, Heterodera glycines
  SCN-specific regions: Sequence locations=1-394
aagataaatttgaggttggattagacgtgcaattttttgctccacaagaaattgaggtcagaatgccaaaagaaaagagaaaaattatccaattaaaaaaaaaaaaaacaaggtcaaagtgtcgggccaagatgtgatcattcattgtctccacgaaattcgcaaagatcagcacggaagtgttaagcgcgaaattcaccgtcaataccgactgccaaatgacgtcgacgcggcaacattgaaatctcatctgtccacccgtggcgtgcttacattgacagcctcgaaaaaggactaactgagaaggaaaattgagtgaatttgatgggaaattaggacggaaattttgctcatcttgtgagctgctgttgaaataaattgaaacaaattgcta

SEQ ID NO: 97320 - DNA, 230 bp, Heterodera glycines
  SCN-specific regions: Sequence locations=1-104,133-230
aacattttcacatttattttcatcgccttgctgtgccaataccaccgcagcaaacatcatataaatgctggaccattggacgctgaaaaatgtcggcataaatgatttaataataataataataatttttatgttttaagaattaacgttttttttatttctgtcagaaataatttaaaaaaggaaagctttttgaacattttgaaaaaaatataaatttaattgccacc

SEQ ID NO: 97321 - DNA, 166 bp, Heterodera glycines
  SCN-specific regions: Sequence locations=1-89,113-166
agagaattggaaaatgatccgatcagccttcactcatttatcttcggacattctgaacaaaggataactgaagaaagaatggaatgttgatcaaacaatttcaattgttttatttaacgatttctgcctccattttaattttttatttcctaactattaaattttg

SEQ ID NO: 97322 - DNA, 394 bp, Heterodera glycines
  SCN-specific regions: Sequence locations=1-29,51-136,246-394
attatacccaattaaaaaaagtaaatcctctttaaaaatgaaactttcaataattttattgctttccttggccttttgtgcgtcaatcatcgatgcatatccatcgggaaatggtaaagatcttgaagctgacaacgaaaaaacggaagtgaaggaagagaagatggaaaaaagagaagcggaagtggaggaagggaagaaggaaaagaaagcaaaaggcgctgcgggggaagaagcaaaggaagtgaaaacgcgaacctaacaatagtggaaccaatttcactgtactttttacacagctgtagtcagacattgtaaattttggcatcatttacgatttaagcattcgccggttcgttaattaatttgtcgtgttgtgattttctgtactttt

SEQ ID NO: 97323 - DNA, 542 bp, Heterodera glycines
  SCN-specific regions: Sequence locations=1-225,247-271,295-364,398-542
accatgattacgccaagctctaatacgactcactatagggaaagctggtacgcctgcaggtaccggtccggaattcccgggtcgacatcatcatcatcatcatggccgctaatacgactcactataggggcattttttatcggagtgaactgactaatcattccattttcatgtcaattacatattaaccataaaaaccgaaaatgtcgatggttttcattcctatgttcaccctttaaaatttaccaaatcttacaacattaaacttctattttaatttaaagtaattaactgttattatacccatgtactaataataattagtcaaaaaatttaattgtttaaaccacttttgaattagtggaataaaaatataataattagttttaaaattaatccgatgaagctgtgggtggaggacacgacggatgaggaccttttcccgcactttgacatcgtggcagatcagatccatgccgtcatccaagaccgtggtgccgttctggtgcactgcgtcgccggcgtttcccgatccgccgcca

SEQ ID NO: 97324 - DNA, 219 bp, Heterodera glycines
  misc_feature (218)..(219): n is a, c, g, or t
  SCN-specific regions: Sequence locations=1-161,183-219
gatgacaaattttttgctcgtctgtggcctcaatgaacgcagtgtccgtttgggtgcgctgttttttgatgtcttttggcagttcgtcaccgatttttgttccacgaccttcgcctttttggtgacccattgccttatcattatgttgaaattgtgtcacctatttattgtttcatttctttgatgtcacaaaaacccgaatgaatgctcaatgatann

SEQ ID NO: 97325 - DNA, 150 bp, Heterodera glycines
  SCN-specific regions: Sequence locations=1-89,113-117
aaatatttatggaattgggacaaatcgcatttgatatcttttcaattatagacattcttctcacattgacagttctgttgatagattcacagatttttaggaaatatgcaaattgttaaaaaaaaaaaaaaaaaaaaaaaaaaaaaaaaa

SEQ ID NO: 97326 - DNA, 154 bp, Heterodera glycines
  SCN-specific regions: Sequence locations=1-94,116-154
aattcgatttggcaactctctgaggaataaataaatatccactaaaactaatcaatttttatacaattaaatttttgctttggtgtagagtcaactaacaacaaaaattccaaaataactcatttgaagagtaaatttcttacagtttgattgg

SEQ ID NO: 97327 - DNA, 455 bp, Heterodera glycines
  SCN-specific regions: Sequence locations=1-76,98-404
tctcagaaagcgcttgaggatttggacaaagtgcagacggaacttgacactttaaatgaaacagccagcgacgaaatattaaaagtcgagcagaaatacaatcagatgcgaaagcccttcttcgaaaaacggacacacttcatcaaacagataccaaatttttgggtgacagtgttcataaaccatccacaaatcagcaatatcctcgaggaagaagaggaagaatgcttgcactatttgacgaaagtcgagattgaggaaaatgaagacatcaaggccggttataagttgaaattttctttcgacccaaatccattcttcgagaactctgaaatagtcaaagaattcaattggactgcagcagaaccgaacagtgtgacaactgaaatcaaatggaagcactcgacgatgaagaaaatgaggaggaggacgatggtggggatgaggaggaggaa

SEQ ID NO: 97328 - DNA, 443 bp, Heterodera glycines
  SCN-specific regions: Sequence locations=1-160,204-364,386-443
cagaagtgtcgtttcgaaagcagcaaataatgttgcggaacaggggacttcttcagtttcgggaaataaggagaatctgttaaatgcctatttacagctctccaaatgccgtctcaccgcattgatcgcttgcacttccgtcagtggttttctgatgtcccccgccctctcttccgccccctcctcccttttcttctcttgcgtcgttggcactgcgcttctttcggcttctgccagtacatgcaacaacgtaatcgaacgtcagcacgataaacagatgaaaaggacgcgttcgagagtgctgcccgtggggaggttgacgcccattcacgctttgctcttcgccggtgccacgggaactgccggacttggcatcctttgcctcagttgtaatcacctcacctccgcccttggcttcgtaaatctcgcgctttacgccggtg

SEQ ID NO: 97329 - DNA, 444 bp, Heterodera glycines
  SCN-specific regions: Sequence locations=1-444
gacagaatcaaagaatggatttatccgatggacgtcggcccaatgattgaagaattggataaattggcctatttttgtcgatcgcaagaaaaagactctgtgatgaaccatttgcgggaaatgcccgttggccatttcgcgctgcgactgtccggcacgaggcgaagatttttggcactgagtatccgagtggaaagggatgagaagaatcagaaagggattgcccactatttggtgcttcgcaatgagcatgggtttcgcatcaaaggttccaagcgttacttccaatcgcttcccatgctgatcacccaccactcagtgatcactgaccaattgccgtgccgtcttttgctgtccgattggcgttggacacggggagacgcaaatcaacgacgacgtcaaagcagcgggggaagcactttggcagtgctaagggcaaccgaa

SEQ ID NO: 97330 - DNA, 381 bp, Heterodera glycines
  SCN-specific regions: Sequence locations=1-245,282-282,305-381
ccaaaagaagcagttgaagaagaacacggagaagaggaagggcacaataacattcattttatgtacagtatcactctggaccattaccgtacccgtccccttgttacagtgtccactcatagcgtccaaaaaccgtcgtttgtttctttcttcccatttcagtgccgtcctttgtttttgattcgttcattcgcctccatttctcttccaaagcacaaatctcgtcacaatccatcccatccgaattcatttcttttcctttttcccctcattttctccttaattcccctcccccctttaaatgccttaaccaacccaaaagatttccaaattttgttccattcaaactttaaatttgctaataataaatgcataacaatt

SEQ ID NO: 97331 - DNA, 394 bp, Heterodera glycines
  SCN-specific regions: Sequence locations=1-28,50-344,387-394
ctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttacatttatcgtggcgactttttccatgactcaaagaatgagccgcatgtggaggagcaattagttgccgcaatttatgatctgatctccaagtacaaagttgatctgtacgaaattgtcatttttgtgtccaagagtccatgctttcaccaggattgtgagccc

SEQ ID NO: 97332 - DNA, 532 bp, Heterodera glycines
  SCN-specific regions: Sequence locations=24-153,184-196,218-273,303 -306,332-367,389-532
aattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggctgcaggcgcgcaaattacccactctcaacgcgaggaggtagtgacgagaaataacgagaccgatctcttatgaggccggtcatcggaatgggtacaatttaaaccctttaacgagtatctatgagagggcaaacattgacattcttctcgtcaccggttcccgagcctcccacattgagaatgtcagacatgtgttcgagaatatgcgccgagaaaagagcactttgctcgtcattgacgacaaaatggacgtttt

SEQ ID NO: 97333 - DNA, 230 bp, Heterodera glycines
  misc_feature (229)..(229): n is a, c, g, or t
  SCN-specific regions: Sequence locations=1-161,183-193,216-230
gacccaacgaccagaatttgtctgagagagagagagaggtgccgaacccgaacaaaggatgccatggcgaatggacgaattgtgccaatgccaaatgttatcggatttattaactttaaatatttttttaacgacggtcgatttatgctgttctgtttatctttatttactcatttattgctgttatcaattattttcttatttgatttaatattacgttttctttaana

SEQ ID NO: 97334 - DNA, 515 bp, Heterodera glycines
  SCN-specific regions: Sequence locations=1-96,118-288,310-515
tgagcaacgcacttttgcttctccgatacgtcaccattttcctcgctcaacgactttcacccgccgaatttgcgcatttttttccttcccaataaccaaacagacaaaaaaccaaaacagttggatactgatgagtcatttgctcaacaattggaaagtgctgctccataacaatgtcggcttccgcaactttgtgctctcccgcattaatcttgaacagctcgtgctccccgtcgtccgggttttatacgacggaatgtgctcagtgcctggccatggatttcaacgtccttcccccacgtcctccccgaaaatgcggcgacagtcccaattcagccacaataactcaacagttcacacccaccaaacttatttggcactgattgttctgctcatactcagcgaagatgacttctttaagaaagtcatccatgaaatgacaatcaaaaacattgactggtacactttggaccgaacaacgcatttggcagaaaccacgttgggcggtctcattg

SEQ ID NO: 97335 - DNA, 296 bp, Heterodera glycines
  SCN-specific regions: Sequence locations=1-296
aaaatgacatcaatttatgctattggaatccgaatgtacagtatccggatagacggattggccaatgcgagccatctcaatataccaagttagaatattcgaacgtgaagatagagaagaaccggaactgaaactgagaaacgacgaagctgcaaaaccatttgctttagacaccggcacaaaaagctgttaagaaacgccgaccttatttaaaaaagagacaatataatcttacattcaccttggaattttgaagaacccagtataggaatgaataattaaaatttcaaattgtt

SEQ ID NO: 97336 - DNA, 394 bp, Heterodera glycines
  SCN-specific regions: Sequence locations=1-394
gctaaacgaatggcttcaaaaaaagggagtgccatcggatgaggcggctttttttcttgaaacttattttcatgagaacgagaaacaaatattaaacaacttcggaagagcattcattgcttgtcatgaaacttatggaacaaattttacgggaaaattggcacaaattggcattactgagaaaaagttagtgcaaatttgtcagtttttagggtatgatgacaaaatatttgatatacaaccaatcgacagtgatgtgaactttgggcttccggattggaaagaattttgcccaaaattaatggccaataaaattccaaaaaattcagtggttgtaatggacaaattaaattcagtggaaaccgtcggcatgaacaaaggtcaaaatatttta

SEQ ID NO: 97337 - DNA, 394 bp, Heterodera glycines
  SCN-specific regions: Sequence locations=1-17,40-282,305-394
ctctcgcttgtcactcaaaaatgaatgttaaaggtggtggtatctctcaagtgaatgattccacttctgatgaaatgaggctcttcagaggaggtcttagacatgctggccaaaccccaagcagattgatctacgacactacttcatgcattagaaactatcacgataagtacagctacgaaagaggtttcattgcccactctcgttcaccatccaatcaataccttaacttccacttcatgtacggaggtttcaagaagttcgccctcgagagacacgtttaccagaactggtacagaaagaacattagaaactggtggctccctgctatcatctgctacactgctggttgcctcaccatgagaatgtacgacaatgctgcttatgactattt

SEQ ID NO: 97338 - DNA, 288 bp, Heterodera glycines
  SCN-specific regions: Sequence locations=57-58,84-110,139-195,285-288
cgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctaccataatgcttttagtcgcttattttttgctgcatttaaaatgttaaattttaaaaataaaaataaatttttttgaattttcgtatttttaattaatttctttttacgaataaaaataattaccta

SEQ ID NO: 97339 - DNA, 201 bp, Heterodera glycines
  SCN-specific regions: Sequence locations=1-201
gggaggaagagggaaaagagggctcttgacagagcggtccgcgagaccatcgacgaagcgacagagaaggccaaagagttccttgaagaaaattggagcgcatttgagaaattcgctattgtgttgcacgagcgcaaaacaataagtgcggatgaagcagaggagtaattttttcccccataaattttataaaaaaatagt

SEQ ID NO: 97340 - DNA, 113 bp, Heterodera glycines
  SCN-specific regions: Sequence locations=1-113
attattcagaaaacagcttaaaaaagctaattgaagcggaaaaaatggaagaaactttgaaaatttggtagtgatttatgacattatgtgaaaaatcattttgcaataaactg

SEQ ID NO: 97341 - DNA, 252 bp, Heterodera glycines
  misc_feature (252)..(252): n is a, c, g, or t
  SCN-specific regions: Sequence locations=1-170,194-199,221-252
caaaaggtggtggttatttgacgaggtcatttaaccatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatattttgcttcttttcatggaaaacaagaagtcaataagttgtttan

SEQ ID NO: 97342 - DNA, 337 bp, Heterodera glycines
  SCN-specific regions: Sequence locations=1-191,213-218,245-271,293-337
ttcccttattgcctccatctttgaacaaattcaaacgtccaatgactgaaagttattttggagagagacaatccgggaaaagagacggggcggacagagtgacaggcgatggagaagaaaccgtggcatgtcaatcctcgactcaccaagaataatattaaacggaaaaacaaaccaatttaatgttctaaaatttgtcatgtactttcatcattccttcactttcattttattttgtcaccattatcaggcttattcctacatcagtggttcgtgtaaatgatctcatggattatttgtacatctgaaaaaaagtgatttgaataaattgtttctc

SEQ ID NO: 97343 - DNA, 393 bp, Heterodera glycines
  SCN-specific regions: Sequence locations=1-393
cgcaaactatctgaaaaacccttacaaattctgcggagattattacttccagccttgcacgcaggacgttttggagccaactatgctgtcatacaaaatgagctggattttggacaaagttaagaagaaccgttcaaaaccaccgtctacgattttcatcattcgcgatggtgttagtgagggaatggttccgaacaacattcacgacgaatttccttcctatgtgagggcgtgtaagaaatatgacccgacttgggagcccaaattcgtctattgcatcgtcgacaagaatcacaacaaacgtttcttcgttaaggggcagcaacaagtcgagaatactgctccaggggcggttattgattcgaaagtggtacgcgtcgacatccacgagtt

SEQ ID NO: 97344 - DNA, 484 bp, Heterodera glycines
  SCN-specific regions: Sequence locations=1-484
tcatactgaggatccgctgattgttggcatttgcgcaaactctctgaaaaacccttacaaattctgcggagattattacttccagccttgcacgcaggacgttttggagccaaatatgctgtcatacaaaatgagctggattttggacaaagttaagaagaaccgttcaaaacctccatctacgattttcatcattcgcgatggtgttagtgagggaatggttccgaacaacattcacgacgaatttccttcctatgtgaaggcgtgtaagaaatatgacccgaattgggagcccaaattcgtctattgcatcgtcgacaagaatcacaacaaacgtttcttcgttaaggggcagcaacaagtcgagaacactgctccaggggcggttattgattcgaaagtggtacgcgtcgacatccacgagttttggatgcagtcacatgttccgctcaaggggacatcaaaaatgccacaatacattttt

SEQ ID NO: 97345 - DNA, 265 bp, Heterodera glycines
  SCN-specific regions: Sequence locations=1-265
acaacattgacaaagtagcgcttcttttggagctgtttgagcggcgacacttgcccctgacaaacgaagactttttccataatcctgcaattttgcgggattttggtccgaccggaaaatgtgctgtgcgagcatcgccgttttactacccacttgcaaattatacggatacgtgtacggcttcgtactatttttcgggttcattcatccatgcatgtgaatcgtacattgtttatttttttgtgtgatgaatggcacattttgg

SEQ ID NO: 97346 - DNA, 276 bp, Heterodera glycines
  SCN-specific regions: Sequence locations=1-276
cgaaaccaggagatcaccttccaaatgtgcaagtggatggtgatcctgtccgtgttcttcactgcgcacaactttgccatgatgttgtacgggaccaaggagaagccgttgtggccctacacgctgttcatgaagaagagtgacggagcataaagaagctctctcgacgacacatattgtttttgtgtgtattaggtgtaaacaaaattttcatgttttatggacggaaaatgttagtttggatgtttatgttccatggataaagaaagctgggct

SEQ ID NO: 97347 - DNA, 539 bp, Heterodera glycines
  SCN-specific regions: Sequence locations=1-518
accatgattacgccaagctctaatatccctcactatagggaaagctggtacgcctgcaggtaccggtccggaattcccgggtcgacatcatcatcatcatcatcatcatggccgctaatacgactcactatagggcaaatgcaaggcactctacgaattccaagcactaaacccgggcgaactcgactttaaggagggccaaatcattcagctcgattcgcaaattgacgagcattggtttgagggcacagtggacggccggaccggctttttccccatcacttacgtggaggtgatcgtaccaatcccttcttcttccacgacggcacaacaataaactttgtagaacaccgaacagatgacacaaactgtgctttgggatggtcaacagaacaagtcaaacaaactcacctaaatttgctaataattccttaattttcactgtttgtttttcgacccgagattctcttcttacaatagaaaatggcaaatttctaaaccattaacttctcagataatttgttttatttcttaaaaaa

SEQ ID NO: 97348 - DNA, 199 bp, Heterodera glycines; identical to SEQ ID NO: 61973
  SCN-specific regions: Sequence locations=1-53,76-155

SEQ ID NO: 97349 - DNA, 150 bp, Heterodera glycines
  SCN-specific regions: Sequence locations=1-90,113-130
gaagtgaaagcgattaaacgaaaaacggagaaaagtgtggatgatcaatcttctgcttaatcttaatttcttaaacatttaacctgtacgtattttactttattattttttcgaaaagaaaattcattttaaaaaaaaaaaaaaaaaaaa

SEQ ID NO: 97350 - DNA, 480 bp, Heterodera glycines
  SCN-specific regions: Sequence locations=1-402,425-480
cccctgtcgaactgtcgcgagactcgccacccaattcgactgagacaatattcgtcataaaaggcactccattccaaatccatcatgtccaacacatcatccgtattaaagtgggcgatgttgcaccgggaacaccactaccatcttttcacggcaatgctggcattaccaatgccacaacgcctttggccgttggaaatccctacggacccacgccgcatcaagcttttagtgctgcgcctgctcagcaagacccttcggcttggactcagtattacaaccaacaacaagcgatggcaattgcggggggtccgccttcccaacctgcttcttttggtgccacgccggcacagcattaccaaacagtgcccgggactatgcaaactgctgtttcacaagcagcacagctccattcaacccaaatgcagcagcaacaaatccatcaacagcagcaagcgaccattgctcagcctcagcaag

SEQ ID NO: 97351 - DNA, 527 bp, Heterodera glycines
  SCN-specific regions: Sequence locations=1-457,479-527
gtttgagatacctcctcctcccattcgttcattcttctccaattcgtcctttcccttctcaaatggcccaattccccgtcgccaacattctcctcgcctcccttttgttgggtttcgtcattttgaacagcaaaacgaatgcgcagtttcaatacggcggcggaatgttagccgaagggccccaaatggaaggccttttggaggattacggtagggtgggcgactatcccttcgaaagtcttgcaaaacgcgcgccgctcgaccgttccgcaatggccagatttggtaagcgcgcaccgctcgaccgttccgcgttggcacgattcggcaagagggcgccgttggatcggtccgcaattgcgcggttcggaaagtgaggagaaacggacggatggatggaaaccggtggaaaatggcggaaggaaaggaaccaccggcggaaaacaaacattttctgttttcattccttctcaaatttactttttccacacacattttatggcgaaaaagaaattattttctcggtt

SEQ ID NO: 97352 - DNA, 352 bp, Heterodera glycines
  SCN-specific regions: Sequence locations=1-10,33-49,80-258,281 -315,338-352
aaatcatcatcagcaacaaaaacagcaacaaattcatttaaattcccacaaataattaattaattaattattttattttctacaaaatgatttccgtccaattttcccccatcgttttgctgctgcttctgctcactttgctgcacctttcttcaccggccaatgctcgtccccaatggtattacgccgacccaatttcgatggccaacaatcgtggcactcttttcgacaatttgtggggacggaagtgatttggcactcaaaaagaccaacaaaacaattgtcaatttgtgcataatattgtgtaaagttttgtttaattttgttttaataaatgccattaattcaaaaa

SEQ ID NO: 97353 - DNA, 271 bp, Heterodera glycines
  SCN-specific regions: Sequence locations=1-5,27-271
agtcctcaagtcaaagtcaatttgctgctccatgcgcatttaatgcgcattcagttgagcgccgagttgaccaaagacactgattggattgtgctgaaaacggtgcgccttgttcaggcgtgtgtcgatgtgctttcgagcaacggttggctttcgcccgccatccacgcgatggaattgtcccaaatgctcactcaagcgatgtattcaaacgagtcgtacatgaagcaattgccccactgcacgcctgaactgcttgaacgttgcaagg

SEQ ID NO: 97354 - DNA, 270 bp, Heterodera glycines
  SCN-specific regions: Sequence locations=1-43,66-126,171-212,243-270
agcgaagaatcccccaaaaaacgcattattttaccaataatataaatgagaaaatgaatttatttaaattatgctttcacttcattttatacactgactgctaattgcatataaacgaacgaatcctttaaatgaataaatattctatttcaaataaatttattaaaaatgaaaatgttcagttaaatttcatggattgggctatgtaaatgtttaattattaaaataaatttaaaaataaagttcgtttcaaaattgcatttaatttgg

SEQ ID NO: 97355 - DNA, 462 bp, Heterodera glycines
  SCN-specific regions: Sequence locations=1-169,192-462
agggttaaattctgaaaattaaccgaccactttcggataccttctagaacaacagttcccatttatttgctccgactcattgtcagaacaatgagcaagccctttcgctcatcgattttatgctgacgcttaaccccgagaaacggccctctgcgtccgctgccttggaccacaacttctttttcgagacgcccatcccagcaataaacattcaggaattgctccaacagttaagagggaccaatttgttcgagtacacttcgggctgtggagctcatgctaaccgtcgtcggccggttgctcctgccgctcccatgcaccagcaacaaatacgcggaaaaatgccttctgttgggggagcgatgcatcgggcaacgggaggggcaccgcaaagggcacaacaccaaacggtgggcggtcctccaaacatccaccggtcaacgggcggagcaccgcaaaggg

SEQ ID NO: 97356 - DNA, 145 bp, Heterodera glycines
  SCN-specific regions: Sequence locations=1-55,77-145
aggatggcagcagctacaacaacaggagctaatggaaatcgattcattccattagctcctgttgttgttgctgctgccatccttagacgtagtggccatttctcaggcccctatagtgagtcgtattagcggccatgatgatgat

SEQ ID NO: 97357 - DNA, 339 bp, Heterodera glycines
  SCN-specific regions: Sequence locations=1-210,232-248,270-275,298-339
cgtgtgaataaagccgaggctcattcaaaccaattaggtaattagctgacaattagccatcaacaaattggggccaaaaacgaggatgccatccaaacgcatcactgtgccgctgtttctgctgttgactgtgctcgtcttggcactccgtgcctcggagacaaagattaaggcgatggaggagaaagtgatggaggaacaggacaagaaaatgagtaaggttttcacttttctatctttccaacaacttttaacttggctttttcctaaatgccttttgctaatattttatcaatgcaagcatagttctttcataaaatgaataaatcccttttttta

SEQ ID NO: 97358 - DNA, 127 bp, Heterodera glycines
  misc_feature (76)..(77): n is a, c, g, or t
  misc_feature (90)..(90): n is a, c, g, or t
  SCN-specific regions: Sequence locations=1-2,38-127
ctaaggatggcagcaggcgcgcaaattacccactctcaacgcgaaggaggactttaagcagaaagtggggaaaaannagcgcgcaacatnttcctcctcctccacccgccaatgcgtctctgatcga

SEQ ID NO: 97359 - DNA, 466 bp, Heterodera glycines
  SCN-specific regions: Sequence locations=1-418,441-466
caatggagaaggagtataaacagagtgttcgtaagctgtatgctggaaaacaccgtggctatctgctaatgcctgtcgaactccctaatccaaatgatccaaatggggatcgttttagtggccaggggcatgttttgatggaggatttggtgtggcaactgagaggcaaaacacgcaacgcaacccatgggattattatgttctacgtaatcagaaatttataacctttactttatgaaattgtatccaaggtgcaatacgcgaattggacgctgtataacgtcaaatataacttttagtggattcatagtgcgatccggtcgatgaacaacactccaattgctgatggctgagtaaaagtgtattttctcaaattaacatcgaatgttattaaatccccaaattatgttttttgcgcttttattattgatcattttcaatatgcaaataaagtgtgagacgctga

SEQ ID NO: 97360 - DNA, 366 bp, Heterodera glycines
  SCN-specific regions: Sequence locations=1-99,121-279,301-366
acaacaaattccttcccgaaaattcaaataatccattcaaaaaatggctttatcagcaattaaattgctttcactgtttctgctcgtcctttgtattggcatggccattgagcagacccaagcttattatggctggggtggttacggctacggctatccctacggattttatggcaaacggcaagccggctttggcccatccgcaaatgttggcacttttggtcgcaacgaaggcgaaaatgccaacggaggaggaggaggaccattttcactaaacaatttttgagagaaaaaggaaatacaaaagcaaaattgactatctcttttttgtgaacgaatttttcgtcaatacaataaaatttgacc

SEQ ID NO: 97361 - DNA, 394 bp, Heterodera glycines
  SCN-specific regions: Sequence locations=1-66,108-248,270-310,332-394
tcattccttccattttcctgtgtcctaaaccttcatcaattaaaaacaatgcctttcctccgctcgcttcttctcccttccgttttgcttcttcttcttctgcttctgtccgtgtctctttgctccgcgggggtcttcgctccgctgcgtatgaagcgccaattcgattggtttggcaattcgatgggtgcgcgtggcgccggcttcggaggcggatgggtgttcggcagaagatgaaccgttaaaggcgccaaccaattaataaaataataatgcacaataataatatttatttcatttgcccccaattccccattttcaaatgaataaattatatattcacttttgtccattggttggccatttaacaaaattcaaaaaaagaaaagaaatc

SEQ ID NO: 97362 - DNA, 555 bp, Heterodera glycines
  misc_feature (487)..(487): n is a, c, g, or t
  SCN-specific regions: Sequence locations=1-226,248-555
agagtaattaaagttctgcttcttcacacccagagaactgatggcaaattcattcatgcaaattatcattgttccttcataatatttgagcaaatctaatacatattatcttaaaatttatgcatttttaaattcgaaaatgggacagaaggaatcccgtcatgcgtttgtcaattgtgccttgataaggcgagaagaatttgaagacaaaattcaggaactcaacaaaaaatgtgctgagtgttttgaagaaagtactttaaatatgctctttgctacaaaatccacagaagaacgagggattttatggcagcgttctgtccgaattcactgctttacggttttcgatgaaaaaatttaccgaaaggtctacagtctttttcagtttttgaaattctacgaatcattcatccaaattttggaagcatcggaggcatctaaacaccgtgaaaactccctaaacaataaggatttaatgagcatgtcnatatttaaggaaagttgttgtgaatattctgaagacggaaggtgcataatttgttttgactctttccc

SEQ ID NO: 97363 - DNA, 150 bp, Heterodera glycines
  SCN-specific regions: Sequence locations=1-57
atatatttggttattattatatttttcattttttgtagcataaatctttctgaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 97364 - DNA, 239 bp, Heterodera glycines
  SCN-specific regions: Sequence locations=1-46,68-239
ttgtactgagttcggccaaaaaacgtgtaattcccccccccctcctctcacatttatttcattttccaccgcactttttattttattttatttgtcccccccttcactgaatgccattccttccttttcctttttttcccttttttcgcacttccgccgatttgtttcattcactgctcattcattcattgtcagctgaattgaatttgggcaacagaatgtgaataaacgaaccgatt

SEQ ID NO: 97365 - DNA, 399 bp, Heterodera glycines
  SCN-specific regions: Sequence locations=1-13,163-311,354-368,390-399
ctcacccgtttcccttctcccttttcctccgtttccttttcattccttttcctcctctttttctttctcttccgtttcccttcttccttttcctccggttccatttcattccatttcttcctctttttctttctcttccgtttcccttcttcttctgcttctgtccgtgtctctttgctccgcgggggtcttcgctccgctgcgtatgaagcgccaattcgattggtttggcaattcgatgggtgcgcgtggcgccggcttcggaggcggatgggtgttcggcagaagacgaaccgttaaaggcgccaaccaattaataaaataataatgcacaataataataatatttatttcatttgcccccgattccccattttcaaatgaataaattatatattc

SEQ ID NO: 97366 - DNA, 409 bp, Heterodera glycines
  SCN-specific regions: Sequence locations=1-242,264-309,346-409
caaaatatgctcaaaaaggcaatcaaaagcggattgccggtgtttgtcactgagagcggcgccggctcaggcggaagcaatgcgcccgttaatttgccagtaatgaaccaatggtggtcccttttggagcagctcaaaatatcccaaatcgtttgggcagtgcgcggagagggaaatttacaaaatccgctgaataaaaacacggcacccgcaaacattggacagaattgggcactaacggaatacggaaaagtggtgaagaatgtgttcacgaagaacgcaaagccgaaaagaggtagaaaagggagcggaatgagggagaaaaaggagcgaaaagcgaatgaggctgaagagaaaagaaatgagcgataaatagtaacagaaggatagagagaagagcaaattgtgc

SEQ ID NO: 97367 - DNA, 372 bp, Heterodera glycines
  SCN-specific regions: Sequence locations=1-29,51-328,357-372
ggacaattcaatggccgtattttcaacaataaattgaacaatttgggattccccactttcatcacttttgcgcaattaatggacccaagcagaggattttatgacaaagacggggacaaagtgacattggccgttgatgtcgctgtgaagagcaaaagagggacgaagcgcaaattatcggatgagtaaaagtcatcatatttggtaattattcactgaattatcaaaattgtgttcattttaacattctttcactcccgaaattcatttcctcaacactttttactctcaggttccctgtctcttctgaagatatcagattattatccaccatttttgttttgctttttgattattaaatgactacatttc

SEQ ID NO: 97368 - DNA, 159 bp, Heterodera glycines
  SCN-specific regions: Sequence locations=1-159
accgcagacgattacatccgatttggctgatcggactgactgatcggtgataagaatcattgccaagtcgagaatcattatcattgtccatctgctgatcatttatttgtctgatcatttgtggggcggggaattcatataaaaaagtttaaaaaaacc

SEQ ID NO: 97369 - DNA, 154 bp, Heterodera glycines
  misc_feature (154)..(154): n is a, c, g, or t
  SCN-specific regions: Sequence locations=1-154
aaagcgaacgaaaaagtaccacataagaaagttctgtgcgcgttgcagtggtggcagaatggggcgggcatttgcctggggggttgttgtgatcgctaactaacaaatttgtcattgtattcccagcggaattgacggtaaatttcttgattan

SEQ ID NO: 97370 - DNA, 166 bp, Heterodera glycines
  SCN-specific regions: Sequence locations=1-83,105-137
tttccggcggcgacaattcccggcccaattctcagccgaccaatttgctgttgtgaatgtgcgaagaaactgaataaatagcgaatctctttctgtcatttcttcgatgcgttttcctttgtccaaattttgtttcctttttaaaaaattaaatatttatttattt

SEQ ID NO: 97371 - DNA, 192 bp, Heterodera glycines
  SCN-specific regions: Sequence locations=1-192
ttccaatcactgggattcaagctcagcaaatttattcagcatttttcttatggcataagttgttaacatttcctcatcttccttgtttatttcaattttcttacgacacaacatttctcaacattcatttttacaactttttcaaactaattctcattcattcaactgtatatcataaacgaaatttcatta

SEQ ID NO: 97372 - DNA, 394 bp, Heterodera glycines
  SCN-specific regions: Sequence locations=1-2,26-394
aatttcttcatttcctttcttttcaattccaaaatcaatcctcctgtttcccagcgtcgctggtatgagcaaaaaaaaaaagatcgttccgtacttctcgagggttggaattccgtgctgaacgaatgttttctgccgttattcaatcagaaaatgaatatggccgagtcggccgacagcaaacagttcagacagttgcgcggccttttgttcggtcgattttcggagagtggccgttgcgatgtcattgttgctcaagcaaaggcattcattcgattttattcgtaaaaaataagtcatcagaagagcgagaaccacttactctgacgacaataggtaaatgtgcgacatgaggcggagattatgcgtcaaattgagcgattggaggaggaaa

SEQ ID NO: 97373 - DNA, 263 bp, Heterodera glycines
  misc_feature (262)..(263): n is a, c, g, or t
  SCN-specific regions: Sequence locations=1-58,80-139,179-263
aggctttggagaacgacgggaaatatggaaacgaaaggaattggccacggaaggactgagtgaagaagaaatagagaaggcaattgagcaatgggagaacggcggaagaaaaatagtgaaagctcacaatcaacacgaggcagaagaaagccaaaaggggagaacaaaagagtgaaaaccaacacaagagaatgaccttgaagaatgccgcatttattctttaatgtcctcataatcagcaataaaactagttggaaaatann

SEQ ID NO: 97374 - DNA, 222 bp, Heterodera glycines
  SCN-specific regions: Sequence locations=1-222
aatgacatcaatttatgctattggaatccgaatgtacagtatccggatagacggattggccaatgcgagccatctcaatataccaagttagaatattcgaacgtgaagatagagaagaaccggaactgaaactgagaaacgacgaagctgcaaaaccatttgctttagacaccggcacaaaaagctgttaaggttgcataaaaattcaaatattaaaaaaaa

SEQ ID NO: 97375 - DNA, 517 bp, Heterodera glycines
  SCN-specific regions: Sequence locations=1-447,469-517
cgcagcgggactcaacgcggttcagctgtacatcccatggaacttccacgagcaggaaatcggaagattcaattttggaggcgaccggaacatttctcgattcatacgcatagctaaacaaaatgagctgtacgttctgatcagaatggggccctatgtttgtgctgagctcgaattcgggggacttccatggtggctgatcaaagaccaggccaaagtcaggctcagatcatcggagacaacttaccttcgccatgtccaccgttggctcgccgcccttttgtccgttcttcggccgttactgtacaaaaacggaggtcccattctgatggttcagttggaaaaggaatacggaagtgtgtccgtttgcgaccacgattacatgcgatggcttcgcgacttcgtcagagaaacactcggcgaagacgtcgtattgtacacaaccgatggacccactgagaaaatgctcagctgcggagccatcgaaagcactttcgccactgtcgactttggcact

SEQ ID NO: 97376 - DNA, 635 bp, Heterodera glycines
  SCN-specific regions: Sequence locations=1-321,343-582,607-635
cacaaatgttgaaaaacccgtgggctcaatcgccgactacgaccctttggctgccgaaaagcagcaacagaaggccccagccgctggcgctgcggcgcctaaagcgaatgggggcggtttcactgtgaaggcattgtacgattacacggccgcggacaaagacgaagtcagcttcaaggagggcgacgtcattgtgaactgccaaaaagtggacgacggatggatgacagggacagtgcagaggaccttactctggggaatgctaccggcaaattacgtggaacaagtcaaacagcccgtgggacagtttaaattgaaatgaaggatttttagtcctttttgttagcgtccgtccgattgtttcatttcttttctctttaccgattttcttttgtggcctttgatttttcagtttttctttaaacaaatgtgccagaatgttcttcagcaatatttatttctgtttagcactcttagcaatcattttcattgtaagcatttattttctcaaattcacagttatgtatggttttaatttttgtcacatggctgctaatttcctttttatcgtaaccaagtatttgcttcgttcaataaaaattttctgtttctgaaaaaacaaaaaaaacaaaaaa

SEQ ID NO: 97377 - DNA, 211 bp, Heterodera glycines
  SCN-specific regions: Sequence locations=1-86,109-148,170-189
aaaaagagatcacccgcgagggcaaagtggccaagattttgaccgaagaagaaattcagcgcgaaatggcggacacctactgaagaaacgaaagaatgaatgaatggacgaaagtgatcggaatgttggatcggagatacagaaatcaaaacaaaatatgtaaacatttggcgccattttgagcaataaattggttttatttttaaaaaat

SEQ ID NO: 97378 - DNA, 450 bp, Heterodera glycines
  SCN-specific regions: Sequence locations=1-450
atgcgttgtgctttgtacgctttgttcgatgggcatgccgggcgacgtgcggctgattattgtgccgagcatttcgctcgattgttcgttgctgttttcaagaaatatgtgcccccaaagagtgctatgtcagtattcgagaaatccattcgtaaagtatttgtcgatacttataagggtatcgatgatggtttccttgttgaagcaagacgacagaaaccaacgctgaaagatggtacaacggcgacaaccatttttttattggataaaacgctttactgtgctaatattggcgactcgaaggctattgtttgtcgacacaaatctgaaaagagcacaaatattccgctgcaaatcactgtggaccacaaccctcttgttttgacgaacgaatgcgtattcaaaagtccggcggaacagtcaaggatggccgagtttttggcattttag

SEQ ID NO: 97379 - DNA, 481 bp, Heterodera glycines
  SCN-specific regions: Sequence locations=1-30,52-148,175-285,316 -366,391-481
tctcaattcagtaacatcggctaataattttgaaatgtccgcttgcatctgtccgctgtgtgatacgtcgcttgcggcgggcttggccaagttggcaaagtgccaacacattggccatggcccgtgtctttctgcccatgtcagcaagcatggcttttgcccatttttcaattgcgcaatgccgacgacggaggacgaagtgttgctcattacgcacaccgagggaaaacaatccaacaattttgctggcctggtttggcattcttttgagaaacggggaaatccattaatttattaattaaattgatttaattaccaaatttaattggccatttctaatttataccccctccccaccctaaggctatttaaaacattttttaaaagtaattgtcggcacagaaaaacgcaaatggcaaaagccgaattttccaacgaatttataaatttgtgcacagaaagatgccaaaaatgtacgcga

SEQ ID NO: 97380 - DNA, 434 bp, Heterodera glycines
  SCN-specific regions: Sequence locations=1-434
tgggccgtcgtacgaaatgcttttccgtttaacaacgacaaatagaagcaaatctgctccttttctggccaaaataccgacaaaaactttgaaaagggaagtcgcaaacgaagcaaaaacggttcggtcttttggggaacaaattgaaatatcaaaggaaattaacacattgaaagaataattcaacaaatgatgacgagaggaaggaggaggagcaattcgcatctctgaaaaacgttggcatacaatcgcatcgacaagcgcaccttttgcttcaacaaaagtgcaacaaaacggggtggacaacaatcattctctgtctgaaaacagccttcgtcttcttctcccgtggattcccaaaaacttttcaacgccaaatggcttttgaaactcggaacaatgcggaaatttccggggcaatttccctttccccc

SEQ ID NO: 97381 - DNA, 150 bp, Heterodera glycines
  misc_feature (76)..(77): n is a, c, g, or t
  SCN-specific regions: Sequence locations=1-77
ccatcccaaaaacttcaaattttccgcacaaattacggtattttttattggtaaaaaaaaaatattttacaactcnnaaaaaaaaaaaaaaaaaaaaaaaaaaaaaaaaaaaaaaaaaaaaaaaaaaaaaaaaaaaaaaaaaaaaaaaaa

SEQ ID NO: 97382 - DNA, 522 bp, Heterodera glycines
  SCN-specific regions: Sequence locations=1-29,51-465,488-522
tctctctcactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacaaagggacaaactccgcctggcagtccgaaaggtgggcacggcagcaacaaatcgccaacgacgccgcacagtgccggttcgccacacggcacgcagcatggtaaccaacagaaccatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtacaaaacgggaaacagaacttataattgagaaaggaaaaccgtcgccagacagtc

SEQ ID NO: 97383 - DNA, 182 bp, Heterodera glycines
  SCN-specific regions: Sequence locations=1-4,27-43,178-182
gctacctatttaatgctggaatttttgttgataaaatgcgatgaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaggcccccggggttttacccccggttt

SEQ ID NO: 97384 - DNA, 203 bp, Heterodera glycines
  SCN-specific regions: Sequence locations=1-101,123-203
agacaatcgaagggacgaacggacagttcaaagccgacaacgcgcagcttacgaccgattaatgtgtatgttcgccactcagcaaaggcccgattcgtgcggattttttgaaaaagaatggaaaaatgaatggaattgtgaaaagtcgtcaccaaaatgtttaatgccagcccaaattaatgtgaataaagcatttaattttg

SEQ ID NO: 97385 - DNA, 519 bp, Heterodera glycines
  SCN-specific regions: Sequence locations=1-198,220-250,279-488
tagactagtggatccccgggctgcaggaattcggcacgagggaatcttttcagcttttcaacaacaaccccaacacacgtattctaccatggctgactccactggcaacgctgcattcatcaaggccgccgatgaggccaagactctgtcgtaccagccgtccaacgacgagctcctcgagctgtacgcgctcttcaagcagggcaccgtgggcgacaacgacacccctcgtcccggcatgtttgacatcaagggcaaggcaaagtgggatgcctggaccgccaagaagggcaccaccaaggaggatgcccagcaaaagtacattgaccttgtcgaggccctcaagaagaagtaagtctgtgtatcataaaagtatgcttgtgatggctgcacctggctgcacactggctgtactcgtcgcgagtgaccgagtgagtgcgtgagttcttgttgtttgtatgtgatggatgcatttctttattttgttgaaaaaaaaaaaaaaaaaaaaaaaaaaaaaac

SEQ ID NO: 97386 - DNA, 307 bp, Heterodera glycines
  SCN-specific regions: Sequence locations=1-66,88-118,147-215,238-307
agaggccaagactctgtcgtaccagccgtccaacgacgagctcctcgagctgtacgcgctcttcaagcagggcaccgtgggcgacaacgacacccctcgtcccggcatgtttgacatcaagggcaaggcaaagtgggatgcctggaccgccaagaagggcaccaccaaggaggatgcccagcaaaagtacattgaccttgttgaggcccttttgtttaagtaagtctgttgtatgataaaaatatgcttgtgatggctgcacctggctgcacactggctgtactcgtcgcgagtgactgagtgagtg

SEQ ID NO: 97387 - DNA, 114 bp, Heterodera glycines
  SCN-specific regions: Sequence locations=1-65,87-114
atttccaggactcactgccagttggatgaaatgaaattcaattgtatgctttcattatgctttcaaaagttaactttcaaattaatgtccattgttctttaatttagtatgttt

SEQ ID NO: 97388 - DNA, 366 bp, Heterodera glycines
  SCN-specific regions: Sequence locations=1-138,161-190,213-307,329-344
gaggcattacacataaactgatcaatgggactcatttggccaaatcctttataatgagaaaccgactgatcagctggtgaatgctgtgccgggtgatcgttttcccactgtcttttgcgtctttcgctttcataaaatgccaattccctctccccttcccatttctcacatttctgtgctttctttgctgttctttctcatttcacttttttcgctcattcgtttccaatcattccttttttgactcaatgattgatcaaatgtcctttaaatcaatcgaaacattccttctaattttaaatttaaattgttccaattacaaatgaattaatatccatctgaattttaaataaatacttaatattt

SEQ ID NO: 97389 - DNA, 197 bp, Heterodera glycines
  SCN-specific regions: Sequence locations=1-197
gcatgagattgttttcactgcccaaatgccccatatgcgtgacggcgtccaattggaatattcgcccctttatcaatttctcattggctttttggacttggaatttgagttcagacccgaaacaacgtctttttcggaagacattctgatggaattcgacgttcgaatggcattttggcgccgggggggcccacccg

SEQ ID NO: 97390 - DNA, 848 bp, Heterodera glycines
  SCN-specific regions: Sequence locations=1-527,549-848
gtccatttaagttgacaaacagtttcatcactttgtaaaactctgctccgatgagtccattcaatcgcagaatcagcgccaactcagcttacaacaaaagtcgtcatcaattcacaaatcaaatacgaatgcatcagtgatttactctaataagaaaggtccaattccgtcagtgctgaaccgtctgtgtcgagtggtggtactgctggagggtttccgcttaatggggatccgtccgactttggcgcggcaatgcccgcaacaaattccccacagtcatcaaatctggcggaaaaagcaacggactctctgctcaacgggctgcagaacactccggctgtgacttacgaggatttaactgtcgcgactgacggattcagtcccaacaaaatcgtcggcaggggcggctacggcgtggtctatcgcggagtgtggaaacacacgccggtggccatcaaacgaattcaggggaagtgcggaagtgacgaaaggcagcaaagggagcgaattcgtcagagtttacaagaattgaagactttggcaaagtttcgacatgacaacgttctctcactgtacggttattcgctggacgggcccgagccttgccttgtgtaccaattcatgtccaatggtacgcttgaggaccgtttgctatgccgggtaacttacaacggaaaccatttaatgggacggagccactcggttgggccaaaaagctgtccatttgcgggggcgtttgtcgcggcctgcactttctgcacaccatcaaccaaatgccaatcattcacggcgacgttaaatccgctaacattctgctggacaagcattttgagccaaaacttggcgat

SEQ ID NO: 97391 - DNA, 860 bp, Heterodera glycines
  SCN-specific regions: Sequence locations=1-365,387-814,836-860
gtccaattaagaggaagcgataaaagtaattttgtcgatggattcactattattagcgacgaatgaccattctaatggagaaacagcagcaacattagaggagatctacagaaaagcacttgaatattggaactcagttgggtctgacttgaacggaatgcttgggggctttcaacaattgcaccgccccgacattaatgactccatcaattttttgtgcgaattgaggaaaaagtcctttcttcgccacttcgaccgcgcgttggactgcggctgtggcattggccgagtgacaaagcatttgcttttgcccgccttccgttccgtcgacatggtcgacttctccgaccatttgatcgctcaatctcacatttttgtgccttcttcgtccaatcccacggaaaacaattcggttggacagcgttttgtcgaatctttgcacacttttgcgccggccgaaaagggcggagattacgacatgatttggatccaatgggtgaccggacaattggaggacaaccatttggtggactttctcagaagatgcaaggagagtgtcctccgtcgggacggttgcattgtggtgaaagacaacgtggccaaagggactgaaaaagaatttgacgaagtcgacaattcatgggccaggccccgggaaatgctgcacaaattgttcgaacgagccgactgtcgaattgtgctggagagaaaacagccgaacattccgaaagctctttacgaggttcgaacctttgctctcaaaccgttgtcaaatgatgaaacaaatgggatgaatgatgattgaaaacacacatattttattcattatttacttcatgatttttcctttctctgtggtt

SEQ ID NO: 97392 - DNA, 722 bp, Heterodera glycines
  SCN-specific regions: Sequence locations=1-722
gatttccttaaaatatatttgatgaagccgcaagaattttctggagctgtacaatgagcagccatctccgagtcgccactcaataattgtcctgtaaaagtgctgccgagttttactagcacatttctgcctgatttatcaaatgcgcaagtgttgaagccaaagcccaccaatgttgatcgtcttcctttatcaaatgaagaatttataactccaactcagccaaaaaagcagcaaagtcgtccaaattccccagcaaatggcgtatccaaattgatacttccgagaagccgagtcgcttcaatacgtcgtgagtcggattgcaattcagagaaaggatttggtgaggcggaagcggcacacgaaaaaatggtaaaatcggcacagcaagtcgcgatgggttttgaggatttttgtctcgacgacaaggctttcgaggagcgcaaaagggccaagtcgttgtctgagcctatttgcattttcaccaatgcgttccttccccaatgttcgtcaccgtcgccgagtaggggttcaatggatggacagaaacaatgctattctccgtctgcccagcaagtcgtccgcagcaatttggcgtattctccgagtccgagtccaactccgtctggcactcagtcaatgcaccgaatgaggtcttgcgagagtcaaacgcaccttcccgatgattaatttattgaattcgctgaaataagagactatta

SEQ ID NO: 97393 - DNA, 456 bp, Heterodera glycines
  SCN-specific regions: Sequence locations=1-456
gagactttctctgtgccatcgcttctgccagctacaccgttcacttctattttcacgtttccagaacatcaattgttgagccatttgaattgttgctgaacgaacggacgaccaacgaaaagttgacactgatgaaggaaggaggagccaattttggccgaaattgttggtggacgatgaagcggtgcccaattgttggggagggggcagcggctcaattggaagacgacgacggaggaattaattgggacgacaaattgaacaatgtccaaattaatatgtgggctcccaaaaattgcattggcccattgtcttcgccaccagcagcggaagaagaagaagcgagcgggtcaatgcgaagaaaaaaggcgtctgatgagtgcgcggaagtgaattaattatatttgagaaatgctcgatcatctcaccaattgcaaatgaaatttgattgctctc

SEQ ID NO: 97394 - DNA, 482 bp, Heterodera glycines
  misc_feature (14)..(14): n is a, c, g, or t
  SCN-specific regions: Sequence locations=1-482
ctgcctttacaacnggaagaacccatcagcggcggacagccgaacacgccgccaatccccgccatcgaattgtcttaccccgtctccgtcatttactgtggcgaatgttcgatgcccgtcgaatactgcgagtacagtggcaaatttgagaggtgtcagcagtggttggaacgcaatttgcccgatttggcggagaaacaaatgaaaattggggcaggagatggaaaagcggcggaggaagggaatggggaagagacggaggcaaaaaagcaccaaaagcgaggcggaaagggattgccgaaggcgagtgggggcgggaagggctcgaaagagcagtccgctgcggtgccgcggattacgctgaagacggaagtgcggagcaaaaacaaagcggtgaccgtcgttaaaggcctcaccacttgcggtgtcgacttgaaaaccgcctccaaattcttcgcaaatcgtttcgcctgcggctgttc

SEQ ID NO: 97395 - DNA, 402 bp, Heterodera glycines
  SCN-specific regions: Sequence locations=1-402
aatcatattgtgcttttcgagcttcgatggaatgcgttgaagtcctaattttattattcggaaaagctcgggagatggcagaatgccaagaaattcgccagattttgccgaaaagtttgaccagcacggaactttacaaccacatttttgagaagattttccccgctttaatgccaattcgaaattcgtgtattttgacagtgaatcatcgctattgttttgaaggaagagacgccctcggagggacagaaaatcgcatcgaattggaagaaaactccgaaattgcgataattcccccaatatcaggcggatgaaaaagcatcagctgggtaacaactgctgattggacaggccgacttttgcggattaagtaaattgaaataaatttttagaccagaaaag

SEQ ID NO: 97396 - DNA, 549 bp, Heterodera glycines
  SCN-specific regions: Sequence locations=1-549
aaagctggagctccccgcggtggcggccgctctccaactagtggatcccccgggctgcaggaattcggcacgaggatttaagcatgttttcgttttgttatcgccgcgctattcgcaaaagcctcgcaaatcctcagacaattgaagtgtcgtcttttcatttttctcgtgttcttgaacagaatttggacgccgcaagcaaaagggacgaaaagggggaggaagtgccattatggaaagacccgtacaaacatgcaatgccggaacaaaagaatactttttcggaatttcgagaggccaatgtgcattgggaatacgttcgacgactgctgccgcgccgtttgattccagaaataccgcaaaatgccgctgagggcgtaacaccgagcggatggagggcaccaccggaaaaagcaccgaaccttccctattacatcagaagaaaggccaaccatttgcctagcatttttttggaacggcgacgcgacgaactgaacccaaagacaatggacttcgaatatgtggaattggtcattctgacgggcatcg

SEQ ID NO: 97397 - DNA, 439 bp, Heterodera glycines
  SCN-specific regions: Sequence locations=1-11,35-439
gtccttaatagaaaaaataaaaatatttattattggaagggaactctagaacgtgggttgctgaatttgccctttcacttacattcttcgaacagttcgaccttccgaccttaatgcgcaattggtactgaatgcccgccacgacttgtgacttggcactgagaacctccaaggggaaaagactgaagcgatcgtttgactcggagtttattttggccactgagcgagaagcgagagactgaacaaagcgagagaattgagcagaagcgaacggacatttgaatttgtaattggcatttatgaacagttagccaaatttccttttcattgccttgattttttcgtcgttcacattttgctctgtccatcccccgacaattgaattctgctgatcagtcattgccaatttgataagcaaaagtaaaagaatgaaaatttg

SEQ ID NO: 97398 - DNA, 418 bp, Heterodera glycines
  SCN-specific regions: Sequence locations=1-15,93-331,360-418
ccgccctgcccccccggcgagccgggcaaatgctatggcagcgggtccaaagagtccaaagaaaaggagtacaaacccagcaagcgcagcattgacaacttcgagcatggcttacgcgtcgccaggggctacaagcaagaagtcggaccccctggccccgcgggaccgcccggccctcccggaccggacggaccgcccggagaatgcgaatgcaaatactgaggatgatgctgaagatggtccacgatgtgagctcaaccgttttgttcctttgcctgattatccatcgatgtgtgaaactgtagcattagtagtactgtattgtcgatggaataaaaattttattaaagaatatttttcaatgttttttttgcgaaattaatgttaagtctcgaagcgtaaataaagcaaaagctcc

SEQ ID NO: 97399 - DNA, 666 bp, Heterodera glycines
  SCN-specific regions: Sequence locations=1-613,635-666
caccttagagcattaattcccacttatgttctgctattttctcatttttatcttttgctcgttttggcaaagggattcgaaggctacactttcagttgtttggacgggtgcgaatgtgacactgatgacgaggccatccattgtcacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaaggccgttgacgtcgaagggaatgaacatttcgactgttccacgctcgaccattatcggatattgatggtgatgagcgattgcggaaagactcccgaacaattggaggccgaccgggccaaactgccgacggacacacagccaaatgaggattgcgacttcgaatgcgtggcgaaccgacgcagtcgcgagttgcgcgagtacgtcaaacacttgtgggagatggtcaaagagaaggtgagccgactggccaagaagcacggattggacaaagtggtggacgacgtgggcaatttcttcaacgacgtgggcgaacgcatctccaacatcaaactgaagaagaagaaatgagacggacggacggaaggaacaaaagagaaaaacacc

SEQ ID NO: 97400 - DNA, 254 bp, Heterodera glycines
  misc_feature (254)..(254): n is a, c, g, or t
  SCN-specific regions: Sequence locations=1-211,234-254
actccttgaaatcattatcagtgccaaatattaaggcaagaaaaacctaagatgagatggaggattcataaaactgtcgaatgtttgtaaacatcggactgatgatgcctaaatgaaattgtttggtggtcgccaatcggtccttggaatgttggaatgccgcatagaaaagcagggagaaatgggaacgaaacgaatgttgaaaagcacaggctcttttgtttgttcattttaacaaattttccacttcaccn

SEQ ID NO: 97401 - DNA, 839 bp, Heterodera glycines
  SCN-specific regions: Sequence locations=1-839
gatctttccctttctcggcagggcatccgtctgaagcttttcccttctacggccatcgtctggcgaatttgaccattgcgaccgggggatttctgtacgtcggcgatcagcgaacgtttagcaaattcccttctcgcctacgaaatggatgccgattcctttttgctattttacattaagcaaagaattgagaggggagaggacggtcttcagtggtacaatcccccctattgtggggaggacgaagaagggcacgtgccggacaattggcggacaattcaacaggccgtcctctattttgagaaggacaacagcgatgaaattgagcatcaactgattgaccaattggtccaacattcggccgtcaaattcagcgcctttaaatatctcgtggatgcttacttcggactgttgcagcggcgtattgagcgaaaagcggacaattttggttgcccttcggtaacaaatttgtgcgtgcctttcctggcgatgatcgcttttaccggactcttcgcgagacgattggccgaaatggacgcatccgcgcgagtgacggaagaagagcaacaagatcggagggatttccgacgcgaaatttaccaagtgtccatctacgggtcgaccatgttgcgctacaaactgtacacatttgcgaacaacgaagacagtacagcggcgtactcatgggatcgcttttgcgccgactctctccaattggttgagcacatttcatccctcaaagaacgggaaacttcgattgcccttccctcggcttctcccctcctcggcgtcgttttgtgcggaattgcagcagcggcggttgtctattttctcatcgc

SEQ ID NO: 97402 - DNA, 313 bp, Heterodera glycines
  SCN-specific regions: Sequence locations=1-279
tcgtcaagaggctttcttctgaccattgctcttctctccgttgcctaacaggtttccccaagtgcactcgcaaagaaaagagcccgccgttcgatgcccgttaacgctgccatgccggaatggaaaattttgtccgctgaagtggaaaacgatggcacagcataagaaggaggaggcaagctttggatcatcggcatgatcgaagaaggaatttgccaaaatgatgaagaataaaccaatgaatgttgtggatttgtagaaattcattcaaatgccgggaataaaaatagttaaattaaaaaaaaaaaaaaaa

SEQ ID NO: 97403 - DNA, 157 bp, Heterodera glycines
  SCN-specific regions: Sequence locations=1-7,29-118,147-157
ggttcgtacaattcctgagattttcaatattgtctacgctttccacctatagagcatccgtttgtcgcgctcctctaatttctcaataacagccttgtgtttcagggtttcttaaataatctggatttttgtttttaataaatattgttgaccttcg

SEQ ID NO: 97404 - DNA, 435 bp, Heterodera glycines
  SCN-specific regions: Sequence locations=1-161,194-348,370-435
gtccattaagatagcgacgatttgcgcctttatttttccattcccctagaagatggccaactgttcccattcgtttcattgtgtgactctgatgacaaaattgagacaaactttgggcccaatttcatggccatcattccgaagacgttcaaaattgtgccaacaaatcatgaaattgttttccgcactccgtcgatgaacaaaagtccgtcttcaaatcctgaaaatgttttacgcactccgacgaccagcagcattatttcgccgataattcttgcttcatttgtcatgcttatgtgttggctttttctaatttttattttttttagaattgtaatgtaattttgcacacttttcttctaccattctcgattctccattttatgtaatattacggcatttttttttgttaaataataaagtgatcgatcgacc

SEQ ID NO: 97405 - DNA, 825 bp, Heterodera glycines
  SCN-specific regions: Sequence locations=1-666,688-825
atgccatccgcgcacggcgggcccacctttttgctgtggcatcgtgaatacctcaaacgcatggaaatcgctctccgtgccatcgacccatcggtggccatcccattttgggactcggcaatggaccagcgactgcccaatccggccgactccgtcatttggagcagttcgttcatgggcgcactttcggccgccggtacggtggcggacggccccgtcgccggttggattacgcccagcggtggtccgattcgacgcagtctcggcacccgtgggggaaatctgttgaccgaacaggaagtggccagtctgatcggacagccccaaattgagaacgttttggcatttacgtcgagggcacggagcggcgcctgtacgcaaccgacgccaaacccgctcagtgtgctcgagttcatccacaacggagtgcacgcctgggttggaggggacatgttgccgttgaccacctcgccacaggaccccgttttcttccttcaccattccttcattgattacatttgggaacagtggcgactgctccaccaaaatcggcagcagcgcgagacgcaatttccgcccgactcgcaaattgtgccgtgcgctggctcccagaattacctgctcagtgcgacaatgttcccttttcaagaccccgtcgtgctcaaccgagctgggttgagcaactcctacacggacagtctgtacacttacgcgccgaggcccacctgccgtgccgcaggcgactgtcgttcgcgttacttgttctgtgacacgaccagcggccgtccattgtgcacttcccggattaaacccggcggcaattgt

SEQ ID NO: 97406 - DNA, 466 bp, Heterodera glycines
  SCN-specific regions: Sequence locations=1-466
cgccatttgttgctcaaatcccctttgcttgtcctttgttttgtggtcccttcgtccttttccgatccgtgtccctttttcggcgattaccaatgccccgagggctttcactgtgcatttgacaaatgccaagatgagcaggggatggagccaccgggcgattgtgccaaaatcagatgtggcaaggaatcggagtgtcggcaaggcaaatgcgttctttatgtggggcgaccgtgcggaaggaatgttttggtggcggagggattggcccgtgcggtggtatccgattgtgggccccaaggcaaatgcattggcgggcgatgtgccattgacagatgtgcggacacagtctgtgaggagatgagcgagctttgccgggatgggatgtgcatgcaattgtcctccatgttctgcttctcgcccttcgattgcggccctccgtcacttttcgagtgccatcaaaaca

SEQ ID NO: 97407 - DNA, 935 bp, Heterodera glycines
  SCN-specific regions: Sequence locations=1-935
attcgtttatatataaatgaacgagaaaccgtcacatcttttcattttcccatcgaaatacgaatcttctctgtttctctctcacatatccacaaaattgttccccaatgctgcaagctcatcagtaccaacttcagcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctacttgtacaacgatttccagtggagcgactatcagttcgtagtgatggaattggctgttggtggtgacttgctttcgttcctccaaaaatgtggccccgtcagcgaaacgacctgtcacaattggatgctccaaattgttgctgctttggattatctccaccgtaagggaatcgctcatcgcgatctgaagctgaaacacgtccttctttgtgaaaacggcgtcatcaaagtcactgactacggattctctaaacaaagttctgatttgtcttcaacattttgcgggtcgcgttcctattcgtcaccggagattttgcttggcatcgcttatgacatgttcaaatcggacatttggtcattaggcgtcaccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaacccgcttttcgtccgaacatttccgaatgt

SEQ ID NO: 97408 - DNA, 445 bp, Heterodera glycines
  SCN-specific regions: Sequence locations=1-102,125-386,444-445
gacccttaaagcaccggctgagcaattaagagaggcaacagacgcttatatggctcggtggccaaagctgtggaggccaaatatcaccagcgtgaggagcagaaggtcaagcagtaccaggaagaacgagaggaatgggagcgaaggatggcggagacgagacgcaaatttgagacggaacgccacaattttgagcaaaaaatgcgcatgaaaagggaacaacagacggaggaattggcacaaatggaacaacaaatggacgaacagagtcaaaaacattgccgagagcgagaacaacaacagcaacgataattaataaaataatggcaaatttgatacttacaaaacaaatacaactaattaaataatggctaattggttgatggaataatttttacaatattattcatctattttaataaaataaataaaactatttttttgc

SEQ ID NO: 97409 - DNA, 292 bp, Heterodera glycines
  SCN-specific regions: Sequence locations=1-205,227-235,260-292
gttcattaaaggaattcctttgttttcgttctttcttttcatttgcatagaaggacggattggaaaatgatcaccgatatgcaattgggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgatttgatgggttatgattaattaattaatttatgtattaattgagagggacggcgcataaatttgtaattg

SEQ ID NO: 97410 - DNA, 378 bp, Heterodera glycines
  SCN-specific regions: Sequence locations=1-352,374-378
tgcgtggaagaagaccgaattcgcgatcacttcacgtggtgtgcgtagagagtagccgtctggctcagcagacgggatgaaagttttcgacacgattgccaatcacttcgtgttgtctccatgtattattgcggtctcttccccgaataaccatgcgatgacaatgggtggaggaagcgattggctggcaatttgatgatcagtggaatcaaattgaaattcaaatcgatagtcagagtgaaatcggggatgggcttctcaacgaaactaccgacccaagtgatcagcaggaatgaatgagtgatttgctgagaaatgatcggttatggaactgggaattgacgtgaaatgttgaactttgttgaaaattgaattttc

SEQ ID NO: 97411 - DNA, 480 bp, Heterodera glycines
  SCN-specific regions: Sequence locations=1-480
gtggatccccgggctgcaggaattcggcacgagggcaattatggcggttcaaaatccgacacagcagcagcaaacaccgtaggccgtctctgttgcagaaattgccaatggcgttgaggaggttcatggccaaatctttgaagtcgctccccgatatgtgaatctgtcatatatcggcgaaggagcctatgggatggttgtatcagcactcgacacagtcaccagggagcgagtcgcaatcaagaaaatatctccatttgaacaccaaacattttgtcagaggacgctccgcgaaatcaaaattctgtcacgattcaaacatgaaaatattatcaacatacaagcaataattcgggcgccaagcattgagctgatgaaagacatttacatcgtccaatgtctgatggagacggatttgtacaaattgctgaaaacccagcgcctttccaacgaccacatctgttactttctctatcaaat

SEQ ID NO: 97412 - DNA, 470 bp, Heterodera glycines
  SCN-specific regions: Sequence locations=1-29,51-103,125-384,408-470
atcagtatacttttgttgcaatgctgccatccaatcttttcttcttgctgatgaccatgctcagcagttccctcctccatcagacattggcaaataaattttcagcagagaccgacgcagtaaatccgacgcgattaatccagagacggcatttgattcgaagccgcgcaattcacaaagaaaaaatgcactcgaacgattttgccgaagagttcccgatctctgatggaccccaagtttttgggatcggtggaaccgcggcttttgaaaacatcggcggatgggacgcggacaaaaagcgattcggaagaggaaaagtggcggaattggctgcgcaggcatttcccagctgcgagaacaatttctgatcagtgatcactgatcacttttcattttatcaaatgcaaatgatcgctcatctcacctttttgaattggatcggattttcaatcttcaataaactttattta

SEQ ID NO: 97413 - DNA, 351 bp, Heterodera glycines
  SCN-specific regions: Sequence locations=1-44,88-351
actagtggatcccccgggctgcaggaattcggcacgagggaccattaagccagaaaaccattgtttttcttaatatttctccatcatatttattcgtcatatggcgtacgcaaattacggctacggatcctatggctatggtggtgaagatttttccgctggtgcttataatccgcgctaccattatgcggctgcccaaaacgcaggctttgatctgaagaccgatgatggacttccgaggaccatatatgttggaaatcttgacgtgtccgtaaccgaggacttcatcgccactttatttggccaaatcggaccagtcaccaagaccaaagtgatcttcgattcgggctc

SEQ ID NO: 97414 - DNA, 411 bp, Heterodera glycines
  SCN-specific regions: Sequence locations=1-299,321-384,406-411
gacactacaagatggtgcagcgtttggtttaccgacgacgtctgtcgtacaacaccaaaagtaaccggaggagagttgtaagaactcctggtggtcgtcttgtataccagtacctgaagaaacctggcaagatccccagatgtggacagtgcaaggacacactccgtggcatccagcctgccaggcccatggagcgttcccgtatgcccaagcgattgaagactgttaggcgtgcttatggtggagttctctgccataagtgtgtgaaagagaggatcgttcgagctttcctaattgaagaacagaagatagttgtcaaggttctgaaggcacagaaggcagcagtcaaaactaaagcacccaagaagtaacctgttaattttcgtaatataaaaaatttaaaaacgaaag

SEQ ID NO: 97415 - DNA, 417 bp, Heterodera glycines
  SCN-specific regions: Sequence locations=1-254,292-417
ggagaatgacgcaatttggagagcaattgacgggcgaccttaaagaagaactgcacgacgcatcaacaaatattgcaggagacaaacgaatggattgaattggctgtgttggaggaaattgtgcaccaaagggtgaagacgaaaccgaaaggcagcgaagtgatcagaacattcatcgaaagtgacaacatccgcacttttgtcgagcagggaattggcctaattgggcagtgattgtaaatttgaaaatcccgaaaaaaaaaaaaaaaaaaaaaaaaaaaaaaaaaaaaactcgagggggggcccggtacccaattccccctatagtgagtcgtattacaattcactggccgtcgttttacaacgtcgtgactgggaaaaccctggcgttacccaacttaatcgccttgcagcaca

SEQ ID NO: 97416 - DNA, 634 bp, Heterodera glycines
  SCN-specific regions: Sequence locations=1-634
agtggatccccgggctgcaggaattcggcacgaggttccctaataagagaacagaacaggcgaatggcgagtcaaaatggcgttttggagaaccaactggaaatttgccaagggttggtcaacgaactccgagcggaagtcgattcattgcgcggcgaactgagcgaatgcaaattgcctttccgaatttccaacagcgaacttcaaaatatcaccgttcgtcactctcgcactggcgacgccgtggagcgaattgggccacggaaagcgaacaccaaaagtctgctgaagccacgtgcgcgtctctgttccaacactccgaaaatggctgtgccgtctgaaaagcgtgccaagcgtggattgaccaaagacagcgaagatgacgacaatttccgcaccgcggaatttgtgccgaccactccccgtccgcaatttctgttgcctccgcttgtgctcaccccgctcagcagccgtttcccccctcttccgcggcgttcattttctgtcgaaccaactccaactcatatacagaaaaacgctgaacagcaactgacaatgattcgggacggcaacggcgacatgccgtgtccgtccagtcaaaagcggctgaatgacaacggcgaaattcagtgtc

SEQ ID NO: 97417 - DNA, 518 bp, Heterodera glycines
  SCN-specific regions: Sequence locations=1-518
gtggatcccccgggctgcaggaattcggcacgagggccgtaaattaatccctaaatttgttaatgaaatttaaatttacttgtaccactaaaagcgttagatgttttttaattagccatttttgtcctgttttctattttcggcacttttagggacagtttgaatacgggggcggctgttgtacgacatgcacaagcgatgctgattgtacgggcgggaagacggcatttactcggtgctgcgcggctgtctcagcgactttttcgacttcccaccctccaacggagaggagggctgcacctgggggctgtcttcggagaatgcgctgatcgccaccagcgaaaagggcgaattggtgcaaaatgtgcgagtgggcgttaatctgtgcccggcaaaagaaggcactcaatgcaattcgttgttgagaccctccgtggaatacgcccagggcaaacagcaaacggacgcttcgacgagcgccgccggcaacgcttggccgtacagctgccgaaaatcga

SEQ ID NO: 97418 - DNA, 650 bp, Heterodera glycines
  SCN-specific regions: Sequence locations=1-650
gccgatcaaaccgacgtttttggggttgcttcgtcaagcattggaaagccaatcagagttgaacttgggacagggagcagaaaaacaattatttccggcaatttactaacgacagacccggagagcggctcaatagttttggtagagaagcgtcagcaaaataaaacatcggatcaggggaagtgcagccaacgattcattctgattcccggcagttctgttcactctgccaaattggatggacaattggaggaagggacgaagagtaatgccgaactgcgcgagaaggcggacggaattgagtcgggggacgaagcgacaatcgaaagccatggaaaaagaaccctgtccgaaactgtgagaatctttgacgaattcgcactttcgaggcgcctttgtctgattgatgcactaaacaaatatggcatcaaattcagcgaaaagccacatgttttagtacaaaatattgacaatggacagactgagggacaaatgccatcgacggtaatttctctgcagagcggcggcatcaaaatctatccgccgtacggaaagaatgatataatcggcggtggttcaattgtagtcaaagaattgttgcacaaactctccacagaaaatgtttttgatgagtgaatcagccgaaagac

SEQ ID NO: 97419 - DNA, 768 bp, Heterodera glycines
  SCN-specific regions: Sequence locations=1-64,86-155,177-768
tgcctaatttatccatctcaacaaataaaaccgaatttccttatcttgtgcgttatccggcaacaatggctttggttgaatttaaggtaaaattggagcttgtggtaggaatttattctgctgatatgaagcttgaattgcgttcgcacgaagggaaatttatttcagaattaattggcgacgaccgtaccttagaagaattgggagtccgagatcagtgcattgtgaatgtttgcgataccagtgaaacaagaaatgataattccacgaatgaccccaatgcattttatgtaattcccgaagagagatacgccaatagaaaagacacagctcgaaaatggaaacaacaacttatgacaactgcaacgacaacaaccgatgtcgaacgatccgagcagcaagtgccaaataaaattgggcctgggaagcgctgtattgtccaactccgtgatcaacctccacgaaaagcccaaattgcttttgtcggtcctactcattttggcgaaaatccggggactactcaatgggttggcgtaatttatgacgaagcaactgggaaaaatgacggttcacttgatggacacaggtattttcgttctgagccttcacatggcgggtttgttcaaattcgagcaattgtaaatgttttggatgacgtggaacaagccgccaatgacaaagagcaaatacaacagcagatggaaattgaagaaatctaatgaccattcattacatgaaacaaggagaaatcccgtttatgtctgcatt

SEQ ID NO: 97420 - DNA, 825 bp, Heterodera glycines
  SCN-specific regions: Sequence locations=1-77,99-755,777-825
attctttcgtatacctaattcctttttaaccacactgtctcggttcttataatttgttagtttgtttgcccttattgtcctcttttcccctccttttccctatttccgttgggcgaatgcttcatttcattcaatttagcagatggctttccatcaataatgttttaggaagatggggacaaactttgcttgggttttgcttatgctcggcgagggaaaaagaatgcatgggaagggagtggaagagcggcagagattgccttgggcatggcaatggaatggccagagggaataatgggcggctcttctcttttgttgggccgtgcctttttgagaatttggtaaaatgccgggaagaaaagagagtgtttaacggaggcaatgagagagttttcatctcaccataaaaacattctatgcccaaaaggatggaattttcatcttagatttctctcccatcaaaattaaatcagaaaaaatctgaaaaagtcgtagtttcttctgttcgaatggatcgtctctcgtggtatcagacgggcgagtcgatggaggaaattctctgccaagcgggcagtgttggcatttacgacggggacctcaaacagacgtcgttcgaacagggcaccgcttcactgacttatcagcgaatcatttgggccgattcgactgatccggtgggaagagagaccggttttgagtttcgacccccaaaattaaaggattgtcgccttgttcttcaccattcgatggtccacaaaatagaaaaacagcacaaaacaatgtttggacgtggcggcaaaatcattgtgacggtaaaacccgtga

SEQ ID NO: 97421 - DNA, 486 bp, Heterodera glycines
  SCN-specific regions: Sequence locations=1-160,183-486
atcaaaacacccaacaacttgcacaaattgccttcctttgccttcttatccgtcccagcggtgatcagagcctcgagaagtttggtggacattagcattctgacaacagaagaaaagggtgaggaattgacggacaaaacaatgctacatctgaacacggaattcacatggaaacggcagaaattcaaagtgatgttgccccttccgagcaaaccgcaggaaaaggaggcggaagcgacatgcaacacagtgcaacaggacagaaaatattacacggaatgtgccattgtgcgaataatgaaatccaggaaagtgatgaagcacggtgcactcgtggaataggtcataaagcagtcgcagctgagatttgttcccgatgttcagttcatcaaaaagaacatcgaatcgctgattgacaaatactacctacaacgaacagaccaaaacgacgaatacgaatacatttcttaagtgcaatattgaaaa

SEQ ID NO: 97422 - DNA, 529 bp, Heterodera glycines
  SCN-specific regions: Sequence locations=1-529
actagtggatccccgggctgcaggaattcggcacgagggttcataaaagataatcgaacttattcctttgcattcgacctaccctacagggttatttactaaatttgaagtatggaaatgcaagcatcgcccggtcctgactgtggctttaccaccccctcaagaacatccacaaacagtaaatttatcgtcgatgtgcctctttcgacaaaacgtgaaaagcttttgcgtggaactccgactcgttttcgacttcctcctgtgcgtcgtctgatgaagtccgctccgaatattcaccacagattctatttggcacgtgaccatatcgaaccatttgcgcaaatcgtttcattcaagcgatcagaagacaggccttcacttagcaaccgatatcggcccgaattggaggagacttatctccaacaatgctttgtacttcagggcagattgggccaaggcgatttcggagaggtggtcagtgtgcgttccaaagacgacggcaaattgtatgcggtgaaaagctctttgg

SEQ ID NO: 97423 - DNA, 618 bp, Heterodera glycines
  SCN-specific regions: Sequence locations=1-618
gccatgaggcgttatttggacaccgaaaaggccgttgaggaatttggacttcgggaggatttaagagctgctttggagaatttcctagtcgagtccgacattcgttctgaccattctctgttcactttcctccacaatctcctcccttacattatgcttctcaatgtcattcttcttatacccgcggcgctgttttttctccgctcgacagtttccactcgaaaattggtcacatttcttttgctgagcactttttgttggtcatgttacgcaacttacatgcgaaaataccaggaaattttggctgaacgttttctgcgcactgacgctgtgtttcgtcgagggggaggcgtttgttctcctcaaggcttgttaagcgaggcgtttgatgtgatgctaagttatgtgagaataaaacaaaagagcgagtgtctgaaggcgtatgaggacgaactaattgctcccctctggcaagtcgacccgttgcaggtgatcgccgaagtgttgtccaactttttcctgggcggtcttcccgcttccggcacccatctgaaccttttcttcaataatttcttcgtcgacacgccctttcatttggcattggtcaaaatgcttttc

SEQ ID NO: 97424 - DNA, 527 bp, Heterodera glycines
  SCN-specific regions: Sequence locations=1-46,86-174,292-373,395-527
gactagtggatccccgggctgcaggaattcggcacgagggcccgttccagcactgaaacacctggaccgcctggacccagcactgttacaccaggacccgaatcaagcacatcaacaccatctgagggaccaggaactccgagcactgagacacccggacccagcactgaagcgcctggaccgcctggacccagcactgaaacgcccggaccgtctggacccagcactgaaacgcccggaccgtctggacccagcactgaaacgcctggaccgcctggacccagcactgccggaacttcctctacaaagacctacactgttccaacaactccaaaaccacctccgtgttgttatggctgtgactaccctgtcgactgccacacttctgggaaggattgcgactattccccgcttcagccgccttatcaaagcgacccttacccggttgggaagtgcgtcttcaaaaatgtcacttgcgccgctccaaacaccggcaaagtgctcttcatgaagctcaacaatgaccc

SEQ ID NO: 97425 - DNA, 364 bp, Heterodera glycines
  SCN-specific regions: Sequence locations=1-364
actcggcgacgtgagggagggcattgaaagcgccgaagccattggcgtgtcccacgggcgacaacgccgtgaaagtttgcttgggctggacgtgccgtacaaagcgcaatcgacggaaaaccaacaacagcaaaacgccgaggggcaaatgggggagcaaaaaggcaaagacggaattttggaggaaagagcggcgggaagagaaacagagaaacagccggtgaaatgagcaaatggcgagaagcatatgatgaattctgtgaaattcacaagcaatcacttttttctgtcacataaattatttaagacaatttattattaattaatggggctgtaaatttcacataaatatttattttttcct

SEQ ID NO: 97426 - DNA, 490 bp, Heterodera glycines
  SCN-specific regions: Sequence locations=1-233,302-490
caactatgaaattactcaatgacccgtaaaaggaatcgtttaaaaccctaaaggcaaaagtgttgccgattattccggatctaacggatttgtcccagcgaatggcggtggcgcagtgcagaaaaaccgaccggaccggcgacaaattctgttttggaggagcccgttcaggacactgctgtatttcgtgttggaacttgtgcacatcgtttgggatttcggcggaagattgttcgtccttcgctttctcctcccctttctgctcgccttcggctcccttctcttccttttcttcgtccccggtgcgcacagttcgtatgtgaggcatttcgagaagaaacttctttggtgtttctattggctcggtttgggcgttctctcctcaattggacttggcacgggtcttcacacatttctcctttatttgggaccgcacatcgcccgagtgactctcgccgccttcgagtgcaattctttggactttcccgaa

SEQ ID NO: 97427 - DNA, 525 bp, Heterodera glycines
  SCN-specific regions: Sequence locations=1-192,214-525
gcaaacctgaaaagggcattggacgaaatcatcaaaacccaggtcacccttcaggtgcttctgctgctggtagaagtgttggttctggacgccgtcttgccggtgcgactacaaactctcgttttcgttttcttcagagaggatttgtttcgggggatgttcctgccggacaatggaagcatgacaagtttgcagagctctatggaggtggcaagaagcgcatgggtggagctagcctgggacctctcaaggcggtaaagggcggtgcggggagttccattggagcacgcattgcacggaatgcaatcgagcggaattctgggggtatggtgaagctccaagtttctaacttgcccggatcggtggtcactttggatttggaggaacttttccaagacttcaatgttttcggagtcgctgttcattatgatgagatgggcaatcatttgggaactgctgacttgttcacagaccaacaatctgccaccaacatccttaacgaattcaaaaacatcgctatcgatg

SEQ ID NO: 97428 - DNA, 542 bp, Heterodera glycines
  SCN-specific regions: Sequence locations=1-84,106-216,240-542
cgcggggcggcgctctagactagtggacccccgggctgcaggaattcggcacgaggcttcattcgctcataactccgtttatatagaactttgaggttctcttcagtgttcgaaactcacaggtgccaacgcgccgaacacgcctgagaaatcggccacggcgcctgaaaaatgaaggctccgcgccgacttggccgcaaaaaattgactcccccctaaaaaaaaaaaaaataatttttctgttagatgagttttttaaatttcgacgcacggcaccggattctcacttttcactgaatgcgccgtgatatataggcaaaaagtcaatttgcccactaaaaaatcttctatggcccctaaaaatcgagcttcatgggccacatgactccttaaactcgaaagttagtttcgaacactggttttaaaagtggttcaattggtttcctcgagggggggcccggtacccaattcgccctatagtgagtcgtattacaattcactggccgtcgttttacaacgtcgtgactgggaaaaccctggcg

SEQ ID NO: 97429 - DNA, 484 bp, Heterodera glycines
  SCN-specific regions: Sequence locations=1-114,136-484
ttcccgtcaacgtcggaaaccaccgactcggaagagcaccaccattctttaggaagagactgaccttgaggcattttctacaccattggacgaccaaggcgacaataagccatgtctgaatgtgtttgttttgttcaaacacacattggaagaaatgaatacccgcaattcgcctcttttggtcagcatttctgatcagcaacgaattggcgaggcacgagttgcaaagcttaaccatttgatggaaatttgcacgagagaggaaaatttggagaggtcaaagcgcttggcgcaggccggcggctattcttttgacgccaatgcgccggtgccgacaacattcatcttcagctgatcgaagagagagaaagaattctaatccattcattcgtttgtctttgatcactttgggtgtaaaataattccattatgccttttacaccgcaccacttttgaataccgctcaatgttccaattattttta

SEQ ID NO: 97430 - DNA, 413 bp, Heterodera glycines
  misc_feature (412)..(413): n is a, c, g, or t
  SCN-specific regions: Sequence locations=1-1,24-215,237-413
tctttcaagagatttactgacttcaagcccccgggagtctatttcttaaagcccccccccccggaatatggactttatttcagggggaggtgttctaattcagggttttaatcaaggctgtagtggcacccaggatcaacccgtggttttgtcaggcgtacatcttaacttaagcaaatattcaaaatggctgatgttttgttggcatttgttctccaaactgcactcatcgcagcggaggcgcaacttagtttcagcgcgtgcgttccttctctgcgcgaccgagaaacagtgaatgccaaaccaattcagaacatatacaaaacatggcaagatgccgcagggtgtccatgcgtgacaatgattatgtgaaggaagaaagaaacaattaataaattaggatggatttccnn

SEQ ID NO: 97431 - DNA, 521 bp, Heterodera glycines
  SCN-specific regions: Sequence locations=1-164,188-222,263-265,299 -366,389-440,464-486,511-521
gtggacccccgggctgcaggaattcggcacgaggaacctctctaaaaccgccgaaatgcctcccaagagtaaaaagatctctccaaccccaagaggccgtctcctacggtcctcaagtgcgtgagggcgagctcgtcttcggcgttgcccacatcttcgcctcgttcaacgacaccttcgtccacgttaccgatctttccggccgcgaaaccatcacccgtgtcaccggtggcatgaaggtcaaggctgatcgtgatgagtcgtcgccgtacgccgccatgttggccgcccaggacgttgccgtccgctgcaaggagctcggcatcactgccctccacattaagctccgtgctaccggtggtgttggccccgccacccccggccccggtgcccagtcggctctccgtgctcttgcccgtgccggtatgcgtattggccgcattgaggatgtgacccccatcccgaccgattcgacccgccgcaagggtggtcgtcgtggtcgtcgtctctgagcgcgcacg

SEQ ID NO: 97432 - DNA, 251 bp, Heterodera glycines
  SCN-specific regions: Sequence locations=1-207,230-251
gaatctttttgtgtgcaacaaattccttggttttgtcagccctttctggccggcacgcgtttcaacatgggcatcgacccatggagcggcagccccgaaaggggaaacatcggattcggaaacaatttggctgcctttttttacgtttgccacacatgcagcagaggaagaagataaaaggagcgatcggtagaaaaacggcgttaatttttaaaaatttcatttgtttacaataaataaaagttgaaggc

SEQ ID NO: 97433 - DNA, 425 bp, Heterodera glycines
  SCN-specific regions: Sequence locations=1-172,194-425
tgccttactcgtcgaaaagggaggaacgcagcgggtgtttaccttcgaagaggccaaggataagaattcgagtgccttgtgcgattacatgtgcgacatggtcacattcacggaaaagggcaagccgcaaatccaagtggcaccgcaagaaatggagacggagggacagcatgaggaagaggaggagaaagtgttggaacggacccatgacgacgacgggaaactgaacttcgacgattaaaagggcagagacataatttgagaagtttgagacggcactttacttcattcctcacggattttactcaatgatatattatcttcaatgtttgtttgtagccccacccaatgaaagtgaactcacataaaaccgaatttggaataaaaatgaattttgatttcattggaataaaacggctcccggt

SEQ ID NO: 97434 - DNA, 1074 bp, Heterodera glycines
  SCN-specific regions: Sequence locations=1-1074
ttctttataagaaagtgcatttgcgccatttgattttaaatattctgctgaaaacaatgtcaaacattcatactctcggcggtgacgacgataacaaatctcgacaaaggtccaactcaagtgacgatgaaaacagcgatgaggggaggcagggcttttttgttggcggaagtgatcacagtggacaggaagtgctggggccgaaccgcaacgaaaacatttctgctgaccatttctttgatgcaattcggcgggctggagcggaacgaattacgcaggaacagaacgaggcactgaacatgccgagacaaaccggcggaggtgctggccagtcgcatgtggcatttcgactgggcggacacggaatggagagcgaacgaatcggagggacgtcggcgaccgcggggggtaccactcgccagcaggctccggttgttgttcgtctcgtgttttggaacaatggctttaccgttgacgatgggccgctccgacaatttcaagacccacagaaccgggaatttcttcaggccgttgtgacaaagcgtattcctgctgagctgacaatggctgcgccgggccgtgaaattgacttgcgaatcgaaaagaaaggcacggaatatgaacagccaaagacgaaggcattctcgggccagggaaaccaactcggcacaatcacgccgaacgtgggagggtcggcggacgttgtttttgttgatgcgccgccgaagctttcggcagaggaaactgccaaattggtggaacaagctcaggccgaactgaaggaggatgacaatttgccaaccactcgcattcaaattcgaattccggacacggcacggcccatcgtcgcgcgccttaaccaagggcacacagtgaatcagctgcgcattttcattgtcactgccgacccgagtttggcctaccgtcccttccgccttatgacttcgtaccccactcaaccgattgacgacgagggactcagcgtcaaagacgccggactgctcaatgcgacggtgttggtcaaatttgaatgaatgagtgcctgacgaatgattgaattaccaacttcaacgg

SEQ ID NO: 97435 - DNA, 114 bp, Heterodera glycines
  SCN-specific regions: Sequence locations=1-84
aaatgttatctcaatattttgcacaaaaactttatttgtgtccgcataatcgacaacgttttgataagaaactcttatactgtgaaaaaaaaaaaaaaaaaaaaaaaaaaaaaa

SEQ ID NO: 97436 - DNA, 703 bp, Heterodera glycines
  misc_feature (47)..(47): n is a, c, g, or t
  SCN-specific regions: Sequence locations=1-703
gagcattttcagcagcatctgctccatcccctttcagaaggccaagncccgacaaatcagaatccactttggatcgaacttgtcaagcaaccccaaaaaaacaatggccgcctcaacaccatttgcaacctccgctgccccagcgccatcccggtccaaggccccgctcggccaagcgactcactcggttgacaagaacgcccttggcttcgacttcaacaagcttgtgctctacctctaccaaaccgtcccgcaattcattgcccccttgcgcatcgaaaagtttgccctgggccaatccaaccctacgtttttcctcgtcgatggccgtgagcaaaagtacgtcctgcgcaagaagcccgccggcgcactgctctcaccgaccgcacacgccgtggagcgcgaatacaaggtgctgcacggtctcggcacttgcggccatgtgcccgtaccgcgtgtgtacacgctgtgcatggactcgtccgtgatcggcacgccattttacgtgcggatcatggctgtatcgaggtttatgtcatgcagagcgttctcacgcacgatccctcgttgcggcacatacatactaggtcatggaattcgtcaagggccgcatctttccctcgcccgcacttcccgaaatcccggccacggaacgtcgcgcatactgggaagccgccatccgcacactcgcgcgcctgcattc

SEQ ID NO: 97437 - DNA, 716 bp, Heterodera glycines
  SCN-specific regions: Sequence locations=1-520,549-601,628-634,657-716
ccatgggtgctatttttgagaacattgctttgcatgactttctcgtgaaagaagtgataaacagtttcccggacaaaaagagcatttttcttttacttgcgaaatccgatgagaaggctttgctcatctgcaacaaacaagcttttgaagaggaagtggcaaatgtttccgattggttggtcaaatcgaaattgcgttacattgattcaaatgatcgttttggaaactttgaaatggcattgccttctgaatccaatcaaatcaaagtcacgttcatttatccggctaccgaatgggacattgagaaatattcgcgtcagacgccgttcttcatttatgagacgccgggagactaccaaaatatcacttttgattatctttccgagaatgactaccttaaaccactccaatggggttacaattttttgagaaaaaaagtgagtcggagcgaattgggttttgaggatgaagacaaacagaatgggttttggtcttgcgcccaatttaaaatggaacgggacctatgttggatgatctttattttgttggaaattggcaattccccttgctttggttcagtgaggggcttgacttcccaacaatttcccctttttgggaaattttcgggaccaatccgccaatttttccagaagaaatacggggttgggccaaaatcacttgaaaatggctttccctatccgccgaatttttaccat

SEQ ID NO: 97438 - DNA, 318 bp, Heterodera glycines
  SCN-specific regions: Sequence locations=1-318
gtcctttggccactgcttccgacgatgcgaccgcgcgcgtttgggacttcgcgcggtgtgcggaagagcgcgtcatgcggggccacggagcagacgtccgatcggtggattggcacccgacaaaaggacttttggccacaggttctcgcgactcgcagcaaccggtcaaactttgggacgtgaaaacgggccaatgcttggccactcttcatgaccacaaaaattcggtgatggctgtccaatggaatcggaatggcaattggctgctcaccgggtcgcgcgaccacgtgatcaaaatgtacgatgttcggatgatgc

SEQ ID NO: 97439 - DNA, 326 bp, Heterodera glycines
  SCN-specific regions: Sequence locations=1-326
gtctatataaggtaatttggaatggattcttcaattgcattgacctaggagaatgaacgtcattttcgaaatcctttccttgaaaatgtggctgatggtgctcgagctgttagcagggaatggcttttgcaaaaactcgaaactctgacagagcgaattgcgtcacgaaaaattcgagcggaagagaatggaaaagttggtccttatgttggcccttctggaattgcttattctctcattaaagcgtcaagaaaactgaaccaatctcaaagcaatttgagcgattacatccggacacttcttgcgactgaatctgattatgatgc

SEQ ID NO: 97440 - DNA, 161 bp, Heterodera glycines
  misc_feature (160)..(161): n is a, c, g, or t
  SCN-specific regions: Sequence locations=1-130,152-161
atccgttggggaattgcgaaagagaatggcgaaactgcgcgaaactggcattgaatatgagttcgactttgagaagaaatacaacgagtttttaaattctcaaaataccgagtgatttttgcctccgttgttttatttttttataaattttgttggttcnn

SEQ ID NO: 97441 - DNA, 562 bp, Heterodera glycines
  SCN-specific regions: Sequence locations=1-452,474-562
accattgaataattatcatttaatctttttgcttgtcgcactccttagaggatttggtctgatagcgccaatgaaaattgaagaattgaatgacctggacgcggaaaattttgtgtccaagttgggcaaaatttttgaaaattcagcttgggtagtccaagaagcctatggagaaaggccatttgaaggtgtggaccaattgttcaatgcaatggaacgggttttaatgaatgctggacgagaaaaacaactgaaattgatccaagctcatcctgatttggcggggaatgaaatgtttagtggaaatctaacgcaacattctacgagcgagcaggctaatgctgggcttaacgcattaacggctcagcaattgtccgagtttaattcgctgaactccgcttacaagtcgcgcttcaattttccgtttattattgcgcttcgagaccaaaaagaaggcattgatggcattttggcggcatttcgtctacgacttaacaactcggaagaacaagaaatcaacgaggcactctcacaaattggacgaattgctcgccatcgattg

SEQ ID NO: 97442 - DNA, 770 bp, Heterodera glycines
  SCN-specific regions: Sequence locations=1-300,325-386,408-670,692-770
caccgtcaaggaggtacggggcaaagaagggcggtggaaagagccttgaggatgccacgaaggcggctggagaatttttggaggagcattggaatgcattcgagaagcgccaaacgacagcagtgcgttcgggtggctgaacagcgcattgtccggatcgctcaatcaatgcactttttggtgttcccaacaacaaacgctgaacaaacggcggttgacaaaatgggcgaagtgcaattgagcaaatgcgctgaacaaacagcgaagattgttgaccgtgttcgtgtccatcgccattcgttgtgtgctggtggtgctgctggtccttcttctttctgttgcccatcatcattttcatcgttatccatttccaatccgccgattgctcattatcataatcatcatcaacaaccgaaacaacattttcatcagcaacagcagcagttgtccttcatctcggccccgtgtgcgttgcattcttcgcatggcccttcaacaacaacggcaaatgccattccggcccagttgtttatgctctcaaaaaatggtcgcgaatgttccaaactccgtgagatggtctcttctctcggcgaacaattgaatgtgccgtcgacaacaaaaatttcttaaatttacctatgcttcaaactcgttaactgtctgttgatgatctgctgtttctctctcttatggaattttaaaaatttcttttttgtcttctttttttctttattcactttgatcaaagtgctgctatgtcttttttattc

SEQ ID NO: 97443 - DNA, 526 bp, Heterodera glycines
  SCN-specific regions: Sequence locations=1-526
actagtggatccccgggctgcaggaattcggcacgaggtttctgttgacccaccagcaacggaaaatgggcaacgaacacagccctggtcgctttggtggcaacggcacaaacaaagaaaagggggacgacgatggcggtcaaacatctccgagcacttccactggaattcccgcctcattttcttttctcgctaagaaacgaaattcgacaaaaagtgcgctgatgggcagcattgtcgtggtcaacgagggggccagctgttcgtcgtccgctgaccctggcaaagacgtggaccttcggaggataaaggaaattcctcgttttttgcctttactccgcggagttttgcccggtcacagagacatccccgaagcgcagcagaaaatcgacagcaaaagcattcttagttttatgcatcgccttcagcaacattttaaaagctgtgctcaaacggtggcgactgagcagggccgaatgttcgcccgaattgtcgaaattgaccaattaatttcgtcgctgttcaa

SEQ ID NO: 97444 - DNA, 486 bp, Heterodera glycines
  SCN-specific regions: Sequence locations=37-453,476-486
ctctgtgccgaattcggcacgaggatttttattaaaattatccgcttttctccatactaaaaaatgaattctgcgacaatgttcactctgctgttgatcattggcactgttcttgcactgacaattggcatgccaacccccggcggatctgatgaaagtgttgcatcgatgcgccaaaagcgcggctacggaatgagcaacggaggcggaatgggcaatggattcggaggcggaatgggcaacggatttggaggcggaatgggcaatggttttggaggcggaatgggcaacggttttggaggtggaatgggcaacggttttggaggtggaatgggcggctgaagcggcggtggctatgggtacggtaaacgtcgctgatgaattactgtgttttacattatgacgacgacatttcattatgctcagattgtcttttttttacaaaaatgaaacttttttgtatttataaatgaatatttaaaattt

SEQ ID NO: 97445 - DNA, 331 bp, Heterodera glycines
  misc_feature (329)..(329): n is a, c, g, or t
  misc_feature (331)..(331): n is a, c, g, or t
  SCN-specific regions: Sequence locations=1-44,66-331
gtgcctcaaagtaatcttgatatggtggcatcgtttctttcgaactttgaggggttccatgtgagcgccaacgcggcagggcatcgggcaaacgatgttgagacgagcgaagcgattgtccgtcgttctgacgcacagattgagcgactccgtcagcttgagatgcgtttcaacactttcatcgaagatttggagaaagtgcgcaaccacggcgccgaatgagaacgaagtgcagcagtaaattgacggaggatgaatttgttaaattgattctcaattgttcgatgaatcataatgtatttttgctttcaacgtaaagagcggatacnan

SEQ ID NO: 97446 - DNA, 669 bp, Heterodera glycines
  misc_feature (3)..(3): n is a, c, g, or t
  misc_feature (10)..(11): n is a, c, g, or t
  misc_feature (59)..(59): n is a, c, g, or t
  SCN-specific regions: Sequence locations=1-629,651-669
ggngacccgnntaaaatgggtgcttttgaaaggaaaacgacgggaaggccatgggacgntcagcaaacgggtttgttgcattcggatgcgagcgcaaacggatgggcgaagaggaaaatggtggcaaagtgttttatctgctgctgaccactcggctgaacaaaggacacccacgcaaaattaagttgagccatttctaccgactgtttgacaaaatgaagcgcaatgggatggcaaccttccaatttgctgacccgaacttgacagtttacgtgtcgcaggcagaccctaaagcactttgccagtttttgctgcatctgtatggcttgttacgacatgccgttgatgccaacattagatgttccgccccatcatgttcatctcccgccaatgtgccgtcatcgcccccgccaatcgcaacagtttcgactgtccatcgccaatgcacttcagcaattgcgtcagcgaaaccgaccaaaatttgcattcaatcgcgacaggaataccagtcgatgatcagacaagcttcatcggccaatctgcaacgcctcgacattgtcgggattggctttcgtgccgtggacattcgttggtttggcatgcgccgcttgcaacaactttcgttggctgccaacaaattgggctcggacgaatggtgcactgaacgca

SEQ ID NO: 97447 - DNA, 700 bp, Heterodera glycines
  SCN-specific regions: Sequence locations=1-14,36-197,272-326,348 -481,503-700
gtccttctgccttttaccctccgccaactttttggatgcctcacattgaaatcccaccattgagaaaatacgaatacacattcgaacatgaaaaggcagccatcttcagatgggaaaaagaaagacgaagcgaacgggtcgaagaagagacagagcaaactcagcagatgagaaaacaacggcaaaggcacatggaagagaaagggacgaaaaaggacggggagagggaaagagcggaggagggacagagacggacagaaaggcgaagggataacacattgaataaccctgagtatcgaaacggagaatgtttcaaaattgaatcgcactccttgccctcttccaatgtttcaaagcccaaccaaccgccacattttgcctcttcgtcacttctaaagccagtcccaatgtcgaagagttcgtccaattctttgcacgttggcatcgcatcaactcaaaatggaaatatgttgcaaaaatcgaccaataacaatacattgaacgggttagaggaatttgagccccgacgcgacctttttgacctattagaattgcggtcgttagacgcccgaaaagaattggagaagttctttgacttgtgatacgattattttgaccaactatcatcatgttgtttttatgtaaattttattatacctaaataatatggaatcttttgcctttttaatgtaaattttaa

SEQ ID NO: 97448 - DNA, 547 bp, Heterodera glycines
  SCN-specific regions: Sequence locations=1-547
cacctttgattgtgaacccaattagaaatatattcgtgaggaattttgcctgtcaattcggaccttctgaactcgctcgttcctatgtcaccgatggcccactgacagtgagcggacgcagtgcgcctgtcaaaaagcgcacaaatgccgcagacgaaattgcgcggacaaagttcgagcttttggaacctatcgctgttactgacttgccacgggcgcaacaacgttttgctcgtcaaatccacagatccaatcggactcgggtgcaaaaaatatttgccaagaatatcaaaatgatcaaaaacggcctggccggcattgcattggtggtcgccatttatttgtacacatttttcgtgatgcgaaaggaaacattcttggaagaaattgacgaagaaatggcaattgaacggggcgaaatgaaactcgatgaccaagggagactggtggcagtgaaatgagcacttttgttaatttgattttagcacttcatttgtctaatttgttttgttttattttttgaagagaaattaaattgttttgttta

SEQ ID NO: 97449 - DNA, 451 bp, Heterodera glycines
  SCN-specific regions: Sequence locations=1-233,257-451
tcgtaagaacttgccgagctggagcagtacatgaagcaggacctttaaagaaggccccactatcaattctactctcgtgccatgcgtgtccgggcatatcagcaatttttgtcaccgtacaaaacggtcggtcttgatgtcatggccaaatgctttggggtcagcaaagagttcatcgacaaggaactgttcatgttcatctccttgggtgcgttgaagtgtcgcattgacacggtgaaagatgtggtggaaatggggcaggccgacaacaaattctaccagtacaaaaagttgcttcatgacggggacattctgttgaatcgtgtgcagaaattatcgcgggttatcaatgtgtgaaatgaattggaaaggatacgatttgctaaaaatgatttttcttttttgttatgtgtgattaaatatagaccaataaaaaggattgtcagcggtt

SEQ ID NO: 97450 - DNA, 439 bp, Heterodera glycines
  SCN-specific regions: Sequence locations=1-439
gtccatagaaggaaatttaccagtgagtgcgaaggtcaaggcgggctttcatggtgctacatttgcaacacggacggatgtaacaaaagttggaaaaattcaactttctcttccactactccgacgagtacttcgaccaccaccaataaattgtcctctacgcctctcgcggaaatcaaaaataaattgcaatgtttggcatggaatatttgcaatttgagcacgaaattgaagcagtcaaaggtttcgcgacggttttcaattggtcaaaactgcgaggaaatggccaaagactggggacagattgaagaagatgaaaaaatcggagatgaatacgaccaaagtgccgacgaagatggccaagtgtttttggcggattttttcgttgggcgaattaatgcaaagatttaattgattttctaacaaaaattccaatttg

SEQ ID NO: 97451 - DNA, 815 bp, Heterodera glycines
  SCN-specific regions: Sequence locations=1-815
actcattgttccccaacaaccaaatttgttccgcttattcaactccttttgcattgtgaggaccgacaaaagtgtggcacagtgcgcacattcgaattcactctcccggaggcccgtcaatttttactcagtttaaaagccgaggacgacgacgacaaaaataacaacaacaatcgccaactgtcgcactgatgttttcgaaaaccgcctccccctcctctgtaccctacgacaaagtgtcgggactcaaattgcccaagccgagacggttggtgtacacgcgcacgtcgttgaccatttcagtgctcctctccggtggcattggctattacatgtacaaaatattgcggggcgacgagcgcttgcacagggaatgggttgttccgatggtccaccgttggtttgctcccgaaagtgcgcacattctcggcgtcaaggcggtcagattgggtttcctcgacgattttgtggagagtcgcaaggagtaccccgagttggcatgtcaaatgttcggcaaacagttgaacaacccaatcggtttggccgccggctttgacaagaatggggaggccattgacgggctgcgcaagtcgggcttcggcttcatcgaaattggcacggtgacgccaaaagcgcaaattggcaatgatcggccacgcgtttttcgcttgagagaggaccaggcggtgattaattcgtatgggttcaacaacgacggcattggcacggtccttggccgtgtaaagaaggcatttgtgccggacagtggcgtgccgttgggcgtcaatttgggcaaaaacaaaacggcggaagac

SEQ ID NO: 97452 - DNA, 580 bp, Heterodera glycines
  SCN-specific regions: Sequence locations=1-580
gtccataatgggcggcgctgctcccggcacgtgcgttctgttgcttggaggcaaagacaatccgcgctataacactgacaccaccgactcgcccttccgccaggaatcttactttttctgggccttcggtgtccatgaaccggattgttttgccgcggttgacgttgaaagtggcaaatcggccattttcccgcccaaaatgagtccggacagtgcaatttgggacggaaaaattcagcccgaaaaatggttcctggacaaatacaaagttgaccacgtgaactttcaaacgaatggcgccgaaattggccaatttttgcacaaacttttcaacgccaaaaaattattgcttttgaaggcagaaaatacggacagtggaaatgttttggagcccgcaaagttcccgggaatggacagtttctccaccgatttggcctccctttacccgacgatggccgaacttcgcgtcatcaaaactgaattagagttggctgtgcttcgttatgcctcaaaaattgctaacgaagcgcacaaagaagtgatgcgacacgttcggcctgagatgtacgagtaccaattg

SEQ ID NO: 97453 - DNA, 527 bp, Heterodera glycines
  misc_feature (2)..(2): n is a, c, g, or t
  misc_feature (103)..(103): n is a, c, g, or t
  SCN-specific regions: Sequence locations=1-430,452-527
gnggcggcgctctaaactagtggatccccgggctgcaggaattcggcacgaggcttcataaaaggtgaaaatggacgaatcacttggaaataaacggcctatnaacagcacagtcaaagaggatgattcagtttcattgtgcggaagtgtcgcaacaacggccgccggggatggctctctgttggactttgggcttgacgaagaaacattggcggtcgaatccgacacggaattcgagcgaaaattcttcgtaatgaaagagggctcttttccggggaaggtttttgctttgcctcaccccgcctcgagggaacgcgcgttgtatttgttgaatgaacatggcgaactctttgaactgctccgacttgacaatggaaagcgttcttttttcttttttgattccgtcgtggccaatggctccgttcatttgtttttccctgtccatccttttttcttggccattgaatgtctccagcggaatgcatctgaacattttttgactgcttctgaactgctcgaagatgacg

SEQ ID NO: 97454 - DNA, 227 bp, Heterodera glycines
  SCN-specific regions: Sequence locations=1-2,25-103,133-227
agtataaaagaatcaaagaaaaaccctaccttatcaccaatttcataagatcaatatcattgatgaccaactaccttaatagtcaagtctgaactagtgttagaaaaattaaaaaaaaaaagtaaaaaaatagaaggaataatttgagaaatcaagaaaaaaattggaataaaacatatccaaaactccaataaaccaaatcctaaattaagattaaagaaaaaatt

SEQ ID NO: 97455 - DNA, 314 bp, Heterodera glycines
  SCN-specific regions: Sequence locations=1-26,119-314
ggcaatacaggaagctgaaagggaatggaggagaacggaggaaccgaggaggatgggagagggggaagaaaaggaagtgagagaaaatggaggaagcgaagagaaggcggaggaggagccgcaccgcctggacaagctcctcttttggttttacttcttccgcaaaatggtgcccgcgaggatatttcggatgaaaaaataatgtgccaaagtgcgttgtgcccttccctctgtttggcttagcccgtggcattatctcctctcctcttttgttctgtttttcactttttgttttgtcataaattatgttttcg

SEQ ID NO: 97456 - DNA, 809 bp, Heterodera glycines
  SCN-specific regions: Sequence locations=1-809
agtcctgaaactttgcatccttttgatttgctattatttttggtatgttcctcagcaattttgttgcacaaacactgcccacaatgactgaagaatggaaggacgcggtgctttacgcgccgtaccaaaaggagcaagcgctgatgtaccaatatgccgacacgttggctgtccgtgcctttcttatgatggccgatctgtccttcgttttggagcagaggccaaacgcggaatttatgtccccgacgggagaagtgccctttctgcgtcttcagaacactctggtcgctgaattcttccctattgttgatttggtcggcaaaaaaggaattcgtccgtcaaatacgctaagcgctgctgaacaggcggacattcaggcattttgctcactgattgaggaaacgcttcgaaacgccgaaaaatatttgtcatggcttgacgacgaatcctacgaattggtgaccaaaaaaaggtacggcagcgtttacttgtggcctttgaattggctgctgccgacgctcaaacggcgcgaaatgcacaattatttggcggacatcggctgggcggaccttccaatagccaaagtggcggagcgatgcgacaaatgtttccacgcgctttccatcaaattgggccagcagcaattctttgtgggcgaccaaccgaccgaacttgatgcactcgcttttggccatttgtacactcttctgaccacggaaatgccaaacaaagcaattgtggagacattgagcaaatacccaaatttgatcgctttttgccagacaattgacaaggaatattttagtcaa

SEQ ID NO: 97457 - DNA, 519 bp, Heterodera glycines
  SCN-specific regions: Sequence locations=1-152,174-424,446-452,474-519
gtggatcccccgggctgcaggaattcggcacgaggctacattatacattcgcctaaaacatacttttggtcattagcaaactttgctaattatttgactatgtcaaatttcggctacggccagcagcagggccaagcctaccatccccagggggccaacccataccaacaacagccgggttggaatgtgccgccaccgccccaaggacaacagccgtataatgcgcaacatttcgcggagcaaggccaggccgggatgccgaagaacgagttgggcttcaacgaccagacaattcgttcacaatttgtgcgcaaagtgttctccaccgtgggcattatgttggccgttgtcgctgtgatgagtgctttcccgttcatgcatccgcccatgatggcatttgtgcggcacaatgtcggactttatttgttgggatacatcactttcttcgtcgtttacattgcattgatctgttgcgagggcgtccgtcgatcattcccggccaatatcattttgcttggc

SEQ ID NO: 97458 - DNA, 328 bp, Heterodera glycines
  misc_feature (328)..(328): n is a, c, g, or t
  SCN-specific regions: Sequence locations=1-14,38-182,204-328
attcatcaaactaatcccaacatttccttttgttattctcgacccttacacaatgccgacttatttttgacactttcctttccgtttgtaagcgccttatctcttggattagttgtttagtccgcctttgttgttacgcctcaatttgaattttattcttggccttaacattgtatataccatcttattttcttttgtcccttccctaagcatcattagtccctcctcgtttcccatttttattgtttttttttctgccggtgcttccgtttattctcgtcaccgactttttcaatttctaatcacatgcataaaatacttaatttcn

SEQ ID NO: 97459 - DNA, 230 bp, Heterodera glycines
  SCN-specific regions: Sequence locations=1-230
atcaaaggtttcggaccgactttgtttcccatgcttttttcttctcatttgccagcctttgttttgtttcacaaagtacaaagccaatgaatgccccaggggcatttgtatgtttcccgtatccatcaaattggacatattccttgctgtattgttcgactgtacattcttaaacgtaacatgtaacattttgatagttactttacgattgataaattagtgttgctgcc

SEQ ID NO: 97460 - DNA, 234 bp, Heterodera glycines
  misc_feature (4)..(4): n is a, c, g, or t
  SCN-specific regions: Sequence locations=1-190,212-234
gtanccccaatgatcgaacattaatgggttgttgtgccgaaggaccctttgatgggcggtgagtcttccgccgaggctaatgttctgattttgaaaagttgagcaagatacccactccaacgtgaacaaatgccaaagaaagacaaaacgaaagccaaagtaattaatgaagcaattaaagcaaatgacatttattctgtttcctctttatacggtctgaataaacaaatgtat

SEQ ID NO: 97461 - DNA, 491 bp, Heterodera glycines
  SCN-specific regions: Sequence locations=1-82,104-491
ctccttcaagagaacaaccgtccgcaatctgcccatttctcgctcctctccgcgaccccccgcccgacacttcaaacaacgaccaccccccaaatacaacaccatgtctgccattgctgaaaaggccgtcaagattgtgcactgtgaggaggcggaggtcgaggaagtcgaagaagtcgagatttccgaccccaaggagcaaatcgccgaggagtgccgcgagcttccgtccaacgccccgctccgtgaggcgcttgaggcgtgcactgcccgcgttgaggccggtgccgaggagacctgcgttgaggagttcttcaagcttcaaaaggccgtcgaccaatgcacctcggcgaccctcttcaccaagctcaagtaatcagccagtgtcgaccactttcccccatcctacattccgatgtcctctactctctaaacttcttagccgccttgttttccctccgttcctccatgtatttctttttcttctctta

SEQ ID NO: 97462 - DNA, 461 bp, Heterodera glycines
  SCN-specific regions: Sequence locations=1-7,30-375,397-461
atctctcaatccctttgtcagtttatcattctttgttccattccttaaagatataatggaacaatatttttaattgatattttttagaatgcgttttttaccgtcgtgattatttaaaattttcttaaaagcaaaattaatgggaggcaaacatctgaggcgcaatcatagtcactagaagtaattggacgataattatcgcctagaacaaagcctgcgggtgttctattttccaattccttcaaaatgtcaacccttttatatgcgttaattaatatgtcactttacattgtcaataacataagtgatgcgcgtgtacaagcaggtggcattcacattgacctggaaaatgaaaaattgatttgcctaattattccttaattaatttttacataatcgcaagtgtcacagatgggacagatcaattcatggctaattcgtccttggcatacatcattgct

SEQ ID NO: 97463 - DNA, 698 bp, Heterodera glycines
  SCN-specific regions: Sequence locations=1-698
attcgttaaaaacagtttttataatgaagccagacttaaaagacccttactttatgtacaaattaattgttggccaactcttttacgatggtcatcaacaattggcactgaacttggcacaaacgcttggtctttcgctacgaccgcctcctccatctgacaaactttttcgtcttgtggcaatagctaaacaatttgtggaagatcccgagtctaaagaacgggagacaatcttgcaggtcggtgggtttgagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgaagtcacttgcgttgctttccatccccgcgagtccgtcctcctttcgggcagcaacgattttacgctgaaaatgttcgattattcaaaaactgcgggtaaaagggcaatgaaaaccatcacggaggtcaaggcgatccctgcggtcagttttcatccgagcggagagttt

SEQ ID NO: 97464 - DNA, 390 bp, Heterodera glycines
  SCN-specific regions: Sequence locations=1-356,379-390
gcggcactctgttgcgctacgtcgcctcctggctccagtcgctggtgacctttgagctgcccggcgcgtactccgccgacgatcggctcgacctgaacagatacgagccctacgagttgttggcccgctgccgacactttgtgcagcagaaagacttgctgaacgctgtccgagtggccaatctgatcagaggcgagtcggctcggattttcagcgattggctcaacgacgccaaagcgcacttggaagtgcggctgctggttgagctgctctttgcccatgctcaggcgacgggaattaggacgacctattgaaaatggacaaacgaacgaaggaatcaatcattttatttgatgtgttttcaaaataaattatgtaaattacctaatt

SEQ ID NO: 97465 - DNA, 340 bp, Heterodera glycines
  SCN-specific regions: Sequence locations=1-340
aataatcgacaatgatatgccggaaggaccgggcagaaggcttcggaaaaatgtggccaatgttcggaaacacatagactacatcgcaaacgcactcaatcacatggaggggagcctttgggaggagccggaccgaagtcaattgcggtgggaacggaggggcattaagggggacattcgctaccaggggaatgggttaaggccgagacttacgacaaaagtgccggaggaacggcggttggaggaaattagggcgcggcgggacgaagcaaagggaagggaacgaatcaagacagtaagctggaccaccggagggcaaacgagcagattagcggcggct

SEQ ID NO: 97466 - DNA, 408 bp, Heterodera glycines
  SCN-specific regions: Sequence locations=1-23,78-408
gaccgtccaaggaagcatctttcaaaatttatttattttttaatctttagaattatttttcttaaaaaaaattaaaagttggcgtggaaaggagccgaatctcctccaaaatattttccgttcataaccactgacaatgagacaagaacttgacaaaaacggaactgtcaaaattttcttaaatggaataaatattcttaaattaatttccccccccccccgaacaattgagcacggcgtttacctgctgtccttttgtactgcgatttgctgaccaatcgctgcttttcttctcgtcggcgcgttcttctactgccgattggaaccgttccgactcagccatttgttgaggagcagtgaacgccacacaaaagcagaagcatgatgatgatgatgatgagagcaaac

SEQ ID NO: 97467 - DNA, 708 bp, Heterodera glycines
  SCN-specific regions: Sequence locations=1-708
ccgcgggcggcgctctagactagtggatccccgggctgcaggaattcggcacgagggttccttacggatgattctgaaagttgttcagcagaacaggcttttactgccgatgaggttgagtcgtccagtaggaggtccagcacagataacttgggaggtgattccgactacggcgatgactcggtgtctgacacagattcggatgacgaaaatgaaaagagcaaaagttcgacgctgagagaacgcatgaaatatacggactcgaaaatacacgacggaaaaacaaatacacaaagtgacactgagacgaaaaatttgctggatgacatgggcgaggaaatggacgacgatttgtcgatattgcacgagatgaattgtcgtagtaaacagaatgggtcgtcagagttagactcaaaactctttgagctctccgatgaacagttgaattattacaccaattgctttctttttcttatgcagaaatcgcaggggttcttttctctgcaaggggcgctccaaggcaatgacagaacaattcttgacttcttccgcaaaagttccctcgacgattcaattctttccaaaatttggtctctcagcgatgtgaacgaggacggatttttgaatttgacggagtttattttggccatgcatttggtcgttttgcacaccaaaggttctgttcctatcccaagtaggctcccttcc

SEQ ID NO: 97468 - DNA, 386 bp, Heterodera glycines
  SCN-specific regions: Sequence locations=1-23,103-386
aaagggccgaaatcgcaaaaaaatgaaactgaaaagccgccccagcagaagcagcctcaagaaaagccgggggcgcaacaggacgacacggagacggaggaggacagcaaagaagacaagcggaagccgataaagtgtcaggaggagaggaaatgctacgcacactcggagtgtggcgcaaggagcaaatgcaaaccggcgacgctggacaggaagaagaaggtgggcacgtgcgactgcggcgtgtgcgggggattccaactgttattgctgtgcagtctcaacagtggcgccctttcccttgacaaaaacattgtgccgcgggagtgtgccggactgaaagatgcttgtgtcgaaaagccattattcgtgggcagcaaatccaa

SEQ ID NO: 97469 - DNA, 153 bp, Heterodera glycines
  SCN-specific regions: Sequence locations=1-61,83-126,150-153
agagagaaaagggagggagaaagaccttataagaatataaaaaatgattaatgattcattttcctatttttatatttaaaaatgcttgccgcaaacacataaaagagaaaaattgttctaatgaaattttaaatgaataaacaattaaacatt

SEQ ID NO: 97470 - DNA, 198 bp, Heterodera glycines
  SCN-specific regions: Sequence locations=1-162,184-198
tatggcccaatatccggccccaaattccgccccccctgggcaaagatatgcaaattcactataggagagaggagagaaacagagaaaaagagtaaaaaaatatgcgcgagaaaacaaagaaaaataccacttaatcctgtgtaaaatccttaattcgttgtaaacccttgccccccagggcagagaaaagcgcatttg

SEQ ID NO: 97471 - DNA, 474 bp, Heterodera glycines
  SCN-specific regions: Sequence locations=1-4,31-31,53-240,274-278,303- 332,364-474
gtcttacatgctcccgcacttgcacaatgggtggcaggttgaccaggccattttggctgaggaggaccgtgtcgtgctcatccgatttggccacgattgggacccgagttgcatgagaatggacgagacgctttacaaaatcgccaacaaagtcaaaaactttgccgtcatttacttggttgacatcagtgaggtgcccgacttcaacaaaatgtacgagttgtacgacccggtcaccgcgatgttcttcttcaggaacaagcatatcatgatcgacttgggcaccggcaacaacaacaaaatcaattggccaatgcacgacggccaagaactgatcgacatcatcgagacggtgtaccggggcgcacgcaaaggccggggtttggtcatctcaccgaaggattactccaccaaatacaaatactgagcaacacaaatggcgacggagcagaaatcgggcggccgcatgttgtc

SEQ ID NO: 97472 - DNA, 231 bp, Heterodera glycines
  misc_feature (199)..(199): n is a, c, g, or t
  misc_feature (209)..(209): n is a, c, g, or t
  misc_feature (228)..(228): n is a, c, g, or t
  SCN-specific regions: Sequence locations=1-174,196-231
gaagggagttggggcgaagtttttcgggactttttatcaaagttttcgccgttttttcggtttcttcacagaaagggttacataacttcggttttgtaacccagtttcgcgttctgtgcgccgattacatcttatcgcgtacgcgataaacatgtggcaagcatcgttgcaggattcagatgtttcctccttacttggncggctaaggnatggatttttttttttatnccc

SEQ ID NO: 97473 - DNA, 219 bp, Heterodera glycines
  SCN-specific regions: Sequence locations=1-219
atgttccaatttggatccagctttgattaacgttttgttggacgatgtccaattgctaacagactctcaaactgataatgatacgttgctgtttccaattgtaaaagcttttagacaacttcatgctcaattgaaggaggagcttagttgcgttttaagtggacaaattggcagtgaaccaaaaccttttactctactttcgattttggaaaaacaacc

SEQ ID NO: 97474 - DNA, 528 bp, Heterodera glycines
  SCN-specific regions: Sequence locations=1-277,299-380,424-528
agtggatccccgggctgcaggaattcggcacgagggaaccctaaagctcataatcactattccataaattcgacccaaaatgagcaaagcaattataaaagtgcgaattgttcagattattgaagcagacgaagctgctgggcaacctaagcaagtggtggctgagtatgtggacgacccgagcagacgagttaccatgaaagcaagcggagaggtccgaattggccaacttgttgctttctttgaaggtcctgacagaaaccgcattcagcgatgcttcacgaacaacaacaacaactgatttgaaggatttgataaaaataaatttgaaaaacgtacatatgtaatcctttttgaaagcgcaataaaaaaagcacattaaaaaaaaaaaaaaaaaaaaaaaaaaaaaaaaaaaaaaaaaaactcgagggggggcccggtacccaattcgccctatagtgagtcgtgttacaattcactggccgtcgttttacaacgtcgtgactgggaaaaccctggcgttaccca

SEQ ID NO: 97475 - DNA, 299 bp, Heterodera glycines
  misc_feature (299)..(299): n is a, c, g, or t
  SCN-specific regions: Sequence locations=1-231,253-277
atcatcaaaagttccgtttataatccatgtccattcaacgtccctgaaggaggactgggacaatcgcgaactgaacagcattatatccgacaacatccgccaaatttccgagtttttgagtcatttcgacgagacctgcaaggcaaaattggccacgctgaatgacaccatcacatcgatggagcgaaaggtggaatttctcgagtcgacggtgaccagaggagaaacgctgaattgattttccttccttctcatttttatttatttatttttgtaattcaataaacgtttctgaaacn

SEQ ID NO: 97476 - DNA, 289 bp, Heterodera glycines
  misc_feature (283)..(283): n is a, c, g, or t
  SCN-specific regions: Sequence locations=1-222,245-289
tttggcttctttcgccctctgctcgcccaatgctgctgatctgctaaaatttaaacgagaagcggcgatcagcagttgtggagctggacagtttgaatacgggggcggctgttgtacgacatgcacaagcgatgctgattgtacgggcgggaaactatgtgtgccaattctcaacttgctcagcgtcagtctgggctttgccccatgcggaaattaagacagaaaagaaagcagcagcaaaagagggctctgatattttttttttttgataggattaaatganagaatg

SEQ ID NO: 97477 - DNA, 426 bp, Heterodera glycines
  SCN-specific regions: Sequence locations=1-3,25-235,257-426
cgactttacaagtgatttcaaatcgctttgtaggacttccaggggcccgaaaattaggagatgagttttccagtgccttctgacgatgatttttatgatgaaacaacagactatttatatttgaccaatgacaatgcaaatccgactaactgtgaacagactttggcgaatgaacacagtgccgtggcactttcgtcggcaatccccggcaatgatgaaaattcctcgtcgcccgccgttccctctgaacgaagtttagaattgctgaagaaatatttcggttattcgcgctttcgccctttgcaatacgaagtgatcgaagcggctctaagcaaacgcgaccaattggtcgttatgtccaccggttatgggaaaagtgtgtgctaccaattgccctctctcattcaaaataatctcactttggtc

SEQ ID NO: 97478 - DNA, 255 bp, Heterodera glycines
  misc_feature (255)..(255): n is a, c, g, or t
  SCN-specific regions: Sequence locations=1-23,46-255
cgacgatgttatttatctagaaggacaaacttttttaatcggctcccttggagcgaattatggagggtcggggagcgcattgatcacccccgaaggtgcgctagcgggaatccttgtcggttcggattcgaaaatgaccgtcaatgatgcacttagtgaatggctcgattcactacatgaacaaaggcactcaaaaatggtcgatatcggtgccatactaatttcctatcgaaacatgataaacaattaggttcn

SEQ ID NO: 97479 - DNA, 645 bp, Heterodera glycines
  SCN-specific regions: Sequence locations=1-494,517-590,612-615,638-645
cggccgttactgatgaagaacatttggcagttggacaatcggtgccactaggcgctgatgctgacgctgtccgtacagccaacccccgtggtgcgcttcactcggtacatgaccacgccggtgtttgacgacgagttgcaccacctgatctggactgagatgcattggcttcgtgatcgcaattacatcatgtgggtccgcttggtgctggacggacttagggcactgatcgtggaccggcacaacactttgggcattggcccggcccagcagctggcggcagccaacaaaaagtgtgccagccatggcttcgtcattttcagtgcgttcattgccgtcctctgctccatcgttggcactatgtgcgcaccgctgctttggcataaatgctgtgaacgttttgggcccattgttggaaagccttcactgccattcccgatggtccgctttaacaatgaacgtgacatcggcccttacacaacgacaaacaatggccaccaacagcaacaacaacaatgaagcaattacaaatggactttttaagaatttaatgcacagcgaatgctcgatattaataaaataaagttacaaagagatattttaataaatattaacccattttaaacaaatacatattaatgtggt

SEQ ID NO: 97480 - DNA, 440 bp, Heterodera glycines
  SCN-specific regions: Sequence locations=1-297,319-440
gacacaatgatgagaaggtatggagaggtatgtactgtactgtagactgcacacacttttgaagtgcacgtttgtgttgtgtcgctgtccttcaccaaacacaccgtttcaacctaaccaaaaaccatattaatcggttatcacgtgattaaccaacggttttgtttttgtaactgaatcacgtgactacttcttgtctccatcctttccaaccgaaccgtaccggttattttcagccgcaagtgcctgactagttgggtctcaaattttggatataaaacggagtgaatagtgaaagcccagcccaccaagtggcataatacattcaatataaactttatatagtaggccttaccaaagtatcgataagtgctatcacgaccttgcataagtttctggtagataaatccctggaatgcccattccaccagtagtagaca

SEQ ID NO: 97481 - DNA, 718 bp, Heterodera glycines
  SCN-specific regions: Sequence locations=1-104,126-301,324-432,454-718
gaccgtttgattatttttgtcagagagcatctgcggaatggctgccgaatttgccaagccgaaatttgacggcaaaatcttccaaaaccccgacagcttcacaacatgaaaaaacccgccttcggcaggagacccgagaagttggcgggacttcattaaatggaaatgggatgcaaagagcacgaaactgcccaatttgaaagtgcttgaccagactttgccggtgttaaagcctcggttccaaacggattctcggctttcggccacttggctcggccatgccacactttttgtgcgcattgacggcatttcagtgctcacagacccatgtaaattccgccaaaatttccaaaggtttgggcgatgtttgccactccttcgttccttcccttcttcaaattttgcccgcgttttcgtccaccgccgtgtaaaattgaggaattgccaaagattgacattgtcctcatctcccacaaccattacgaccatttggacgtcgtcgccgtccgtgagttggcacaacactttcctcacatcatttgggttgtgccgttggggcttaagcaattggtgcaacacgagacgaactcaaaagcagtgcacgaaatgaattggggtgaccgtctggaactgcaattaaacgagagaacctttgaagtgttcagtgtgccggcacagcattggtcacagcgaaacttaattgaccgaaacacgtcat

SEQ ID NO: 97482 - DNA, 703 bp, Heterodera glycines
  SCN-specific regions: Sequence locations=1-103,139-166,191-517,539-703
gttccatattcaccttcaaaaagagcgttcctttgccgaaccccgccttcgaggttacgccgccgaagtcgcaagtgctctcggctatttgcacgcgaaggatatcatttacagggatttgaagcctgagaatttgctgctggacagaaatgggcacgtcgttctgacggacttcggcctgtgcaaagagcacgtcaaaatgcggcagaccaccagcactttctgcggcacccccgaatatttggcgcccgaagtgattcagaaaaagccgtacgatcggacggtcgattggtggtgtttgggctgcgttctgttcgaaatgctcttcggattgccacctttctacggtaagaatcagaatgaaatgtaccacaagacgctcacccaaccgttgtgcgttccctcgtccgcttcgactttagtgcgcaaattactcgtcgaaatactgcacaaagaccgttcggaacgattgggcgcaaaatccgattttgaggaaatacgaagccatccctttttcgcaccaatcgattgggacaaactgctaaacaaagaagtgaaggcgccgtttgtgccgaaagtgcgtgccgaaacggacactttgaacatcgcgcgcgaattcactgacattgagccgaaccctgcttctttggtgcctttgcaaacattcgtcaacagagaaacggaattcgccggattcacttac

SEQ ID NO: 97483 - DNA, 520 bp, Heterodera glycines
  SCN-specific regions: Sequence locations=1-26,48-91,113-520
gcttgtgcatccttttttgtaatttgtgcctttttggttctccttttcggcattggcgttgtcttttcgtcgctctgttcgatcgatccgccgacgacacttccaatttcgactccgaattcactggcgaagcgcccaaattgacgccggtcgaccgattgttcctaatgaatttggaccagaacgaattcgaagggttcacttttgtcaacgcggaatttacgccccagggcgaaaataaaacggcggacaaaacaatttgaaggggcggaggacgacgacgaaacgaaagatgacgaggacggaccaacagcagcgagtgttcattggcactgatcaccaaaatgccattggcagttccaaagtcgccctctctcttctcgcacattcactcacccaagcgaaatgttcgcattccctcaccactcgccatttcttcccaattagctgctttattattggaaagtttgtatttgtgttttagaaatgtctatgattaattgatacatttcatcatttt

SEQ ID NO: 97484 - DNA, 485 bp, Heterodera glycines
  SCN-specific regions: Sequence locations=1-485
cttgcctctgagctttgcatccgacttttccaaccccgagcattccactctgctgtctactctccgccatgtccatgtcatcaacctctgctgcctcggcctcggccaccgacgccgaagctcaagtggaattccccattgtctgcgaaccctgtctcggtaccaacccgtacatgcgcatgacccgccagccccaaggcgcgcaatgcaaatcgtgctcgcggccgttcaccaccttccgctggtcgcccggcccgggccagcgcactcgccgcaccgaaatctgcacctcgtgcgcaaagctcaagaacgcctgccagtcgtgcatcctcgacctcgagtttggcctctcgacccgcgtacgtgacgctgtgctcgggttggattccggcgcaaacacgagcaacgatcataatcggcaatggttgttgcgggccgccgagcagaatttggcaaagacgggttcgggcatggtggattacggt

SEQ ID NO: 97485 - DNA, 384 bp, Heterodera glycines
  SCN-specific regions: Sequence locations=1-202,244-293,315-384
accaattcatttttcttttggcacttctgccatttctgttggtcccaatttgttgtgaacaatgcagttgggacgacgtgaataacatttgcgttggagattgttcatcactgtgtgtgctgaaagattttgacaattgcaactgcaaccgcttaccaaaaaatcttcaattcttcaaaaaccgtcgtaatttcggcaacttaaaagcattggcaaagaaagaagaaacaaacaatggcaaattgatgtacaaaaaataaattttcgaaaggaggcggattaaaattcaagatcaaatgggatggagaaaaagaaagtgcaattaacagatgaataaataaatacattcagtgattgaattaattgataaaagataatttaata

SEQ ID NO: 97486 - DNA, 475 bp, Heterodera glycines
  SCN-specific regions: Sequence locations=1-4,29-83,158-160,217 -259,329-330,378-413,443-475
cggaaacgagcgcttccgttgccctgaggcgttgttccagccatctttcctcggcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgccggagcgcaaatattcggtgtggatcggcggctccatcctcgcctcgctctccactttccagcagatgtggatcagcaaatccgagtacgacgagtcgggcccgtccattgtgcaccgcaagtgcttctgattgagcggcggtgatgtccgcagggaggcgaaagaaggaggaaaatgttggaggataaaatttgatttttttttttttttgctgttttgtcatggc
